United States Patent 10,696,975 (GENES AND USES FOR PLANT ENHANCEMENT) - sequence listing, part 12

SEQ ID NO: 51300 - protein, 258 aa, Streptomyces avermitilis MA-4680
MTSRMPLMAGNWKMNLNHLEAIAHVQKLAFALADKDYEACEVAVLPPYTDLRSVQTLVDGDKLKIKYGAQDVSAHDSGAYTGEISGSMLAKLKCTYVAVGHSERRQYHHETDEIVNAKVKASFRHGLIPILCVGEELEVREAGNHVTHTLTQVEGGLKDVPAEQAETIVIAYEPVWAIGTGKVCGADDAQEVCAAIRAKLAELYSQELADQVRIQYGGSVKSGNVAEIMAKPDIDGALVGGASLDADEFVKIARFRDQ

SEQ ID NO: 51301 - protein, 273 aa, Bordetella pertussis Tohama I
MGIVTDPADLAKMRAACQDAAKILDFITPYVKPGVTTGELDKLCLAYLTDELKVKSATIGYAPPGYPPFTGAICTSVNHQVCHGIPGDKVLKNGDSLNIDVTIIKDGWFGDTSRMYHVGEPSILSRRLTDITYDCMWKGIEQVRNGATLGDIGHAIQKYAEAQGFSVVREFCGHGIGQRFHEDPQVLHYGKPGTGVKLVTGMLFTVEPMINAGRREIRQLADGWTVVTRDHSLSAQWEHTVLVTDTGYEVLTVSPGMPAPPAFVTRPVEIPAL

SEQ ID NO: 51302 - protein, 586 aa, Triticum aestivum
MDSTDQFDNSPLLDGDGSSQENTTEYTGDGSVCISGHPASRKHTGNWKASFLIIVCSFCCYLAYSSIGKNLVSYLTKVLHETNLDAARHVATWQGTSYLAPLVGAFVADSYLGKYRTALIACKIFIIGMMMLLLSAALQLISAGPHAWTVWVHLVSSQYTIFLIGLYMVGLGYGAQRPCVTSFGADQFDDTDYVEKTRKSSFFNWHYFAINAGSLIAGTVIVWVQEHEGWLWGFTISTLFVTLGVCIFFLGSIVYRFQKPRGSPLTRLCQVVIAATRNFDKVLPCDSSALYEFMGQGSAIEGRRKLEHTTGLGFFDKAAIVTLPDCESPGQHNKWKICTVTQVEELKILIRMFPIWSAMILFAAVQEQMSSTFVEQGMAMDKHIGSFEIPSASFQCVDTITVIVLVPIYERLIVPVIRKFTGRANGITSPQRIGIGLCFSMFSMVSAALVEGNRLQIAQAEGLVHRKVAVPMSIMWQGPQYFLLGVAEVFSNIGLTEAFYDESPDGMRSLCMAFSLVNMSAGNYLSSLILSLVPVFTARGGSPGWIPDNLNEGHLDRFYLMMAGLSFFNIVVFVFCAMRYKCKKAS

SEQ ID NO: 51303 - protein, 537 aa, Zea mays
  misc_feature (142)..(142): Xaa can be any naturally occurring amino acid
MLRSALFRSAPGLRRSPATAHLSTAAAAAAAWLSNGPASAPSRVRLLIGGEFVESRADEHVDVTNPATQEVVSRIPLTTADEFKAAVDAARTAFPGWRNTPVTTRQRVMFKFQELIRANMDKLAENITTEQGKTLKDAWGRXFRGLEVVEHACGMGTLQMGEYVSNVSNGIDTFSIREPLGVCAGICPFNFPAMIPLWMFPIAVTCGNTFVLKPSEKDPGAAMMLAELAMEAGLPKGVLNIVHGTNDVVNNICDDEDIKAVSFVGSNTAGMHIYSRASAAGKRVQCNMGAKNHAIILPDADRDATLNALIAAGFGAAGQRCMALSTAVFVGGSESWEDELVKRASGLVVSSGMVNDADLGPVISRQAKDRICKLVQSGVDSGARILLDGRKIVVPRYEDGNFVGPTILADVKSDMECYKEEIFGPVLLLMKAESLEDAIQIINRNKYGNGASIFTTSGVSARKFQTDIEAGQVGINVPIPVPLPFFSFTGSKASFAGDLNFYGKAGVQFFTQIKTITQQWKESPVQRVSLSMPTSQK

SEQ ID NO: 51304 - protein, 448 aa, Pseudomonas aeruginosa PAO1
MNQPLNVAPPVSSELNLRAHWMPFSANRNFQKDPRIIVAAEGSWLTDDKGRKVYDSLSGLWTCGAGHSRKEIQEAVARQLGTLDYSPGFQYGHPLSFQLAEKIAGLLPGELNHVFFTGSGSECADTSIKMARAYWRLKGQPQKTKLIGRARGYHGVNVAGTSLGGIGGNRKMFGQLMDVDHLPHTLQPGMAFTRGMAQTGGVELANELLKLIELHDASNIAAVIVEPMSGSAGVLVPPVGYLQRLREICDQHNILLIFDEVITAFGRLGTYSGAEYFGVTPDLMNVAKQVTNGAVPMGAVIASSEIYDTFMNQALPEHAVEFSHGYTYSAHPVACAAGLAALDILARDNLVQQSAELAPHFEKGLHGLQGAKNVIDIRNCGLAGAIQIAPRDGDPTVRPFEAGMKLWQQGFYVRFGGDTLQFGPTFNARPEELDRLFDAVGEALNGIA

SEQ ID NO: 51305 - protein, 428 aa, Erwinia chrysanthemi
MVSTDKHDPLMLARQLPLKSVALILAGGRGTRLKDLTAYRAKPAVHFGGKYRIIDFALSNCLNSGIRRIGVITQYQVAHSVQHIQRGWSFLNTEMNEFVDLLPAQQRHDENDHWYRGTADAVCHNLDIIRRYGAEYVVILAGDHIYKMDYSRMLLDHVENGAVCSVACIPVPIEEAHAFGVMSVDKDNRIVSFDEKPANPTPMPDNPDMALASMGIYVFNADYLYRRLEEDVCTSDSSHDFGKDLIPKIVAQGHAWAHPFTLSCVTSSDNAPPYWRDVGTLEAYWRANLDLASVMPELDMYDHNWPIRSAMAALPPAKFVQDRSGSHGLTMNSLVSGGSIVSGSVVTHSVLFPRVRINSFCSIDSSVLLPDVNVGRSCRLHRCIVDRACEIPEGMVIGENAEDDSRRFYRSEEGIVLVTRAMLAKLKP

SEQ ID NO: 51306 - protein, 550 aa, Streptomyces avermitilis MA-4680
MNADSRTRLNQRPEWTALAKHREELAGTHLRDLFAADPGRGAGYTLEVGDLHVDYSKHLVTDETLRLLRELAAATDVFGLRDAMFRGEKINVTEDRAVLHTALRAPRDAVVEVDGENVVPAVHAVLDKMSTFAERVRTGEWTGHTGKPIKNIVNVGIGGSDLGPAMAYEVLRSFTDRSLTVRFVSNVDGADLHEAVRDLDPAETLFVIASKTFTTIETITNATSARDWLLTELKAGQEAVAKHFVALSTNAEKVSEFGIDTANMFEFWDWVGGRYSFDSAIGLSLMIAIGPERFREMLDGFRIVDEHFESAPAEDNVPLLLGLLGIWYGNFHDAQSHAVLPYSHYLSKFTAYLQQLDMESNGKSVQRDGNPVEWETGPVVWGTPGTNGQHAYYQLIHQGTKLIPADFIGFAEPVADLLPGLVAQHDLLMANFFAQTQALAFGKTPDEVRAEGVPEQLVPHKTFKGNHPTTTILAKELTPSVLGQLIALYEHKVFVQGAVWNIDSFDQWGVELGKVLAKRVEPALTEGADVPGLDESTKALVAKYRQLRGR

SEQ ID NO: 51307 - protein, 510 aa, Pseudomonas syringae pv. syringae B728a
MGITALKTALPRELLASVVVFLVALPLCMGIAIASGMPPAKGLITGIVGGLIVGWIAGSPLQVSGPAAGLAVLVFEVVREHGMAMLGPILVLAGLLQLLAGRFKLGCWFRVTAPAVVYGMLAGIGVLIVLSQAHVMFDSGPKPSGLDNLIAFPSTLIQAFGPGTGMQAGMLGLGTMLIMWGWEKLRPQSLRFVPGALLGVGIATGISLFMALQVKRVEVPDNLADAIDWLRPADLMNLADPAILVAAIVVAFIASAETLLSASAVDRMHSGQRSDFDKELSAQGVGNMLCGVLGALPMTGVIVRSSANVQAGATTRFSTIFHGLWLLAFVLLLSSVLQSIPVASLAGVLVYTGLKLVDLKAFRGLGRYGRMPMFTYAATAVAIIFTDLLTGVLVGFGLTLVKLAFKASRLKINVVELAGEKEFELRLVGAATFLKVPALTQALGTIPQGSTVHVPLGNLSYIDHSCLELLEEWGRSNAAHGTRLLIEPRGLKRRLEGRIYTTTGIGSGAA

SEQ ID NO: 51308 - protein, 525 aa, Escherichia coli K12
MTENIHKHRILILDFGSQYTQLVARRVRELGVYCELWAWDVTEAQIRDFNPSGIILSGGPESTTEENSPRAPQYVFEAGVPVFGVCYGMQTMAMQLGGHVEASNEREFGYAQVEVVNDSALVRGIEDALTADGKPLLDVWMSHGDKVTAIPSDFITVASTESCPFAIMANEEKRFYGVQFHPEVTHTRQGMRMLERFVRDICQCEALWTPAKIIDDAVARIREQVGDDKVILGLSGGVDSSVTAMLLHRAIGKNLTCVFVDNGLLRLNEAEQVLDMFGDHFGLNIVHVPAEDRFLSALAGENDPEAKRKIIGRVFVEVFDEEALKLEDVKWLAQGTIYPDVIESAASATGKAHVIKSHHNVGGLPKEMKMGLVEPLKELFKDEVRKIGLELGLPYDMLYRHPFPGPGLGVRVLGEVKKEYCDLLRRADAIFIEELRKADLYDKVSQAFTVFLPVRSVGVMGDGRKYDWVVSLRAVETIDFMTAHWAHLPYDFLGRVSNRIINEVNGISRVVYDISGKPPATIEWE

SEQ ID NO: 51309 - protein, 272 aa, Staphylococcus epidermidis ATCC 12228
MERLENKIAVITGASTGIGQASAVALAIEGAHVLALDISDQLEETVQSINDNGGKATAYRVDISDDKQVKQFSEKIAQEFGHVDVIFNNAGVDNGAGRIHEYPVEVFDKIMAVDMRGTFLVTKFLLPLMMKQGGSIINTASFSGQAADLYRSGYNAAKGGVINFTKSIAIEYGRENIRANAIAPGTIETPLVDNLAGTSDEEAGQTFRENQKWVTPLGRLGTPDEVGKLVAFLASDDSSFITGETIRIDGGVMAYTWPGEMLSDESWKNSTK

SEQ ID NO: 51310 - protein, 607 aa, Saccharophagus degradans 2-40
MLQDPVVLLVSVGLISLACQYLAYKLKLPAILPLLISGIVLGPMLGVLHPDELFGDLLFPIVSLSVAIILFEGALTLRMQDIAGHGAMVRNLCTVGVVITWLVVAPVAHYALGVSWQVACLFGAIVTVTGPTVVIPMLRTIRPSTRVANILRWEGIVIDPIGALLAVLVYEFVVADQNALSHTLQAFGLTIAVGCVIGAGLGYLIGVALRNQWIPHYLQNTAVLTLMLGGFAGSNMIAHESGLLTVTIMGIGLANMKNVDVDGILEFKETLSVLLISALFILLAARINFSEILSVGWGSIVVLFAIIFVARPLSVFASALRTGISFNERLLLSWIAPRGIVAAAVSALFALRLEEKGDAQAAILVPMVFLVIIATVVLQSLTSVSVAKFLKLRAPSPHGILIFGASKFSRALAKELIERDISVRLCDTNWESISEARMENIPTYYGNPISEHAERMLDLSAIGQVLVLSPYRQLNPLVTYHFEYTLGKGKVLALTSGEQEGRASHKVSEDYARKLSLFNGTATYGRLVGLVNRGAKIKATKLSEAFTEENYRETYGSRATPLFAVDTQGRVQFYTLDKPIKPKPDWTIVSLIEDAPPAPAQPNILNS

SEQ ID NO: 51311 - protein, 702 aa, Rhodospirillum rubrum
MAGIYLFVVAAALAALGYGALTIKTIMAADAGTARMQEISGAVQEGASAFLNRQYKTIAVVGAVVFVILTALLGISVGFGFLIGAVCSGIAGYVGMYISVRANVRVAAGAQQGLARGLELAFQSGAVTGMLVAGLALLSVAFYYILLVGIGATGRALIDPLVALGFGASLISIFARLGGGIFTKCADVGADLVGKVEAGIPEDDPRNPAVIADNVGDNVGDCAGMAADLFETYAVTVVATMVLASIFFAGVPAMTSMMAYPLAIGGVCILASILGTKFVKLGPKNNIMGALYRGFLVSAGASFVGIILATAIVPGFGDIQGANGVLYSGFDLFLCAVIGLLVTGLLIWVTEYYTGTNFRPVRSVAKASTTGHGTNVIQGLAISMEATALPALIICAAIITTYQLSGLFGIAITVTSMLALAGMVVALDAYGPVTDNAGGIAEMANLPEDVRKTTDALDAVGNTTKAVTKGYAIGSSGLGALVLFAAYTEDLAFFKANVDAYPAFAGVDVNFSLSSPYVVVGLFIGGLLPYLFGSMGMTAVGRAAGSVVEEVRRQFREIPGIMEGTAKPEYGRCVDMLTKAAIKEMIIPSLLPVLAPIVLYFVILGIADKSAAFSALGAMLLGVIVTGLFVAISMTAGGGAWDNAKKYIEDGHYGGKGSEAHKAAVTGDTVGDPYKDTAGPAVNPMIKITNIVALLLLAVLAH

SEQ ID NO: 51312 - protein, 187 aa, Pseudomonas aeruginosa PAO1
MSLINTQVQPFKVNAFHNGKFIEVTEESLKGKWSVLIFMPAAFTFNCPTEIEDAANNYGEFQKAGAEVYIVTTDTHFSHKVWHETSPAVGKAQFPLIGDPTHQLTNAFGVHIPEEGLALRGTFVINPEGVIKTVEIHSNEIARDVGETVRKLKAAQYTAAHPGEVCPAKWKEGEKTLAPSLDLVGKI

SEQ ID NO: 51313 - protein, 520 aa, Sinorhizobium meliloti 1021
MTAGNDFQHQAIAAHVAQRLAGPARAILGFQELLVEQARDLGLIHIKGDLDRIGAAARQLNGFIDRLLEGAACPLEEGEAEAEARLRHDLRTPLNAIIGYSEMILEEASDAPEHALKEDLHVILSAAAELLTQVDAIASLSRGETVEMLQPGERAEIDAAGLERLLFKAQEVACPEQGGRILVVDDVASNRDLLSRRLRREGHRVVTAESGLSALARLAEDEFDLILLDILMPDMNGIEMLSRLKSEERWQHVPVIMISGLSDVTAVARCIEAGADDYLTKPFNPILLRARINSTLEKKRWLDREHRYLQQIKTEKLRADSLIRAILPDQIVARLQDGEEIIADRFDEVSILFADIVGFSPIAASLTASDLVRRLDRMFRRFDLLTEQHRVEKIKTIGDAYMAACGIPEPAPDHADRIVALGKSMLRSLQDMEAGPDRFRVRIGIHTGPVVAGLIGRLRFVYDVWGETVNIASRLESQGVADVIQISEATRRALRGPWTLERRCALELRGIGAVETYLVR

SEQ ID NO: 51314 - protein, 433 aa, Magnaporthe grisea 70-15
MASLGSYAKKHKVTIIGSGNWGSTIAKIVAESTREHKDVFEEDVQMWVFEEKVTIPKDSPYYESEEPQKLTEVINKHHENVKYLPGIKLPSNIIANPSLTDAVRDSSVLVFNLPHEFLGKVCQQLNGHIVPFARGISCIKGVDVSGSGINLFCEVIGEKLGIYCGALSGANVASQIAAEEGVSETTIAYDPPPIDSSRAATPRDRSPNYDSTSANKLPDLTVTSADSNGKDDRGRRTKAKLTPVPESYPPLDHGTLQILFDRPYFSVSMVSDVAGVSLSGALKNIVALAAGFVDGKGWGSNVQSAVIRVGLAEMLKFAREFFGESVDPFTILLESAGVADVITSCISGRNFRCASMAVKRGVSVAEIEEKELNGQKLQGTSTAKEVNSLLKARGREGDYPLFTTVNEILEGKARVDDLPKLVIRQKHTIEKSG

SEQ ID NO: 51315 - protein, 399 aa, Agrobacterium tumefaciens str. C58
MAEAAAPLFDTFARAPLRFERGEGVWLFTESGERYLDFAAGVAVNSLGHAHPHLVEAIKTQAEKVWHVSNLYEVPGQEKLAKRLTEATFADKVFFTNSGAEALECAIKTARRYHYSKGHPEKFRIITFEGAFHGRTLATIAAGGQQKYLEGFGPKVEGFDQVPFGDVDALKAAITAETAALLIEPIQGEGGIRAPAKEFLQLLRSLCDEHDLLLIFDEVQTGVGRTGKFFAYEQTGVAPDIMAVAKGIGGGFPLGACLATADAASGMTAGVHGTTYGGNPLAMAVGNAVLDVVLADGFLEKVRDVALVFRQGLASLKDRYPDVIEEIRGEGLLLGIKARVPSGELLQAMRAEHLLGVPAGDNVIRLLPPLVTTAEEAREGLARVEAAAASLTAKQAKIA

SEQ ID NO: 51316 - protein, 305 aa, Agrobacterium tumefaciens str. C58
MASPKHFLDLSAVGPQDLRTILDDARARKVATKAGTAEKPLAGKMLAMIFEKPSTRTRVSFDVGMRQLGGETLFLSGTEMQLGRAETIGDTAKVLSRYVDAIMIRTTDHSRLLELAEHATVPVINGLTDDTHPCQIMADIMTFEEHRGPVKGKTIAWTGDGNNVLHSFVEGSARFGYRMTMAVPMGSEPHDKFMNWARNNGGEIALYHDADKAVAGADCVVTDTWVSMNQEHKARGHNIFQPYQVNEALMAKAQKDALFMHCLPAHRGEEVTDAVIDGPQSVVFDEAENRLHAQKSVIAWCMGVI

SEQ ID NO: 51317 - protein, 443 aa, Magnetospirillum magnetotacticum MS-1
MGLKTACIEKRGSLGGTCLNVGCIPSKALLAASHHYHAASHDLGAFGIKVSKVEIDVAGMMGHKDKVVSDNTKGIEFLFKKNKVTYIIGAGAITAPGQIEVTAKDGAKSTVAAKHIVIATGSEVTPLPGVEIDEEVIISSTGALALPKTPKHIVVIGGGVIGLELGTVWGRLGAKVTVVEFLDRILPFNDGEVSKTMQRLLAKQGMEFKLGTKVTAITRKGKTATITVEPAAGGAAEKIEADCVLVAIGRRPFTEGLGLDKVGVAIDKRGFVTIDGHFRTNVPGIYAIGDVVGGAMLAHKAEEEGVALAEILAGQHGHVNYEAIPAVVYTWPEVASVGKTEEQLKAEGIAYKAGKFPFTANGRARSMNEVDGFVKILACATTDKVLGAHIVGPNAGDLIAEVVLAMEFGAASEDIARTCHAHPGLGEAVKEACLAVDGRPLHT

SEQ ID NO: 51318 - protein, 483 aa, Aspergillus oryzae
MPRSPRTPAENEELQRYPERYSENIHKRGKAAKELVNVFFHENIERARDRNMRSTNLDKMIQDPSISKDAKRQEGETIAKKESNFLRFLRTKETPSNFQTIKVIGKGAFGEVKLVQRKTDGKIYALKSLIKTEMFKKDQLAHVRAERDILADSKDNPWLVKLHASFQDSAYLYLLMEFLPGGDLMTMLIKYEIFSEDITRFYMAEIVMAIEAVHKLGFLHRDIKPDNILLDRGGHVKLTDFGLSTGGKKTHDNSYYQNLLKNSTSKDKNRNSGYFNDAINLTVSNRGQINTWRKSRRAMAYSTVGTPDYIAPEIFNGQGYTYLCDWWSVGAIMFECLVGWPPFCAEDTTDTYRKIVNWRECLYFPEELTLSRESEGLIRSFLCDAEHRVGNDGGQFGGATQIKNHPFFRGVVWEQLRNIRAPFEPRLSSNIDVSYFPIDEIPQEDTSAIHRAQARAMPEEQEAEMSLPFIGYTYKAFNAFQNN

SEQ ID NO: 51319 - protein, 339 aa, Physcomitrella patens subsp. patens
MQASDPCTTDQDCGQGYYCFSCDGNPSVCTLDFASPVSSFAQNFSQPFNKYAWVTTHNSYAIVGEAPVLGVTIVSQKNQEDSITSQLSKGVRGLMLDIYELNGDIWLCHSVYQRCYDFTAFRPLNGTLTEIETFLAANPTEVVTIFFEDYVNTTNALTTAFQAAGLTKYLFPLAKMPKDGSDWPTLSTMIADNQRLLVFTSDKNKEASEGFAYQWNYVVENQYGTLNQSCLPRESSALLTDKMKTLFLQNYFPSNPNRTTACIDNSDNLSKALNVCHTAAGNRWANFLAVDFYQRSTSEGVFKGVNTLNGQLHCGCEDIRACEASFRSTCFQSFPQLLI

SEQ ID NO: 51320 - protein, 613 aa, Francisella tularensis subsp. holarctica
MQLISVKNVSLNFGTQIVLDNVNLEISKGQRICLIGRNGTGKSSLLKIIEGSVIPDSGEVIVHNNAIVASMIQEVPNDMQGSIADVMLQGLGTLGDYLIEYQQTLVSNPESAKLEQLHSYIDENHGWGYLNDVEVLASKFNFKPTASFKDLSGGMKRRVILARALIKKPDLLLLDEPTNHLDIDSINWLEEFLASFNGAILFITHDRKFLNNVAKNIIELDRGHLYCFDGNYTKFIEKKEQILDAQEKANSEFDKKLVQEEVWIRQRIKARRTRNEGRVRVLEQMRRERKQRRENIGKADIKVIQVEKSSKKVIQAENIAFEYTGKYLFKDFSTEIQKGDKIAIIGQNGCGKTTLLNCLLGLDKPTQGLVTLADNIKIAYFDQLRDQLDETLSIIDNVKEGSDFISLNGKETHVITYLQKFLFTPDRLHAPITHLSGGEKNRLLLAKILSKPSNIIVLDEPTNDLDIETLEILEEMLINYQGTVIIVSHDREFINNVATSTIVFDNSNLEEFVGGYDDWLSQRKQPQQVKITKNNSELSKNKLTYEQKKQLRNLPNQIEKLEANIATIQQQMSQLDFYQKSQQEIAKVQKQLEDLNHDLEQKYLLWEELLELE

SEQ ID NO: 51321 - protein, 266 aa, Arabidopsis thaliana
MASVASSTTLISSPSSRVFPAKSSLSSPSVSFLRTLSSPSASASLRSGFARRSSLSSTSRRSFAVKAQADDLPLVGNKAPDFEAEAVFDQEFIKVKLSDYIGKKYVILFFYPLDFTFVCPTEITAFSDRHSEFEKLNTEVLGVSVDSVFSHLAWVQTDRKSGGLGDLNYPLISYFTKSISKSFGVLIHDQGIALRGLFIIDKEGVIQHSTINNLGIGQSVDETMRTLQALQYIQENPDEVCPAGWKPGEKSMKPDPKLSKEYFSAI

SEQ ID NO: 51322 - protein, 256 aa, Mesorhizobium loti MAFF303099
MTPGIRPLVAGNWKMNGTSASLNELRMIGNGFMSGLDAETEALVCVPATLLSHAAEILSRTPVHAGGEDCHTKESGAYTGCISAEMLKDAGASHVIVGHSECREQRGEDDATVQAKAAAAWRAGLVAIICIGETQQQREAGATLEVLSRQVAGSVPPSATPSNTVIAYEPVWAIGTGLTPTAADVAEAHAHIRERLSEKLGASAAKTRILYGGSVKPSNAVELLGVRNVDGALVGGASLKAADFLGIAEAYRSISG

SEQ ID NO: 51323 - protein, 281 aa, Triticum aestivum
  misc_feature (109)..(109): Xaa can be any naturally occurring amino acid
LGKGLNFFSYLFPHMPTPTNQRRDKAHIRLKEIFTKIIRSRRSSNRAEEDVLQRLMDSKYKDGRSTTEAEISGIIMALVFAGKHSSTAASTWTGAFMLSNTKFLIAAMXEQKHIISKYENQIDYNALLEMDTLHRCIKEAMRMHTPSQMLIRKAHKNFKVQAKEGKEYDIPKGHNIVIPTALNNKLAHIYSNPHVYDPDRFGPGREEDKVGGKFSFTTFGGGRHVCPGMALAYLQIKVIWSHLLRNFELKLISSFPKADGSKMNQEPKGKVMISYKRHQLL

SEQ ID NO: 51324 - protein, 342 aa, Ostreococcus tauri
MTVEHGARDARSTAHQPWVEKYRPKTVRDVASQEQVVRVLEQALETGNMPHCLFYGPPGTGKTTCALAIAKQLYGPELYKQRVKELNASDERGISVVRDKVKTFASLAVGAPAPGYPSPPYKILILDEADAMTTDAQSAMRRMMETYSKVTRFFLLCNYVTKIIDPITSRCAKFRFQPLALETMTTRLKYIAEQESLELSDDVFPACSKHSGGDMRKAITLLQSAARLFSGKVDAAGIVEVAGYIPDVKLTTLLDLCKSGDFDKAQAHMEDILRDGYSGIKIMDQLSDIVLEADCSDEIKGDIFMKMGEVDRALAQGADEGLQLATVVSSAIKSFEKYPVAA

SEQ ID NO: 51325 - protein, 143 aa, Magnetospirillum magnetotacticum MS-1
MSVESILKTKGSVVFTIRPEHSVADAAALLTNKKVGVAVVCDAKGKLQGVLSERDIVKGLAQYGKAALEMPVRNVMSSPVVTCTPGDSVKTIMGVMTERRIRHLPVLEKDELIGIVSIGDAVNFRLTEAQMEMNVLRDVAATR

SEQ ID NO: 51326 - protein, 114 aa, Triticum aestivum
  misc_feature (55)..(55): Xaa can be any naturally occurring amino acid
  misc_feature (78)..(78): Xaa can be any naturally occurring amino acid
  misc_feature (84)..(84): Xaa can be any naturally occurring amino acid
  misc_feature (103)..(103): Xaa can be any naturally occurring amino acid
KLFNQEVTKICPKKWVFPVPFQGFQSSKTIGRLIVRGNFPFGLGPLVYSHGCFSXSYEQELFAGLDSRMNQSKDVLPXIVSAKXVLTGDKLRDEIYAPFENIXPVLTEYRKSQQ

SEQ ID NO: 51327 - protein, 207 aa, Hyphomonas neptunium ATCC 15444
MSTSLQTALNLVPMVVEQTSRGERAFDIFSRLLKERIIFVTGGIDDGIASLITAQLLFLESENPKREIAMYINSPGGYVSSGLAIYDTMQYVRCPISTVCIGQAASMGSLLLAAGEKGLRIALPNARVMLHQPSGGYSGVATDIERHAEEIIELKRRLNDIYVRHTGQEYDVVERKLDRDTFLTAEEAMEFGIVDKVYERRTAEDEK

SEQ ID NO: 51328 - protein, 501 aa, Thermoproteus tenax
MRAGLLEGVIKEKGGVPVYPSYLAGEWGGSGQEIEVKSPIDLATIAKVISPSREEVERTLDVLFKRGRWSARDMPGTERLAVLRKAADIIERNLDVFAEVLVMNAGKPKSAAVGEVKAAVDRLRLAELDLKKIGGDYIPGDWTYDTLETEGLVRREPLGVVAAITPFNYPLFDAVNKITYSFIYGNAVVVKPSISDPLPAAMAVKALLDAGFPPDAIALLNLPGKEAEKIVADDRVAAVSFTGSTEVGERVVKVGGVKQYVMELGGGDPAIVLEDADLDLAADKIARGIYSYAGQRCDAIKLVLAERPVYGKLVEEVAKRLSSLRVGDPRDPTVDVGPLISPSAVDEMMAAIEDAVEKGGRVLAGGRRLGPTYVQPTLVEAPADRVKDMVLYKREVFAPVASAVEVKDLDQAIELANGRPYGLDAAVFGRDVVKIRRAVRLLEVGAIYINDMPRHGIGYYPFGGRKKSGVFREGIGYAVEAVTAYKTIVFNYKGKGVWKYE

SEQ ID NO: 51329 - protein, 579 aa, Kluyveromyces lactis NRRL Y-1140
MPENKFEVTEEYLDPQSMLELSMPGGASKLSVRQKLILKCRRAMRMRDTEKKGSSSTDPVQSQYSLSLSSAEDKKRGFFGSVQDVLRKYMRFVGPGLMVSVAYMDPGNYATDVSAGASNEFSLLCIVLVSNIIAIFLQSLCIKLGSVTGLDLSRACKKHLPKWLNLTIYVFAECAIIATDVAEVIGTAVALNILLRIPLPAGVVITCIDVLFVLIAYKPGSSSMRFVRMFEYAVALLVFGVVICFCVELAYIPKTPVGHIFRGFVPSKQMFEHNGMYTATSILGATVMPHSLFLGSGLVQPRLLEYDVDHGYYDLLAEEDEDNVIEETEDTHSAVKEKEDIEVIRERRYFNYQPTNSAIKYAMKYSIFELAITLFTFALFVNSAILIVAGATLYGSEEAVDADLYTIHSLLSKNLAPIAGTVFMLALLFSGQSAGIVCTIAGQIVCEGHLDWNFKPWKRRLITRGISIIPCLIISLTIGRSALSKALNASQVVLSILLPFLVAPLIFFTCKKSIMKVKVNNKDKLNAPTVIGEEEQPDEYIDMSNNWITTIIAFLVWIFISLLNVYTIVQLGISHGDIS

SEQ ID NO: 51330 - protein, 574 aa, Synechococcus sp. WH 7805
MLRLERVSKIYPTGEVLRDVTWEVKDGDRIGLVGVNGAGKSTQMRLIAGLEEPSSGQIVRQGEPRIAFLQQEFDVDLERTVREELFQAFGEAAEVLTEQKQVELAMGSEQAAADPDHLDRLIHRLGALQTRFESLHGYELDARIDKLLPTIGFTAEGAERQVKDYSGGWQMRIALGKILLQDPDLLLLDEPTNHLDVETIQWLEDYLQTQTAALVVISHDRAFLDKVCNQIVSTERGISRAYLGNYTAHLEQKTLEQEATQAAFERQQKDIAAQQAYIDRFRASATRSTQAKSREKQLEKVDRVEAPIESVAGPSFRFPPAPRSGAQVALIDNLTHSYGDKILFLGAELEVERGDRIAFVGPNGAGKSTLLRLVMGLETPDEGSATLGEHNIVASYFEQNQAEALDLGKTVIDTMFEAVPDWTQTQVRSLLGSFCFSNDSVFKEVGQLSGGEKARLALALMLLSPCNLLVLDEPTNHLDIPAKQMLEDALCAYEGAALLVSHDRYFISRVANRIVELRDGELVLYRGDYNYYLEKKKEERQAAGEALLKAQQEAKRQAKRNKQKERESRRKKAA

SEQ ID NO: 51331 - protein, 602 aa, Kluyveromyces lactis NRRL Y-1140
MSHDPNQQQPHGGSGQGHHQRQLTNHAQGQHIGKYQIIKTLGEGSFGKVKLAYHISTGQKVALKIINKKVLAKSDMQGRIEREISYLRLLRHPHIIKLYDVIKSKDEIIMVIEYAGNELFDYIVQRDKMPEQEARRFFQQIISAVDYCHRHKIVHRDLKPENLLLDEHLNVKIADFGLSNIMTDGNFLKTSCGSPNYAAPEVISGKLYAGPEVDVWSSGVILYVMLCRRLPFDDESIPVLFKNISNGVYTIPNFLSQGAASLIKKMLIVNPVNRITVHEIMQDEWFKVDLPDYLVPAESTHQENSESKTEDGGPSVPLELIDDSLVQTLSNTMGYDVDEIYEALESDEDHPSLNEIRDAYQLIKENRNLINDIKVNKQQSNDLDTFLSQSPPTFEQSLHAPPGSKNRHSHRHSKRTQQRTYQYHYGNGSQDGDSTIAILPSSLPQIHRANMVAQGSQAAAKISPLSVKKSKTRWHFGIRSRSYPLDVMGEIYIALKNLGAEWAKPSEEDLWTIRVRWRYNIDMPDDEMKNKQIPDLMKMVIQLFQIETNNYLVDFKFDGWESSNGVVYSSRNDDEMSTFSAYPFLHLATRLIMELAVNSQGS

SEQ ID NO: 51332 - protein, 507 aa, Streptomyces avermitilis MA-4680
MSSSNPLRDPADRRLPRIAGPSGLVIFGVTGDLSRKKLMPAVYDLANRGLLPPGFSLVGFARRDWEHEDFAQVVHDAVKEHARTEFREEVWQQLIQGMRFVQGTFDDDDAFERLRDTIGELDKAQGTGGNFAFYLSVPPSAFPVVIQQLKKHGLADQSDGSWRRAVIEKPFGHDLKSAEELNAIVHEVFGSDQVFRIDHYLGKETVQNILALRFANTMFEPIWNRSFVDHVQITMAEDIGIGGRAGYYDGIGAARDVIQNHLLQLMALTAMEEPASFDADALAAEKTKVLGAAKLPKDLSKNTVRGQYAAGWQGGEKVVGYLQEDGIDPKSKTDTYAAVKLEVDNRRWAGVPFYLRTGKRLGRRVTEIAVVFQRAPHSPFDHTATEELGQNAIVIRVQPDEGITVRFGSKVPGTSMEIRDVSMDFAYGESFTESSPEAYERLILDVLLGDSNLFPRTEEVELSWKILDPIEEHWDKHGKPAQYPAGTWGPVEADEMLERDGRSWRRP

SEQ ID NO: 51333 - protein, 233 aa, Staphylococcus epidermidis ATCC 12228
MTGKHKRAIEDHFDNQKELEMVLENKGKADLLEKVQYSTDLANIFYVRQKEQKGLGHAIHTAKQFIGNEPFAVLLGDDIVESDTPAIKQLMDVYEETGHSVIGVQEVPESDTHRYGVIDPSAKEGSRYEVRQFVEKPKQGTAPSNLAIMGRYVLTPEIFDYLETQQEGAGNEIQLTDAIERMNSKQQVYAYDFEGNRYDVGEKLGFVKTTIEYALKDPEMSQDLKAFIKQLDI

SEQ ID NO: 51334 - protein, 358 aa, Cryptococcus neoformans var. grubii
MGGCMSSPATGDPVAEARSKEIDRALKEDEKRMAKEVKLLLLGAGASGKSTILKQMRLIHDRPFESDEVEDYRKLTFSNIVGGMRAIIDVMDELGLAVQPENRRYISLVDAEPPINTNDSYPIKYLTALKRLWEDPSVQECYKRGNEFALAENMPYFYADLDRLFAKGFKPSSDDILRVRSKTTGITETRFPIRDVVFRLFDVGGQRSERRKWASCFENVTAILFLVALSDYNSCLIEDRESNGMQEALMLFDSICNSQWFTKSSIILFLNKADLLQVKIQDPSQQLHENFPEFEGKPYSFQDAVDFFKIKFRSLNRMPQKEIYCHVTTAVDRQNVKVVMTACQDTILKNALRDMAIL

SEQ ID NO: 51335 - protein, 265 aa, Glycine max
  misc_feature (261)..(261): Xaa can be any naturally occurring amino acid
LRIIKPCNHVLSLSFPIRRDDGSWEVIEGYRAQHSQHRTPCKGGIRYSTDVSVDEVKALASLMTYKCAVVDVPFGGAKAGVKINPKNYTDNELEKITRRFTMELAKKGFIGPGIDVPAPDMSTGEREMSWIADTYASTIGHYDINAHACVTGKPISQGGIHGRISATGRGVFHGIENFINEASYMSILGMTPGFGDKTFVVQGFGNVGLHSMRYLHRFGAKCVGVGESDGSIWNPDGIDPKELEDFKLQHGSILGFPKPRXYEGS

SEQ ID NO: 51336 - protein, 305 aa, Thellungiella halophila
MAAPWQWENATAGAVAGFATVAAMHPLDVVRTRFQVNDGRRSILPTYKNTAHAVFTIARLEGLRGLYAGFFPAVIGSTVSWGLYFFFYGRAKQRHARGREEEKLSPGLHLASAAEAGALVCLCTNPIWLVKTRLQLQTPLHQTRPYSGLLDAFRTIMKEEGPRALYKGIVPGLVLVSHGAIQFTAYEELRKVIVDLKERRRKSESADKILNSVDYAALGGSSKVAAVILTYPFQVIRARLQQRPSTNGIPRYIDSLHVIRETARFEGLRGFYRGLTANLLKNVPASSITFIVYENVLKLLKRPPT

SEQ ID NO: 51337 - protein, 337 aa, Thellungiella halophila
MSPVPERTKLHIAMAVFQTGYAGNHVIMRFALNLGVSKLIFPLYRNIIALSVLAPSAFFLEKKERPRMTTSLLIQFFLLGLVGITLNQGFYIFGLDNTSPTFASATENAVPAVSFLMAALLGIEKVELKRRDGVAKVVGTFVSVAGSLAITLYKGPTIYQPSLRSMDQPTNAGEAEEQNKNWTLGCVCLMGHCLCWSSWIVLQSPLLKRYPARYSFVSYSCLFAVFQIVGISAYFERDLESWKIKSGREMYALLYTGLVGSGMVFAIQIYVVERGGPLFVSAYLPLQTLLAALLATFALGEHLYLGGLIGAILIICGLYLVVMGKSGRRKLFANSNT

SEQ ID NO: 51338 - protein, 1530 aa, Schizosaccharomyces pombe 972h-
MNQNSDTTHGQALGSTLNHTTEVTRISNSSDHFEDSSSNVDESLDSSNPSSNEKASHTNEEYRSKGNQSYVPSSSNEPSPESSSNSDSSSSDDSSVDRLAGDPFELGENFNLKHYLRAYKDSLQRDDIITRSSGVCMRDHSVYGVGSGYEFLKTFPDIFLQPYRAITEKQVVEKAILSHCHALANAGELVMVLGQPGSGCSTFLRSVTSDTVHYKRVEGTTHYDGIDKADMKKFFPGDLLYSGENDVHFPSLTTAETLDFAAKCRTPNNRPCNLTRQEYVSRERHLIATAFGLTHTFNTKVGNDFVRGVSGGERKRVTISEGFATRPTIACWDNSTRGLDSSTAFEFVNVLRTCANELKMTSFVTAYQASEKIYKLFDRICVLYAGRQIYYGPADKAKQYFLDMGFDCHPRETTPDFLTAISDPKARFPRKGFENRVPRTPDEFEQMWRNSSVYADLMAEMESYDKRWTETTPASSEAPEKDNFGSDISATTKHELYRQSAVAEKSKRVKDTSPYTVTFSQQLWYCLARSWERYINDPAYIGSMAFAFLFQSLIIGSIFYDMKLNTVDVFSRGGVLFFSILFCALQSLSEIANMFSQRPIIAKHRASALYHPAADVISSLIVDLPFRFINISVFSIVLYFLTNLKRTAGGFWTYFLFLFIGATCMSAFFRSLAGIMPNVESASALGGIGVLAIAIYTGYAIPNIDVGWWFRWIAYLDPLQFGFESLMINEFKARQFECSQLIPYGSGYDNYPVANKICPVTSAEPGTDYVDGSTYLYISFNYKTRQLWRNLAIIIGYYAFLVFVNIVASETLNFNDLKGEYLVFRRGHAPDAVKAAVNEGGKPLDLETGQDTQGGDVVKESPDNEEELNKEYEGIEKGHDIFSWRNLNYDIQIKGEHRRLLNGVQGFVVPGKLTALMGESGAGKTTLLNVLAQRVDTGVVTGDMLVNGRGLDSTFQRRTGYVQQQDVHIGESTVREALRFSAALRQPASVPLSEKYEYVESVIKLLEMESYAEAIIGTPGSGLNVEQRKRATIGVELAAKPALLLFLDEPTSGLDSQSAWSIVCFLRKLADAGQAILCTIHQPSAVLFDQFDRLLLLQKGGKTVYFGDIGEHSKTLLNYFESHGAVHCPDDGNPAEYILDVIGAGATATTNRDWHEVWNNSEERKAISAELDKINASFSNSEDKKTLSKEDRSTYAMPLWFQVKMVMTRNFQSYWREPSILMSKLALDIFAGLFIGFTFYNQGLGVQNIQNKLFAVFMATVLAVPLINGLQPKFIELRNVFEVREKPSNIYSWVAFVFSAIIVEIPFNLVFGTLFFLCWFYPIKFYKHIHHPGDKTGYAWLLYMFFQMYFSTFGQAVASACPNAQTASVVNSLLFTFVITFNGVLQPNSNLVGFWHWMHSLTPFTYLIEGLLSDLVHGLPVECKSHEMLTINPPSGQTCGEYMSAFLTNNTAAGNLLNPNATTSCSYCPYQTADQFLERFSMRYTHRWRNLGIFVGYVFFNIFAVLLLFYVFRVMKLRSTWLGKKITGTG

SEQ ID NO: 51339 - protein, 384 aa, Staphylococcus aureus subsp. aureus COL
MKLSLNSNSKYLRAPSIRQFSNRMNNLDDCVNLTIGQPDFPMPDVVKKAYIDAINNDKTSYSHNKGLLETREAISQYFKNRYHFSYDPEEIIVTNGASEAIDTTLRSIIEPGDEIIIPGPIYAGYIPLIEVLGGKPIYIDTTATQFKITPDALESHISPKTKAVLLNYPTNPTGVVLKRNEVLNIVNVLKKYPLFIISDEIYAENTFSGKHVSFAEFEDIRDQLILIGGLSKSHSATGIRIGFLLGPQYLIDKLTFMHAYNCICANVPAQIACITALNEGLEAPKYMNEAYVERRNYLVSELTKLGFEITAQPEGAFYIFPSIKHITDDDFEFCVDLLESTHLAIVPGSSFTEFGKGFVRISYAYEMDVLKEGMKRLAKYLNTK

SEQ ID NO: 51340 - protein, 54 aa, Populus trichocarpa
MFPGLFMKKPDKAEALKQLRSHVAMFGAWVVVLRVTPYVLHYISHEKDELKLEF

SEQ ID NO: 51341 - protein, 266 aa, Gossypium hirsutum
LSIEEVEVAPPQKDEVRIKILFTSLCHTDVYFWDAKGQNPLFPRILGHEAGGIVESVGEGVTDLKPGDHVLPIFTGECKECPHCLSEESNMCDLLRINTDRVGMINDGKSRFSINGKPIYHFLGTSTFSEYTVVHVGQVAKINPHAPLDKVCVLSCGMSTGFGATVNVAKPKKGQSVAIFGLGAVGLAAAEGARVSGASRIIGIDLNPSRFEQAKKFGVTEFVNPKDYNKPVQEVIVEMTGGGVDRSVECTGSIQAMISAFECVHD

SEQ ID NO: 51342 - protein, 266 aa, Gossypium herbaceum
LSIEEVEVAPPQKDEVRIKILFTSLCHTDVYFWDAKGQNPLFPRILGHEAGGIVESVGEGVTDLKPGDHVLPIFTGECKECPHCLSEESNMCDLLRINTDRVGMINDGKSRFSINGKPIYHFLGTSTFSEYTVVHVGQVAKINPHAPLDKVCVLSCGMSTGFGATVNVAKPKKGQSVAIFGLGAVGLAAAEGARVSGASRIIGIDLNPSRFEQAKKFGVTDFVNPKDYNKPVQEVIVEMTGGGVDRSVECTGSIQAMISAFECVHD

SEQ ID NO: 51343 - protein, 366 aa, Bacillus subtilis subsp. subtilis str. 168
MALTAGIVGLPNVGKSTLFNAITQAGAESANYPFCTIDPNVGIVEVPDDRLQKLTELVNPKKTVPTAFEFTDIAGIVKGASKGEGLGNKFLSHIRQVDAICHVVRAFSDDNITHVSGKVDPIDDIETINLELILADMETVEKRITRVSKLAKQKDKDAVFEFEILSKLKEAFESEKPARSVEFTEEQQKLVKQLHLLTSKPILYVANVSEDEVADPSGNENVAKIREYAAGENAEVIVVCAKIESEIAELEGEEKQMFLEELGIQESGLDQLIKASYSLLGLATYFTAGEQEVRAWTFKKGMKAPECAGIIHSDFERGFIRAETVAYEDLLAGGGMAGAKEAGKVRLEGKEYVVQDGDVIHFRFNV

SEQ ID NO: 51344 - protein, 236 aa, Debaryomyces hansenii CBS767
MKLNISYPANGTQKCIDIEDEHKLRVFYEKRMGQEVEGDTVGDEFKGYIFRITGGNDKQGFPMKQGVMHPTRVKLLLAKGHSCYRPRRTGERKRKSVRGCIVAQDLAVLALSVVKQGDSDIEGLTDTTTPKRLGPKRANNIRKFFGLTKEDDVRQFVVRREVVKGDKKYTKAPKIQRLVTPQTLQRKRALKAQKVKNAQQQRDAAAEYAQLLAQRLHERKAERAEIKKRRASSLKA

SEQ ID NO: 51345 - protein, 72 aa, Oryza sativa
  misc_feature (7)..(7): Xaa can be any naturally occurring amino acid
  misc_feature (64)..(64): Xaa can be any naturally occurring amino acid
MATTRPXARNDPHLPGDEAARVEAKVRGYFDSMARRRPSKPPRIDPADAGEGGAEADADADLPXELRMLRDL

SEQ ID NO: 51346 - protein, 266 aa, Gossypium raimondii
LSIEEVEVAPPQKDEVRIKILFTSLCHTDVHFWDAKGQNPLFPRILGHEAGGIVESVREGVTDLKPGDHVLPIFTGECKECPHCLSEESNMCDLLRINTDRVGMINDGKSRFSINGKPIYHFLGTSTFSEYTVVHVGQVAKINPHAPLDKVCVLSCGMSTGFGATVNVAKPKKGQSVAIFGLGAVGLAAAEGARVSGASRIIGIDLNPSRFEQAKKFGVTESVNPKDYNKPVQEVVVEMTGGGVDRSVECTGSIQAMISAFECVHD

SEQ ID NO: 51347 - protein, 266 aa, Gossypium robinsonii
  misc_feature (58)..(58): Xaa can be any naturally occurring amino acid
LSIEEVEVAPPQKDEVRIKILFTSLCHTDVYFWDAKGQNPLFPRILGHEAGGIVESVXKGVTDLKPGDHVLPIFTGECKECPHCLSEESNMCDLLRINTDRVGMINDGKSRFSINGKPIYHFLGTSTFSEYTVVHVGQVAKINPHAPLDKVCVLSCGMSTGFGATVNVAKPKKGQSVAIFGLGAVGLAAAEGARVSGASRIIGIDLNPSRFEQAKKFGVTEFVNPKDYNKPVQEVIVEMTGGGVDRSVECTGSIQAMISAFECVHD

SEQ ID NO: 51348 - protein, 519 aa, Oryza sativa Japonica Group
MAVAAPGQLNLDESPSWGSRSVDCFEKLEQIGEGTYGQVYMAKETETNEIVALKKIRMDNEREGFPITAIREIKILKKLHHQNVIQLKEIVTSPGPERDEQGKPIEGNKYKGSIYMVFEYMDHDLTGLADRPGMRFTVPQIKCYMRQLLTGLHYCHVNQVLHRDIKGSNLLIDNEGNLKLADFGLARSFSSDHNGNLTNRVITLWYRPPELLLGSTRYGPAVDMWSVGCIFAELLNGKPILTGKNEPEQLSKIFELCGTPDELIWPGVTKMPWYNNFKPQRPMKRRVKESFKHFDQHALDLLEKMLTLGSITEGYRQKMHLTRSISGLIPYRVIQRACRSMRRLMSSKLRKNASSRGKQRKPQSARNCSILHHIPVCLQSRTQANHTKSGLASLCIMHHLWQLAQVITMQSREDLEALIGTHKAGTKEATIRTAVDREEAMGVAHIHSKDEVLPLILVVAWAEPVVRGVVVAVAMVLADQIINRVDLMVHLVQVEARTIIKVVLAINNSMETGNSTAVS

SEQ ID NO: 51349 - protein, 497 aa, Ammi majus
MDVIIIVLSVMLAYVLVKHLLLSRDRGKNLPPGPFQLPIIGNLTNLGKLPHRSLAKLSQNYGPIMHLQLGRVTTIVISSSAIAQQVFQKKGRAFSRRFIPDSLCACDHSLYSFVWLPIGPQWRNLRKISNSNLFSANKLDANQHLRGRKVNELIAYVQKCSQTGDAVDIGRAAFRTSFNLLSNTVFSKDMVDPYQDSAQEFKDLAWNIMVEAGSPNLVDYFPVLKKMDPQGVKRRMTGYFQKVIKMLDGLINERLALKGSGTTVDKTDMLDELINISQVNPNEMDKILMEHLFVDIFVAGTDTTSNTVEWGMAEILRSTETMMKVKAELRHLVGKGVILEEGDIYRLPFLQCIVRETLRLHPPFPLLLPRQTEEETELNGYTIPKNSQVLVNAWAIGRDPVSWKNPSSFRPERFLDSEVDVKGQDFELIPFGAGIRICPGLPLVMRMVPVMLGSLINCFDWELEGGIPLNELDMEEKCGLSVAKLHPLRVLATSQVV

SEQ ID NO: 51350 - protein, 427 aa, Photobacterium sp. SKA34
MQKMNIVDIDFDKEHVWHPYTSTVTPLPCYPVTSAQGVYLTLEDGTQLIDGMSSWWSTIHGYNHPVLTEAAKAQLDKMSHVMFGGITHQPAVDLCKKLVAITPAPLDKVFLADSGSVAVEVALKMALQYWHAQNESRAKFLTVSHGYHGDTFAAMSVTDPTNSMHSIYKGFLPEHIFAKSPECGFGDDWDETDIADFEEKIRLHHKDLAAVIIEPIVQGAGGMRFYHPTYLKRIRELCDQYNVLLIADEIAVGFGRTGKLFACEHAEISPDIMCLGKALTGGYMTLSATLTTKHVADTVCSGEAQCFMHGPTFMGNPLACAVANASLDLLAENKWQQQVKNIEQQLALELPLIAELENVKSVRWLGAIGVVELHHPVEMKSIQEKFVQQGVWVRPFGKLVYIMPPFIINSSQLTLLTTSIKKVISSI

SEQ ID NO: 51351 - protein, 530 aa, Ammi majus
MITCEMGIYLQMQDIILFSLVFFSTLILWRIFSTYVIRKKTCSGPPEPAGRWPLIGHLHLLGGSKILHHILGDMADEYGPIFSLNLGINKTVVITSWEVAKECFTTQDRVFATRPKSVVGQVVGYNSRVMIFQQYGAYWREMRKLAIIELLSNRRLDMLKHVRESEVNLFIKELYEQWSANGNGSKVVVEMMKRFGDLTTNIVVRTVAGKKYSGTGVHGNEESRQFQKAMAEFMHLGGLLMVSDALPLLGWIDTVKGCKGKMKKTAEEIDHILGSCLKEHQQKRTNISNNHSEDDFIYVMLSAMDGNQFPGIDTDTAIKGTCLSLILGGYDTTSATLMWALSLLLNNRHVLKKAQDEMDQYVGRDRQVKESDVKNLTYLQAIVKETLRLYPAAPLSVQHKAMADCTVAGFNIPAGTRLVVNLWKMHRDPKVWSDPLEFQPERFLQKHINVDIWGQNFELLPFGSGRRSCPGITFAMQVLHLTLAQLLHGFELGTVLDSSIDMTESSGITDPRATPLEVTLTPRLPPAVYQ

SEQ ID NO: 51352 - protein, 590 aa, Ostreococcus tauri
MSLVRVLTGHVRVALDATNAPEIAREIARVAVTTIEQRHAWTAVIAIAIVLRVLLVERTPKIVVALTEEEASCEGDALTFDPSGAWPTKTVPCYDPGTMRRLGPDVEAMSAEEVRARIRRASEAQKEWAKSSFATRRKLLRVIQRFILEEQDSICRVSARDSGKPLVDAAFGEVLVTLEKIRWLCNEGEQWLKPESRSSGAMMFYKKARVEYHPVGVMGAIVPWNYPFHNVFNPLVANLFAGNALVVKVSEYATWSSQYYGRVIDAALDAVGAPRDLVQIITGYGEAGNALVTGGCQKVVFVGSTGIGRKVMEAAAKTLTPVVLELGGKDPFIVCADADLKQCVPMALRGAFQSCGQNCAGAERFYVHEKIHDKFLGKVVDSAKKLRQGRSTFNRSSTTPLRELGAQGGQFYPPTVISGITHDMRIAREEVFGPVLAIVKTKSDEESIALANDCDFGLGSNVFTRSTKRAEFLGKQLEAGMTSINDFCSTYMAQSLPFGGVKESGFDRFAGIEGLRGCCVPKSVVVDRFPLLMKTNIPPPLCYPVADNAFAFCKALARMFFGLSLAQRFGGLLALAKCFLLPSKTYTKYD

SEQ ID NO: 51353 - protein, 1094 aa, Ostreococcus tauri
MPARAPRASSAMQARSNGVDVEHTFLCVPISTLDAVGGDERAESERGEDDATKHEFHRRVFARIRRAYKLGKKKRSYNQVELSFERLGKNLERARGDAEADNPGVRVFEATETAFKADVPVQFRDSALEYELKLYNGVVARAVVYLVYSEPQRERDANGKKGLSDGRGYTWVPVMRQTCAKGCEGPILSAIQRFGKQGRTQKSAAQQDSAPVAKPQAEDKWKDTRNLFISIDEASNHVCTLGPNKCKTFRLLFGVFERDSQQLLGSGVSGPIRVLANNDVPKGAAAMRVRCGLSESWTGWEQNAMKNEEELREHFKAMCPPPPGKPSLDKARDRRSEDASQQTTRKPLQNNTNTVRQGAAGKRTAMPVPAQSKRAKMSGATKSKRNTVPVPYEALGFGFDPSMQEAMGMPAPESQDQDLPFNFIMGSPLGTPPDEQRAVPAFAGIFGTPEYLGAPEIMNDALNTSDLPNVCTPGAARTAAQDAMAMPPPTTGMGGAFRFTPALLPNITSSGSLPSLLGLDSLGTMTFGKTPADFRKKTESKVFTRSTRKVVATGEPTPTTQFLNSIFASAQAASTRRTTRSNSEAKPALQRDNADVLTDTEAKNASVRAEVEPSTAVAPAHGAEATDVAPQVAPARVARSLQVSPSGVAPVRLFFASPVGRGGEPLEGSDEEDDAIGFASPNARNTVSGANGLQSHNRRNTRNAQKIRLPRMASVPEIVDDAAEKANDRAAKAARLSGHFRPVKVPPPPKHVASDPESIKRKTRNLVHFSNDVNFENAPSTSPSTPSRAAMEPSSLHLLCAPAPLTPRTPMRRASSSLNSISRAIKTKLPLASARTNIHANARAMHGASLIASSALAPRVIGGALNSAKCNVRDVHRAPLRSALMQKGLVRGFSVVAEAGDEDGAGAGGRQDEHRVYVGNLSWGVTDESLAELFSEFDVRDASVMKDRETGRSRGFAFVSMNNEEDVERASAALNGREVDGRELRVSKAQAQAERGERPMRMPRQRRDFDQAEGRRVYFGNLSWGMDQYDLQDLCSEFGSVEDSRLITDRDTGRSRGFGFVTMSNTTEADEVVAQLNGQDVDGRVLRVNIATSN

SEQ ID NO: 51354 - protein, 382 aa, Vibrio campbellii AND4
MTIEIKPGQTHIQSKAMVAWKAGEPLKRETVDVELPKAGEVLVRIVATGVCHTDAFTLSGDDPEGIFPSILGHEGGGIVEMVGEGVTSVEVGDHVIPLYTAECGECKFCKSGKTNLCQAVRETQGRGLMPDGTSRFSINGEPIFHYMGCSTFSEYTVLPEISLAKVAKEAPLEEVCLLGCGVTTGMGAVLNTAKVEKGDTVAVFGLGGIGLSAIIGARMAGASKIIGVDINESKFELAKQLGATDCVNPMKFDKPIQDVIVEMTDGGVDYSFECIGNVNVMRQALECCHKGWGESVIIGVAGAGQEISTRPFQLVTGRVWRGSAFGGVKGRSELPEIVNRYMAGEFGLQEFITHTMGLDDVNEAFELMHKGESIRTVLHMDK

SEQ ID NO: 51355 - protein, 289 aa, Vitis vinifera
  misc_feature (244)..(244): Xaa can be any naturally occurring amino acid
  misc_feature (289)..(289): Xaa can be any naturally occurring amino acid
MASTQFSSIRAAPLVNHGVSSSFMEKLKSEIGEFYKLPLEERMKYKMRPGDVEGYGLSPIRSEDQKLDWGDRFYMTTNPIHTRKPYLLPELPPSLRDSLECYLAELQKLAMMLLGFMAKALKLEKGEMEELFEDGMQSVRMTYYPPCPQPELVMGLTPHSDATGITILLQINGVDGLQIKKDGVWIPVSFLPDALVVNVGDILEILSNGVYTSIEHRATVNAAKERISIAMFFNPKSSAQIKPXASLINPQNPPLFKQVGMEKYFKDFFSRKLDGKSYLEHMKIKNEEX

SEQ ID NO: 51356 - protein, 110 aa, Kluyveromyces lactis NRRL Y-1140
MSSSVPYDPYVPATEETAGDSKTAALKSEIDDTVDIMRDNINKVAERGERLTSIQDKADNLAVSAQGFKRGANRVRKQMWWKDLKMRMCLVLVVIILLIVIIVPIAVHFS

SEQ ID NO: 51357 - protein, 361 aa, Streptomyces ambofaciens
MPELPPPHVVREAEKARAELQRQSRELAPPPFALLEMIMGVMVSRAVHVVAELKVAEALAEGPLSAEELAGRVGADADALGRVLRLLASNGVFATRADGTFELTPMADALRADHPMSMRPIALLMGHPIHWEDWSGFPETVVTGEPALPKLRGMHAFEFLTKNAEYGQVFFEGMGSMSASETGPIVAAYDFTRFGTVVDFCGGQGGLLAGILASSPATRGVLYDPRVEENGAAEFLAAQGVADRTERVAGDLFEVPPGGADAYVLKHIVHDWPEEQALQILRNVRAAIKPGGRLLIAEMVIPEQGDEPHSGKLVDLWLMLLVGGRERTPGQYADLLARAGFRLERVVETAAAISLVEAVPV

SEQ ID NO: 51358 - protein, 262 aa, Streptomyces ambofaciens
MTDTTTQRVAVITGATSGIGLASARLLGAQGHRVFIGARSADNVAATVKELQGEGLDVDGAVVDVRDTASVDAWIQAAVDRFGTLDVVVNNAGRSGGGPTADIADELWDDVIDTNLNSVFRVTRAALTLGGLRAKDRGRIINVASTAGKQGVVLGAPYSASKHGVVGFTKALGNELAPTGITVNAVCPGYVETPMAQRVRQGYAAAYDTSEEAILDKFQAKIPLGRYSTPQEVAGLIGYLASDTAASITSQALNVCGGLGNF

SEQ ID NO: 51359 - protein, 340 aa, Bacillus subtilis subsp. subtilis str. 168
MKVKVAINGFGRIGRMVFRKAMLDDQIQVVAINASYSAETLAHLIKYDTIHGRYDKEVVAGEDSLIVNGKKVLLLNSRDPKQLPWREYDIDIVVEATGKFNAKDKAMGHIEAGAKKVILTAPGKNEDVTIVMGVNEDQFDAERHVIISNASCTTNCLAPVVKVLDEEFGIESGLMTTVHAYTNDQKNIDNPHKDLRRARACGESIIPTTTGAAKALSLVLPHLKGKLHGLALRVPVPNVSLVDLVVDLKTDVTAEEVNEAFKRAAKTSMYGVLDYSDEPLVSTDYNTNPHSAVIDGLTTMVMEDRKVKVLAWYDNEWGYSCRVVDLIRHVAARMKHPSAV

SEQ ID NO: 51360 - protein, 397 aa, Physcomitrella patens subsp. patens
MYVLRCDFSFFLAAARPWKASDCRLVLEDGSVWSGKSFGSTGTQVGEVVFNTSLTGYQEILTDPSYSGQFVLMTQPHIGNTGVNLGDEESGKCFTGALIIRRLSNIVSNWRSSEDLPEYLKKRNVMGISDIDTRAITRRLREEGSLIGVLTTENSKTDDELIEMAKTWKIAGKDLITDASCTEPYEWQEKTDDEWEFSSDIPDLESKKFHVVAYDFGVKQNILRRLTSYGCKITVVPSTYPTSKVLNLKPDGILFSNGPGDPSAVPYAVKSVQDLVGIVPVFGICMGHQLLGQALGGTTFKMKFGHHGGNHPVRHLPTGRVEISAQNHNYAVDPDTLPEGVEVTHINLNDGTCAGLTFPAMKAMSIQYHPEASPGPHDSDPAFSDFVEMMRKNRSEA

SEQ ID NO: 51361 - protein, 485 aa, Bacillus halodurans C-125; identical to SEQ ID NO: 1177

SEQ ID NO: 51362 - protein, 366 aa, Bacillus halodurans C-125; identical to SEQ ID NO: 1273

SEQ ID NO: 51363 - protein, 280 aa, Bacillus subtilis subsp. subtilis str. 168
MTTHLQAKATLHNGVEMPWFGLGVFQVEEGSELVNAVKTAIVHGYRSIDTAAIYGNEAGVGEGIREGIEEAGISREDLFITSKVWNADLGYEETLAAFETSLSKLGLDYLDLYLIHWPVEGKYKEAWRALETLYKEGRIKAIGVSNFQIHHLEDLMTAAEIKPMINQVEFHPRLTQKELIRYCQNQGIQMEAWSPLMQGQLLDHPVLADIAQTYNKSVAQIILRWDLQHGIITIPKSTKEHRIKENASVFDFELTQDDMNRIDALNENLRVGPDPDNFDF

SEQ ID NO: 51364 - protein, 513 aa, Rubrobacter xylanophilus DSM 9941
MELQVRFPLGASGPLGCASEIAARHPSYRVEGGGDGARVSVRLELPGDWRLLDDFSTLLRGEEVSYAADGTPVPGEELLRGLRCFLRKQRSGKTAREWCTPASLGDRQLFPCRQIRVYDNDHLTPNSWYAFGSVGGDGAFRVDKEALTERVLEDLGPCVRCPLLDLEAVAETVAALPDRIDPAREAGWRYREGGGGWKVTKAGAAGPSPEEAAAEESRREGLLERLARSVRGGGVPVVGGPVGSRNVPDTGYGDVGGMDETIALVREAVELPITHPEIFQRLGIRPHKGILFHGPPGTGKTLLARAVARESGAHFIAVSGPEILNKYWGQSEARLRGIFAEARAKAPSIILFDEIDSFASARDAMSESFEATLVSQLLSLMDGLNSLGRVCVIATTNRPEALDPALRRPGRFDHEIEIGLPDAGARLHILQIHTRRMPTDPDLDLEQIARLTGGYSGADLEALCREAALACMRRTLNLRDFERRITPRQLAALSVTTYDFRTAMKRVGASIRR

SEQ ID NO: 51365 - protein, 221 aa, Escherichia coli
DLLDADYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYE

SEQ ID NO: 51366 - protein, 458 aa, Oryza sativa Japonica Group
MAASTSATSFSTPTKPASSSSSSSSPNSVCFARASGRCRMASVVVRAEAVDATISPTVSALRPSKTMAITDQATALRQAGVPVIGLAAGEPDFDTPHVIAEAGMNAIKDGYTRYTPNAGTLELRKAICNKLQEENGISYSPDQVLVSNGAKQCITQAVLAVCSPGDEVLIPAPYWVSYPEMATLAGATPVILPTSISENFLLRPELLASKINEKSRLLILCSPSNPTGSVYPKELLEEIADIVKKYPRLLVLSDEIYEHIIYQPAKHTSFASLPGMWDRTLTVNGFSKAFAMTGWRLGYLAAPKHFVAACGKIQSQFTSGASSISQKAGLAALNLGYAGGEAVSTMVKAFQERRDYLVKSFKELPGVKISEPQGAFYLFIDFSSYYGSEVEGFGTIKDSESLCMFLLEKAQVALVPGDAFGDDKCIRMSYAAALSTLQTAMEKIKEAVALIKPRVAAK

SEQ ID NO: 51367 - protein, 425 aa, Helicobacter pylori 26695
MAYNPKILQKPKEGEEITIKDNKLHVPNHPIIPFIEGDGIGSDITPAMIKVVDSAVQKAYKGEKKIAWYEVFVGEKCYQKFKDYKELSPEEQWLLPDTIEAINHYKVSIKGPLTTPIGEGFRSLNVALRQKMDLYVCLRPVRWYGSPSPVKEPQKVDMVIFRENSEDIYAGIEWQEGSAEAKKLIHFLQNELKVKKIRFPESSGIGVKPISKEGTERLVRKAIEYAIDNDKPSVTFVHKGNIMKYTEGAFMKWGYALAQKEFNAQVIDKGPWCSLKNPKNGKEIIIKDMIADAFLQQILLRPSEYSVIATMNLNGDYISDALAAMVGGIGIAPGANLNDTVGMFEATHGTAPKYAGLDKVNPGSIILSAEMMLRHMGWVEAADLIVSAMEKAIKSKKVTYDFARLMDGAKEVKCSEFASVMIENM

SEQ ID NO: 51368 - protein, 342 aa, Physcomitrella patens subsp. patens
MIRLCASQLSILCKVSVLDLFFFATCNPGDGCLIPAPYFPAFDNDMSIRNEVIPIPVQPTDTRTYIPTVHEMEEAVLAAESKGIRARMLLVTNPGNPLGTLYPEATLKELLLWAVKRGLHVLSDEIYANSKFGLVTKNAVMEGLLSAETAAELVHTAYGMSKDFGMNGFRVGCLHTKNKDLLEFWQNMGMFAAVSNDTQHALAIMLEDENFVDKYVKENNRRLKKSYELLTKSFEAANLRYMPACAAMFCWLDLKSLLTEPTFTAEDNLWKEILDECRIVLTPGGQACHYAEPGFFRVCYASMAPASLEIACARLTGFAEKKRRKRKSRDGQLDIDTLRTNH

SEQ ID NO: 51369 - protein, 321 aa, Dianthus caryophyllus
MANIVNFPIIDMEKLNNYNGVERSLVLDQIKDACHNWGFFQVVNHSLSHELMDKVERMTKEHYKKFREQKFKDMVQTKGLVSAESQVNDIDWESTFYLRHRPTSNISEVPDLDDQYRKLMKEFAAQIERLSEQLLDLLCENLGLEKGYLKNAFYGANGPTFGTKVSNYPPCPKPDLIKGLRAHTDAGGIILLFQDDKVSGLQLLKDGHWVDVPPMKHSIVVNLGDQLEVITNGKYKSVMHRVIAQTDGNRMSIASFYNPGSDAVIYPAPTLVEKEEEKCRAYPKFVFEDYMNLYLKLKFQEKEPRFEAMKAMETTGPIPTA

SEQ ID NO: 51370 - protein, 252 aa, Prunus caroliniana
AHYKSEADVGNAIAEAIRSGLVKREELFITSKASNHGHVVEACKNSLKKLQLDYLDLYLVHYPLATKHSGVGTTASLLDENKVLDIDVTVSLETTWHDMEKTVSLGLVRSIGLSNYELFLTRDCLSYAKIKPQVSQFETYPYFQRESLVKFCKKHGVTPMAHTPLGGATANVKSFGSISPLEDPVLLGLAKKYKKSVAQIALRWNIERDTPVIPKSSKVERLKENLEVLNFKLEKEDIELINTIDKKSRTTL

SEQ ID NO: 51371 - protein, 337 aa, Triticum aestivum
MAPLGDTVASVASAAAPGLVVSFGEMLIDFVPDVAGVSLAESGGFVKAPGGAPANVACAISKLGGSSAFVGKFGDDEFGHMLVDILKQNGVNAEGCLFDQHARTALAFVTLKSNGEREFMFYRNPSADMLLTEAELNLDLIRRARIFHYGSISLITEPCRSAHVAAMRAAKSAGILCSYDPNVRLPLWPSAQAARDGIMSIWKEADFIKVSDEEVAFLTQGDAHDEKNVLSLWFEGLKLLVVTDGEKGCRYFTKDFKGSLPGYTVNTVDTTGAGDAFVGSLLLNVAKDDSIFYNEAKLREVLQFSNACGAICTTKKGAIPALPTTATALELISKGTN

SEQ ID NO: 51372 - protein, 361 aa, Zea mays
MKALILVGGFGTRLRPLTLSFPKPLVDFANKPMILHQIEALKEVGVTEVVLAINYRPEVMINFLKDFEDKLGITITCSQETEPLGTAGPLALARDKLADGSGQPFFVLNSDVISEYPFAELIKFHKCHGGEATIMVTKVDEPSKYGVVVMEEATGRVERFVEKPKIFVGNKINAGIYLLNPSVLDRIELRPTSIEKEVFPQIAADQQLYAMVLPGFWMDVGQPRDYITGLRLYLDSIRKKSAAKLATGAHVVGNVLVHESAKIGEGCLIGPDVAIGPGCVVEDGVRLSRCTVMRGVRIKKHACISNSIIGWHSTVGQWARIENMTILGEDVHVCDEVYSNGGVVLPHKEIKSSILKPEIVM

SEQ ID NO: 51373 - protein, 712 aa, Arabidopsis thaliana
MMKELILLEEGWSVMKTGVAKLQRILEDLSEPPFDPGQYINLYTIIYDMCLQQPPNDYSQELYNKYRGVVDHYNKETVLPSMRERHGEYMLRELVKRWANHKILVRWLSRFCFYLDRFYVARRGLPTLNDVGFTSFHDLVYQEIQSEAKDVLLALIHKEREGEQIDRTLVKNVIDVYCGNGVGQMVIYEEDFESFLLQDTASYYSRKASRWSQEDSCPDYMLKAEECLKLEKERVTNYLHSTTEPKLVEKVQNELLVVVAKQLIENEHSGCLALLRDDKMGDLSRMYRLYRLIPQGLEPIADLFKQHVTAEGNALIKQAADAATNQDASASQVLVRKEIELHDKYMVYVDECFQKHSLFHKLLKEAFEVFCNKTVAGASSAEILATYCDNILKTRGGSEKLSDEATEITLEKVVNLLVYISDKDLFAEFYRKKQARRLLFDRSGIMKEVTDITLARELQTNFVDYLSANMTTKLGIDFTVTVLTTGFWPSYKTTDLNLPTEMVNCVEAFKVFYGTKTNSRRLSWIYSLGTCHILGKFEKKTMELVVSTYQAAVLLLFNNAERLSYTEISEQLNLSHEDLVRLLHSLSCLKYKILIKEPMSRTISKTDTFEFNSKFTDKMRKIRVPLPPMDERKKVVEDVDKDRRYAIDAALVRIMKSRKVLAHQQLVSECVEHLSKMFKPDIKMIKKRIEDLINRDYLERDTENANTFKYVA

SEQ ID NO: 51374 - protein, 540 aa, Glycine max
  misc_feature (150)..(150): Xaa can be any naturally occurring amino acid
METRMLRLSIQRVRKLNFLRPQISALGRSHLSTAAEPSSSKSNPPRVPNLIGGSFVDSKASTVIDVINPATQEVVSQVPLSTHEEFKAAVSAAKEAFPSWRNTPITTRQRVMLKLQELIRRDMDKLALNVTTEQGKTLKDAQGDVFRGLXVEHACGMATLQMGEYVSNVSHGIDTYSIREPLGVCAGICPFNFPAMIPLWMFPMAVTCGNTFVLKPSEKDPGASVMLAELALEAGLPEGVLNIVHGTHDIVNAICDDENIKAISFVGSNVAGMHIYSRAAAKGKRVQSNMGAKNHAIVMPDANVDATLNALVASGFGAAGQRCMALSTVVFVGGSKPWEDKLLERAKALKVNAGTEPDTDLGPVISKQAKERIHRLVQSGVESGARLLLDGRNIVVPGYESGNFIGPTILSDINANMECYKEEIFGPVLLFMEADSLEEAINIINSNKYGNGASIFTTSGVAARKFQTEIEAGQVGINVPIPVPLPFFSFTGNKASFAGDLNFYGKAGVNFYTQIKTITQQWKDSTGGSRINLAMPTSQK

SEQ ID NO: 51375 - protein, 470 aa, Vibrio campbellii AND4
MNAIVDVEIGHLLQQKLDKLKTAYNQEPYPSLALRKQKLNLLKQTILNHQQVLVEALSADFGYRSEFDSAMTDVLPTVAQINYTLKRLNRWCQPSRRHAGLLLAPSKVTVEYQPVGVVGIISPWNFPVILSLSPLVTALAAGNRVMIKLSEFTPMTNKVISEICRVLPEDIEVVEGEAKVAQAFSQLPFDHLLFTGSTNVGRAVARAAAQNLTPITLELGGKSPVIVAGDANLNKAVDAILFGKCINAGQICVAPDYAFVPEGKVKEFVALFLQRFEELYLKGQKSQGFTHIINQRQYDRLKAMLKDAKDKGAEIHTVPEISTEGRRLYPHLVTHVSEEMTIMQEEIFGPFMPIKPYRDIQDVISYINQNQRPLALYIMSDDRRTVEHITRHTHSGGVGVNDTVLHVGAEDAPFGGIGESGIGHYHGEEGFRTFSHAKTILNTPTWLPRVGILMERRSMAIKALQKFFMR

SEQ ID NO: 51376 - protein, 69 aa, Zea mays
MADWGPVVIATVLFVLLTPGLLFQLPAHGRIVGFGTMHTSGIAILVHAVLYFALITIFLIAIGVHIYAG

SEQ ID NO: 51377 - protein, 396 aa, Photobacterium sp. SKA34
MFEKITAAPADPILGLTEEFKADTRATKINLGVGIYKDETGNTPVLATVKKAEAILLEKEKTKSYLSIPGTPEYGLAVQELLFGNDATIITEKRAQTAQAPGGTGALRVAAEFIKRQLGDVKVWISNPTWANHHGVFGAAGLETQPYSYYNAETSDIDFDAAITDLSQASQGDIVLLHGCCHNPTGIDPTTEQWQTLAKLCIEKKLLPMFDFAYQGFARGVEDDAQGLRIFADQLPELLVASSFSKNFGLYNERVGAFTLVGKTAEQAATAFSQVKSIARVIYSNPPAHGAAIVTTILNNAELRAEWEQEVADMRDRIQEMRTLFVNTLKELGVTNDFSFIERQNGMFSFSGLSKEQVTQLKNDFAIYIVGSGRISVAGMTKDNMMPLCKGIAAVL

SEQ ID NO: 51378 - protein, 751 aa, Oryza sativa Japonica Group
MAILSDVATEVLIPIAAIIGIGFSIAQWVLVARVKLAPSQPGASRSKDGYGDSLIEEEEGLNDHNVVAKCAEIQNAIAEGATSFLFTEYQYVGVFMSIFAVVIFLFLGSVEGFSTKTHPCTYSKDKECKPALFNALFSTVSFLLGAITSVVSGFLGMKIATYANARTTLEARKGVGKAFITAFRSGAVMGFLLASNGLLVLYIAINLFKMYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGINHDFTGMCYPLLVSSMGIIVCLITTLFATDFFEIKAVKEIEPSLKKQLIISTALMTVGIALVSWLALPYKFTIFNFGEQKEVTNWGLFLCVSIGLWAGLIIGYVTEYYTSNAYSPVQDVADACRTGAATNVIFGLALGYKSVIIPIFAIALGIYVSFTIAAMYGIAVAALGMLSTIATGLSIDAYGPISDNAGGIAEMAGMSHRIRERTDALDAAGNTTAAIGKGFAIGSAALVSLALFGAFVSRAGVKVVDVLSPKVIIGLIVGAMLPYWFSAMTMKSVGSAALKMVEEVRRQFNTIPGLMEGTGKPDYANCVKISTDASIKQMIPPGALVMLTPLIVGTLFGVQTLSGVAISASNTGGAWDNAKKYIEAGASEHARSLGPKGSDCHKAAVIGDTIGDPLKDTSGPSLNILIKLMAVESLVFAPFFATHGGILFKLF

SEQ ID NO: 51379 - protein, 418 aa, Streptomyces avermitilis MA-4680
MTQLPGLLDTEAIRKDFPILDRQVHDGKKLVYLDNAATSQKPRQVLDALSGYYERYNANVHRGVHVLAEEATALYEGARDKVAAFINAPSRDEVIFTKNASESLNLVANMLGWADEPYRVDHETEIVITEMEHHSNIVPWQLLAQRTGAKLKWFGLTDDGRLDLSNIDEIITEKTKIVSFVLVSNILGTVNPVEAIVRRAQEVGALVCIDASQAAPHMPMDVQALQADFVAFTGHKMCGPTGIGVLWGRQELLEDLPPFLGGGEMIETVSMHSSTYAPAPHKFEAGTPPIAQAVGLGAAIDYLDSIGMDKILAHEHALTEYAVKRLMEVPDLRIIGPTTAEDRGAAISFTLGDIHPHDVGQVLDEQGIAVRVGHHCARPVCLRYGIPATTRASFYLYSTPTEIDALVDGLEHVRNFFG

SEQ ID NO: 51380 - protein, 242 aa, Colwellia psychrerythraea 34H
MFTDITGQKVPSVTFPIIADDTWSTRNSEEIFANKTVVVFSLPGAFTPTCSSSHLPRYNELATKFSANGVDEIICISVNDTFVMNAWAKDQDADNISFIPDGNGEFTQGMGLLVDKAAIGFGKRSWRYAMLVKNGVIEKMFIEPDLPGDPFEVSDADTMLNFINPEAVQSTEVAIFTKHGCSHCTKAKALLAEQGLQYEELVLGEDTTITAMRAISNADTTPQIFIDGKHIGGNDELVKHFS

SEQ ID NO: 51381 - protein, 217 aa, Burkholderia pseudomallei K96243
MINRAQLLDTLASQAPRDFEAQALGLVPIVVETSGRGERSYDIYSRLLKERIVFMVGEVNDQTANLVVAQLLFLESENPDKDISLYINSPGGSVSAGMAIYDTMQFVKPDVSTLCMGLAASMGAFLLASGAKGKRYALPNARVMIHQPLGGARGQASDIEIQAREILYLRDRLNHLLAHHTGQDVERIARDTDRDNFMSSEDAKAYGLIDHVSTKRP

SEQ ID NO: 51382 - protein, 538 aa, Pseudomonas aeruginosa PAO1
MLDFSAHALPYASQRSPVHARRGMVATSQPQAAQVGLEILRRGGNAIDAAIATAAALTVVEPTGCGIGGDAFALVWTRGRLHGLDASGRAPGLLDRERVRAAGHERMPLYGWTPVTVPGCPAAWGELSRRFGKLPFEQLLRPAIELARDGFPVSPVIARLWQSGLDKFRAALPQRPELRAWFDEFLIDGRAPRAGEVFRQPGQADTLDELARSQCESFYRGELARAIVGHAECSGGYLRAEDLAGYQAKWVEPISLNYRGYDVWEIPPSGQGLIALMTLNILKGFEFGERDCARTWHRQLEAMKLAYVDGLHYISQPQSMRVSVEELLHEDYAASRRALIGERALDPSPGQPRPGGTVYLACGDEEGNLVSFIQSNYHGFGSGVVVPGTGIALQNRGAEFSLDPDHVNCLEPGKQTFHTIIPGFLSKDGVPLGPFGVMGAYMQPQGHVQMVMNLVDFGLNPQAALDAPRWQWLGGLRVGIEHAAPRALAAELAQRGHQVEIAYDSTSYGRGQIVLRDPASGVLCGGTEPRTDSQIAVW

SEQ ID NO: 51383 - protein, 618 aa, Arabidopsis thaliana
MEGLIQTRGILSLPAKPIGVRRLLQPSHGLKQRLFTTNLPALSLSSNGHKKFQAFQQIPLGISVSHKERSRGFICKAEAAAAGGGNVFDEGDTAAMAVSPKIFGVEVTTLKKIVPLGLMFFCILFNYTILRDTKDVLVVTAKGSSAEIIPFLKTWVNLPMAIGFMLLYTKLSNVLSKKALFYTVIVPFIVYFGAFGFVMYPLSNLIHPEALADKLLATLGPRFMGPLAIMRIWSFCLFYVMAELWGSVVVSVLFWGFANQITTVDEAKKFYPLFGLGANVALIFSGRTVKYFSNMRKNLGPGVDGWAVSLKAMMSIVVGMGLAICFLYWWVNRYVPLPTRSKKKKVKPQMGTMESLKFLVSSPYIRDLATLVVAYGISINLVEVTWKSKLKAQFPSPNEYSAFMGDFSTCTGIATFTMMLLSQYVFKKYGWGVAAKITPTVLLLTGVAFFSLILFGGPFAPLVAKLGMTPLLAAVYVGALQNIFSKSAKYSLFDPCKEMAYIPLDEDTKVKGKAAIDVVCNPLGKSGGALIQQFMILTFGSLANSTPYLGVILLGIVTAWLAAAKSLEGQFNTLMSEEELEREMERASSVKIPVVSQEDAPSGETTSQLSEKSTPTGI

SEQ ID NO: 51384 - protein, 598 aa, Staphylococcus epidermidis ATCC 12228
MFNMSLELPVMLTIVLFLALGIFSQWLASRIKWPSIVVMAIVGLLVGPIFGLANPKEALGPEAFSSIVSLAVAIILFEGSSNLDFRELKGISKAVIRIITIGAGIAWILGAIALHVTMNFPLSISFVIGGLFLITGPTVIQPLLKQAKVKRNVDSVLRWESIILDPIGPIIALTAFYVFQIFEEGIGFVVIILFILKLLAAILIGFGAAFLFNWLIGQDKIPQSLMPPIQLVFILLTFSICDEILSESGLLAVTIFGLMMARKKRHDLIFKESDHFIDNASSILVSTVFILITSSLTKDVLLNVLSWQLILFSLVMIVLVRPISVLLSTLGTEITKKERVVVALMAPRGIVVLTVAQFFSSLFMDDKIPMAQYITPVTFGLVFITVVIYGFGFTPLSKLFGVASTEPPGVIIVGESEFSFHLGINLRDHGIPVMMFNLFENTSEKAHEAGFEVFKGNLLSSNDRIYSDLLRYNKCILMTQSFIFNSLAFNELVPEFGLNNVDMMPVSFNDEQARNNLNGPIRNHILFDENHTPRWFNQFITQHNIVEVPAEDYEKITENDMLIYHINEDKEVTFKRSNRDIPEHETGVYGILKNAYLT

SEQ ID NO: 51385 - protein, 758 aa, Saccharomyces cerevisiae
MIIRAPIRTKTKSFRGDQMDFKFPSNESLPRGTLEEYHLNNHHLLNDVFAAENGVSRDEDGNSQTLSDYTSTSNTNTNSGYSSNGYYSFANISDNTTSSPRIVINQNETARLTSSDSNKSDFFASHDFPGNDSLHYSSSNVVKNQLHSMEAIPEGNITGSISTAFQTIPTADNVSYDIAPSSASSLLPRKSTSKSAILPSTQEAKPMTKLNMEKDIKTIELNNSVVPKPKKKLNRVPTIRRVESSRFSNSRYSSSVSSKSSSSRCSLKRSKAIRCKGGLLYYFTSLGIKIKKKLRKLRLVLRRRLFSYNVQKVPSATNSKTTKSKANINNKSKKRGTNLVNKNSNSTPRQKKSQRYVSNLQRSISSKSLVPVLAPQKKTKPLTVDTKFKANHPQSEDSKVGSNTPRSPLVSYTPSLRRTNSSIRRAASILTASATMTPANNKNSFISVPDNVSHAVTRNSSMYSRSRLVRSKPSTALNAIARQPSIVVENKVIPLSMNRYSIKEEDEYVIDTSSMRELSPVNSVCSSDYDRESSESYSNYADAMETTEVDNKDRVECNNEIQNVDANNEETSNEESYNLMKHYLSTVIAQRIMLRVQIARIQNYKSNVVYMNKSAETNSTIYEDLVDSLLTEYEADGSSSQIFDGVTVRADEEEEEDEDDEDDEEEEEENDDEEDEEDEEDDEDDEEEEEKRKEGEGRNLAKEVDELAELSPMRKQSDLSITLRSPFAMLNPAYSNSIISLPTGVVKRSLTLPVGMKI

SEQ ID NO: 51386 - protein, 479 aa, Staphylococcus epidermidis ATCC 12228
MEVFNMTNQLFINNEFIESQSKETMDVINPATGEAFDTITLATEEEVNDAIEKSQQAQLEWERVPQPTRAEHVKLLIPLLEKNRDEIAQLYVKEQGKTLTQAYGEIDKSISFIDYMTSLSMSDKGRVLQNSIANETIQIINKPIGVTAGIVPWNAPILVLMRKVIPAIVTGCSVVIKPSEETTLLTLRLAELFRASTIPAGLIQIVPGTGETVGTQLASHKDIQLISLTGSMRAGKSVYENAAQTVKKVNLELGGNAPVIVTSNADLDKAVNYIVTARINNAGQVCTCPERIFVHEDVHDDFLNKVTSKMKSLTVGDPFDENTDYGAIINQKQLDSIHEKVQDAIKNGATLMTGGHQLKRHGFFYAPTVLDNVRKDDNVFKDEIFGPVLAITTYRDFEQVIEDANDTNAGLSSYIFSENLTEVMTATERLKFGEVYANCEAEEVVNGYHAGWRESGLGGADGIHGFEEYYNTTVSYIRY

SEQ ID NO: 51387 - protein, 174 aa, Zea mays
  misc_feature (89)..(89): Xaa can be any naturally occurring amino acid
PTAPTYHIITYEPRVLSQSPQSDSTFFMIKPDGVQRGLIGEIISRFEKKGFYLKALKLVNVDRSFAEMHYDDLSSKAFFQGLVDYIISXGPVQLMGRVEGNERRYTCCPLRSLWPSCTLSSEPVSIRVDFDVDIVRNDIHGTDIIASDIKDIALRVPDGPVDWHSSHHPCIYDN

SEQ ID NO: 51388 - protein, 539 aa, Bacillus halodurans C-125
MIICSLQHVKQMYGAHTVFHDICCEVKKGERIGIIGRNGEGKSTLLHVMAGKEPPSEGTVTRKKGLSLGLLEQLPKLDPEKPVRGLLHDVFSDLNELKGKLAEIERALAENPASLEQLLETYGSLQDQFLQLGGYEIDSRINRVVSGLQLVHLLDKKWQELSGGERTKIGLARLLLRSPELLLLDEPTNHLDLSAIEWLTDFIRQYDGTVVIVSHDRYFLDEVTTSIFELEHGELHTYQGNYSSYMKEREERILREFQHYQDQQKKIKKMKETIKRLKEWANRSNPPNDGLHRRAKSMEKALARIELLKKPILQHKKVDLDFHIQNRSGTDVIMMENVAKTYGERELFHDVQLHVRFQERVAIVGENGSGKSTLLNMILGKQQPEKGRIQIGSNVSIGYLSQHNEEMDGKKTILEEFRAKVTVTEGEARHILARYLFYGNTVFRKVKDLSGGERMRLRLAQLVHQRHNLLILDEPTNHLDIDSREVLEEALSEFQGTVIAVSHDRYFLDRLFPVTYWLAGHLLTRHEGNYTFAREKRKY

SEQ ID NO: 51389 - protein, 436 aa, Rubrobacter xylanophilus DSM 9941
MRPGELHERHRAALPAWLSLYYERPIELVRGEGFRVWDSEGNEYLDFFGGIVTTISGHAVPEIVEAVKEQAERILHSSTLYLIESQVRLAEKLISLSPISGEQKVFFVGSGSEANEAALLFATQYRGSSEVIALRGSYHGGSFGTMGITGQSSWRPTPRTALDVSYAMPPHRSYSPLYGRFGDPEELARACAEDVRSLIETSTTGRVAAFIAEPIQGVGGFIELPPAYLSRVKEILEEHGVLFVSDEVQTAFGRTGSHFWGIERSGVEPDLITMAKGLGNGLAIGAVMGRAEVIDSLSPKLHISTFGGNPVSTAGALANLEYILENDLQRNAEEVGSYLKERLLGLAAEHASVGEVRGRGLMLAVELVREGAPDPQAAAAFMEACRERGVLVGKGGLKGNAIRISPPLTVTREAAEEAARVFDEALSSVEAGERVV

SEQ ID NO: 51390 - protein, 315 aa, Alkaliphilus metalliredigens QYMF
MNTSGSGIKIFCGNSNTELASKIAEILGGEIGEAEVSTFSDGEISVNILETVRGADVFVVQSTNPPVNDNLMELLIMIDAFKRASAGRITAVLPYYGYARQDRKAKARDPITAKLVADILTTAGADRVLTMDLHAAQIQGYFNIPVDHLLGVPILAKYFKEKNLKDVVVVSPDLGSVTRARNLANHLDAPIAIIDKRRPKANVAEIMNIIGEIEGKNVILIDDMIDTAGTITQGANALKEFGAKDVYACCTHPVLSGPAMERIENSVIKELIITDTIPLPPEKHSDKIKIMTVAPVFAEAIRRIYNNVSVSKLFD

SEQ ID NO: 51391 - protein, 497 aa, Staphylococcus epidermidis ATCC 12228
MTNINVRNYIDESYGLFINNEFQASDSGETLTVSNPANGEDLAKVARAGKKDVDKAVQAAHDAFDSWSKISKEERADYLLEISRRIHEKTEHLATVESLQNGKPYRETSTIDVPQAANQFKYFASVLTTDEGSVNEIDQNTMSLVVNEPVGVVGAVVAWNFPILLASWKLGPALAAGNTVVIQPSSSTPLSLIELAKIFQEVLPKGVVNVLTGKGSESGDAIFHHEGVDKLSFTGSTDVGYGVAQAGAERIVPTTLELGGKSANIIFDDANLEQVIEGVQLGILFNQGEVCSAGSRLLVQSSIYDELLPKLKEAFENIKVGDPFDEDTKMSAQTGPEQLDKIESYIKIAEEDDKANILTGGHRITDNGLDKGYFFEPTIIEINDNKHQLAQEEIFGPVVVVEKFDDEQEAIEIANDSEYGLAGGIFTTDIHRALNVAKAMRTGRIWINTYNQIPAGAPFGGYKKSGIGREVYKDAIKNYQQVKNIFIDTSNQTKGLY

SEQ ID NO: 51392 - protein, 401 aa, Chromobacterium violaceum ATCC 12472
MNPRLDQLHPYPFQRLAALLADAKPPASLPHISLAMGEPKHPAPQLVKDALCANLAGLSGYPATQGTPALRQACADWAERRYGVRLDPASEVLPVNGSREALFSLTQCLIDAGGAAKPVVVSPNPFYQIYEGAALLAGAEPHYLNCEAENRFQPDWDGVPDEVWRRAQLVIVCSPGNPTGAVMDLAAWDKLFALSDRYGFVIASDECYSEIYFDQPPLGGLSAARALGRGLERLVMLTSLSKRSNVPGMRSGFVAGDAAILKQFLLYRTYHGSAMSLTVQAASVAAWNDEAHVESNRAAYAAKFAAVLPLLQPVLEVERPEAGFYLWAKVPDGDDAAFARALFQQRHVTVLPGSYLARDAHGANPGRGYVRIALVAEQAECVAAAQRIVEFTQTQRAATPA

SEQ ID NO: 51393 - protein, 221 aa, Escherichia coli
DLLDADYMAYMLKYDFTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYE

SEQ ID NO: 51394 - protein, 316 aa, Frankia sp. CcI3
MRAVVMDRFGGPEVLTVRDVADPVPGRGQVLVAVEYAGITFVETQVRAGRGPALRNPPPLPRVPGNGVGGQVVAVGADVDPALAGVVVVTTTGGTGGYAELAVADADDLIPVPSTVPVRDAVALLADGRTAVLLHGQAEVKPAESVLVEAAGGGLGSLLVQLSAAAGATVIGAARGTAKRELVMSLGAAAYVDYSRPGWTLEVVEATRGTGVDLVYDGVGGDIGAHALTTLRAGGRISIHGMASGSWTEPPAGVTVISGDTPTPEQMRALAAEALAQAAAGRLRPIIGQTYPLGEAAAAHQAIEDRETAGKTLLVP

SEQ ID NO: 51395 - protein, 91 aa, Vitis vinifera
MNKNLYWQGTLSQGCAWLSLRGIMWSISYYFLMPWACLCMGIFLVKTIKRVLFAEVRSYVSSKHHYLLLLIALAQFPLFIWLGNISLHWLF

SEQ ID NO: 51396 - protein, 344 aa, Rhodobacter sphaeroides 2.4.1
MRIQRDLAEAIGNTPLIRLRKASELTGCEILGKCEFLNPGQSVKDRAALYIIRDAVAKGLLQPGGTIVEGTAGNTGIGLSLVGASMGFRTVIVIPETQSQEKKDMLRLAGAHLVQVPAAPYRNPNNYVRYSGRLAEALARTEERGAIWANQFDNTANRQAHVETTGPEIWEQTDGKVDGFICAVGSGGTLAGVAMALQPRGVKIGLADPEGAALHSFYTEGTFEAPGSSITEGIGQGRITANLEGLTPDFSYRIPDAEALPIIFDLMQEEGLCLGGSSGVNIAGAIRMAREMGPGHRIVTVLCDYGNRYQSKLFNPQFLRDKGLPVPQWLDEAPPAIPAVFEDL

SEQ ID NO: 51397 - protein, 296 aa, Arabidopsis thaliana
  misc_feature (128)..(128): Xaa can be any naturally occurring amino acid
MRNKSQSFISSKLIFICCSILVLFILFLKRASFSSNSTATIRDEYHQKSKCPSTPQQCTKLPTSLSDALVHYVTSEITPQQTFDEVSVSKRVLDKKSPCNFLVFGLGHDSLMWASLNHGGRTCKLFIXMFLEEDEAWIETVTKKFPNLESYHVVYDTKVKDSNKLMELKRTEDCKAVSDPRDSKCALSLKGFPADVYETQWDVIMVDAPTGYHDEAPGRMSAIYTAGLLARNRYDGGETDVFVHDINRPVEDEFSVAFLCGGYMKEQQGRLRHFNIPSHRASFGTPFCPADISRRF

SEQ ID NO: 51398 - protein, 216 aa, Brassica napus
  misc_feature (59)..(59): Xaa can be any naturally occurring amino acid
KSKDYYKKIGKAGKRGYLWFGPPGTGKSTMIAAMANFLEYDVYDLELTTVMDNTQLRRXEDGDDKEAIEKKMMKNEGDKKESKVTLSGLLNFIDGLWSACGGERIIVFTTNFVDKLDPALIRKGRMDKHIEMSYCGFEAFKVLAKNYLDVVESELFDEIKMLLEVEEIKMTPADVGENLLPKSEGEEGETCLRRLIEALKEEKEEAKRRVEEEVKP

SEQ ID NO: 51399 - protein, 470 aa, Helicobacter pylori 26695
MKIKNILLSGGSGKRLWPLSRSLYPKQFLKLFDHKSLFELSFKRNASLVDETLIVCNEKHYFLALEEIKNEIKNKSVGFLLESLSKNTANAIALSALMSDKEDLLIVTPSDHLIKDLQAYENAIKKAIDLAQKGFLVTFGVSIDKPNTEFGYIESPNGLDVKRFIEKPSLDKAIEFQKSGGFYFNSGMFVFQAGVFLDELKKHAPTILKGCERAFESLENAYFFEKKIARLSEKSMQDLEDMSIDIALMQQSHKIKMVELNAKWSDLGNFNALFEEAANEPKENVSLNQTPVFAKESENNLVFSHKVSALLGVENLAVIDTKDALLIAHKDKAKDLKALVNEVETNNQELLQTHTKVYRPWGSYEVLHESGCYKVKILEVKPNARLSLQKHFHRSEHWVVISGMASVELDHQLFELQANESTYIPKNTLHRLANYGKIPLIIIEVQVGEYVGEDDIVRIDDDFNRQNQNA

SEQ ID NO: 51400 - protein, 471 aa, Bacillus megaterium
TIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIEGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPLGGIPSPSTEQSAKKVR

SEQ ID NO: 51401 - protein, 365 aa, Bordetella pertussis Tohama I
MADGTIFRGVSIGVPGHTVAEVVFNTSMTGYQEILTDPSYAGQTVMLTYPHIGNTGVNPEDVEANRVYAAGLVVRDCPARVSNFRATQSLPEYLNAQGIVAIAGIDTRKLTRILRESGAQGSCILVGEDAERAVELARGFPGMSGQDLAKVVSIKERADWTQGTWELGSGYTQPAQDRFHVVAYDYGVKSNILRLLADRGCRVTLVPAQTTAEEAFKLQPDGVFLSNGPGDPEPCDYAVDATRAFLERKLPVFGICLGHQLMGLALGGKTVKMKTGHHGANHPVQDVQSGRVFITSQNHGFAVDAATLPANTRVTHISLFDGTLQGFELTDRPAFCFQGHPEASPGPHDIIVLFDKFISLMAGQK

SEQ ID NO: 51402 - protein, 324 aa, Nicotiana tomentosiformis
MSFLRFVGTILFLVAIFAASNAQLSATFYDSTCPNVTSIVRGVMDQRQRTDARAGAKIIRLHFHDCFVNGCDGSILLDTDGTQTEKDAAPNVGAGGFDIVDDIKTALENVCPGVVSCADILSLASEIGVALAEGPSWQVLFGRKNSLTANRSEANSDIPSPFETPAVMTPLFTNKGMDLTDLVAQSGAHTFGRARCGTFEQRLFNFSGSGNPDPTVDATFLQTLQGICPQGGNNGNTFTNLDISTPNDFDNDYFTNLQNNQGLLQTDQELFSTSGSATIAIVNRYAGSQTQFFDDFVSSMIKLGNISPLTGTNGEIRTDCKRVN

SEQ ID NO: 51403 - protein, 421 aa, Glycine max
MMASESQNWVFMVTAQTPTNIAVIKYWGKRDETLILPVNDSISVTLDPSHLCTTTTAAVSPAFHQDRMWLNGKEISLSGGRFQSCLREIRARACDVEDETKGIKITKEDWGKLHVHIASYNNFPTAAGLASSAAGFACLAYALGKLMNVKEDESQLSAIARQGSGSACRSLFGGFVKWIMGKEDNGSDSLAVQLTDEKHWDDLVIVIAVVSSRQKETSSTTGMRESVETSLLLQHRAKEIVPKRILQMEEAIKNRDFASFSQLTCADSNQFHAVCLDTCPPIFYMNDTSHRIISIVEKWNRSEEAPQVAYTFDAGPNAVLIARNRKAATSLIQRLLYYFPPNSDDLSSYIIGDKSIAKDAGINGIQDVEALPPPPEIKDNIPSQKYKGDVSYFICTRPGRGPVLLSDSIQALLNDETGLPK

SEQ ID NO: 51404 - protein, 540 aa, Burkholderia pseudomallei K96243
MTLNSLPVWPALQAHYEEIRDAHLRDWFAPANDRAPTRAERFTFEGGGLAADFSKNRLTDATLALLVRLAREAGVEARRDAMFAGETVNPTEGRAALHTALRANAPDAPFQAQVAAERAKMARFADAVRSGAWTGYTGKRIRHVVNIGIGGSDLGPKMVVHALHHVATPDIATHFVSNVDGADLARVLERIDPEATLAIIVSKTFTTLETMTNARSLRDWFVANGCPEGALAKHFVGVSANPAEVVKFGIAEANVFEMWDWVGGRYSLWSAVGLSIMIAIGPERFDELLAGARDMDEHFRTAPLERNLPVLQGLVGIWYRNFFGAQSYLVAPYSEALHYLPSYLQQLEMESNGKSARIDGAFVDYPTSAVTWGEPGTNGQHAFFQMLHQGPTLVPIDFIAVLTPEHPLASHHPKLLANCFAQSEALMLGRTLDEARKIVGPAKPELAPHLTFPGNRPTTTLLVDALTPRTLGALIALYEHKVLVQAAVWNINPFDQWGVELGKILGKVVEADLTAAQVDPAKHDSSTSALIARARKALGE

SEQ ID NO: 51405 - protein, 434 aa, Beta vulgaris
MDRYKLLKELGDGTCGTVYKAVNRESYEIVAVKKMKRKFYFWEECVNLREVKSLPSIESSHIIKLKEVVRENNDLFFIFEYMQYNLYQIMKDRHRPFTEEEIRNFLTQVLQGLAHMHRNGYFHRDLKPENLLVTNDVIKIADFGLAREVSSIPPYTEYVSTRWYRAPEVLLKSSLYTPAIDMWAVGAVLAELFTSCPIFPGESETDQLYKICCVLGAPDWAVFPEAKNISQLTSISYSQMLPANLSEIIPNANWEAIDLISQLCSWDPLKRPTAEQALHHPFFHVALRVPRPIHDPFHSKPDYTKTKPNLELNLWDFDSKADDCFLGLTLAVNPGVSSLEMGPRVSGSTRQDVYFCSSFQDHPEQSVFWSLFSPCRNGATPPVDPSLSLSFSSITHPRIAVPHSGGFGLAALQPGILDGPLLVVSSPHQPSHYL

SEQ ID NO: 51406 - protein, 444 aa, Physcomitrella patens subsp. patens
RSVDSEEQDRAPSTSPEPGEFRQEKTSGNIGKSSQDGEEYERELNKKELQELDEDDGSEDREMQQPEIESEPEVSPILNGAQTRAIDMLKGCRSVDEFEKLNKIDEGTYGVVFRARDKKTGELVALKKVKMEKEKGGFPMTSLREINVLLSFHHPSVVDVKEVVVGNMLDNIFMVMEYMEHDLKGLMESMKQPFSQSEVKCLMLQLFDGCKYLHDNWVLHRDLKTSNLLLNNRGELKICDFGLARQYGDPLKEYTHEVVTLWYRAPELLLGARKYSTAIDMWSLGCIMAEFLAKEPLFPGKSPIDEIDKIFKTLGTPNEKIWPDFVKLPGVRCNFTKQPFNRLREKFPATAFAGRPTLSEKGFDLLNRLLTYDPSKRITADEALSHPWFREVPLPKAKEFMPTFPARSEHDRRIRRLMKSPDPLEEQRKRELKRAELGGGGLFG

SEQ ID NO: 51407 - protein, 585 aa, Bacillus subtilis subsp. subtilis str. 168
MRKTKIVCTIGPASESIEMLTKLMESGMNVARLNFSHGDFEEHGARIKNIREASKKLGKNVGILLDTKGPEIRTHTMENGGIELETGKELIISMDEVVGTTDKISVTYEGLVHDVEQGSTILLDDGLIGLEVLDVDAAKREIKTKVLNNGTLKNKKGVNVPGVSVNLPGITEKDARDIVFGIEQGVDFIAPSFIRRSTDVLEIRELLEEHNAQDIQIIPKIENQEGVDNIDAILEVSDGLMVARGDLGVEIPAEEVPLVQKELIKKCNALGKPVITATQMLDSMQRNPRPTRAEASDVANAIFDGTDAIMLSGETAAGSYPVEAVQTMHNIASRSEEALNYKEILSKRRDQVGMTITDAIGQSVAHTAINLNAAAIVTPTESGHTARMIAKYRPQAPIVAVTVNDSISRKLALVSGVFAESGQNASSTDEMLEDAVQKSLNSGIVKHGDLIVITAGTVGESGTTNLMKVHTVGDIIAKGQGIGRKSAYGPVVVAQNAKEAEQKMTDGAVLVTKSTDRDMIASLEKASALITEEGGLTSHAAVVGLSLGIPVIVGLENATSILTDGQDITVDASRGAVYQGRASVL

SEQ ID NO: 51408 - protein, 363 aa, Physcomitrella patens subsp. patens
MDLEGRAIEELAKAQLEVLGLAVSVVFPAALNAVVKMQVAEVLATAAEEGHRSLSADEIVARMPNRPSQPNSKNLERLLRVLSFKGVFKEEARHDKRRTFRLTPMSSALIRNLPEGTMANYVLLTSLGQEFIESCKHLTAAVLESKVPFAMAHGGKHQFQYCAANPDYSNVFQAAMTDHSHQLVDLMLAKFEGFKDVQRMADVGGGVGTTIGRIVEQYPHIQGINFDLPHVIAHAPQREGVEHIAGDMFESVPPDCDAFFLKNIIHDWDDELNIQILMNCHKALPSRGRVIMVDAVLPATTLLRESSLDDMCAFEADITMMAVSAHGRERDAEEWENLATTSGFTNITFVKLDYMYVIEAMKP

SEQ ID NO: 51409 - protein, 530 aa, Streptomyces ambofaciens
MTVLNDVPQVSAALVGARGRVAELHGIRAQAVAGPSEKATAAQHAKGKLTARERIALLLDAGSFQEVEQLRRHRASGFGLEAKKPYTDGVVTGWGTVEGRTVFVYAHDFRIFGGALGEAHATKIHKIMDMAIAAGAPLVSLNDGAGARIQEGVSALAGYGGIFQRNTRASGVIPQISVMLGPCAGGAAYSPALTDFVFMVRDTSQMFITGPDVVKAVTGEEITQNGLGGADVHAGTSGVAHFAYDDEETCLAEVRYLLSLLPQNNREYPPCVPCSDPAGRRGEALVDLVPADGSRPYDMTEVIGEIVDDGEYLEVHEGWARNIICALSRLGGQVVGIVANQPSALAGVLDIEASEKAARFVQMCDAFNIPVITLVDVPGFLPGVDQEHGGIIRHGAKLLYAYCNATVPRISLILRKAYGGAYIVMDSQSTGADLTFAWPANEIAVMGAEGAAGVIFRRQIAAAPDPEAMRQKMVKEYRAELMHPYYAAERGLVDDVIDPAETREVLIRSLAMLRTKHADVPSRKHGNPPQ

SEQ ID NO: 51410 - protein, 410 aa, Bacillus subtilis subsp. subtilis str. 168
MSLREEALHLHKVNQGKLESKSKVEVRNAKDLSLAYSPGVAEPCKDIHEDINKVYDYTMKGNMVAVVTDGTAVLGLGNIGPEAALPVMEGKAVLFKSFAGVDAFPIALNTNDVDKIVETVKLLEPTFGGVNLEDIAAPNCFIIEERLKKETNIPVFHDDQHGTAIVTVAGLVNALKLSGKSMSSIKVVANGAGAAGIAIIKLLHHYGVRDIVMCDSKGAIYEGRPNGMNDVKNEVAKFTNQDRKDGSLKDVIVDADVFIGVSVAGALTKEMVQSMAKDPIIFAMANPNPEIMPEDAREAGASVVGTGRSDFPNQVNNVLAFPGIFRGALDVRATHINEEMKIAAVEAIASLVSEDELSADYVIPAPFDKRVAPAVAKAVAKAAMETGVARITVDPEEVAEKTRKLTIIGE

SEQ ID NO: 51411 - protein, 452 aa, Escherichia coli W3110
MSHNVTPNTSRVELRKTLTLVPVVMMGLAYMQPMTLFDTFGIVSGLTDGHVPTAYAFALIAILFTALSYGKLVRRYPSAGSAYTYAQKSISPTVGFMVGWSSLLDYLFAPMINILLAKIYFEALVPSIPSWMFVVALVAFMTAFNLRSLKSVANFNTVIVVLQVVLIAVILGMVVYGVFEGEGAGTLASTRPFWSGDAHVIPMITGATILCFSFTGFDGISNLSEETKDAERVIPRAIFLTALIGGMIFIFATYFLQLYFPDISRFKDPDASQPEIMLYVAGKAFQVGALIFSTITVLASGMAAHAGVARLMYVMGRDGVFPKSFFGYVHPKWRTPAMNIILVGAIALLAINFDLVMATALINFGALVAFTFVNLSVISQFWIREKRNKTLKDHFQYLFLPMCGALTVGALWVNLEESSMVLGLIWAAIGLIYLACVTKSFRNPVPQYEDVA

SEQ ID NO: 51412 - protein, 113 aa, Glycine max
  misc_feature (74)..(74): Xaa can be any naturally occurring amino acid
MASESQNWVFMVTAQTPTNIAVIKYWGKRDETLILPVNDSISLTLDPSHLCTTTTVAVSSAFHQDRMWLNAKCXEISLSGGRFQSCLREIRARACDVEDENKGIKITKEDWAK

SEQ ID NO: 51413 - protein, 521 aa, Coccidioides immitis RS
MFKSGVARTFGRSAFARPASTILSSTRSAVGNNALRALSARYASTEAGKTGKIHQVIGAVVDVKFDTEQLPAILNALETENGGQRLVLEVAQHLGENVVRTIAMDGTEGLVRGAKAVDTGAPIQIPVGPGTLGRIMNVTGDPIDERGPIKGVKLAPIHAEAPEFVEQSTTAEILVTGIKVVDLLAPYARGGKIGLFGGAGVGKTVFIQELINNIAKAHGGYSVFTGVGERTREGNDLYHEMQETRVIQLDGESKVALVFGQMNEPPGARARVALTGLTIAEYFRDEEGQDVLLFIDNIFRFTQAGSEVSALLGRIPSAVGYQPTLAVDMGVMQERITTTTKGSITSVQAVYVPADDLTDPAPATTFAHLDATTVLSRGISELGIYPAVDPLDSKSRMLDPRIVGDEHYQVATRVQQMIQEYKSLQDIIAILGMDELSEADKLTVERARKLQRFLSQPFAVAQVFTGIEGKLVDLKDTIRSFKAIINGEGDDLPEAAFYMVGDFESARAKGEKILAELEKSS

SEQ ID NO: 51414 - protein, 385 aa, Crocosphaera watsonii WH 8501
MILLTAFSEESQQSLSQEIVSVVLKGGIFLLFIAFLTRYILPKLLHALAYSTELLLIFAISWAITLAAMGDSLGFSKEVGAFVAGVSLASTSYRATIGARLVSLRDFLLLFFFIDLGIHVNVSYLGAEIISAVVLSLFVLVGKTVMIMALMSIMGYGKHTSTVTNLSLSQISEFSLIIAALGLDLGHIDENVLGLITLVGLITMGVSTYMIMGSHIIYEKLLPIVSHFDKLIPHRHQKLGNLDEVDVYGVDIILFGLGRYGGSLIRALQGSDLQVLGVDFNPELVRQWRNKGLLAFYGDAEDPEFAATLPLNQAKWVISTLPGERIGLTLLHTLEYQKYQGKIALTSHTEREMEILKNAGSDLVLLPFRDAAYEAARVLVTDFNE

SEQ ID NO: 51415 - protein, 68 aa, Populus trichocarpa
MNDWAASLIAAALFAFLSPGLVFQMPGKERPLDFMNMKTSLAAIFVHLVIYGLLLVLFLVILHVHLYV

SEQ ID NO: 51416 - protein, 291 aa, Streptomyces galilaeus
MKGIILAGGSGTRLHPITVSVSKQLLPVGDKPMIYYPLSVLMLADIREILLICTERDLEQFRRLLGDGSQLGLRIDYAVQNRPAGLADAFVIGADHVGDDDVALVLGDNIFHGHHFYDLLQSNVHDVQGCVLFGYPVEDPERYGVGETDASGQLVSLEEKPLRPRSDLAITGLYLYDNEVVDIAKNLRPSPRGELEITDVNRNYLARGRARLVDLGRGFAWLDAGTPESLLQATQYVRTLEERQGVRIACVEEVALRMGFIDADMCHRLGEQMSQSGYGRYVMAVAREFSG

SEQ ID NO: 51417 - protein, 245 aa, Zea mays
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTISGKPIFHFVGTSTFSEYTVIHVGCLAKINPSAPLDKVCVLSCGISTGLGATLNVAKPKKGSTVAIFGLGAVGLAAMEGAKMAGASRNHPCGLEPCKNTQAPKKFGCTRTL

SEQ ID NO: 51418 - protein, 330 aa, Helicobacter pylori 26695
MKRMLAEFEKIQAILMAFPHEFSDWAYCIKEARESFLNIIQTIAKHAKVLVCVHTNDIIGYETLKNLPGVEIARIDTNDTWARDFGAISVENHGVLECLDFGFNGWGLKYPSNLDNQVNFKLKSLGFLKHPLKTMPYILEGGSIESDGAGSVLTNTQCLLEKNRNPHLNQNGIENMLKKELGAKQVLWYSYGYLKGDDTDSHTDTLARFLDKDTIVYSTCEDENDEHYTALKKMQEELKTFKKLDGTPYKLIPLEIPKAIFDENQQRLPATYVNFLLCNNALIVPTYNDPKDALILETLKQHTPLEVIGVDCNTLIKQHGSLHCVTMQLY

SEQ ID NO: 51419 - protein, 307 aa, Petunia x hybrida
MDQYEKVEKIGEGTYGVVYKARDRVTNETIALKKIRLEQEDEGVPSTAIREISLLKEMQHANIVRLQDVVHTVKSDCILSFEYLDLDLKKHMDSSPEFSKDPRLVKMFLYQILRGIAYCHSHRVLHRVLHRDLKPQNLLIGRRTNALKLADFGLARAFGIPVRTFTHEVVTLWYRAPEILLGSRHYSTPVDVWSVGCIFAEMVTQRPLFPGDSEIDELFKIFRVMGTPNEDTWPGVTTLPDFKSALPKWPSKDLATIVPNLDGAGLDLLDKTVRLDPSKRITARNALEHEYFKDIGYVFRSKGSSRV

SEQ ID NO: 51420 - protein, 955 aa, Flaveria brownii
MSSLFVEGMLLKSANESCLPASVKQRRIGDLRRLNHHRQPAFVRGICRRKLSGVSRIELRTGGLTLPRAVLNPVSPPVTTTKKRVFTFGKGNSEGNKDMKSLLGGKGANLAEMASIGLSVPPGLTISTEACEEYQQNGKKLPPGLWDEILEGLQYVQKEMSASLGDPSKALLLSVRSGAAISMPGMMDTVLNLGLNDEVVDGLAGKSGARFAYDSYRRFLDMFGNVVMGIPHSLFDEKLEQMKAEKGIHLDTDLTAADLKDLVEQYKNVYVEAKGEKFPTDPKKQLELAVNAVFDSWDSPRANKYRSINQITGLKGTAVNIQCMVFGNMGNTSGTGVLFTRNPSTGEKKLYGEFLVNAQGEDVVAGIRTPEDLVTMETCMPEAYRELVENCVILERHYKDMMDIEFTVQENRLWMLQCRTGKRTGKGAVRIAVDMVNEGLIDTRTAIKRVETQHLDQLLHPQFENPSAYKSHVVATGLPASPGAAVGQVVFSAEDAETWHAQGKSAILVRTETSPEDVGGMHAAAGILTARGGMTSHAAVVARGWGKCCVSGCADIRVNDDMKVFTIGDRVIKEGDWLSLNGSTGEVILGKQLLAPPAMSNDLETFMSWADQARRLKVMANADTPNDALTARNNGAQGIGLCRTEHMFFASDERIKAVRKMIMAVTPEQRKAALDLLLPYQRSSFEGIFRAMDGLPVTIRLLDPPLHEFLPEGDLEHIVNELTADTGMSKDEIYSRIEKLSEVNPMLGFRGCRLGISYPELTEMQVRAIFQAAVSMNNQGVTVIPEIMVPLVGTPQELRHQIGVIRGVAANVFAEMGLTLEYKVGTMIEIPRAALIADEIAKEAEFFSFGTNDLTQMTFGYSRDDVGKFLPIYLSQGILQHDPFEVLDQKGVGQLIKMATEKGRAANPNLKVGICGEHGGEPSSVAFFDGVGLDYVSCSPFRVPIARLAAAQVVV

SEQ ID NO: 51421 - protein, 371 aa, Picrorhiza kurrooa
MSLVNSITWSQTSSILNIQSNISKKLTPFSILPHPLTNNLPISLFPNPKSNISNSNTPLSAILTKDQKPQNPPTTPTFDFKSYMLQKADSVNKALDDSIPLTEPLKIQESMRYSLLAGGKRIRPMLCIAACELVGGDESTAMPAACAVEMVHTMSLMHDDLPCMDNDDLRRGKPTNHKVFTEDVAVLAGDAMLAFSFEHVASLTKGVCSERIVRVIYELAKCVGCEGLVAGQVVDICSEGMDEVGLEHLEFIHLNKTAALLEGSVVLGAILGGGSDEEVEKLRNFARCIGLLFQVVDDILDVTKSSKELGKTAGKDLVADKTTYPKLIGIEKSKEFAERLNREAKEHLAGFDQNKAAPLIALADYIAYRDN

SEQ ID NO: 51422 - protein, 452 aa, Ustilago maydis 521
MPAADFDAAAFGETHITKGIGRLSKHVFEDGKGSWITTDKGVKLLDMTSGIGVCNLGHCHPKVTEAAVKQCAKITHAQVNIGFSAPQIELIKNLLPILPHASLDTVFFWNSGAEAVEAAVKLARAATKKQNVIVMQGSYHGRTAATAALTRSKTIYGEGHGPLMPGVFATSFPFYSHFGLPVDTDVEELVRQSLHQVRLTLQQQTAASDTAAILIEPVIGEGGYVPAPASFLHGLREICDENELLLICDEVQSGFGRTGTMFAVEDSGVRPDVLIFAKGIANGFPLSGIASTNQIMSRQKPGSMGGTYAGNAVSCAAATAVIKAFKDEHVLDNVAQRSKQLVSFLRALQHESKYGHLIEDIRGRGLMIGVQFGSPVTKTDSHNSTAANPRKPEQIAPKVVAECLKRNMLLLSTSVFDVLRFIPALNISQDELSHACTIFKQAFEAAAQELGH

SEQ ID NO: 51423 - protein, 164 aa, Euphorbia esula
MSADIEYRCFVGGLAWATTDQSLQEAFSPYGEILDSKIINDRETGRSRGFGFVTFNNEKSMRDAIQGMNSQELDGRNITVNEAQSRGSGGGGGGGGYSRGGGGGGYGGGGRREGGYGGGGGGYNSRSSGGGGGYGGGRDQGYGGGGGGSRYSRGGGESDGNWKN

SEQ ID NO: 51424 - protein, 510 aa, Arabidopsis thaliana
MAYVGLVEVFIALLVFFFFHFLIHKKSHQITPRNWPVLGMLPGVLVMLHRINDYVAEILEVSNLTFAFKGPWFSGMNMLITADPSNIQHVFSSNFSNYDKGPEFKEMFDFLGNGIFTADSKLWEDMRKSALVVLSHQGFQSFSLRTITCKIKNGLVPVLDHFAEANTVFDLQDVFQRLAFDVTLTLVTGCDSSSLSIEMPKNEYAKAMDDAEEVVVYRHVKPVVLWKLQNWIGLGEEKKMKEANAAFDRSCAKYISAKREEIISHHSNIGGEAHAEDLLSVYMNLDISKYELLNPNDDNFLKDIIKSFMLAGRDAIATTLTWFFWLLSKNPEAVTKIRQEINTNLPGSGMSLDADKLNKMVYLHGALCESLRLYAPIPFERKTPIKQDVLPSGHMVDKNWKILFSVYALGRMRSVWGQDASEFKPERWISERNGGLKHEPSFKFFVFNSGPRNCLGKNLSFLQMKTVAVEIIRNYDIKVVEGHKIEPASSIILHMKHGLKVTVSKRGLVS

SEQ ID NO: 51425 - protein, 425 aa, Psychrobacter arcticus 273-4
MMNISNIKIAVIGLGYVGLPLAVEFGKNHSVIGFDINNDRITELTSGMERTLEVSNEELAQAAHLSYSSNIQALKDCNFFIVTVPTPIDEYKQPDLTPLIKASESIGSLLKKDDIVVYESTVYPGATEEVCIPVLEKISGLVFNQDFYAGYSPERINPGDKEHRVTNILKVTAGSTPEVADFVDEVYNLIITAGTHKAPSIKVAEAAKVIENTQRDVNIALINELAVIFNKMNIDTEAVLEAAGTKWNFLPFRPGLVGGHCIGVDPYYLTHKAQAIGYNPEIILAGRRLNDSMGEYVVTQLVKTMIKKRIQVEGAKVLILGLSFKENCPDVRNTKVIDIVRELEEYNIEVEIYDPWVNKAEAEREYNVTPISKLAINTYDGIVLAVAHNEFVEMGVEQIRSLGKTSHVLYDLKYVFTKEDTDIRL

SEQ ID NO: 51426 - protein, 734 aa, Bacteroides fragilis NCTC 9343
MDSILFWLVPFASVLALCFALYFHKQMMKESEGTPQMIKIAAAVRRGAMSYLKQQYKIVGWVFLGLVILFSVMAYGFQVQNAWVPIAFLTGGFFSGLSGFLGMKTATYASARTANAARTSLNAGLRIAFRSGAVMGLVVVGLGLLDISFWYLLLNWAIPADVLTPTHKLCIITTTMLTFGMGASTQALFARVGGGIYTKAADVGADLVGKVEAGIPEDDPRNPATIADNVGDNVGDVAGMGADLYESYCGSILATAALGAAAFIHTDDTVMQFKAVIAPMLIAAIGIILSIIGIFSVRTKENATMKDLLGSLAWGTNLSSALIVAVTFFILWLLQLDNWMWISCAVVVGLVVGIVIGRSTEYYTSQSYRPTQKLSESGKTGPATVIISGIGLGMLSTAIPVVAVVIGIIASYLLASGFDFNNVGMGLYGIGIAAVGMLSTLGITLATDAYGPIADNAGGNAEMSSLGKEVRKRTDALDSLGNTTAATGKGFAIGSAALTGLALLASYIEEIRIGLTRLGNLVLTFPNGDTISTANATFVDFMNYYEVNLMNPKVLSGMFLGSMMAFLFCGLTMNAVGRAAGHMVDEVRRQFREMKGILTGETEPDYERCVAISTKGAQREMVVPSLIAIIAPILTGLIFGVPGVLGLLIGGLSSGFVLAIFMANAGGAWDNAKKYVEEGNFGGKGSEVHKATVVGDTVGDPFKDTSGPSLNILIKLMSMVAIVMAGLTVAWSLF

SEQ ID NO: 51427 - protein, 344 aa, Psychrobacter arcticus 273-4
MIQTQTVYEQIKQTLANEPKTWLITGVAGFIGSNLLETLLLLNQKVVGLDNFATGFQHNLDEVQSLVSAQQWQGFTFIEGDIRNLADCQAACIGIDYVLHQAALGSVPRSIADPINTNETNISGFLNMLTAARDAKVASFTYAASSSTYGDHPALPKVEDAIGKPLSPYAVTKYVNELYADVFARTYDFNTIGLRYFNIFGKRQTPDGAYAAVIPKWTAAMIAGDAVYINGDGDTSRDFNFIENAVQANILSATATDEAKNEVYNVAVGGRTTLNTLFTALHENLALNGVNYTQEAVYRDFRAGDVRHSQADISKIQNALGYAPQFDIVQGIEKAMPWYVKFLG

SEQ ID NO: 51428 - protein, 497 aa, Oryza sativa Japonica Group
MVLSHASSGRDDAVRCTFATRYACETLPRFRMPEQSIPREAAYQIINDELMLDGNPRLNLASFVTTWMEPECDKLIMDSVNKNYVDMDEYPVTTELQNRCVNMIAHLFNAPIKEDETAIGVGTVGSSEAIMLAGLAFKRKWQNKRKEQGKPCDKPNIVTGANVQVCWEKFARYFEVELKEVKLSEGYYVMDPVKAVEMVDENTICVAAILGSTLTGEFEDVKLLNNLLTEKNKETGWDVPIHVDAASGGFIAPFLYPELEWDFRLPLVKSINVSGHKYGLVYPGVGWVIWRSKEDLPEELIFHINYLGTDQPTFTLNFSKGSSQIIAQYYQLIRLGFEGYKNIMQNCMENTAILREGIEATGRFEILSKEAGVPLVAFSLKDSGRYTVFDISEHLRRFGWIVPAYTMPANAEHVAVLRVVIREDFSRSLAERLVSDIVKILHELDAHSAQVLKISSAIAKQQSGDDGVVTKKSVLETEREIFAYWRDQVKKKQTGIC

SEQ ID NO: 51429 - protein, 143 aa, Burkholderia pseudomallei K96243
MSGDRDDPRYPYPKDDAELRRRLTPMQYEVTQHAATEPPFTGEYTDTEDAGIYHCVVCGTALFESGAKFHSGCGWPSYFKPIDGEVIDEKMDYTHGMTRVEVRCNQCGAHLGHVFEDGPRDKTGLRYCINSAALNFEAKPERK

SEQ ID NO: 51430 - protein, 525 aa, Burkholderia pseudomallei K96243
MGSNMSFSRSEAAPAAPLPDLAATLAAPRDDAFQQLGAAFVTRLPAAPLPAPYVVGFSDDAARMLGLEPALRDAPGFAELFCGNPTRDWPQASLPYASVYSGHQFGVWAGQLGDGRALTIGELAHDGRRYELQLKGAGRTPYSRMGDGRAVLRSSIREFLCSEAMHHLGIPTTRALAVIGSDQPVVREEIETSAVVTRVAQSFVRFGHFEHFFANDRPEQLRALADHVIERFYPACRDADDPYLALLAEATRRTAELVAQWQAVGFCHGVMNTDNMSILGLTIDYGPFGFIDAFDAKHVCNHSDTQGRYAYRMQPRIAHWNCFCLAQALLPLIGLHRDAPSEDARAERAVEDAHAVLGRFPEQFGPALERAMRAKLGLALEREGDAALANQLLEIMDASHADFTLTFRHLARVSKHDARGDAPVRDLFIDRDAFDRWANLYRARLSEEARDDASRAAAMNRVNPKYVLRNHLAETAIRRAKEKDFSEVERLAAVLRRPFDEQPEHDAYAALPPDWASTLEVSCSS

SEQ ID NO: 51431 - protein, 118 aa, Panax ginseng
LCEGGELFDRIVARGHYTERAAAAVTRTIVEIIQMCHKHGVMHRDLEPENFLFANKKETAALKTIDFGLSVFFKPGERFNEIVGSPYYMAPEVLKRNYGPEIDVWSAGVILYILLCGV

SEQ ID NO: 51432 - protein, 477 aa, Candida albicans SC5314
MSTDHHSHPVEGHQFKKIFNRLSGQPESYSRKQNYTFGKTLGAGSFGIVRYARDNSTDEEVAVKIILKKALKGNESMIIDEMQLLEQLNNPHIVGFRDWFESKDKFYLVTQLATGGELFDRIVQKGRFTEHDASLVVLQMLEALEYLHNKDIVHRDIKPENILYLTSKDDSPIVLADFGIAKRLQNPNEKLTSSAGSFGYAAPEVILGTGHGKPCDIWSLGVVTYTLLCGYSPFRSENVQDFINEVKHNNAVIFHADYWKDVSKDARRFIIKALQFNPDNRPTATELLNDPWLVSIAKEYKETDLLPNFKQGFDAKKKFRQAIELVKLNNRIKKLKEWQTDEDDDPTEINLFNEHGSVEQRANPSTNDGLTIPGTTSPRRGESPLNTWKKFNDVINSLDTNRSKASLSSFKSPYDLAHSNRGTDVSNSGATNVGKSDTASSAFVQLVHAATANKEKVANYTEDEEGKEKKQKDGDKN

SEQ ID NO: 51433 - protein, 844 aa, Candida albicans SC5314
MSNNNFQESSNNTSSPSKRSTPMLFLDAENKTQEALTTFELLNACTYQNKYVGSANVTTTATTSTKTSNSTSTKSHQQQHRRKLEYMTCDCEEEWDSELQMNLACGPDSNCINRITCVECVNRNCLCGDDCQNQRFQNRQYSKVKVIQTELKGYGLIAEQDIEENQFIYEYIGEVIDEISFRQRMIEYDLRHLKHFYFMMLSNDSFIDATEKGSLGRFINHSCNPNAFVDKWHVGDRLRMGIFAKRKISRGEEITFDYNVDRYGAQSQPCYCGEPNCIKFMGGKTQTDAALLLPQMIAEALGVTPRQEKAWLKENKSIRNQQQNDESNINEEFVNSIEIEPIENQDGVTKVMSALMKTQHPLIIKKLIERIFLSNDQDDINVMFVRFHGYKTISTILQDLLVAKNSGKESETTDNNDIDNSTGDDDQDKDELIIKILKILVSWPAVTKNKIASANLEEVVKDIQTNNENSNNNDEINQLCTSLLDRWSKLEMAYRIPKQESVPTNNAAAAATTTATATGTTTSASPFERISSHTPEVGGTNTPSSTSQQQQQQNSRDAGLPENWRSAFDKNTGGYYYYNLVTKETTWERPLGSLPLGPKPPSGPGLKGRINKYNEIDLAKREELRIQKEKEMKFIEMQNRDRKLKELIEMSKKSMNNIGGSSGTTITAATINGLSDNGGNNNGNITGIYGDDKHSKHHHHHHDKHLKNGPRNTSTSSSSGNNVEKIWKRIFAKYIPNIIKKYESEIGRDNVKGCAKELVNILTQSEIKHGNSLPSSSSSNGYSMELSDKKLKKIKEYSHGYMDKFLIKFNNSKKHKSTMGSKGSDNHKRKHNGDGDNGVKRSKV

SEQ ID NO: 51434 - protein, 198 aa, Physcomitrella patens subsp. patens
MTKASKTRKFAQLKRILAPKGIKQYKDDVLNPKRKDTSLEKLPRNVPNTSSALFFKHNSALGPPYQVLVDTNFINFSIQNKLDLEKAMMDCLYAKCTPCITDCVMAELEKLGQKYRVALRVAKDPRFETLPCTHKGTYADDCIVERVTRNKCYIVATCDRDLKRRIRKIPGVPIMFISQHQYSIERLPEATIGGAPRK

SEQ ID NO: 51435 - protein, 698 aa, Sulfitobacter sp. EE-36
MTDKIGYTRKGDVAVLRIKNPPVNALSHAVREGLVAGMAQAEADDGVKAVVIVGEGRAFIAGADITEFGKTPLEPFLPDVCKRIEDSPLIVVASMHGVSLGGGLEIALSAHYRVAQPSAKVGLPEVHLGLIPGAGATQRLPRLIGVDPSLDLITSGRQVKAAEAESLGIVDQVTEGDPEDVGVAYAENLIATNAPRRPVSEMAAPAPIDWDAAYDGTLKKGRGQISPAQAVRAVQAAAELPFDEGMLAERKIFMELMETDQRQGMIHAFFSERAVGNLPELKGVEPRALQSIGIIGGGTMGAGIATAALLAGFNVVLIEMKEDAAEAARGRIAGNLSGALKRGKITQMKYDAMTNTALEVSINYDSLASVDLVIEAVFEDMGVKKEVFGKLDAVCKPGAILASNTSYLDVDEIAASTSRPADVIGLHFFSPAHIMKLLEVVVAEKTAPDVVATGFALGKALNKISVRAGVCDGFIGNRILATYRTAADHMVLDGASPFQIDKALVDFGFAMGPFAVGDLAGLDIGWATRKRKAATRHPAERVPTYPDKICEAGNFGQKTGKGYYIYEAGSRGGVPNPEVSELIAAERAERGITPRDFTDAEIVRRYMAAMVNEAAKVVGEGIAKRPLDVDMVLLFGYGFPRYWGGPMKWADLQGLPALLADIESYAKEDAWFWEPAPLLKQLVAEGRSFDDLNKQAAK

SEQ ID NO: 51436 - protein, 333 aa, Staphylococcus aureus subsp. aureus COL
MKNLRNRSFLTLLDFSRQEVEFLLTLSEDLKRAKYIGTEKPMLKNKNIALLFEKDSTRTRCAFEVAAHDQGANVTYLGPTGSQMGKKETTKDTARVLGGMYDGIEYRGFSQRTVETLAEYSGVPVWNGLTDEDHPTQVLADFLTAKEVLKKDYADINFTYVGDGRNNVANALMQGAAIMGMNFHLVCPKELNPTDELLNRCKNIAAENGGNILITDDIDQGVKGSDVIYTDVWVSMGEPDEVWKERLELLKPYQVNKEIMDKTGNPNVIFEHCLPSFHNADTKIGQQIFEKYGIREMEVTDEVFESKASVVFQEAENRMHTIKAVMVATLGEF

SEQ ID NO: 51437 - protein, 243 aa, Vitis vinifera
MKPLPSTSSKNPVKFRMPTADNLVPIRLDIEIDGHRFKDAFTWNPSDPDSEVVVFAKRTVKDLKLPPAFITQIAQSIQSQLAEFRSFEGQDMQTGEKIVPIKLDLRVNHTLIKDQFLWDLNNFESDPEEFARTFCKDLGVEDPEVGPAIAVAIREQLYEIAIQSVTSARETRISKKGRRGAEHIPASKASGTALDLMKLFGNKSSIIRKRREWDVYEPIVDILSNEEVDVLEAREDRNARRID

SEQ ID NO: 51438 - protein, 229 aa, Sulfitobacter sp. EE-36
MTFDRSIKIAPSILAADFANFGAECEAIEAQGADWVHVDVMDGHFVPNISFGPTTCAAIRPHIKGVMDVHLMIAPVDPYIDAFAKAGADVITAHVEAGPHIHRTLQAIRGAGAKAGVALNPGTPAAAVEHLLDVADLVCVMTVNPGFGGQKFIDMSDKIRTLRAMIGDRPVHIEIDGGVDVNTASSVAQAGADVLVAGSAVFRGGSVSNPAPYGENIRAIRAAAEGVYV

SEQ ID NO: 51439 - protein, 211 aa, Brassica napus
MAPPIEIVTTKNYAEKQASVPPLNERILSSLTHRSVAAHPWHDLEIGPEAPVIFNCVVEIGKGSKVKYELDKTTGLIKVDRILYSSVVYHHNYGFIPRTLCEDNDPIDVLVIMQEPVIPGCFLRAKAIGLMPMIDQGEKDDKIIAVCADDPEYRHYNDIKELPPHRLAEIRRFFEDYKKNENKEVAVNDFLPATAAYEAVQHSMDLYADYV

SEQ ID NO: 51440 - protein, 150 aa, Triticum aestivum
  misc_feature (129)..(129): Xaa can be any naturally occurring amino acid
MMMDGSAAGTSNGGSGADGDAARRNNTRMPKYSKFTQQELPACKPILTPKWVVSVFFLVGVVFVPVGVVSLLAAQDVVEIIDRYDHACVPPNMTDNKLAYLKNDTISQECTRILTVTKEMKQPIYVYYXLDNFYQKHRKVWGRARNGCAG

SEQ ID NO: 51441 - protein, 464 aa, Magnetospirillum magnetotacticum MS-1
MSGPIPVILSGGAGTRLWPLSRELMPKQLLKLTGERTLLQETALRLGAPPVVVCNFEHRFIVAEQLREEGIEPRAVVIEPVGRNTAPAAAVAALMLAESDPDALMLLMPSDHLIADTGAFRRAVDIAVPLARQGCMVTFGITPTGPNTGYGYIKRGAALDGGFMVERFVEKPDLATAESYVASGKYTWNSGIFLLPVGLFLAELDRFAPGIKTGSAEALAKGQRDLFFFRLDETTFAAIEGRSIDYAVMEPSDKVAVVPVDMGWSDIGSWSALWQESPRNADGNVILGDVLAVDSTDCYLRSQDHLVATVGVSNLVVIATDDAVLVADKSRDQEVKAVVEALKREGRPEATQGTRGWRPWGWYKTIEQGERFKVKQIHVDPGAKLSLQKHWHRSEHWVVVKGTALVTCGDTSFVLRENESTFIPAGTNHRLENPGKVPLRLIEVQSGEYVGEDDIVRVEDDYGR

SEQ ID NO: 51442 - protein, 581 aa, Schizosaccharomyces pombe 972h-
MSHSDYNFDIEQNAFEKEAPKVSIERKGDVVEEEVIATGEVENYAEPKSRNFLQRFFDDFKPALTTRGDGVALKRKLTSRHMQMISVGGAIGSGLYVGSGSAFADGGPASVIINYILIGIMMIFVIYALGELAIAYPVAGSFNTYATRFIDPAWGFAVSWNYFLNYFVTCPLELTTCAITFKFWTEINSAAWISIFLAVVIVINLFGVRAYGEVEFILSTIKVIATVGFIILAIIINCGGVPTDHRGYIGGSIIKQKPFRHGFKGFCSVFTTAAFSFSGTEIIGLAAAEVGNPRKSVPSAVKQVFWRIAIFYVVSLILIGLLVSPDDPRLMGNGDVSVSPFVLAIQEANIKGLPSVFNAVIIISVVSVTNSTTYTAARTLQGMATLKQAPKFFSYTDRVGRPLIAMVVVLLFGFFAYINEADKNGSDISDTVFDWLLAISGLSSFFTWGSICLSHIMFRLAFKKQGHSLKELGFVSPMGIWGSVIGLGFNILCLMAEFYVSLFLIGGSPNANDFFQGYLAACIALAFFIGYKIYDRSHIPSLDKLDIDTGLKTYDNQDEEKEEYSSKGPLNILKKAWNAVC

SEQ ID NO: 51443 - protein, 326 aa, Zea mays
  misc_feature (196)..(196): Xaa can be any naturally occurring amino acid
  misc_feature (296)..(296): Xaa can be any naturally occurring amino acid
  misc_feature (300)..(300): Xaa can be any naturally occurring amino acid
  misc_feature (304)..(304): Xaa can be any naturally occurring amino acid
LAALRRSTPTPTPPPPLPPPIPRAGMNVARFNFSHGTHQYHQETLDSLRQAMHNTGILCAVMLDTKGPEIRTGFLKDGKPIKLTKGQEITVTTDYDIKGDENMIAMSYKKLPVDVKPGNVILCADGTISLAVLSCDPGAGTVRCRCENTAMLGERKNCNLPGIVVDLPTLTEKDKEDILGWGVPNDIDMIALSFVXRKGSDLVTVRQVLGQHAKRIKLMSKVENQEGVVNFDEILRETDAFMVARGDLGMEIPVEKIFLAQKMMIYKCNIAGKPVVTATQMLESMIKSPRPTRAEXTDVXNAVXDGTDCVCQCEVLDLPEVVNHGR

SEQ ID NO: 51444 - protein, 399 aa, Cyanidium caldarium
MEKFKLLKLGKPATLLLEDGTVFRGKSFSNPQTVTGEIVFNTGMTGYQEIFTDPSYNEQLVVLTYPEIGNTGTNLDDYESLKIQAKGIILKNLSNAYSNFRAMRSLLSFLKRHKVVEIHDIDTRALVLHIRNNKTMLAVISNETYNLTFKEAKATIKYGKHTLNSNLASRVSTSLDYYQWMQPLNRKLKFGYSIIRSFNSAINKKLHTSKKLRIIVLDLGVKFNILRYLKSFECEVIIVNYKSTYQQVMKFHPDGIVISNGPGDPAKINRVVVRVNKFINKKIPILGICLGHQILARCFEAKTFKLKFGHRGLNHPVGINKRMEITSQNHGFAVNFEFLKSNKFYANHLNLNDGTLAGISSQNFPLISVQYHPEGSPGPHDSNYLFKYWVYIIYKSKSS

SEQ ID NO: 51445 - protein, 182 aa, Rubrobacter xylanophilus DSM 9941
MEPFFGEVGGLRPRVAPDAFVAPGAVLVGGVRVGARSSVWYGSVLRADDEEVVVGEGCNIQDLCLMHADPGYPAVLEDGVSVGHRAIVHGATVREGSLVGMGAVLLNGVVLGPGSVVAAGAVVTPGTEIPSGSLVAGVPARVVRPAREADREMIRHTARSYLRKSGLHREARPLRREEVEAG

SEQ ID NO: 51446 - protein, 148 aa, Oryza sativa
MFAEENGLKGDPRLQAISQAIRVVPHFPIHGIMFQDITTLLLDHKAFKDTVDIFVDRYRDTHISVVAGIEARGFMFGPSIALGIGAKFVPLRKPRKPARGRNSKKKGPKKWTGWLEVEGGGCQPREPAINNGELGGHRWNNVSRSKTS

SEQ ID NO: 51447 - protein, 694 aa, Burkholderia pseudomallei K96243
MAVDYTTRDGVAVITLNNPPVNGLGLSTRLGIMEGLERAQRDPAVAAIVLTGAGRAFSGGADITEFNTPKALQEPTLHTVIDAVEASGKPVVVAIHSVAMGGGLELALGAHYRVASAGAQIALPEVKLGLLPGAGGTQRLPRAVGLETALNMIVSGAPVPSEQLAKSGLFDAFVEGDLLEAAVAFARKAGAASGPHPRVRDREIVHENAAGFIQFARNSVKAVAQHYPAPHKCIDAIEAGVLQGFDKGLAFERDCFVALVQTPESRALRHAFFGERAAGKIADVPADTAVRGIESVAVIGAGTMGGGITMNFLNAGLPVTLLETKQEALERGLATIRKNYDAQVSKGKLTQEKLDARMALLRPTLSYDDLKDADLVIEAVFEELGVKEQVFKRLDEVAKPGAILASNTSTLDVNKIAAFTGRPQDVVGLHFFSPANVMKLLEVVRGEHTAKDVLATVMQLAKKIRKTAVVSGVCDGFIGNRMVEQYIRQALFMLEEGALPAQIDRAIEAFGFAMGPFRMSDLAGNDIGWAIRKRRYVEQPDLHYSKIADRLCEQGRFGQKTGAGWYDYVPGERRAKPSKLVDEMIVAYSSERGVARRQIGDAEIVERLVYALVNEGAKILEEKIASKASDIDMVYLTGYGFPLWRGGPMLYADTVGLYNVERAMRGYAQRANGDAWQIAPSIVELAKSGRGFNA

SEQ ID NO: 51448 - protein, 280 aa, Legionella pneumophila str. Lens
MHHLILGYGYCGYYLAQELLGHHQQVTVVSRQLKKELELSKLQHISHDLEYPFHWSEPDSIIYYLIPPPSQGTCDTFLQQFLNQSSLNAKKIIYFGSSGVYGNHQGAWVDELSACIIDSPRQQRRLDAEQQWLAYCQQHNKELSLLRIAGIYGPNRIPVDAAKSKIPIIKPTEAPFTNHIFVKDLALIAYLLGQKQTTSAVYNVADGNPTHMGALQQTVANALGIELASYESFAQAWEKASPMKREFMRASKRLKIDMLKAALGEDIQFTSLYDAVKQSL

SEQ ID NO: 51449 - protein, 504 aa, Bacteroides fragilis NCTC 9343
MSKKALLMILDGWGLGDHGKDDVIFNTATPYWDYLMETYPHSQLQASGENVGLPDGQMGNSEVGHLNIGAGRVVYQDLVKINLSCRDNSILKNPEIVSAFSYAKENGKNVHFMGLTSDGGVHSSLDHLFKLCDIAKEYNIENTFVHCFMDGRDTDPKSGKGFIEQLEAHCAKSAGKVASIIGRYYAMDRDKRWERVKEAYDLLVNGIGKKATDMVQAMQESYDEGVTDEFIKPIVNAGVDGTIKEGDVVIFFNYRNDRAKELTVVLTQQDMPEAGMHTIPGLQYYCMTPYDASFKGVHILFDKENVVNTLGEYLAANGKKQLHIAETEKYAHVTFFFNGGRETPYDNEDRILVPSPKVATYDLKPEMSAYEVKDKLVAAINENKYDFIVVNYANGDMVGHTGIYEAIEKAVVAVDACVKDTIEAAKAQGYEAIIIADHGNADHALNEDGTPNTAHSLNPVPCVYVTENKEAKVADGRLADVAPTILHILDMVQPAEMTGCNLIK

SEQ ID NO: 51450 - protein, 136 aa, Agrostis stolonifera
LLTLIPLRQVLVVDYKLVYPSGTATAVLINGFHTAQGDKNSKKQIRGFLKYFGGSFVWSFFQWFYTGGNACGFVQFPTFGLKAWKQTFFFDFSMTYVGAGMICPHIVNISTLLGAILSYGLLWPLISKNNGDWYPA

SEQ ID NO: 51451 - protein, 310 aa, Magnetospirillum magnetotacticum MS-1
MKILACNSNRPLAEAIAEYLTMSITKAVIRRFSDNEVFVEIHENVRGEDVFVIQSTSYPANDNLMELLVTLDALRRGSARRITAVIPYFGYARQDRKSSPRSPISAKLVANLITTAGADRVVTLDLHSGQIQGFFDIPLDNLYAAPVFTNDIRARYQGDDVMVVSPDVGGVVRARAIASRIDADLAIIDKRREKAGVSEVMNIIGDVRGRRCIMVDDIVDSAGTLCNAAEALMKAGAVSVAAFVTHGVLSGGAVARVTASPLEELVITDSIPATEAVKMARNIRQVTIAPLMAESISRISEERSVSSLFD

SEQ ID NO: 51452 - protein, 87 aa, Oryza sativa
  misc_feature (46)..(46): Xaa can be any naturally occurring amino acid
MDSFSSPSSAGSTASTEHLMEQIKAQLAQAYAQEFLETVGNKCFAXKCVTKPGTSLSGSESSCISRCVDRYIEATGIVSRALFSSQR

SEQ ID NO: 51453 - protein, 403 aa, Candida albicans SC5314
MYTTANNRLTQLTQILSPIVNDADSSFAQYLLQNPTFAPNPESSLNPEKPFKIAVVGSGNWGTTIAKIVAENALARPHLFSHYVNMWVFEEKINGENLTQIINQRHENIKYLPGVKLPNNLIAQPDIVTAVKGADLIIFNLPHQFLPKILKQLKGNVPKTTRAISCLKGLEVSKDGCKLLSTYITEELGIVCGALSGANLAPEIARGKWSETTVAYKLPNDYRGAGKDIDKLVLKACFHRPYFHVNVIEDVAGVSVAGALKNIVALAVGFVEGLGWGDNAKAAIMRVGLLETIKFSETFFPQSQADTFTAESAGVADLITTCAGGRNVKVGRYMAETGVSAEEAEKKLLNGQSSQGIVTAKEVHELLTYVNKLEEFPLFEATYQIAFGSESIENLPNLLNTTA

SEQ ID NO: 51454 - protein, 331 aa, Burkholderia pseudomallei K96243
MRCCLPRRLPLTMPLNPKIAQVLDMIERAKRPDYHEQTPAQARAAYEKSAPILDVAPAPMFSVEDLRVPSRDGGAFGARLYLPVEPSLAEPLPVLVYYHGGGFTVGSVNTHDALCRMFARDAQCAVLSVDYRLAPEHKFPTAVDDAEDALVWLHAHASRFGIDSARLAVGGDSAGGTLATVCAVLARDRGIALALQLLIYPGTVGHQQTESHARLAKGYLLSADTIQWFFGHYVRDASDRDDWRFAPLDGTRGAPSFERVAPAWIATAQYDPLSDEGEAYADKLRAAGNRVTLVAYAGMIHEFFKMGGYVPEVRLAHADAVGALRAAFDGD

SEQ ID NO: 51455 - protein, 358 aa, Bordetella pertussis Tohama I
MTHQIAVLPGDGIGPEIVEQAERVLKALDLPLELRQAPVGGAAFDQFEHPLPPATLELAQGSHAVLFGAVGDWKYDTLPREFRPEQAILGLRKALGLFANLRPAILYPELASASSLKPEIVSGLDILIIRELTGDIYFGTPRGVRTAADGAFAGEREGYDTMRYAESEVRRIARIGFESARKRNKKLCSVDKANVLETSQFWRDLVIEVSRDYLDVELSHMYVDNAAMQLVRNPRQFDVIVTGNLFGDILSDEAAMLTGSIGMLPSASLNAAGQGLYEPSHGSAPDIAGQGIANPLATILSAAMLLRYSLNLAPQADRVEAAVRKVLADGLRTADIHEAGTTKVSTSQMGDAVLKALG

SEQ ID NO: 51456 - protein, 880 aa, Leptospira interrogans serovar Lai str. 56601
MDSDLGFLGLRKARESFMEDKNKTIKETLQGSADAGKRKKLIIKKKGDDPSTPSPAASPKKETVAESDPSSKPPVMPLPLPDDSGQSPIVRPAPSSHSPAKREESPGKQDAGRPPRDKDTRQGGGSSYPPSRSPFQKEDSNIIVSRPIQRTGPSRPNSGGGYQGNRGPGQGGGGYQGNRGPGQGGGGYQGNRGPGPGQGGGGYQGNRGPGQGGGGYQGNRGPRSGGTGTRPMPITSAEVELSQSRGSSVTSKKKGHDKEKSTSDRDFSGAENTKFFKQKFKKTKVVGVSGVSVPKEITLLENVQVGELAKKMNLKPGDVIGKLMKMGMMVTINNIIDAETAALLADEYGCKVKVVSLYEETIIEEEKDNQEDYINRPPVVTIMGHVDHGKTKLLDTIRRSSVIDTESGGITQHIGAYQVRTARGLITFLDTPGHEAFTSMRARGAKVTDIVVLVVAADDGVMPQTLEAISHAKAAEVPILVAINKIDLPAANPEKIMQELANHGLQSEEWGGETMYAKISARENIGIDKLLEMILLQAEVMDLKANPKRRAKGTIIEAKLDPGRGSVATVLIQNGTLRVGDPFVAGVFSGRVRAMYNDLGQLIQEAGPAFPAQVTGIDGVPDAGAPFDAMADEKEARNISQHRIEFERIGNAGAATGTSSKVTLENMNEFIKQGALKELKVIIKADVRGSAEAIKESLEKLSTPEVKLNVIQSGAGAIVDMDVMLASASNALIIGFHVRANPKTIALAEKEGVQIKYYNIIYQVVDEIKLAMEGLLEPEKIEEVIGTAEIREIFKVSKIGNIAGCMVLSGKIQKSANIRVIGDGVTKFEGKLKSLKRVKDDVNDVVAGFECGIQVDGYNDFKVGDTIEAYNVTVIKRKLE

SEQ ID NO: 51457 - protein, 151 aa, Brassica napus
LFTSPPKLKVMKRDYFLFLGIIILLFSGLVASAPSSTSPAKIVSGFISNHGTSLMKWLWSLKTTSKKTAVSTKSMVKFENGYSVETVLDGSKLGIEPYSLQVLPNGELLILDSENSNVYKISSSLSLYSRPRLVTGSPEGYPGHVDGRLRD

SEQ ID NO: 51458 - protein, 171 aa, Candida albicans SC5314
MAKSASNKKSIPTTSSSSTTTSAASSSVVLKEVKSTLTTTINNYFDTISAQPRLKLIDLFLIFLVLLGILQFIYVLIIGNFPFNSFLGGFISCVGQFVLLVSLRLQINDSTTTTTNKESDDQLELDEDKIENGTTGGGNGRLFKEITPERSFGDFIFASLILHFIVIHFIN

SEQ ID NO: 51459 - protein, 428 aa, Leptospira interrogans serovar Lai str. 56601
MMQEPSQIVHRKVLPGGITVLFQKAPHTVSASAGVFVRVGSRHESSKNAGYCHFLEHMLFKDTAKRSAKQQAEDIERVGGFTNAATSREYTYFHVTVAGKHIGIGLELLAEMIYEPLLKQSDIDNEAGVILEELQGYEDSPEDYIHDFYYQNFFPKNSLGRDIIGTRESVSGVTHKSILDFYDTYYHTENMFLSISGNFEPDEIFTIAAKYFNRTRVKKREGNSLSLPKKKWGYFPKKKKLEQVYFILGGEGFAREFHNASSASLFTHILGGGTSSRLFQKVREEKGLCYHITAYPSSYADVGINSIVCSTSKEKFITCLEIISDEIKSVLDHGISEKELLDAQTNHEGTLSISYEQTESRMNTIALMELYYGRNFSYEERVKEIYSITLEDLNMFAKSVFGIPKLHLSALGNLSLKEEKAVQRIFSI

SEQ ID NO: 51460 - protein, 435 aa, Streptococcus pyogenes M1 GAS
MSIITDVYAREVLDSRGNPTLEVEVYTESGAFGRGMVPSGASTGEHEAVELRDGDKSRYLGLGTQKAVDNVNNIIAEAIIGYDVRDQQAIDRAMIALDGTPNKGKLGANAILGVSIAVARAAADYLEVPLYTYLGGFNTKVLPTPMMNIINGGSHSDAPIAFQEFMIMPVGAPTFKEGLRWGAEVFHALKKILKERGLVTAVGDEGGFAPKFEGTEDGVETILKAIEAAGYEAGENGIMIGFDCASSEFYDKERKVYDYTKFEGEGAAVRTSAEQVDYLEELVNKYPIITIEDGMDENDWDGWKVLTERLGKRVQLVGDDFFVTNTEYLARGIKENAANSILIKVNQIGTLTETFEAIEMAKEAGYTAVVSHRSGETEDSTIADIAVATNAGQIKTGSLSRTDRIAKYNQLLRIEDQLGEVAQYKGIKSFYNLKK

SEQ ID NO: 51461 - protein, 449 aa, Xanthomonas oryzae pv. oryzae KACC10331
MALARTDRGCAMSARQPAPDATGLVRVVSRWQIVGLSINDVIGSGIYLLPAATAALLGPMSLWAVMLAGLAVALLVLCYAQAASYFDTPGGSYLYTREAFGPFVGFQIGWMIWLTRISSAAALSNGLADAVARFWPTAATDNWARLMVVVGSLGLLTAINVIGVKSAAHTGIALVIGKLVPLLLFVAIGLFYVDWSWAFAGTTPDLRDLGNLGEAALLLLFAYAGFENIPAAAGEYRNPRRDVPFALITMIVTVTLIYAAVQVVAQGTLPNLAASPTPLADAASRFGSEALALILTVGATISILGTTSNTVMLGPRFLFALARDGYGPAFLARVHPRFHTPAAAVLIQGVLSLALALSGSFTQLALLSMVTRLFAYIGTAAAVIVLARRYRQRTDTLRLPGGPAIPIAALLLSLGLLASASWQNLAAAGLALVVGWLIYLLPRKQVENR

SEQ ID NO: 51462 - protein, 1657 aa, Frankia sp. CcI3
MATASALSSALSLTAQMMRPRPERPDMGGLLIAQRQRTGTVRLSRAPRITFGFRGIPPGRRRIDLWLMRQLDDLVGGIWPLMSGTGGRARAVARSSTSRTSRLVLGSAGARVLVVGTGGLGGPGVDRAGEVGAVVARAVAAVGGVFVERCGLAEESLRTVVDPATPLDLGEALAAAVEQATEALLVYYAGIVLVDADGMIHLATAVSDSRPHRLAYTALPLSSVLATMATSRAATRLIAVDGLWVRTTVANSTVPPVPPRVPGLREDVPGPREDAGGGVNAAGDGVELLVLTSPLAAHTGPAADDGPPLSAGLVRLLVNGDPDGPVELSVGQVTRRLAQRLTAAGNAVLHSAAAWSDGVILAGNAAHTPPIADLEPAPTTVLTDGPGPVVTPTPRQPAGLPSAPDGGGTTGEAACPYPGLASFDAGTQRWFFGRERATAEALSRLEERLDGAGPLVLVGASGSGKSSLLGAGLLPALARGAVAGARGWPQVLMTPTDHPARELARTVAQAAGLSVLAAARLDVVSQPARFVGALSDLLALGPAAAGGGTTPPTRRVVIVVDQFEETFTLCADEEERGAFIRALVAACRGDGATRPPAVVVIGVRADFYGWCAAYPELVDALQTGQVVVGPMTAAEVRDAIVKPAEAVGLTVEPGLVDLMLHDIGADEHGVVADPGSLPLLAHALRATWRERENGTLTVAGYLRAGGLRGAIARTAEETFGTLDAAGQDAAWQILLQMIQFGDGTDDTRRRVSRTELLSTSASAQNSASAQNSASAQNSASAQNSASAQNVSAVLDALVAARLVTVDADTVEISHEALLRSWPRLREWIEVDRAAAVTRQRLTDAAATWDDGGRDPSYLFAGSRLATVREWAQAGQRQTALSPVARDFLAASLAAEQAARRAEVRRTRRLHQLVAALTVLTLIAGGAMAFAFRQRAQIAGERDRALSVAIGRQADQLRRSDPLAAAQLGAVAYRLAPTAEARSAVLSTFASDYGFATRHLGTQTRPIGAVAYSRDGRLVATASDDWTVALWSASDPTRRTPLSTIRGHRLAVKSVAFSPDGRFVATGSDDRTVRLWTITDPTHPVLAATLPGASDSIHGLAFRSDSRVLATGGYGSQVRLWDVSDVSAIRPAGAITAHTANVRAVAFSPDGTELLTGGDDGRALLWDVRDLAAPAELSELKGEAGPNVVLSANTAVRAVAISPDGKTAVTGSDDTTARVFDLTDPRRPTTLQVIDEVRSVEAVAVNVDGLVAVGVNSAVEIYDPSRHFDAIAVLPHASKPWALAFSPDGRTLASGADDRTLRLWDVPGPVLVGHHRFLWSTAVHPNGRVLATGDYGQTVRLWDAHDPDRPLPAATLTGFNAAVGSVRFTPNGRVLIAGSLDYATDFDGMVTLWDVADIHRPRLLSTIHPGIGGIKDLEVSPDGRTLALAGTSARLALVDISAPATPRGRSVLAGHRYDVATVSFSPDGRTLASGSSDRTIRLWDITTPDRPAGISTITGFTSALITIAFSRDGRTLAVGSFDTKVALWDVTDRRAPRALPSIIGLGAGVNSIEFSSDGRLMAAGVGGANGVVRLWDMSDPADPVPYATFSGRYNGFAAVAFAPDTAFIVGAPYQVIGFVWDLDPASVVTRLCARAGDPLTREEWKQYLPGLDYDPPCG

SEQ ID NO: 51463 - protein, 243 aa, Chlamydomonas reinhardtii
MPSGFRLDTDGWTKEFDECKQLAQETLQLIQERNLRHPNGGPEASRLSAAARKKLGTLGVQLDKLLRWLDSPEADSLSEPEKNRRRDLIHDLRGRREGMQMSIKRSTGAADRDALFSGAGPSSGPLPPRETEATAELDNRGLLGLQQAVMRRQDEELAAMEKTVASTKHIALAIGEEVDLQTRLLDDLADDVDVTQSRLKAATAKVKQLMRDSGNCRLGVCVFILIVTLVVVIILTVKLARFL

SEQ ID NO: 51464 - protein, 116 aa, Brassica napus
MPGGKPVTLSDQDILEMVFFPVVNEACRVMDENVVIRAADLDIASVLGMGFPKYRGGLIFWADTVGASYIHSKLSKWAEIYGDFFKPSSYLEERAKSGRPLGAPKTAQQAPTRSRM

SEQ ID NO: 51465 - protein, 304 aa, Glycine max
MAATSTSLFSSNLHSLNSQPFSSSLSFFRNVHSTLSFPSSKPSRGVVAMAGSGKFFVGGNWKCNGTKDSIRKLVSDLNSATLESDVDVVVAPPFVYIDQVKNSITDRIEISAQNSWVGKGGAFTGEISVEQLKDLGCKWVILGHSERRHVIGENDEFIGKKAVYALSEGLGVIACIGELLQEREAGKTFDVCFQQLKAFADVVPSWDNIVIAYEPVWAIGTGKVATPEQAQEVHAAVRDWLKKNVSAEVSSKTRIIYGGSVNASNSAELAKQEDIDGFLVGGASLKGPEFATIINSVTSKKVVA

SEQ ID NO: 51466 - protein, 243 aa, Zea mays
RHTHERRNPTRPPRTTAPTMDAGAARPSAPSTAAVAGASVADEPRDARVVRELLRSMGLREGEYEPRVVHQFLDLAYRYVGDVLGDAQVYADHAGKAQIDADDVRLAIQAKVNFSFSQPPPREVLLELARSRNRMPLPKSIAPPGSIPLPPEQDTLLAQNYQLLPPLKPPPQYEEIEDETEEPNPSNPANSNPSYSQDQSSKEQQQQHTPQHGQRVSFQLNAVAAAAAAAKRPRMAIDQLNMG

SEQ ID NO: 51467 - protein, 524 aa, Arabidopsis thaliana
MATLISVDFQHCFMYIILLCLFSLLCYSLFFRKPKGTRVGCDLPPSPPSLPIIGHLHHLLSSLTHKSLQKLSSKYGPFLHLRIFSVPIILVSSASVAYEIFKAHDVNVSSRGAAAIDESLLFGSSSFIYAPYGDYWKFMKKIFATKLLRPQVLENSRGVRAEELKRFYRRILDKARKNENIEISKESAMLMNNILCRMSMGRSFSEENGEAERVRGLVGESYALVKKIFFAATLRRLLEKLRIPLFRKEIMGVSDRFDELLERIIVEHKDKLEKEHQVMDMMDVLLAAYRDKNAEYKITRNHIKSFFVDLFVGGTDTSVQTTQWTMAEIINNPNILQTLRKEIDSVVGKSRLIHETDIPNLPYLQAVVKEGLRLHPPGPLLIRTFQERCEMKGFYIPEKTTLVINAYAVMRDPDSWEDPDEFKPERFLSYSRSGQEDEKEQTLKYLSFGGGRRGCPGVNLGYIFVGTAIGMMVQCFDWKIEGDKVNMEETYGGMNLTMVNPLKCTPVPRTQPFSFTSNLEILSS

SEQ ID NO: 51468 - protein, 262 aa, Pyrococcus furiosus
AHHHHHHGSKLKFWREVAIDIISDFETTIMPFFGNPDGGKLVKISPSGDETKLVDKLAEDLILSRITELGVNVVSEEVGVIDNESEYTVIVDPLDGSYNFIAGIPFFALSLAVFKKDKPIYAIIYEPMTERFFEGIPGEGAFLNGKRIKVRKTPDEKPSISFYSRGKGHEIVKHVKRTRTLGAIALELAYLAMGALDGVVDVRKYVRPTDIAAGTIIAKEAGALIKDSAGKDIDISFNATDRLDVIAVNSEELLKTILSLLE

SEQ ID NO: 51469 - protein, 274 aa, Hordeum vulgare subsp. vulgare
SSEAAGPDGTLVRRYTTGPLCRWLTKDRGDGTLSPFAVFVVDPDHLFPWHHIAEAVTAGGPSAFERTQKWPYYEYMGKNQRLGTLFDNAMAQHSVILVTKMLERFKGFDGVQRLVDVGGGTGSTLGMITSKYKHMTGINYDLPHVIAQGLPLPGVEHVAGDMYESIPTGDAVLLQWITLMLNDDEFVKILSNCHNALPKDGKVIVVDGILPENPDSSLTARDAFTLDIIMFVLFKGAKQRTEKEFARLAKQAGFTGGIKKTYIFFNFYALEFTK

SEQ ID NO: 51470 - protein, 438 aa, Bacillus cereus E33L
MHHDEKNKIGLTVALSIVVGTIIGSGVFMKPGSVLDYSGSSNMAILAWVIGGLLTLASGLTVAEIGAQIPKNGGLYTYLEEIYGSFWGYLSGWMQTIVYGPAIIGTLGLYFSSLMINFFYLDKVWNLPIAIGTVVFLGVVNSMGTKYGGIVQTITTIGKMIPIVLIVVLGFWKGNSDIFNVVVPISENQSIGMAILATLFAYDGWILLASIGGEMKNPTKLLPKAMTVGILIVTAAYVLINLALLNVLPAVEIVDLGENATATAAGMLLGEYGGKIISIGIIVSIFGCLNGKILTFPRIPMSMAERGQLPFAKFIAKESPRFKTPANAITVEIILGIILMIISDPNKLSEISVFIIYIFYVMTFIGVFILRKRNKNKERAYSVPLFPIVPIVAIFGSLFVIGSAIINDPLSCFLSIGIVFTGLPVYWYLNKKNKTEVS

SEQ ID NO: 51471 - protein, 406 aa, Pyrococcus furiosus DSM 3638
AHHHHHHGSIRASKRALSVEYAIRDVVLPARELEKKGIKVIRLNIGDPVKFDFQPPEHMKEAYCKAIKEGHNYYGDSEGLPELRKAIVEREKRKNGVDITPDDVRVTAAVTEALQLIFGALLDPGDEILVPGPSYPPYTGLVKFYGGKPVEYRTIEEEDWQPDIDDIRKKITDRTKAIAVINPNNPTGALYDKKTLEEILNIAGEYEIPVISDEIYDLMTYEGEHISPGSLTKDVPVIVMNGLSKVYFATGWRLGYMYFVDPENKLSEVREAIDRLARIRLCPNTPAQFAAIAGLTGPMDYLKEYMKKLKERRDYIYKRLNEIPGISTTKPQGAFYIFPKIEVGPWKNDKEFVLDVLHNAHVLFVHGSGFGEYGAGHFRAVFLPPIEILEEAMDRFEKFMKERLKE

SEQ ID NO: 51472 - protein, 430 aa, Escherichia coli
MTTDDLAFDQRHIWHPYTSMTSPLPVYPVVSAEGCELILSDGRRLVDGMSSWWAAIHGYNHPQLNAAMKSQIDAMSHVMFGGITHAPAIELCRKLVAMSGRNALECVFLADSGSVAVEVAMKMALQYWQAKGEARQRFLTFRNGYHGDTFGAMSVCDPDNSMHSLWKGYLPENLFAPAPQSRMDGEWDERDMVGFARLMAAHRHEIAAVIIEPIVQGAGGMRMYHPEWLKRIRKICDREGILLIADEIATGFGRTGKLFACEHAEIAPDILCLGKALTGGTMTLSATLTTREVAETISNGEAGCFMHGPTFMGNPLACAAANASLAILESGDWQQQVADIEVQLREQLAPARDAEMVADVRVLGAIGVVETTHPVNMAALQKFFVEQGVWIRPFGKLIYLMPPYIILPQQLQRLTAAVNRAVQDETFFCQ

SEQ ID NO: 51473 - protein, 919 aa, Arabidopsis thaliana
MAISFLCVFLITFVSLIFFAKKIKRSKWNLPPSPPKFPVIGNLHQIGELPHRSLQHLAERYGPVMLLHFGFVPITVVSSREAAEEVLRTHDLDCCSRPKLVGTRLLSRDFKDIGFTPYGNEWKARRKFALRELFCLKKVQSFRHIREEECNFLVKQLSESAVDRSPVDLSKSLFWLTASILFRVALGQNFHESDFIDKEKIEELVFEAETALASFTCSDFFPVAGLGWLVDWFSGQHKRLNDVFYKLDALFQHVIDDHLNPGRSKEHEDIIDSMLDVIHKQGEDSSLELTIDHIKGFLANIFLAGIDTGAITMIWAVTELVKNPKLIKKVQGDIREQLGSNKERITEEDIEKVPYLKMVIKETFRLHPAAPLILPRETMAHIKVQGYDIPPKRRILVNVSAIGRDPKLWTNPKEFDPERFMDSFVDYRGQHYELLPFGSGRRICPGMPMGIAAVELGLLNLLYFFDWKLPDGMTHKDIDTEEAGTLTIVKKVPLKLVPVRVHPPKFPVIGNLHQLGELPHRSLQRLAEKTGDVMLIHLGFVPVTVISSKEAAEEVLRTHDLNCCSRPNLVGTRLLSRGFKDVGFTPYGEEWKERRKFLVREFFSLKKVQSFGYIREEECNFLVKKLLESAVDQSPVDLSKTLFWLTASVMFRVAFGQSFHESEFIDKDKVDELVFEAETAQASFTCSDFFPIAGLGWLVDCISGQHKRLKDVFFKLDALFQWIDTGALTMIWAMTELARNPEVMKKVQGEIRDRLGRNKERITEEDINKVPYLNLVIKETFRLHHPVPLLLPRETMAHIKVQGYDIPPKRRILVNAWAIGRDPKLWTNPEEFNPERFINSPVDYRGQHFELLPFGSGRRICPGISMGMATVELGLLNLLYFFDWKLPDGMTHKDIDTEEVGTLTIVKKVPLKLLPVRFQ

SEQ ID NO: 51474 - protein, 575 aa, Sulfitobacter sp. EE-36
MRIPAAARRYLPVLDWGRDYDKAALSNDLIAAVIVTIMLIPQSLAYALLAGLPPEAGLYASIAPILLYAVFGTSRALAVGPVAVVSLMTAAALGNIADQGTMGYAVAALTLALLSGVMLLVMGVFKLGFLANFLSHPVISGFITASGVIIAASQIKHILGIDASGGNLAELLMSIWANLGTVNGTTVVIGVSATLFLFWVRKGLKPFLRARGVGPRAADVATKAGPVAAVVVTTLAVWAFDLAGQGVKIVGAVPQSLPPLTLPDLSFELMGSLLLPAFLISVIGFVESISVAQTLAAKRRQRINPDQELIGLGAANIGAAFTGGYPVTGGFARSVVNFDAGAQTPAAGAYTAVGLAVAALALTPLVFFLPQATLAATIIVAVLTLVDFSILKKAWGYSKSDFAAVLSTMLITLGSGVELGVTCGVVLSIFLHLYKTTKPHIAEVGLVPGTEHFRNINRHEVETCPTVLTLRIDESLYFANARFLEDCIYDRLAGNTCLRHVVLMCSAINEIDFSALESLEAINARLRDMGIKLHLSEVKGPVMDRLKKQHFISDLTGSVFLSQHAAYVALGKAAA

SEQ ID NO: 51475 - protein, 744 aa, Vitis vinifera
MTMNERKTIDLEQGWEFMQKGITKLKNILEGLPEPQFSSEDYMMLYTTIYNMCTQKPPHDYSQQLYDKYRESFEEYITTTVLPSLREKHDEFMLRELVKRWSNHKVMVRWLSRFFHYLDRYFIARRSLPALNEVGLTCFRDLVYQELYSKVRDAVISLIDQEREGEQIDRALLKNVLDIFVEIGMGQMEQYENDFEAAMLKDTAAYYSRKASNWILEDSCPDYMLKAEECLKREKDRVSHYLHSSSEPKLLEKVQNELLSVFANQLLEKEHSGCHALLRDDKVDDLSRMYRLFSKIPRGLEPVSNIFKQHVTAEGTALVKQAEDAASNKKADKRDVVGLQEQVFVRKVIELHDKYLAYVNDCFNNHTLFHKALKEAFEVFCNKGVAGSSSAELLATFCDNILKKGGSEKLSDEAIEETLEKVVKLLAYISDKDLFAEFYRKKLARRLLFDKSANDDHERSILTKLKQQCGGQFTSKMEGMVTDLTLARENQTHFEEYLSNNPNANPGIDLTVTVLTTGFWPSYKSFDLNLPAEMVKCVEVFREFYQTKTKHRKLTWIYSLGTCNINGKFEPKTMELIVTTYQASALLLFNASDRLSYSEIMTQLNLTDDDVVRLLHSLSCAKYKILNKEPNTKTISPTDYFEFNSKFTDKMRRIKIPLPPVDEKKKVIEDVDKDRRYAIDASIVRIMKSRKVLGHQQLVMECVEQLGRMFKPDFKAIKKRIEDLITRDYLERDKDNPNTFRYLA

SEQ ID NO: 51476 - protein, 128 aa, Populus trichocarpa
MTVEAVNPKAYPLADAQLSITILDLVQQAANYKQLKKGANEATKTLNRGISEFVVMAADTEPLEILLHLPLLAEDKNVPYVFVPSKQALGRACGVTRPVIACSVTTNEGSQLKTQIQQLKDAIEKLLI

SEQ ID NO: 51477 - protein, 234 aa, Aggregatibacter aphrophilus
MNNIPQQLQQIHQQIKQACHAVGREQSAVKLLAVSKTKPVEDILIAHAAGQVAFGENYVQEGVEKIQYCQQHDVSLEWHFIGPLQSNKTRLVAEYFDWMQTLERAKIADRLNEQRSPYKAPLNVLIQINISQESSKSGIQPSDMLPLAKHIENLPHLRLRGLMAIPEPTNDVAQQEQTFCQMKTLFEQLQQALPNAQIDTLSMGMTDDMQSAIKCGSTMVRIGTAIFGTRDYAK

SEQ ID NO: 51478 - protein, 129 aa, Chlamydomonas reinhardtii
MAGRGKGKTAGKKAVSRSAKAGLQFPVGRIARYLKKGKYAERIGAGAPVYLAAVLEYLTAEVLELAGNAARDNKKNRIVPRHIQLAIRNDEELGKLLGEVTIASGGVLPNIHAVLLPKKTKGGKGEETA

SEQ ID NO: 51479 - protein, 187 aa, Legionella pneumophila str. Lens
MSTLTSLPNILTLMRISIIPVFIMVFYFPFKWAHPTAAVLFAIASITDWLDGYLARKLEMMSHFGAFLDPVADKLLVSTSLLLLVGAKDIDYITIPAIVIVGREIVISALREWMAEVGSRASVAVGYIGKVKTSLQMIALVLLLAFNPLVSWWGSLGFALLYVSAILTIWSMVIYLAIAWPELMKKS

SEQ ID NO: 51480 - protein, 224 aa, Mycoplasma genitalium G37
MQALAFGEILLLENTRYCDVNDKGEIVKLESKNDPELAKFWASLGEIFVNDAFGTAHRKHASNAGIAKYVAKSCIGFLMEKELKNLSYLIQSPQKPFVVVLGGAKVSDKLKVVENLLKLADNILIGGGMVNTFLKAKGKATANSLVEKELIDVAKQILDKDTHNKIVLAIDQVMGSEFKDQTGITLDVSDKIQEQYQSYMSLDVGSKTIALFESYLKTAKTIFW

SEQ ID NO: 51481 - protein, 497 aa, Vitis vinifera
  misc_feature (27)..(27): Xaa can be any naturally occurring amino acid
  misc_feature (42)..(42): Xaa can be any naturally occurring amino acid
  misc_feature (431)..(431): Xaa can be any naturally occurring amino acid
  misc_feature (454)..(454): Xaa can be any naturally occurring amino acid
  misc_feature (476)..(476): Xaa can be any naturally occurring amino acid
MAFRRALISTALKRSKSDLHLHRRWLXGGAVSAPPVLPAFDXQPKPYTGPLADEVLQKRKKFLGSSLFYYYQKPVNVVEGKMQYLFDENGKRYLDAFAGIVTVSCGHCHPEILNAIIEQSKLLQHATTIYLHHAIADFAEALASKMPGNLKVVYFVNSGSEANELAMLMARLYSGNLGMISLRNAYHGGSSGTIGLTALNTWKYSIPEGEIHHVVNPDPYRGIFGSDASSYARDLKDHIDYGTSGKVAGFISETIQGVGGAVELAPGYLKLVYDIVRKAGGVCIADEVQTGFGRTGSHYWGFETQGVIPDIVTMAKGIGNGLPLGAVVTTPEIADVLAQKIQFNTFGGNPVCSAGGLAVLRVLDKEKRQEHCADVGLHLIERLRALQQKHDIIGDVRGRGLMVGVELVTDRKEKTPAKAETAVLFENLREXGILIGKGGLHGNVFRIKPPMCFXKDDAAYQNCEDQIFQELEVKSXSPLAPNPTKCQISRTPCIQTL

SEQ ID NO: 51482 - protein, 115 aa, Mycoplasma genitalium G37
MLNFKTLQAIDFQNKTVVLRSDFNVPMINGVISDSERILAGLDTIKFLVKKNCKIVLLSHLSRIKSLEDKLNNKKSLKPVAELLQQLLPTVKVQFSCKNTGAEVKQKSASISIRW

SEQ ID NO: 51483 - protein, 694 aa, Physcomitrella patens subsp. patens
MDEPDSDDYDSDEMNEAFDLAWTGLKNGSLKCLNSDGTFRCPYSPGRKKQNYVYSELHQHAVGVGKGERGPVAAGNHRALQKYLEQDMAARAHPQAERVIHLQQEVPSRVDNDDKRVRPWMGILQNIDNRTRRPADQFRIGPGAADIKEHLRAFNPESVKVLYDYKGHLGMAVVGFRNTMDGFKDAEAFENSFCLKRRGRKDFEMNYPHALGEHLYGWMATEKDVDGWNKGSHKLLVEHLRANGDLKCLPEIVKELELTAQQQVQNLKKVVINKDDVLQVTHRENWSLTNKVDLVTAQREQAESEKLKLIENHKKELEGLQRAASLAAEEHERNMGAYRTQIENRMKELESKCSELGMLQIENEAEKARNFAERQETQKLLAWYKVQAKIQEEQQLKQIELIKKHKDESDKLENELQEQRKKLQAKHWRELENHRVTEQLEAEKAKKAEIIEANIEETEKEKEEYVKKIAELEEKLKDCEEDMDYNNDLVNQLTISHRQANSEVEDAKTLIIKLKVLEKYGTSDIGVKRLGQLNTEGWWEACGHKFPSKMRFCKWQSRVETLMADNTFNPIRVESDGKGGHKYSVNEDDKELTNIREKYGPLVANAVAAAMLELTTWNPSGRYIVSMPWDFKANQKATMSQLFDFFLKVIKNKEDEVKETQKKLKALEEAMALTKEKTKGPASGVSKGKKRPRP

SEQ ID NO: 51484 - protein, 143 aa, Psychrobacter arcticus 273-4
MANERTLSIIKPDAVAGNNIGAIYDRFEKSGLKIVAAKMMQLDDEKAGGFYAEHAERPFYNDLKSFMMSGPVLVSVLEGENAIAKHREIMGATNPKDAAEGTIRADFASSIDENAVHGSDSAESAAREISYFFNEEEVCARTR

SEQ ID NO: 51485 - protein, 507 aa, Oryza sativa Japonica Group
MADSGDSSPHSAAATDDAHHEGSEAAAAHAAPPPPAPPAKVRLMVSYGGRIQPRPHDHQLSYVNGETKILSLERPLRFADFAARLAGLAGSPGDFCVKYQLPGEDLDALVSVTNDEDLEHLVLEYDRLHLLRPAPGSGGGSSRGGSTPRLRVFLFPVQSPTPPPPPQPSGLLEPKQEQRQWFVDALNSVHQPPPPSPPQPKQESVSVQSPPPAVVPMPQPPPVLPAPTGPDYLFGLDNGFVPPPAVKVKDPAGDPPTVKDNVPVEIPAKNDDRHTTNPVSDHVVVSPVVSPGEFQRQIQGLEKLQFADTAAQQPPPPPAPATAAPPPAALPRNGSDDSLTRAYPPATVTPTPPTATPEYYLPKYQEKPAAPPPSSAPPPTAFLPVPGRYTSVAPGSGADHAPVFFIPAPPHGYFTTAAGPGATSFPAVYAVAQHNGNANASGNGPSPAAASNAQAYAPQVAYDSNGHAIYYTSVLPQYASAVSGVPAAATVLGTDPAKPVAVKPTVS

SEQ ID NO: 51486 - protein, 1106 aa, Oryza sativa
  misc_feature (482)..(482): Xaa can be any naturally occurring amino acid
  misc_feature (495)..(495): Xaa can be any naturally occurring amino acid
MADRDEEQILYDTIAEGSSQYWNEEEGNEDPNQYLNEEGNVERDAEGNQQGHVERDVEGNQEEEASGSQPSVGQKRARGQRGAAKKLEGRHIITEVEEDGRPSAPAEAAKNYVRHSGWVVRDNVPVSTVYWRRTRARGDHESFVPDSEKEMLWTTMLETFTLPAGTEDKVKRWTLKKMAEQFQSFKGDLYQKYILKGQTPNFDTFPKLRDHWDEFVAYKTGEQGQAMMERNKENAAKKKYHHHLGSGGYSVAMPKWEQMEASLIERGIEPATANWPERSKFWYYAHGGTLNPADGSLVFGDQIREAARRLTDAVEASSQGTFRPDRDRDELTLALQTPEHPGRTRGKGVIPWKIGFKEDIHTYRSRMRSKRDTEAKIADLEFRVSSYELNMQEEVARKVDERMAAHRSHDPQPTIPPAMVSPSGNRSSCASTGQVASGMAIPTDPSGTYHCRPIPAGYSKVEVELVEGAYEDLELDYPGGDXRYIILPGRQAASXDPAPTPPRAPTPTPPQAPLPAPSKSRAPPAAPPAHTRATKKAKVDAAKNKDPGYDCTQEELDAYVASEVKRQFKPRSPEKKIPIDPSVRNFFRGMSASVKEAIKLSDYERTLKKASSGKSKPVPQLGEQPKQEIEPLVTGKEMTIEQFITDTGLTTDQLLGVAPIEKAEVKYMYELGKPLVKPELLQSLPTQMYKFHQLYMEMSAAGREMIGARIRDTDFLQGDDILWINFKGIYELYQLDALDVSIMSCWILMEIQRARRRRVFDTGFIDPRRVNVAMLDQYPQETEDNLVHLLKAQHYKTFILLPYNTEFHWVLLLFDLEACTVNDVKLRKPAGAMAAGSSHVSADARKLVGKVAVITGGASGIGACTARLFVKHGARVVVADIQDELGASLVAELGPDASSYVHCDVTNEGDVAAAVDHAVARFGKLDVMFNNAGVSGPPCFRMSECTKEDFERVLAVNLVGPFLGTKHAARVMAPARRGSIISTASLSSSVSGAASHAYTTSKHALVGFTENAAGELGRHGIRVNCVSPAGVATPLARAAMGMDDEAIEAIMANSANLKGAGALKADDIAAAALFLASDDGRYVSGQNLRVDGGLSVVNSSFGFFRD

SEQ ID NO: 51487 - protein, 347 aa, Burkholderia pseudomallei K96243
MNAPTSSHSPHVSNPAPRALPRIAVLATGGTIAGAAPDAAQTAGYQAGALGVDRLLAAVPALAQIATIEAEQVASIDSKDLSPALWTTLAERIDALAANDAIDGIVITHGTDTLEETAYLLHLTVKTAKPVVMTAAMRPATALSSDGPLNLLNAVAVAGSAAARGQGVLVAFNNRIHSARDVVKTSTYAVDAFHSPELGALGWVQDGRIEFARRATRPHTLDSRFAIGAAWPQVEVVASYAGASRVIVDACVAAGARGLVVAGTGNGSIHAALQAALADAAAKGVAIVRASRVGSGHVMRNGAANDDALGFVSAGSLNPYKARVLLMLALAAGVADVRELQQVFDTY

SEQ ID NO: 51488 - protein, 822 aa, Ustilago maydis 521
MCPPADDKDEVATAILRQRKSPNKVFVEESTTDDNSVACLSAAKMDELGLFRGDTILLRGKKRRDTVLICLSDENTEDSKIRLNKVARNNLRVKLGDLVSIHACHDIKYGKRIHVLPFDDSVEGLTGNIFDVYLKPYFLEAYRPVRKGDTFTVRGGMRAVEFKVIETDPAEFCIVAQDTVIHTEGEPVKREDEEANLADVGYDDIGGCRKQMAQIREMVELPLRHPQLFKSIGIKPPRGVLMYGPPGTGKTLMARAVANETGAFFFLINGPEIMSKMAGESESNLRKAFEEAEKNSPAIIFIDEIDSIAPKREKTNGEVERRVVSQLLTLMDGLKARSNIVVMAATNRPNSIDPALRRFGRFDREVDIGIPDPTGRLEILRIHTKNMKLADDVDLEQIAAETHGYVGSDVAALCSEAAMQQIREKMDLIDLDEDTIDAEVLDSLGVTMENFRFALGVSNPSALRETVVEVPTTTWKDIGGLDKVKQELQETVSYPVEHPEKFLKYGMAPSKGVLFYGPPGTGKTLLAKAIANECQANFISIKGPELLTMWFGESEANVRDVFDKARAAAPCVMFFDELDAIAKSRGSSSGDGGGAGDRVINQILTEMDGVSSRKNVFIIGATNRPDQIDPAILRPGRLDQLIYIPLPDEPSRLSILKATLKKSPIAEDVDLTFLAKHTHGFSGADLAEICQRAAKLAIRESIEADIKRERERIEKKEANADGEVKMEEDAAAGAAAEEEEDDPVPEITRAHFEEAMRFARRSVSDGDIRRYELFAQNLQSARSFGTSFRFPEGQNPAQTGGAGGAGGAAFGNDDAGDDDLYA

SEQ ID NO: 51489 - protein, 564 aa, Bordetella pertussis Tohama I
MARGYAIGRAVVMGAAALEVAHYRIAPEDAAAESQRLTEALAKAQADLLQMADTLPEDAPRELGAMLNVHRLLLGDPLLAEQALALIAERHYNAEWALTAQGQILGQQFEAMEDEYLRERGGDVRQVIERALHVLAGTSAMLPDGAQLDGNDPLVVVAHDISPADMLRLRGGRFAAFVTDLGGPTSHTAIVARSMGVPAVVALGNVRELVRDGDMLIVDGADGVVVLNPSARILAEYQARQRVYADERAELALLRDEPAVTLDGIDIVLHANIELPEEASLSLACGAHGIGLFRSEFLFMGRPDLPGEEEQYEAYASVVKVMAGRPVTIRTLDIGADKTLDDEATVATNPALGQRAIRYCLARPEMFATQLRAILRASAHGPVRVLIPMIAHMHEVHATYAALESARRELDARGQPYAARVEVGAMVEIPAIAIAIEPFVQALDFLSIGTNDLIQYTLAIDRGDHDVAGLYDPLHPAVLRLVANTINAGERAGKPVAVCGEMAGDARLTRLLLGLGLTEFSMHPQQLLDVKREVRRAHSNALRVKVAAALNRALPIDPDTLDAL

SEQ ID NO: 51490 - protein, 301 aa, Burkholderia pseudomallei K96243
MATIGFIGLGIMGAHMARNLLKGGHRLVVNGAYPVPADLREQTQVVANSTAVAQAADIVIAMVPDTPDVRNVLFAEDGVAKGLSAGKLVIDMSSISPLDTREFAKEINALGCDYLDAPVSGGEVGARDATLTIMVGGPQRAFERAQPLFALMGRNVSLIGENGAGQTCKVANQIIVALNIEAVAEALLFAARSGADPERVRRALMGGFASSRILELHGERMTKRAFEPGFRIDLHRKDLNLALDGARRMNIALPHTASAQQLFSVCAANGGGAWDHSAIVRALEIMSNCEIGEPQSDKKVA

SEQ ID NO: 51491 - protein, 111 aa, Triticum aestivum
MKEATASGGGATAGANDPRQPGTARPYAPPKLSSQDLPVDYAGFLAVVFGVVGVMLHYKVCSWIAIIFCAQSLANMKNFENDLKQLSMAFMFAVMGLVTNYFGPRPGGTKR

SEQ ID NO: 51492 - protein, 390 aa, Carboxydothermus hydrogenoformans Z-2901
MQTVRLTKGRNHRVYRGHPWIYKTELAAQYPYSPGELVRVLDHNNRFVGIGYYNSNSQIAVRIMSFHDEEINYDWIKKKIIKAYQYRSSVVSNTDAYRLIYGEADQIPGLIVDRFGDYLVLQSLTYGIEKLKPLIVEALMEVIKPRGIYERSDVPVRTKEGLPLATGLLAGEVPELVVINENGFKFSVNIKEGHKTGYFLDQRENRLALKPFFHGKKVLDCFCHTGAFSVYAAGFGAKEVIGVDISSEAITRAQENAVLNGFQDKIFFIEANCFDYLRELEKNRANFDIVILDPPAFTKSKEALPGAIRGYKEINLRALKLLNEGGILVTSSCSYHLTEDLFWNVISEAAFDAKKRVRIIEARRQAKDHPMLLSSPETYYLKFFILQVIS

SEQ ID NO: 51493 - protein, 438 aa, Bacteroides fragilis NCTC 9343
MNIAIVGTGYVGLVSGTCFSEMGINVTCVDVDEKKIQKLQDGVMPIYEPGLDELVERNVKAGRLHFTTDLTTCLDEVEIIFSAVGTPPDEDGSADLKYVLEVARTVGRNITKHIVLVTKSTVPVGTAKKVRGVIQEELDRRGVNIEFDVASNPEFLKEGAAIKDFMAPDRVVVGVESAKAKKIMERLYRPFTLNGYPILMMDVASAEMTKYAANAMLATRISFMNDIANLCERVGANVDNVRKGMGADSRIGSRFLYAGCGYGGSCFPKDVKALVHTGIQNGYHMQVIEAVEAVNEKQKSIVFDKLLNAFGGNLQDKTVAMWGLSFKPETDDMREAPALVVIEKLLQAGAIVKVFDPVAMEETERRIGKQVIYCKDMYEAVIDADAIALMTEWKQFRMPSWAIIRKAMKNFVVVDGRNIYDGEELKELGFTYSRIGQK

SEQ ID NO: 51494 - protein, 320 aa, Nocardioides sp. JS614
MRYDNLLASVGNTPLVGLPRLSAQLAGPGADVRLWAKLEDRNPTGSIKDRPALKMIEEAEKDGTLRPGCTILEPTSGNTGISLAMAAKLKGYRIVCVMPENTSEERRQLLRMWGAEIVSSPAAGGSNEAVRVAKRIATEHPDWVMLYQYGNAANALAHEEGTGPELLADLPSITHFVAGLGTTGTLMGVSRFFRAHKADVRIVAAEPRYGELVYGLRNLDEGFVPELYDADLIDSRFSVGPRDAVRRVRELLELEGIFAGISTGAILHAALGQAAKAVKAGESADIAFVVADGGWKYLSTGAYEGTVDEAEDRLEGQLWA

SEQ ID NO: 51495 - protein, 330 aa, Vitis vinifera
MEEPGQLKRAFIDAAAGAIAGGISRTVTSPLDVIKIRFQVQLEPTTSWALLRRDVHGQSKYTGMLQATKDIFREEGLPGFWRGNVPALLMVMPYTAIQFTVLHKLKTFAAGSSKSEDHIHLSPYLSFVSGALAGCAATVGSYPFDLLRTLLASQGEPKVYPKMRSAFLDIIRTRGFQGLYAGLSPTLVEIIPYAGLQFGTYDMFKRWTMAWNQYRSSNANLTGTDSISSFQLFLCGFAAGTCAKAVCHPLDVVKKRFQIEGLPRDPKYGARVEHRAYTNMYDALRQILLVEGWAGLYKGIVPSIIKSAPAGAVTFVAYEFTSDWLESMVT

SEQ ID NO: 51496 - protein, 103 aa, Spiroplasma citri
MIILDGILGLALEEIRKLSDIKIFIKTEDDIRFIRRLTRDLSERGRTVESIINQYLTTVKPMHEYFVEPSIKYTDIIVPYYEGNEIAIDMIATKIKALLLDKK

SEQ ID NO: 51497 - protein, 409 aa, Alkaliphilus metalliredigens QYMF
MTSKINVIGLGYIGLPTALMFAKSGVEVVGTDLNEKLIDSLAKGKLTFEEEGLEELFNDAIEKGIKFTTEYQKTDTYIIAVPTPYINSSKKLDPKYVISAVNTVLDVCEKGAVLIIESTISPGSIDKYVRPEIAKRGFELGKDVHLVHAPERIIPGNMIYELEYNSRTVGADDLIIGEKVKEIYSSFCKSEIVVTDIRSAEMSKVVENTYRDVNIAFANELAKICRTDKMDVYEIIRIANKHPRVNILQPGPGVGGHCISVDPWFLVGDYPDLTNLILTARKINDSMPTHVLGRIRDIMREHKITDISKIGIYGLAYKENVDDTRESPTLQLLERMDEHLAFGVKVYDPFIKERIVDHQFMNFEDFLNEIKILVIITAHDHIKNNLDLVKDKFILDTKNICDFDGVYKL

SEQ ID NO: 51498 - protein, 457 aa, Sulfitobacter sp. EE-36
MLRNDDQLATWDRENFFHPSTHLAQHARGESATRVITGASGVHIEDRDGNRMLDAFAGLYCVNAGYGRTEVADAIAEQAHQLAYYHSYVGHGTETSITLAKMIMDRAPAHMSKVYFGLSGSDANETNIKLVWYYNNILGRPQKKKIISRWRGYHGSGLMTGSLTGLSLFHDKFDLPMNPVIHTDAPYYYRRKDRTQTEAEFTAQCANALEALIQAEGPDTIAAFIGEPVLGTGGIVPPPAGYWDAIQEVLNRHDILLIADEVVTGFGRLGTMFGSEHYGLKPDLITIAKGLTSAYAPLSGSIVSDRMWKVLEQGTDENGPIGHGWTYSAHPICAAAGVANLKLIDDLNLVSNAAEVGGYLNASMKEALGDHPNVGDIRGEGLLCAVEYVADKADATPLDPAAKVGAAISAAMLERGVIARAMPQGDITGFAPPFCITRAEVDTVVAATADAVKTVLG

SEQ ID NO: 51499 - protein, 260 aa, Schizosaccharomyces pombe 972h-
MLFPRVVPFQSLRTAFQKKTFLPVSSAGNVFTPRFQLQAIRSIWIRSEETPNENALKFLPGLDILPPTIGSCEFMRGQGTVNSPLAQKLFDIDGVDSIFFGKDFITVSKGAGTEWAQMKPEVFSVIMEHLSNGSPVLSEEPLKGASDTQILESDSQIVAMIKELIETSIRPSIQEDGGDVEFRGFDEKTGTVSLKLRGACRTCSSSAVTLKNGIQQMLKHYIPEVENVVQVLDPEEEVAIAEFEKFEQRINGNKQKADNK

SEQ ID NO: 51500 - protein, 355 aa, Triticum aestivum
  misc_feature (251)..(251): Xaa can be any naturally occurring amino acid
MATTNWTLPDHPTLPKGKTVAVVVLDGWGEASPDQYNCIHVAQTPVMDSLKNGAPEKWRLVKAHGTAVGLPSDDDMGNSEVGHNALGAGRIFAQGAKLVDAALASGKIWEDEGFNYIKESFDKGTLHLIGLLSDGGVHSRLDQVQLIVKGASERGAKRIRLHILTDGRDVLDGSSVGFVETIEKDLAQLREQGVDARIASGGGRMYVTMDRYENDWSVVKRGWDAQVLGEAPHKFQNALEAVKTLRAEPKXANDQYLPPFVIVDESGKSVGPIVDGDAVVTFNFRADRMVMLAKALEFPDFDKFDRVRVPKISYAGDAPIDGELKLPSQVLVPPPLIERNLVKLVKMCRPSFGKN

SEQ ID NO: 51501 - protein, 257 aa, Escherichia coli W3110
MNPLIIKLGGVLLDSEEALERLFSALVNYRESHQRPLVIVHGGGCVVDELMKGLNLPVKKKNGLRVTPADQIDIITGALAGTANKTLLAWAKKHQIAAVGLFLGDGDSVKVTQLDEELGHVGLAQPGSPKLINSLLENGYLPVVSSIGVTDEGQLMNVNADQAATALAATLGADLILLSDVSGILDGKGQRIAEMTAAKAEQLIEQGIITDGMIVKVNAALDAARTLGRPVDIASWRHAEQLPALFNGMPMGTRILA

SEQ ID NO: 51502 - protein, 142 aa, Zea mays
PPPQPAGGGVVCPRLPGVGNAHPGGAGYPNPPDAGIPDGGVFWAQGGFAVGQSSRWYSPPWGAAFLAGAPFFGFGGVVRGSNPLPSRAGPHPGPFGNSFVKGDNCPAWVTPLGFRAPVFVRDFNPFGCWSGCGLLVQFLGGA

SEQ ID NO: 51503 - protein, 194 aa, Lactobacillus johnsonii NCC 533
MKVVDAEFVISAVSEKQYPKDDLPEFALAGRSNVGKSSLINTIVNRRKLARTSQQPGKTQTLNFYKVNNELYLVDVPGYGYAKVSKKQRAAFGEMIQDYLETRADLKGLILLVDARHNPTADDINMFNYALYLDIPILVVATKMDKLKKMEASQIKQKIGKSLDLSQENVSFLPFSSVSKLNVDKFWDWVEDKM

SEQ ID NO: 51504 - protein, 423 aa, Physcomitrella patens subsp. patens
SNRKQLTLKIDDLPGGADAFELVAKFCYDDASFSITSTNVAMLRCAAEYLGMTEAMSKGNLIRKTEEYLRTMVFWSWEESLTVLRACEEFNQAAEKAHIIQRCASALSDKTSPSASFAVDLSNSPLHPATDAYLASYFVSTPSGNSSHRSSKALCETWWFDDLSTLSVHLMEPVVRYMIIHRAADSRVIAKFLLHYLRSALPVLGYSAASLIQREVVEVVVNLLANLDRKSVSCRSLLGLRRIAVALRAGKHCRRDLERMIGRQLEKATLDNILIPALPPRSSSLYDVDLVLRLVEFFLKEKAEALLLTSNTPVQVSLLKVGELMDKYLAEIAADTYLKPSKFLALAESLPDYARQSDDGLYRAVDIYLEAHPFVSETDATRLFKVLNYHKLGPETSKAASQNPRFPASFAIQVALVQHNQLK

SEQ ID NO: 51505 - protein, 492 aa, Zea mays
  misc_feature (193)..(193): Xaa can be any naturally occurring amino acid
MGSTAAASVLPVSAGSGENLVLILDYGSQYTHLITRRVRQLGVLSLCVSGTAPLASLEGLRPRAVILSGGPHSVHAPGAPAFPEGFLGFAAAAGAHVLGVCYGMQLLVQSLGGAVVSGERQEYGKMDVEVTAASSALYGQAETGKRQTVWMSHGDEVVRLPEGFEVVARSVQGAVAAIENRENRFYGLQYHPXGGVDSTVAATLVHKAIGDRLHCVFVDNGLLRYKEGERVMTTFESDLHLPVTCVDASEQFLSKLKGVEDPEKKRKIIGREFIAVFDDFAHKLEQKIGKRPEYLVQGTLYPDVIESCPPPGSGRTHSHTIKSHHNVGGLPKDMKLKLIEPLKLLFKDEVRKLGGILNVPDSFLKRHPFPGPGLAVRVLGDVTQGNALEVLRQVDEIFVQSIKDAGLYDKIWQAFAVFLPVQTVGVQGDQRTHSNAVVLRAITSEDGMTADWYYFEHAFLVDVVNKICNNVRGINRVCQDITSKPPATVEWE

SEQ ID NO: 51506 - protein, 142 aa, Wolbachia endosymbiont of Drosophila melanogaster
MSRILIVNSIYYTEIANLLLEGAIDKLKGSNASYDVVEVPGTFEIPATILFAVKSGHTNYDGYLALGCVIRGETDHYQYVCKGVIEGLNEVVMHYAIPLGMGVITADSKDKALVRADKNKKNVGGHAASTVLRMIDLHNKLK

SEQ ID NO: 51507 - protein, 508 aa, Mesorhizobium loti MAFF303099
MDTSSVRDIFVIGGGINGCGIARDAVGRGFSVFLAEMNDLASGTSSGSTKLIHGGLRYLEFYEFRLVREALMEREVLWKNAPHIIWPMRFVLPYAKGLRPAWLIRLGLFLYDHIGGRKLLPATRTLDMASDPAGKPLKPLFKKAFEYSDGWVNDARLVALNARDAADRGATIRTRTKVVGARRENGLWTIKIENLQNGETEEIKARLLVNAAGPWVDHVLSGVVGLNDVHNVRLVQGSHIVIAKKFDDPRAYFFQNKDGRIIFAIPYEDEFTLIGTTDRDYPGDPHDVKISDTEIDYLCAAASEYFAQPVKRSDIVWTYSAVRPLYDDGASKAQEATRDYVLKADGGEGTAPIVNAFGGKITTYRRLSESMLEKIEGFLGKRGKPWTSDAPLPGGDFPATGFDAQVAKLKTAYPFLDARLARRLTRLYGTRAQRLLGLAKSNAELGRNFGGDLYEAEVRYLVENEWALTAEDVLWRRTKRGLHLSREHVAALDEFMRGISRRHVAAAE

SEQ ID NO: 51508 - protein, 329 aa, Legionella pneumophila str. Lens
MNKKTIAMLGAGSWGTAVAIHLAKIGHKTLLWSHNPQHVALMAEQHSNPAYLPGIPFPENLIPSDNLIECVQSANYVIIAVPSHAFAEIINKIPKPTQGLAWLTKGVDPASHELLSQLVASRFGVDFPIAVISGPSFAKEVARFLPTALTLASNNTNYQKKMHQLFHHDNIRVYLSDDLIGVQLCGAVKNILAIACGISDGLGYGANAKAALITRGLAEMTRLGLSMGARQDTFLGLAGVGDLVLTCTDDQSRNRRFGLLLGREVPIPEAEHQIGQVVEGKHNAAQICAIANKNRVEMPICEQINALLHGIVHAQEAVNNLMSRPAKEE

SEQ ID NO: 51509 - protein, 256 aa, Botrytis aclada
AYMLKYDSTHGQFKGDIKVLSDGLEVNGKKVKFYTERDPANIPWAESEAYYVVESTGVFTTTEKAKAHLKGGAKKVVISAPSADAPMYVMGVNNETYKGDVDVISNASCTTNCLAPLAKVINDEFTIIEGLMTTIHSYTATQKTVDGPSAKDWRGGRTAAQNIIPSSTGAVKAVGKVIPELNGKLTGMSMRVPTANVSVVDLTVRIEKGASYDEIKAVIKKASDGPLKGILGYTEDDVVSTDMNGDNHSSIFDAKA

SEQ ID NO: 51510 - protein, 430 aa, Burkholderia thailandensis E264
MSRDLPGTLAAWQKAYGDIVHLRIWPEHDVVVADPQLARALLVTHHDALIRWERGIRVLSQVHGHSVLTAEGEAWRTRRHALVPNFSPKAVQGFSPTIVKAATRAFAQWPREDADWHIESALTMLTMDVILQMVFSSTLGEDVRVAEQAIRVASAAANAEFYWPTSMPDWMPWKREKRQALRTLKDLIERHLQRRLKLACDAWPDDLLSCLLQSREDASALSLQNVRDECMTIFLAGHETTAATLVWWAWCMASNPEAQRVARDEVQRVLQGNAPVAETLPELGYLVQTIKETLRRYPVAPLLISRRATRAIQLGDWALPARTLFMIPAHLMHHDARWFPDPEAFRPERFAPDAPEVPRGAYIPFGAGPRVCLGQHLAMAEMTVIAAMLLQRFVLSAPDGSAPPHPVLNVTLRPAQPMHLAITQVDPRIA

SEQ ID NO: 51511 - protein, 303 aa, Wolbachia endosymbiont of Drosophila melanogaster
MKSSEFLKGEVSFEQKAEILLEVLSNIPSFVGETFVIKCGGTIILDETLFNTFVHNVVLLKQLGINPVIIHDGEYEINSVLKMLDMNSKFVNGIRLTDKDTMKIIEMALCGSVNKKIVQYINSAGGSAIGLCGKDGNLIKAEKITATLREDRSNNIEKILDMGFIGRPTEINPDILFFIEESDFIPVIAPIGHGKDGETYHIDADSTASAIAIAVSASKMIILSDTDEEIDKIGGRKISVKNLNASIDCGKIKGEKFIERLMAYVKMAEECAGVVHIVDGRISNIMLDLFTESNSSISIVSDL

SEQ ID NO: 51512 - protein, 471 aa, Ustilago maydis 521
MSSGSRSFFTPQETRLELPQGAAHQTPDITRPASPSENDRAPFLNGGPSDAREDVRMGAKALRNDSEKPAVGIMALAPILCYCAASITMTVVNKFTVSGRGFNMNLLVLLIQSTVGVTCVWIAERAGLIQLRGLNAKDAWNWMPLSIMLVFVIWTGSKALQYLNISVYTIFKNLTIILIAYGEVMWFGGRVTRIVLCSFLFMVLSSVIAAWSDISNVFAIGNLSMPHTPDSIMGGMAKDPITGALFPAFDPLKTEKDAINAQLQSASANDVIEGFQGYGLLSSGYVWMALNCICSATYVLLMRKRIKVTGFKDWDTMFYNNFLSIPVLLLMSFLVEDWSYANLHKNFPDDKQTKLISAIVFSGACAILISYTTAWCIRATSSTTYSMVGALNKLPVALSGMVFFHDPPVTFSSVSAIAVGFFAGLVYAFGKNKQAEAAKLGGHASANGSSSMSGSKDGSSLPMHTFNDRKD

SEQ ID NO: 51513 - protein, 392 aa, Saccharomyces cerevisiae
AITDFDSSNKSYYGENTLYLLSFQGVNGTLGGNSVRVSLTTGPVHDFTWSPTSRQFGVIAGYMPATISFFDLRGNVVHSLPQQAKNTMLFSPSGHYILIAGFGNLQGSVEILDRLDKFKCVSKFDATNTSVCKWSPGGEFIMTATTSPRLRVDNGVKIWHVSGSLVFVKEFKELLKVDWRSPCNYKTLENKDEAFFENHIINNWEPLPDSTTSSLDPKISNKSELQIHSSVQEYISQHPSREASSNGNGSKAKAGGAYKPPHARRTGGGRIVPGVPPGAAKKTIPGLVPGMSANKDANTKNRRRRANKKSSETSPDSTPAPSAPASTNAPTNNKETSPEEKKIRSLLKKLRAIETLKERQAVGDKLEDTQVLKIQTEEKVLKDLEKLGWKDE

SEQ ID NO: 51514 - protein, 143 aa, Brassica napus
  misc_feature (18)..(18): Xaa can be any naturally occurring amino acid
GFSTNDDYHGGFEEGEIXKVFSAMEANYEAWVQGFAPLAVGADVPAAVREFSRTLFNMRPDISLFVSRTVFNSDLRGVLGLVKVPCCVIQTAKDVSVPASVAEYLRDNLGGDTKVETLKTEGHLPHLSAPAQLAQFLRRALPR

SEQ ID NO: 51515 - protein, 583 aa, Carboxydothermus hydrogenoformans Z-2901
MKRTKIVCTIGPASNDVGILKEMIISGMNVARINFAHGSHEEHRERIEKVRRASLEVGIPVAILIDTKGPEIRIGKVENGKIVLKEGDLVVFDPDIAEGQGLRVPVNYPGLARDVNVGGTILLDDGLIELKIEDIQGNKVIARVITGGELSNNKGVNLPGVKVNLPALTEKDRKDIDFGIEIGADFIAHSFVRKAADVLALRRYLEEKGADMEIIAKIENQEGVENIDEIIKVADGIMVARGDLGVEIPTEDVPLVQKEIIEKCNKNGKPVITATQMLDSMIRNKRPTRAEATDVANAIFDGTDAVMLSGETAAGKYPVEAVKTMARIAEKAEEKLLTLRKLNKPTTKSFKTVTDAISHASVTTAEELDAGAIITPTSSGYTARMVSRYRPAVPIIAATPDMKVLRKLTLVWGVFPLLVKTSDSTDEMLSKAIEASLESGLLKPGDLVVLTAGVPVGVKGTTNLLKVHVAGNVLAKGVGIGTRPITGTARVCRTAREAIERIQPGDILVTEATDRDFVSAIEKAAGLVVEAGGLTSHAAIAGLEFGIPVIVGVDGATSIIKDGEKLTLDPQRGLVYHGSAKVL

SEQ ID NO: 51516 - protein, 318 aa, Physcomitrella patens subsp. patens
MEFFKDVHSVRLLTQNGKYLWAAEDRNSVALRRGENTYGVDWRVEVVPERNTIRLKSVYDLYLKPSDYASALGFTGRKIRQSFASKADSSLEWEPVRSDSCVKFTAKGDKFLRANGGVPPYRNTVTYDVPMRKSKQHEVLWTVVVVKLKDPLRPQLPRNPEPGVKYPPTSHHSSCSEWSSPPASPPSRRRPTKTPEPSKDVPKPKQSELRRIYYSVAEDNGEVLAHDDETSGTLLFEGSTIDELAHELQRMTGIDDIILCMKNPLSTKLYKMRLPANRAPLCVVIVRQNSRCSSPLPSSTQSSFPRAKIKIFLMGVYH

SEQ ID NO: 51517 - protein, 355 aa, Chlorobaculum tepidum
  misc_feature (8)..(8): Xaa can be any naturally occurring amino acid
  misc_feature (62)..(62): Xaa can be any naturally occurring amino acid
  misc_feature (116)..(116): Xaa can be any naturally occurring amino acid
  misc_feature (148)..(148): Xaa can be any naturally occurring amino acid
  misc_feature (153)..(153): Xaa can be any naturally occurring amino acid
  misc_feature (221)..(221): Xaa can be any naturally occurring amino acid
  misc_feature (256)..(256): Xaa can be any naturally occurring amino acid
  misc_feature (271)..(271): Xaa can be any naturally occurring amino acid
  misc_feature (347)..(347): Xaa can be any naturally occurring amino acid
MSEPTYFXPPEWAPHASTWLSWPHKLESWPGKFEPVPAVFAELAYQLSRSETVNINVLDDAXEAQARELLKERDPEGKYAERIVFHRIPTNDAWCRDHGPNYVIRTQDGRRDKVIXNWEYNAWGGKYEPYDDDNAVPERVAKAQGLPXVSTGXVLEGGAIDVNGAGLLLTTTACLLNPNRNPSLGKAEIEAQLRRYLGIEKVLWLGDGIAGDDTDGHVDDXARFVNENTVVIAVEEDPEDENYKPLRENYELLKTXTGLDGKPLNIVKLPXPEPVYYDGERLPASYANFYIANTVVLVPTYRCPRDQQAIDILQQCFPKREVVGIDCSDLIWGLGAIHCVTHEEPAXLEHHHHHH

SEQ ID NO: 51518 - protein, 406 aa, Oryza sativa Japonica Group
MVSVFFLLSLLLLLFSSSPPRLRLPGPAAAAPSLADDLRCGHGAPPCLAYLLVGARGDGARLLRLLLAVYHPRNRYVLHLSADASDSERRDLAAWVAAATPAVGAFRNVAVVGAPTAGTPVGSSGLAGTLRAAAVLLRLHPDWDWFITLNAADYPVVTQDDLIYVLSNVSRQFNFVDHTSDIGQKESEKVQSMIVDAGIYLAGRTNFFRASEKRPTPDAFKFFTGISCCLCFCFGSPWVILNRQFIEYCILGWENLPRILLMYFNNIMLPQEGYFHSVICNSLEFRNFTVNNDLRYKAWDNPPQTEPVFLDMTHYDKMVDSGAPFARRFRENESLLDKIDGNVLGRWGHGPVPGAWCSGRKSWFSDPCSQWSDVNIVRPGPQGIKLRQYINRALEGGEFGSKSCRR

SEQ ID NO: 51519 - protein, 452 aa, Cryptococcus neoformans var. neoformans JEC21
MSPIASTASPIPSSKPTLSSQEVMNLEHEYSAHNYHPLPICFEKGLGAHVWDPEGNEYLDFLSAYSAVNQGHCHPEILNTLVTQASKLTLSSRAFYSSNLGPFAKKITSMFGYDMVLPMNTGAEAVETAIKLARKWGYEKKKIPDGKAKVLSVEGNFHGRTIGIISMSTDPESRTGFGPFLENVGPRWDTGLIRYNHTEDLEKVLEKHGDEVAAFLVEPIQGEAGIFVPDDGYLAKCAEICKKYNVLLICDEIQTGLCRTGKMLCYEWDNIRPDMVILGKALSGGMYPVSCVLADKDIMLCIKPGEHGSTYGGNPLGCAVAMTALDVLVKEDLANRSLKLGEIFRSELAKLNSPFIKLIRGRGLFNGVVIDETASKKGRTAWQLCLLMKSKGLLAKPTHVNIIRFAPPLVISEEDVRKAVKIIGESLEELDTIEKIPGDEGEEHKAAIKLDD

SEQ ID NO: 51520 - protein, 196 aa, Zea mays
MADHADDLHAEQTEGFKVGEKKTIDEYQKLDQNDESLQKWKASLGLGQGKDISDPNDPRKCIILSLGLEVEGRDDIIIDLRAPGALEELEKKPFTIKEGASFRMKAQFKVQHEILAGLKYLQKVNRMGVSAKLQEMMGSYGPNTEEKPFYEKKFEPETAPSGMLGRGHYTALSKFVDDDNQVHLQFKWSFDIKKDW

SEQ ID NO: 51521 - protein, 379 aa, Triticum aestivum
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTIGGKPIFHFVGTSTFSEYTVIHVGCLAKINPEAPLDKVCVLSCGISTGLGATLNVAKPKKGSTVAIFGLGAVGLAAMEGAKMAGASRIIGVDLNPAKYEQAKKFGCTDFVNPMDHTKPLQEVLVEMTNGGVDRAVECTGHVDAMISAFECVHDGWGVAVLVGVPHKEAVFKTHPMNFLNERTLKGTFFGNYKPRTDLPEVVEMYMRKELDVEKFITHSVPFSQINTAFDLMLKGEGLRCVMRMDE

SEQ ID NO: 51522 - protein, 131 aa, Aggregatibacter actinomycetemcomitans
SFCERVISGEWKGYTGKAITDVINIGIGGSDLGPYMVTEALRPYKNHLTMHFVSNVDGTHIAETLQKVNPETTLVLVASKTFTTQETMTNANSARDWFLATAKEEKHVAKHFAALSTNAKEVEKFGIDTDN

SEQ ID NO: 51523 - protein, 197 aa, Wolbachia endosymbiont of Drosophila melanogaster
MAKQITSNCNFIFGASDIKSLPNESAPEIAFAGRSNVGKSSLINLLINSKKAARVSSKPGCTRQINFYSMYDDKFRLVDLPGYGYSHAGKEEIIQYLNLIEYYLIQRENLRRVFVLIDSKVGLKEIDKDFIYWLIYNNINFNIVLTKIDKVSQKSLGAVIEDIQKWINNENVSIHQMSIRVKHKITKVRDEFFKFTR

SEQ ID NO: 51524 - protein, 181 aa, Pseudomonas syringae pv. tomato str. DC3000
MSYTDIPAGNAIPDDFFTVIEIPANHSPIKYEVDKPSGQIFVDRFLSTPMFYPANYGFIPNTLSDDGDPLDVLVICPYPVSPGVVIRSRPVGVMYMTDEAGADAKVIAVPHEKLSSMYSNVKECSDLPALLLAQIQHFFENYKALEPGKWVKMGRWGSADEAREDIRKSVAAYNLKKEASK

SEQ ID NO: 51525 - protein, 427 aa, Pseudomonas syringae pv. tomato str. DC3000 [sequence omitted]

SEQ ID NO: 51526 - protein, 533 aa, Saccharomyces cerevisiae
MSEITLGKYLFERLKQVNVNTIFGLPGDFNLSLLDKIYEVDGLRWAGNANELNAAYAADGYARIKGLSVLVTTFGVGELSALNGIAGSYAEHVGVLHVVGVPSISAQAKQLLLHHTLGNGDFTVFHRMSANISETTSMITDIATAPSEIDRLIRTTFITQRPSYLGLPANLVDLKVPGSLLEKPIDLSLKPNDPEAEKEVIDTVLELIQNSKNPVILSDACASRHNVKKETQKLIDLTQFPAFVTPLGKGSIDEQHPRYGGVYVGTLSKQDVKQAVESADLILSVGALLSDFNTGSFSYSYKTKNVVEFHSDYVKVKNATFLGVQMKFALQNLLKVIPDVVKGYKSVPVPTKTPANKGVPASTPLKQEWLWNELSKFLQEGDVIISETGTSAFGINQTIFPKDAYGISQVLWGSIGFTTGATLGAAFAAEEIDPNKRVILFIGDGSLQLTVQEISTMIRWGLKPYLFVLNNDGYTIEKLIHGPHAEYNEIQTWDHLALLPAFGAKKYENHKIATTGEWDALTTDSEFQKNSVI

SEQ ID NO: 51527 - protein, 409 aa, Physcomitrella patens subsp. patens
MPTKKALLVGINYEGQPHHALRGCWKDVERMGECLVSRYGFPKESICTLVDRPGTSPDLMPTGEIIRRKLEELTRDLKWGDCIVFHFSGHGLQMPPEGEPDETGMKEAVVPVDANMITDDDFRILVDKIPDGVFFTFIADCCHSGGLIAHCEQQVGSHAPEDRYAAPNFGNSHEGFRGSYNGNLETVQPGAWPYGGANLGQSSGRYDANLATSKYTSKRSMPVHAVTQMLSARAGHTVEPGNICANLYDLFGDKSSVTCKEIVHTVFNGLRSKGGSKREILKRISSKSIDFLSAKLHSSSLRDSNYQQQTATRDLTDATPENLSHIPKRPDRCILITACQSDETASEHRNEIHGAFTKTLLDIVDEHKGPLDNHRLVYECRQRLARKPYGQHPCLYSTPAQAHHVFICY

SEQ ID NO: 51528 - protein, 173 aa, uncultured Aspergillus
GKSTIVKQMKIIHQNGYTVEELALYRLTVYKNLLDCAKALIGAYHYLQLEPSSPKVEEYISFLEDYNVDPDPNTTLDAKIGEAITYLWNDPCTSTVLEHQNEFYLMDSAPYFFDEAKRITAPDYIPDVSDVLRARTKTTGIYETRFTMGQLSIHMFDVGGQRSERKKWIHCFQ

SEQ ID NO: 51529 - protein, 535 aa, Bifidobacterium longum NCC2705
MFSPRKIPMNVRGISMANGPVLVVDFGAQYAQLIARRVREAGVYSELVPHSMPVDEILAKDPKAIILSGGPASVFEPGAPTIDTKVFESGVPVLGICYGFQVMAYELGGKVDKAALGEYGKTSATIDDAAGILADSPAEQTTWMSHGVAVEQAPAGFEVLAHTEGAPVAAMADESRKLYGVQWHPEVKHSPLGQKLIENFLHRCAALPNDWDASSIIEDQVKKIREQVGDAEVICGLSGGVDSAVAAALVHKAIGDQLTCVFVDHGLLRKGEVEQVKHDFVAATGIRLITVDAADDFLDALAGVSEPERKRKIIGEKFIRTFEKAQRQVLEEAGARGKEVKFLVQGTLYPDVVESGGGDGAANIKSHHNVGGLPKDIKFQLIEPLRTLFKDEVRAIGTELGLPDEIVWRQPFPGPGLGIRIIGEITKERLDLLREADAIAREELSKAGLDRDIWQCPVVLLADVHSVGVQGDERTYGSPIVLRPVSSEDAMTADWSRVPYDVLATISTRITNECRQINRVVLDCTSKPPATIEWE

SEQ ID NO: 51530 - protein, 343 aa, Bifidobacterium longum NCC2705
MGDMVSAILEGKPDKNLILVTGRIHPKLAEDVAEQLGIDVLETTAYDFANGEMYVRYTESVRGADVFVLQSHYKPINKAIMEQLIMIDALKRASARSITAVCPLLGYSRQDKKHRGREPISCRLVFDLLKTAGADRIMSVDLHAAQSQGFFDGPVDHLVAMPVLVDYIRDRFQGHLDNVAVVSPDAGRIRVAEQWAQRLGGGPLAFVHKTRDITRPNQAVANRVVGDVAGKDCVLVDDLIDTAGTIAGACHVLQDAGAKSVTVVATHGVLSGPAVERLKNCGAREVVLTDTVPIPEEKRWDGLTVLSIAPLLASAIRAVFEDGSVAELFDTYPEHHGQGFLFA

SEQ ID NO: 51531 - protein, 552 aa, Psychrobacter arcticus 273-4
MTNTQQQSESIDDNQAQLSKQQNSDNNKKVPRVLMILDGFGHREDDKDNAIAAADMPNLDKIYEQYPHGLISASGEDVGLPDGQFGNSEVGHMNLGAGRVLYQDSTRISSEVASRDFYKNEALVNAVKAANTLGGNVHIMGLLSDGGVHSNQDHIEAMCHSALVHGAKNVFVHCFLDGRDTPPKSADKYINRLRDHIIKLNAHYESGRVQIASIIGRYYAMDRDNRWDRVQKAYELITEGKADRLSTRADGAVQAAYKARETDEFINPTVVIGRDEVPYTVDDNDALIFMNFRADRARELAQAFVLPDHEFSGFARNKQPKLAAFVMLTKYSDVLADNPKTSIAYYPTSLTNTLGEYLQSKGKTQLRIAETEKYAHVTFFFSGGREDEYKGETRILVPSPDVATYDLQPEMSAPEVTDKLVEAIESGQYDVLVVNYANGDMVGHTGIFDAAVQAVEALDVCVGRVAAAVHAAGGDMLITADHGNCEQMQDYESGQVHTQHTTEHVPLIYVGEKKVQVRSGGKLSDVAPTILALMDIEAPKEMTGENLLVAAE

SEQ ID NO: 51532 - protein, 566 aa, Bifidobacterium longum NCC2705
MLIIKGDKNIVTVTRVYIASPEGANGRNVVAYGMLNALTSKYKTMVFRPAVSNHDEFTPILLAASNAGLGVALSTGLDVHKVREDKNTARGDIVGAFNDAMDVSRADAALIVGTDKSHVNDPTSYEFDANVAADLKAGVFLAVCTINRWPHELDETVKLSIEGMEAAGNKVLGIFVTGCEPRHAFSVKETLAKYGLPVWTLPQVPFTDESTKDLALEAFRKNAPTDEVLAALDVDVTAPITPYAFQFGLLGKAKSNKKTIVLPEGEEDRIIKAADYLLEREIVNLIIVGNKDAILARGKELGLNYLDRARFQAMDDENVLKPMVAKLCELRAKKGMTEEQARKQLTDASYFGTMLVVLGYADGLVSGSVNSTANTVRPALQVIKTKPGQKLVSGAFLMCFKDHVAVFSDCAINLNPDAEQLSEIALQSAETARAFGIDPKVGMLSYSTLGSGKGPDVDMVEEATKLLKEKAPDLPVVGSIQFDAAWSPTVAATKAKGNDVAGHVNVFVFPDLCAGNIGYKAVQRSSGALAIGPVLQGLNKPVNDLSRGALVRDIINTIALTAIEAQ

SEQ ID NO: 51533 - protein, 609 aa, Leptospira interrogans serovar Copenhageni str. Fiocruz L1-130
MIRSIFDSEKNCQILLLVNSVVEFETRFRMIPSKRTAFPGITAFPGKLYGKVLKTGKRRNTILTGTYVHESEKEAEVEKFSVALEESLHSLRILITSLETSGPDQKEIQEILETQAMICSDPSLATSVRKRILELGENAILAVQNVTHEISEKFKAMENEFFRERVDHFQDVSNRLIEFIAGKKEEDSFLSGLKEDLILVARELTPSQMILMDKTRIRGIATDLGGKTGHMAILARNYGIPTIVGLKDFSSHVKDNEFIFLDAESGNAIRFPTLEEVKYYGFSSSYPTEENETKKIRAITKDGIRVRIKCNLETELDCEQAIKSGAEGVGLFRSESLFLKYQDSNVSGEEQFLAYKAIAEGMQDKPVIIRTFDIGADKFSTGELEENPFLGNRGIRYSLSNPEWYSEQLTAILRASAFGNVSILLPMITGPVEITRTRKLLEECKRKLSAKKERYNKKIKIGAMIETPAAVAALDLIAREADFFSIGTNDLLQYIMAVDRNNIHVSSLYNPYHISFLRALIRIVEVSRDYDKPLSLCGELASDTDFTIFLVGIGIRELSVSIPFLSPIRKIIRSISLHQAGILVRKILELSEQENYESIEAFLFSKHLS

SEQ ID NO: 51534 - protein, 174 aa, Physcomitrella patens subsp. patens
MAFDIGKGLMALLMVVNFCLYFIAACLAGSILNRNLDVNVGRNDDLQTGNVATVVFIPIALIASMVGLASVFAGANHAHIRRAESLAAVSATSTVAWLLTLLAMGIACKEIHTGYGRSKRLKTLEAFMIILSLFELLYLLALHVGSIFHEGHSSPSSNRAVKDPNLGTPAATAV

SEQ ID NO: 51535 - protein, 175 aa, Physcomitrella patens subsp. patens
MAFGIGKVLIMPLMVINFGLYFIAACLAGSILNRNLDANMHRNDDIQIGNVATVNFIPFALIACMAGLASVFAGGHHIRIWRTESLAAAAATSLIAWLLTLLAMGLACKEIHTSYGRTKRLKTLEAFMIILSLFELLYLLALHAGSVHTNDGVVNTTGHRGVKNPNYGTPAATAV

SEQ ID NO: 51536 - protein, 856 aa, Physcomitrella patens subsp. patens
MAYDGFSGGADDLSGYSGFDDSARFDSSRLESARFDSSFRAADDYKPDPFGLDDNREGFDEFKGASDGYGHPAPIYENEESGGGMPSTYGAGYAGAEYASNPTDEGSYHKELDEDLFGGDGGGGPMLPPPEEMQEEGAVLRQWKRENAQRLQEKEREEKEKLQQIIDDADDYKAKHKAKREANREARMKENRDKETVYHADQEHFHKTAGKQYWKAVTELVPKELPASLEPKSRQMKEKKEKKSTFVALPGPKPGKPTDLGRFRQVLLKLKHNPPAHMIPPPPAAPKPEAKEGEKGAKGEAGKEGGKGKENAPVALVPVPSFQSSHPLSAIGSSLSSARTSLICECITTSVRDGLCNAAIRGTLPHAQLGNGASQDQGRGCALPVRQGCRLQPVLPWSCCRSKERKSDEHTDNHQSMNSDGCADKYPGEFRFPPRSQQVVDDQVVCHARPDGFDASQCHVHLGVRIEYLRSKCGSRQELLGGGGRDHPELVLGGQLGLQVRLGWREERPRGGRGRASRDRWFGFIRQKLLSGTPTLPVSPVLHPAAQSGKSLSGSRCTVHDLRLPEQQGFSVNVYSEPNLPWSALTRTKQIARGERIRGLRSLPISACRPPLSVVAISSSYKLKSILAFELRPWTAACIARLPPGAALRCPSTRGTTAERVRGECRNCHDRGTLPTSNTQRVRKASQQRAPRTAPRRHFPPGGAKLARQSDSHRWKKPPQQPVWLSHSRVCAQSLRFPKSKALQEATALSAATGIRSNHRASLQKPKIGTRQRFVQSPAAWSYPQKTHVARGTPSIATQIPNTTDRHKQLRFVRNRTRHRNMCCHAACKLDAELKVLLRQGATCIHPECFEATRKD

SEQ ID NO: 51537 - protein, 182 aa, Zea mays
  misc_feature (140)..(140): Xaa can be any naturally occurring amino acid
  misc_feature (168)..(168): Xaa can be any naturally occurring amino acid
MTAATATATPLMESLEALVAHIQGLSGSPEELAHLHSLLKQADGEPLRAHAAALVPFLAHLSPETHSLGYLYLLEACATSSSNLSDFGGGDFLVTIGGFLTACSADQIRLAPDKFLNVCRVLKDQVMQLNMPIRGIAPLXRAAVPKIQSSPEQLTPVHADYLILCLLXAKQYKAGLSVLEEG

SEQ ID NO: 51538 - protein, 144 aa, Spiroplasma citri
MMELKPEIIAKGVVAASAGNHSKRISFAANLLKVPATIVMTQKAPISKINATRNYGVEVILHGDFFDDANKKALEIAKAEYKFFVHAFNDIDVISGQVVAKVQLALKFLKNYKILIMFLFQLAGGGGFYPELPRILKQLIKSAN

SEQ ID NO: 51539 - protein, 347 aa, Mycobacterium smegmatis str. MC2 155
MTATMRAERFYADTKKVVVEDVPVPEPGHGEVLVKVEFCGICHSDLSLINGTFPAQVPVVTQGHEASGVIAKLGPGVTGWSEGDRVIVAAGRPCMSCPNCLRGDIGNCLRIQLMAFAYDGAWAEYTVAQAVGLTRVPDNVPLEQAAILADAVSTPYGAVVRTGKVGIGESVGVWGVGGVGTHIVQLSRLVGAAPVIAVDIKPEVLERALAVGADYAFDARDEDLADKIAGVTGGRGLDVAFDAVGLASTFEQALDRLTVGGRLVAVGMSAESPTVGPTSMFGLTQKQVLGHLGYQNVDIATLATLVSLGRLDLSRSISEIVSLEDIAAGIDKLERQEGSPIRILVRP

SEQ ID NO: 51540 - protein, 491 aa, Klebsiella pneumoniae subsp. pneumoniae MGH 78578
MAVTQTAQACDLVIFGAKGDLARRKLLPSLYQLEKAGQIHADTRIIGVGRADWDKAAYTKVVREALETFMKEKIDEGLWDTLSGRLEFCNLDVNDTSGFTRLGEMLDQKNRVTINYFAMPPSTFGAICKGLGEAKLNAKPARVVMEKPLGTSLETSREINDQVGEFFEECQVYRIDHYLGKETVLNLLALRFANSLFVNNWDCRTIDHVEITVAEEVGIEGRWGYFDQAGQMRDMIQNHLLQILCMIAMSPPSDLSADSIRDEKVKVLKSLRRIDRSNVREKTVRGQYTAGFAQGKKVPGYLEEEGANKTSNTETFVAIRVDIDNWRWAGVPFYLRTGKRLPTKCSEVVVYFKTPELNLFKETWQELPQNKLTIRLQPDEGVDIQVLNKVPGLDHKHNLQITKLDLSYSETFNQTHLADAYERLLLETMRGIQALFVRRDEVEEAWKWVDSITEAWAADRDAPKPYQAGTWGPVASVAMITRDGRSWNEFE

SEQ ID NO: 51541 - protein, 480 aa, Klebsiella pneumoniae subsp. pneumoniae MGH 78578
MSRRLRRTKIVTTLGPATDRDNNLEKVIAAGANVVRMNFSHGTPEDHQLRADKVREIAAKLGRHVAILGDLQGPKIRVSTFKEGKIFLNVGDKFLLDANLGKGEGDKEKVGIDYKGLPADVVPGDILLLDDGRVQLKVLEVQGMKVFTEVTVGGPLSNNKGINKLGGGLSAEALTDKDKADIVTAAKIGVDYLAVSFPRCGEDLNYARRLARDAGCDAKIVAKVERAEAVCDQDAMDDVILASDVVMVARGDLGVEIGDPELVGIQKALIRRARQLNRSVITATQMMESMITNPMPTRAEVMDVANAVLDGTDAVMLSAETAAGQYPSETVAAMARVCLGAEKIPSLNVSKHRLDVQFDNVEEAIAMSAMYAANHLKGITAIITMTESGRTALMTSRISSGLPIFALSRHERTLNLTALYRGVTPVFFDSQNDGVAAAHDAVNLLRDKGYLVSGDLVVVTQGDVMSTIGSTNTTRILTVE

SEQ ID NO: 51542 - protein, 131 aa, Aggregatibacter aphrophilus
TFCARVISGEWKGYTGKAITDVINIGIGGSDLGPYMVTEALRPYKNHLTMHFVSNVDGTHIAETLKKVNPETTLVLVASKTFTTQETMTNALSARDWFLAAAKDSAHVAKHFAALSTNAKAVAEFGIDTDN

SEQ ID NO: 51543 - protein, 207 aa, Rhodococcus sp. RHA1
MNSVDRDTARSDRIVTVPNLLSVVRLLGVPLFVYLLLVTHSDGWALAILMISGFTDWLDGKLARILDQSSKLGALLDPFVDRLYVVTTLVTFVLRGFIPWWVAAILIGRDAVLALTLVIYRRRGLPPPDVMYLGKGATFLLMFALPMTLAAHGDWSIATVAQPLGAALLIWGTVLYVWTGLLYTVNALTVARTVPVRGPGGEEREVQ

SEQ ID NO: 51544 - protein, 449 aa, Zea mays
  misc_feature (154)..(154): Xaa can be any naturally occurring amino acid
MATHAALAASRIPAGARLHSRAPASSRHGVQRLDFADFSGLRPGSCSVSAAAREASFSDVLGAQLVAKATGENAVRAPAEAKLKVAINGFGRIGRNFLRCWHGREDSPIDVVVVNDSGGVRNASHLLKYDSMLGTFKADVKIVDDTTISVDGKXITVVSSRDPLKLPWGELGIDIVIEGTGVFVDGPGAGKHIQAGAKKVIITAPAKGADIPTYVVGVNEGDYDHSVADIISNASCTTNCLAPFVKILDEEFGIVKGTMTTTHSYTGDQRLLDASHRDLRRARAAALNIVPTSTGAAKAVALVLPQLKGKLNGIALRVPTPNVSVVDLVINTVKTGITADDVNAAFRKAAAGPLQGILEVCDVPLVSVDFRCSDVSCTIDASLSMVMGDDMVKVVAWYDNEWGYSQRVVDLAHLVAAKWPGAAAAGSGDPLEDFCKDNPETDECKVYEA

SEQ ID NO: 51545 - protein, 513 aa, Oryza sativa Indica Group
MDNAYIIAILSVAILFLLHYYLLGRGNGGAARLPPGPPAVPILGHLHLVKKPMHATMSRLAERYGPVFSLRLGSRRAVVVSSPGCARECFTEHDVTFANRPRFESQLLVSFNGAALATASYGAHWRNLRRIVAVQLLSAHRVGLMSGLIAGEVRAMVRRMYRAAAASPAGAARIQLKRRLFEVSLSVLMETIAHTKATRPETDPDTDMSVEAQEFKQVVDEIIPHIGAANLWDYLPALRWFDVFGVRRKILAAVSRRDAFLRRLIDAERRRLDDGDEGEKKSMIAVLLTLQKTEPEVYTDNMITALTANLFGAGTETTSTTSEWAMSLLLNHPDTLKKAQAEIDASVGNSRLITADDVTRLGYLQCIVRETLRLYPAAPMLLPHESSADCKVGGYNIPRGSMLLINAYAIHRDPAVWEEPEKFMPERFEDGGCDGNLLMPFGMGRRRCPGETLALRTVGLVLGTLIQCFDWERVDGVEVDMTEGGGLTIPKVVPLEAMCRPRDAMGGVLRELV

SEQ ID NO: 51546 - protein, 187 aa, Vitis vinifera
MDELMSGNSTIPNQKMKASAKKTLDPITNVYIWDMDETLILLKSLLNGTYAETFNGLKDVQKGVEIGKMWEKYILQVADDIFFYEQIENYNKPFLDALSQYDDGKDLSDYDFNHDGCSSPYDDLNKRKLAYRHRVIAHKYKQGLHNTFDQDMIKLWDDLYDMTDSYTDKWLSSGTLSYDDAAVEQFN

SEQ ID NO: 51547 - protein, 400 aa, Psychrobacter arcticus 273-4
MNFLRMSELSLTNKVVLIREDLNVPIKEGKVASDARLQASLPTIKMALEKGAAVIVCSHLGRPTEGSSEAIYSLAPVADYLSDKLSAPVTLNNDYLAQGVAIKAGEVVLLENVRFNEGEKKNNAALAQKYADLCDVFVMDAFGTAHRAQASTEGVTQAMHQAGKTACAGPLLAAELDALSLALETPAQPMLAIVGGSKVSTKLEVLHSLAELCSQIIVGGGIANTFLAAQGHSVGASLYEADLVDTAREIMGKTEILLPEYVVVANKNDIDFADFTGSLQKAVATIKSVDNIGDNDMILDIAPDSAIKLAAAITNAKTILWNGPVGVFEVDAFGQGTQIVAEAVKNSQGFSIAGGGDTLAAIDKYQVADGVSYMSTGGGAFLEFVEGKVLPAVAALQINE

SEQ ID NO: 51548 - protein, 198 aa, Triticum aestivum
  misc_feature (59)..(59): Xaa can be any naturally occurring amino acid
  misc_feature (65)..(65): Xaa can be any naturally occurring amino acid
  misc_feature (156)..(156): Xaa can be any naturally occurring amino acid
MKFNISCPERGTQKIIEVDDDKKCAVFFDKRMGEEVPADNLGEEYQGYVFKITGGNDKXGFPMKXGILSKGRPEVLMSKGHSCYRPRRSGERKRKSVRGCIVDADIRVLAVTIVKKGAKEIEGVTNDEKPRRLGPKRASKIRKYFQIKNDKDNKEXAKVLVTKFAVRRTWETAGGKKRQKAPKIQRIITDSRLRSKNI

SEQ ID NO: 51549 - protein, 62 aa, Brassica rapa
ATLKMIVSKYPDLKGINFDLPHVIEEATSHPGIDHVGGDMFVSVPKGDAIFMKWICHDWSDE

SEQ ID NO: 51550 - protein, 268 aa, Burkholderia thailandensis E264
MSGIPPFGLGTFRLQGQVVVDSVRHGLELGYRAIDTAQIYGNEAQVGEALAASGVRRDELFVTTKIWVDHYARDRLVPSLEESLAKLRTDYVDLTLIHWPAPGNGVPLEECLGALADAKASGLTRRIGVSNFNIELTKRAIAALGKDAIATNQIELSPYLQNRKLAAFLQGEGIHVTSYMTLAYGKVLGDPVIGAIAQRHRATPAQVALAWALRLGYSVIPSSTKRENLASNLLAQTLRLTDDDVARVAALERNGREVSPDGLAPQWD

SEQ ID NO: 51551 - protein, 374 aa, Psychrobacter arcticus 273-4
MTDHVNNNASQAAHTSTSNLSNNITTTNGHLQDKLVQDSITNNQNITAQVKALQNTTTSANNNDFTHVEDLPIGTPQGQQTTMPNANTENRTQNSHANSAAQTSTATKQTLFNQRDDINNPHTSDTDGHEETHFGYKTVNKAEKQARVADVFTSVAKKYDIMNDLMSFGIHRLWKRYAISLSGVRAGQHVLDIAGGTGDLAKVFSREVGRNGHVVLSDINAAMLEVGRERLINAGCNNVDFVLANAETLAPFDDNSFDLVTISFGLRNVTDKDAALKSMYRVLKPGGRLLVLEFSKPVFEPLSKAYDLYSFTALPIMGKLIANDAESYQYLAESIRMHPDQQTLKQMMQQAGFENCDYYNLTAGIVAVHRGFKA

SEQ ID NO: 51552 - protein, 327 aa, Blastopirellula marina DSM 3645
MNVLVSGGAGYVGSHTARLLSRQGHDVWIYDNLSQGHRGAVPADRLIVGDLHEGERLTGLMRELKIEAVMHFAASALVGESVTDPAKYYRNNIVATLSLLDAMRAADVRRIVFSSTCATYGEPDQMPITESTKQSPVNPYGFTKLCIEHALADYSHAYGFGYAALRYFNASGASPDGDIGEDHDPESHLIPIVLQVALGQREAISIFGDDYPTPDGTCVRDYIHVDDLASAHLTAMQKLEPGVALRLNLGTGEGVSVRQVIQACRDVTGREIPEKIAPRRPGDPPELVADASLAAEQLGWRAKYLDIRETVKTAWNWHVAHPNGYAD

SEQ ID NO: 51553 - protein, 349 aa, Debaryomyces hansenii CBS767
MSSIPETQKAVVFESNGGPLEYKEIAVPKPKSTEILINVKFSGICHTDLHAWKGDWPLPVKLPLVGGHEGAGVVVAIGENVKGWEIGDLAGIKWLNGTCMNCEFCQNSNESNCPNADLSGYTHDGSFQQYATADAVQAAKIPKGTDLAEVAPILCAGVTVYKALKSANLKAGQWVVISGAGGGLGSLCIQYAAAMGYRVISIDGGEEKGEFVKSLGSEAYVDFTKSKDIVADIKKITNGGAHGVINVSVSEKAMSQSCEYVRSRGTVVLVGLPAGAEIKTPVFDAVVRSIAIVGSYVGNRADTTEAIDFFSRGLIKCPIKIVGLSELPPVYEFMEQGKILGRYVVDTSK

SEQ ID NO: 51554 - protein, 359 aa, Thermosynechococcus elongatus BP-1
MRVGVNPPMIQMVLENPVSVKDAECFCQEILPQVSRTFALSIRFLPGNLGRAVLVAYLICRIADTVEDDPVASIAAKTALLDHLLQCFDSPALANSYGETARGVQGEPAHVQLVKHTGIVFTLYRSLPRTSQQHVQRWVSEMVHGMKKFINLYPNGIRIQTLAEYKEYCYYVAGTVGYLLTDLWHEHSPSIGADEYQVLLKRCAAFGEALQTVNILKDIAWDAEHENSIYIPNESLILQGSSHQTLLSAEHLQQNHAAIKELIALAWHDLDEAQAYLLSVPKAAIPIRLFCVLPLLFAYATLRELTHSTAMLQPGGGVKISRAEVKSLMVMGPLSILSNHGLRWLIGQVRQKPFILGGL

SEQ ID NO: 51555 - protein, 731 aa, Oryza sativa Japonica Group
MKFYLRYIIWLAYLSSDALAIYALATLFNRHKKQDYGHAHNTSILEVLWAPIFLIHLAGQDSITAYNIEDNELWTRHALTSLSQITIAIYVFCKSWPGGDRRLLQAAILLFVPGVLKCLEKPWALSSASINSLVSSPKNVRRTTNREVKKDPIQDFIDKVNESRLEDGRWEESSSPADFKPSELFVDLASPSSDDRLSKLLSFLQREGDESYILLQKSLYETFDLLYTKEKMFPIILSALKRQQNYVNTNVDTDEGKKEQETLKGFCGSMLRGLLPYLSFVAIGLFHQSHRKAYNHTDVKVTYTLLCCTAVLELYGPTLQKILTSGQARVQKTSFNMNSPKSVGKVNHAKHDVQAKSKAKGKLPVYDIMDDMVSQYSLLGYFVRNRKHSVIMGVAEFLSCKDYLDQRWRMKSCSSSRNITNLVLGHVKRWWNDEITNVSCYRKFNDNRGQWTLESEVFLQQLGWSLEGAFDESVLLWHLATDFCYYHICGSHDCEHATKTCFQGTSDLKSESPTFCEESIHQGRAVHCREMSNYMMYLLVVNPEMLMAGSRRNLFTDAYNQLKGMFNKKSTPLNEGELAGTIISEVQVHVQQPIKEKTIEDKTPAPSNKTGLIDDAWSIAEVLLNLHDEEKMWRVIEGVWVEMLCFSAARCRGYLHAKSLGTGVEFLSYVWLLMHYMGMETLAEKLARAELPNGACSGDSRTTHAEHSSGKEQVAGASSNDGITVVVDKNG

SEQ ID NO: 51556 - protein, 1000 aa, Nocardioides sp. JS614
MSVHFSRAGALRRGAGLFSAGAVVAGLLVGTPASVGAAEAKPAASGSTSLTAGRYVVLLREPSAAQYDGTNPRFAATRARGDRQFDARSQRVRTYTAHLRSAQRSIASSVGADVDQSYTIAANGFSTALTQEQALDLSSDRRVLLLQKDQLVHADTWNTPRFLGLTGKRGAWATHGGQKKAGAGIVVADLDSGIWPEAKSFAGPALTRNPQTKWHISRIGTSTRMDKADGGVFTGECELGEDWTADDCNTKLIGARSYSAGYLASGNAIIDADYASTRDGNGHGTHTASTAAGNIVDRVRTEGVEFGTISGMAPAARIAAYKVLWAQDDGTASGVTSDIVAAIDDAVYDGADVLNFSISGALDTVVEATEVAFEGAAEAGVFVAASAGNSGPDASTVAHNSPWLTTVAASTHHNFENTLVLGNGTKIVGASINDKRVSSKKLVDSEASGVAGGDDADAKLCGPDTLDPAKVTGKIVVCTRGVYDRVAKSAEVARAGGVGMVLANPTENSLDADFHSVPTVHITNTDAAKVFAYLAAQGSAATATIEPGNLTKKTTPLPQIAGFSSRGAAIANDADLLKPDIAAPGVSVLAAVAPPSNEGRDYDLYSGTSMAAPHITGLAAFMLSVHPTWSPMKVKSAMMTTAHRVKDAEGKTSNDVLAEGSGQVSPRRFFDPGLFVTSTPREWLGFLTGQGLDTGYAAVAAKDLNGPSMAQGQVPSATSFTRTFTSSMAGTWKVSVSVPGFAAAPSATKLVASGAGDVETLTVDFTRTTAPLLEFAMGWVTLTGPTTVRIPVALRPVSVKAPASVQGTGTDGSVEVPVTAGATGELLVEPTGLAKAQTADNTVAVADFQLECVEIGADSKLARFDLDAADDTADLDMFVYYSPTSCDPDTLVAQVGQSANPTADESVTVMAPDAGFYVIEVDGFAAGDAGAPMAYQLRSYDLGPAATLGNLTVTPNPVPVVAQQETTFDVSWSGLDPDASYLGMLEYDGALAPTMVEITS

SEQ ID NO: 51557 - protein, 352 aa, Rhodococcus sp. RHA1
MTFFESLARKLDRTGVDPTVWHAPPPPPPTGVLAPNGMLDDAHRWTLPAGEGPEDVAVDHDGRVVTGGNDGRIWRFDGHGHATELANTHGRPLGVEILDDGRFLICDAERGVLRVDDQGRVDVLADAAAGRPLVACNNSAVGRDGIVYFTDSSAHFTIADHRYDLLEHRGTGRLLRLDPRTGETDLLAEGLQFANGVGLASDESFVLVAETGSYQISRVDLTGPSQGAASVWAANLPGIPDNMTSQTRDGLFWVALYSPRMRLLDLLAPYPTLRIVAANLPEAVQPNPEHAGWVIALDHRGEIVHSLRGGKGSYSPVTGVREHDGWLYLGSLTADAVARVPAPPRPDVARGE

SEQ ID NO: 51558 - protein, 60 aa, Zea mays
  misc_feature (22)..(22): Xaa can be any naturally occurring amino acid
MASGNARIGKPAPDFKATAVVXGAFKEVKLSDYKGKYVVLFFYPLDFTFVCPTEIIAFSN

SEQ ID NO: 51559 - protein, 370 aa, Triticum aestivum
  misc_feature (135)..(135): Xaa can be any naturally occurring amino acid
  misc_feature (152)..(152): Xaa can be any naturally occurring amino acid
  misc_feature (223)..(223): Xaa can be any naturally occurring amino acid
  misc_feature (262)..(262): Xaa can be any naturally occurring amino acid
  misc_feature (301)..(301): Xaa can be any naturally occurring amino acid
  misc_feature (314)..(314): Xaa can be any naturally occurring amino acid
  misc_feature (337)..(337): Xaa can be any naturally occurring amino acid
  misc_feature (365)..(365): Xaa can be any naturally occurring amino acid
MALTRIGLAGLAVMGQNLALNIAEKGFPISVYNRTTSKVDETVQRAKLEGNLPLYGFHDPASFVNSIQKPRVVIMLVKAGAPVDQTIATLAAHLEQGDCIVDGGNEWYENTERREKAMEERGLLYLGMGVSGGEXEGARHGPSMMPGGSLEXAYQYIEDILLKVSAQVPDSGPCVTYIGKGGSGNFVKMVHNGIEYGDMQLIAEAYDVLKSGGKLTNGELQQXFSTEWNKGELFSFLVQITGDIFSIKDDQGEGYLVDKVLXDRPGMKGTGKWTVQQAAEPSVAGLTIEASWDPRFLNGPXGDRVPASKIFQGXDYSRGETVPKGQLFPGLLGKPLXPSRIWGYPQGLKFFRPKNRGKEWGPTLXNGQRS

SEQ ID NO: 51560 - protein, 554 aa, Chromobacterium violaceum ATCC 12472
MSNLIELKVPDIGGHSNVDIIEVFIAPGQTVSVDDSLITLETDKATMEVPAEAAGVIKEVKAVVGGKISEGDVIAILEVGAAASAPAPAAAAPAPAAAPAAAPAPAAAAPAAAPAAPAASGRSEIRVPDIGGHNGVDVIEVTVKVGDEIAVDDSLITLETDKATMEVPATAAGKVVEVKIKVGDKVSEGDLIVVVEGAVAAASAPAAAAPAPAAAPAAPAPVAAAPAAAPAVAPVAAAVSAAIDEIAFSKAHAGPSVRRLARELGVDLGKVKGNGRKGRITEDDVKAFVKGVMQNPAALAPAAAPAGSGAGLDLLPWPKVDFAKFGPIETKPLSRIQKISGANLSRNWVMIPHVTFNDECDITELEDFRKTVGKEWEKSGLKISPLAFIIKAAAEALKAFPTFNSSLDGDNLVLKQYYHIGFAADTPNGLVVPVIKDADKKGLRQIAQELTDLSKLAREGKLKPTDMQGATFTISSLGGIGGTSFTPIVNAPEVAILGVCKSQIKPVWNGKEFAPRLMCPLSLSFDHRVIDGAAAARFTVHLGKLLSDVRRLIL

SEQ ID NO: 51561 - protein, 599 aa, Chromobacterium violaceum ATCC 12472
MSNLIELKVPDIGGHNNVDVIEVFVKPGDVIEKEASLITLETDKATMEVPAEAAGTVKEVRVTVGSKVSEGDLVVILEAAGAAAAAPAEVKPVETTGVASATTQAGFAPQAAPVAASHSGGADIECDVMVLGGGPGGYSAAFRAADLGLKVVIVERYATLGGVCLNVGCIPSKALLHNAAVIDEVSHLAANGIKFGKPEVDIDMLRGYKEKVIAKLTGGLGGMAKARKVEIVRGNGHFIDPHHIEVSLTTGKGREESGEKKIVKFKNAIIAAGSRVVKLPFIPNDPRVVDSTGALELKGVADRMLIIGGGIIGLEMGTVYSTLGARLDVVEMLDGLMQGADRDLVKVWQKWNAHRFDNIMLNTKTVAVEPKEDGVWVTFEGEQAPKEPQRYDLVLYATGRAPNGKLIGAENAGIAVTDRGFIQVDKQQRTNVPHIFAIGDIVGQPMLAHKGVHEGHVAAENCAGMKSYFDARVIPGVAYTDPEVAWVGVTEDEAKKQGLKIEKGVFPWAASGRAIANGRDEGFTKLIFDAESHQIIGGGIVGPHAGDMIGEVCLAIEMGCDATDIGKTIHPHPTMGESIGMAAEVAHGTCTDLPPQRKK

SEQ ID NO: 51562 - protein, 337 aa, Coccidioides posadasii
MVVKVGINGFGRIGRIVFRNAVEHPEVEIVAVNDPFIETHYAAYMLKYDSTHGRFKGDVKFSENGLDVDGKHVRFYQERDPANIPWAETGADYVIESTGVFTTTEKASAHLKGGAKKVIISAPSADAPMFVMGVNNETYKSDIKVLSNASCTTNCLAPLAKVVNDNFGLVEGLMTTVHSYTATQKTVDGPSSKDWRGGRTAAQNIIPSSTGAAKAVGKVIPSLNGKLTGMSMRVPTSNVSVVDLTCRTDKSVTYDQIKEAMKKASANELKGIMSYSEDALVSSDLNGDPHSCIFDATAGIALNDHFIKLVAWYDNEWGYSRRVIDLIAYIAGVDAGK

SEQ ID NO: 51563 - protein, 194 aa, Xanthomonas oryzae pv. oryzae KACC10331
MMTVLMLDNYDSFTYNLVQYLQALGAEVMVVRNDAMRVDQIAALKPERIVISPGPCTPNEAGISLQLIEQLGQTTPILGVCLGHQSIGQVYGGDVIRAGNIMHGKTSPIRHQGQGVFAGLPDSYEATRYHSLVVDKSTLPDALEVTAWTENPDGSIEEIMGLRHRQFPVEGVQFHPESILTQHGHALLKNFLQR

SEQ ID NO: 51564 - protein, 131 aa, Aggregatibacter segnis
SFCERVISGEWKGYTGKAITDVINIGIGGSDLGPYMVTEALRPYKNHLTMHFVSNVDGTHIAETLKKVNPETTLILVASKTFTTQETMTNALSARDWFLAAAKDPAHVAKHFAALSTNAKAVTEFGIDTNN

SEQ ID NO: 51565 - protein, 336 aa, Rhizomucor miehei
MTVKAGINGFGRIGRIVLRASLLNPEVEVVAINDPFIDLEYMVYMFKYDSTHGRFKGTVEAKDGKLVVNGKPISVYAERDPCCIPGRIGAEYIVESTGVFTTKEKAGAHLTGGAKKVIISAPSADAPMFVVGVNLESYSSDMQVISNASCTTNCLAPLAKVIDDEFGIVEGLMTTVHATTATQKTVDGPSGKDWRAGRGAGANIIPASTGAAKAVGKVIPHLNGKLTGMAFRVPNPDVSVVDLTVRLEKSASYEDIKAAIKKASEGSLKGILGYTEDEVVSTDFIGDSHSSIFDAKAGISLNPNFVKLISWYDNEYGYSTRVVDLLVHIAKVDGRL

SEQ ID NO: 51566 - protein, 169 aa, Triticum aestivum
LLQSEHCRGKIVMELINANPVIHEKRERRTRQAPENIDENAREAIDQLEIFDHIRDIKDPEHPYSLEELNVVTEDSVEISDELSHVRVTFTPTVEHCSMATLIGLCLRVKLMRSLPPHYKVDIRVAPGSHATEAALNKQLNDKERVAAALENSNLLDTVEECLSPMTLG

SEQ ID NO: 51567 - protein, 337 aa, Omphalotus olearius
MVVKVGINGFGRIGRLVIRNALEAQGVEVVAVNDPFIPLDYMVYMFKFDSVHGRYKGTVEAKDGKLIIAGKPIAVFGERDPASIPWGASGADYVVESTGVFTTIDKASAHLKGGAKKVIISAPSADAPMYVCGVNLDAYDPRRPSISNASCTTNCLAPLAKVIHDKFGIVEGLMSTIHATTATQKTVDGPSNKDWRGGRSVNNNIIPSSTGAAKAVGKVIPSLNGKLTGLSFRVPTLDVSVVDLVVRLEKEATYDEIKAAVKEAVAGPLKGILDYTEDALVSTDFTGNTHSSIFDASAGIALNKNFVKLIAWYDNEWGYSRRVVDLITFVAQKDGNA

SEQ ID NO: 51568 - protein, 333 aa, Oryza sativa Japonica Group
MLTAAMHMLDSSTSSSPWLPPDLMPPPPPPPPAAATLHHHFRAAAAAPGRRRIAKRRPRPSRRLPTTYISADPANFRRMVHQVTGADDLPPPPPSLSLQQTTELLLPAVHAAPAGSPGAAGALMLPTLDTSAFLLGRRAEPAAAAPPCDESVALVRGGAGNYGSNNNSISSSSSSGNCGGGFPTLDSWDLLATVKFVLIFLLLIPASLHQPQENGRQYCVVHAKHITVGSAGSTATLAYTTETGRMQAQAKTGTDCVCRRQISRVSWRTAPLITPRWQDETAQACHHGDMVTYFAAFSTAIPGWQQISPGIRDTGKELLCKVTRTSQSVSHGW

SEQ ID NO: 51569 - protein, 131 aa, Aggregatibacter segnis
SFCERVISGEWKGYTDKAITDVINIGIGGSDLGPYMVTEALRPYKNHLTMHFVSNVDGTHIAETLKKVNPETTLILVASKTFTTQETMTNALSARDWFLAAAKDPAHVAKHFAALSTNAKAVAEFGIDTNN

SEQ ID NO: 51570 - protein, 354 aa, Oryza sativa Japonica Group
MAGARAIGSLPVPNVQELAKTCNGPDEHIPERYIRPEASSEEVISNYHGEAIPIIDLNKLLSPQSSEECVKLRSACQYWGFFQLINHGVPDEVIANLKRDIVDFFSQPLDAKKEYTQLPNSLEGYGQALVFSEDQKLDWADMLYLQVHPSDSRDLRFWPTSPASFRRSLDAYSSETKSLALCLFEFMAKAVGAKPEALLGIFEEQPRGLRMTYYPPCLQSDKVMGISPHSDVVGLTLLLQVNDVQGLQIKKDGKWLSVDAPNGAFIVNIGDTLEILSNGKFRSVEHRAVINPNKERISASLFHYPCENMVIRPLTEFVKDGKVNYRSISYLDFMTQFFTQQLDGKNRLEMLKLE

SEQ ID NO: 51571 - protein, 338 aa, Paracoccidioides brasiliensis
MVVKVGINGFGRIGRIVFRNAVEHDDVEIVAVNDPFIETKYAAYMLKYDSTHGQFKGDIQHSSSNNLTVNNKTIHFYQERDPANIPWGKHGVDYVVESTGVFTTTEKAKAHLSGGAKKVIISAPSADAPMFVMGVNEKSYRPDISVLSNASCTTNCLAPLAKVIHDNFGIAEGLMTTIHSYTATQKTVDGPSHKDWRGGRTAAQNIIPSSTGAAKAVGKVIPALNGKLTGMAMRVPTANVSVVDLTCRTEKPVTYDQIKAAVKAASEGELKGILGYSEDALVSTDLNGDPRSSIFDASAGIALNDRFVKLISWYDNEWGYSRRVLDLIAYIAKVDAGK

SEQ ID NO: 51572 - protein, 131 aa, Aggregatibacter segnis
SFCERVISGEWKGYTGKAITDVINIGIGGSDLGPYMVTEALRPYKNHLTMHFVSNVDGTHIAETLKKVNPETTLILVASKTFTTQETMTNALSARDWFLAAAKDPAHVAKHFAALSTNAKAVADFGIDTNN

SEQ ID NO: 51573 - protein, 298 aa, Legionella pneumophila str. Lens
MNKQVIDKYTQRHELYLEQLLNEIVIPAPQIRSALHYALFSGGKRIRPILVYLAGDLIDVDQEVLDIIAAALELTHCYSLIHDDLPAMDNDDLRRGKPSCHKAFDEATAILVGDGMQALAIEVVLMRLSPLLPAAQVVAITQVLVNASGISGMVSGQSLDLSELAKSSVTEEQLREIHLLKTGKLILACFEMVLAAQHEVSEQIKSALRTYGKHIGLVFQMQDDYLDLYAPTQILGKGRSSDQANQKTTFATLFNKQQLEEEIAVHYQIAMDSLRLFGIKAAALIELTKQLQNRSNLS

SEQ ID NO: 51574 - protein, 131 aa, Aggregatibacter segnis
LFCERVISGEWKGYTGKAITDVINIGIGGSDLGPYMVTEALRPYKNHLTMHFVSNVDGTHIAETLKKVNPETTLILVASKTFTTQETMTNALSARDWFLAAAKDPAHVAKHFAALSTNAKAVAEFGIDTNN

SEQ ID NO: 51575 - protein, 131 aa, Pasteurella pneumotropica
DFCQCVISGEWKGYTGKAITDVVNIGIGGSDLGPYMVTEALRPYKNHLTMHFVSNVDGTHIAETLKKVNPETTLFLVASKTFTTQETMTNAESARDWLLASAKDKSAVAKHFAALSTNGKAVAEFGIDTNN

SEQ ID NO: 51576 - protein, 66 aa, Brassica rapa
  misc_feature (22)..(22): Xaa can be any naturally occurring amino acid
  misc_feature (32)..(32): Xaa can be any naturally occurring amino acid
  misc_feature (58)..(58): Xaa can be any naturally occurring amino acid
VGGGIGATLKMIVSKYPTLKGXNFDLPHVIEXATSHPGIEHVGADMFVSVPEGDAIFXKWICHDWS

SEQ ID NO: 51577 - protein, 424 aa, Legionella pneumophila str. Lens
MVFVACGLNHKTAPIHVREKVALQPAMQDSLLSSLLDLPEVNEAAILSTCNRTEIYCDTNTPEVLGNWLAHEHQLSEELLSQFLYIHQGKEGIKHTLRVASGLDSMMIGEPQILGQMKQAYQHACRLGTVKTQLRPVFEYIFRASKRIRTRSGIGANPVSIAYAAVQLIGQLFKNYHSLSVFLIGSGETASLVAKYLHQHGVHRFLIASRTLENAQKLAETFDGKTLSIGDIPQYLPLADVVISATACPLPFINKSLVEHALEQRNHAPMFLLDLAVPRDIEGNVNELEQVHLYNVDDLQSMIEKGMDERRNAALQAEQLIESELDNYIRWHRSLRAKDVICDYRNQMHTLAQQELQRALKKISAGQNQQDVLNEFSMRLVNKLTHNPTIGLRQMAWDNREDLLDLARYLFDTTANQSLYEEIS

SEQ ID NO: 51578 - protein, 90 aa, Oryza sativa Indica Group
MAQPAFLSSLRSRLRSPQPQAPALPHLQAPRRGFHVELGAREKALLEEDTALKRFKSYKNSVKQVSKVGNILTGVVLFACAYEIVALANS

SEQ ID NO: 51579 - protein, 62 aa, Brassica rapa
ATLKMIVSKYPNLKGINFDLPHVIEDAPSHPGVEHVGGDMFVSVPKGDAIFMKWICHDWSDE

SEQ ID NO: 51580 - protein, 362 aa, Triticum aestivum
MALRRLLQGIVLPRTTGRHVGASFSTEAGETIRATLFPGDGIGPEIAESVKQVFNVAGVPIEWEEHYVGTEVDPRTESFLTWESLESVRRNKVGLKGPMATPIGKGHRSLNLTLRKELGLYANVRPCNSLPGYKTRYDDVNLVTIRENTEGEYSGLEHQVVRGVVESLKIITRQASLRVAEYAFHYAKANGRERVSAIHKANIMRKTDGLFLKCCREVAEKYPEITYEEVIIDNCCMTLVKNPGTFDVLVMPNLYGDIISDLCAGLIGGLGLTPSCNIGEGGICLAEAVHGSAPDISGKNLANPTALMLSAVMMLRHLQFNDQADRIHNAILQTIAEGKYRTADLGGKSSTSDYTKAVCDHI

SEQ ID NO: 51581 - protein, 546 aa, Psychrobacter arcticus 273-4
MMADDKTKSTQAERLVQLRRDKGMTAEQLAQAMTAAGAKVSRGAISNWERGTNGIVSSKLPTLARILGCSEGYLLRGELESDSKSDVDLKNIASDNTNVYVESDEQAHSASQITHTTTIPSTPRKISPNNLMSGPFMNTIKKSDKLQNVCYDIRGPLLQTANKMEAEGKRILKLNIGNPAPFGLEAPHEILRDVAMNLPEATGYSDSQGIFSARKAVLQYYQSKGLLSAVDVRDVYLGNGVSELIVMTLQALMNDGDEVLIPMPDYPLWTAATNLAGGTAVHYRCNEEDNWHPDIEDIKSKITSKTKGIVVINPNNPTGALYSDEVLLQIIEVAKEHDLIIMADEIYDRILYDDMEHTPMSTLTDEVLVLSYNGLSKSHRIAGFRAGWMMISGRKEHAADFIEGLDMLASMRLCSNVQGQYAIQTAMGGYQSMKDLTSKKGRLYKQRELAVTRLNAIKGISCTMPQGAFYCFPKMDPEIYPIKDDMQFMMDLLLEENVLMVQGTGFNWDKHDHFRLVFLPNLHDLEDAMDRLDRFFAKKRKQFGTD

SEQ ID NO: 51582 - protein, 65 aa, Brassica oleracea
  misc_feature (24)..(24): Xaa can be any naturally occurring amino acid
  misc_feature (29)..(29): Xaa can be any naturally occurring amino acid
  misc_feature (31)..(31): Xaa can be any naturally occurring amino acid
  misc_feature (36)..(36): Xaa can be any naturally occurring amino acid
  misc_feature (60)..(60): Xaa can be any naturally occurring amino acid
IVSKYPDLKGINFDLPHVIEEATXHPGIXHXGGDMXVSVPKGDAIFMKWICHDWSDEHCXKFLKN

SEQ ID NO: 51583 - protein, 1408 aa, Arabidopsis thaliana
MGTETVVHDQARWAMAAMERRLAVAKAQLLQQQQQKNEKDKKGTSDVDVSMKESHQADSLPTPSKTSIKKVDPKDDDSVAYTKLSHPVDENLLATNVKFSSAKGTIVDKVLHNLLRSGDSAQKYLQGTKSVKLDNYILLDNFVQSRSSASGSKKASQKDSKRSKSRMSMKRLKKSGALHIPKDLQKFDLFKPMHGMWESYMMKLIKVTGKIQLSLTLLSADLHGAFMFGNPSFFHKSVVLGYDLLSLTHFPKLNFSQPILLVTVAECKIASFTGVQGIMVRETSETFGIITRDDKFRVVPKKLSVFIIQLDCWKITLHGDKRSPDKKKRMNPSQQHLPKLCPKRLFLFFTPFLLFSLYYILTTIKTITISSQDRHHPPQLHVPSISHYYSLPETSENRSSPPPLLLPPPPSSSSSLSSYFPLCPKNFTNYLPCHDPSTARQYSIERHYRRERHCPDIAQEKFRCLVPKPTGYKTPFPWPESRKYAWFRNVPFKRLAELKKTQNWVRLEGDRFVFPGGGTSFPGGVKDYVDVILSVLPLASGSIRTVLDIGCGVASFGAFLLNYKILTMSIAPRDIHEAQVQFALERGLPAMLGVLSTYKLPYPSSSLCFELLASSTLLLILKERTFYPDGLYLMEVDRVLRPEGYWVLSGPPVASRVKFKNQKRDSKELQNQMEKLNDVFRRLCWEKIAESYPVVIWRKPSNHLQCRKRLKALKFPGLCSSSDPDAAWYKEMEPCITPLPDVNDTNKTVLKNWPERLNHVPRMKTGSIQGTTIAGFKADTNLWQRRVLYYDTKFKFLSNGKYRNVIDMNAGLGGFAAALIKYPMWVMNVVPFDLKPNTLGVVYDRGLIGTYMNWCEALSTYPRTYDLIHANGVFSLYLDKCDIVDILLEMQRILRPEGAVIIRDRFDVLVKMEALSSLTFKGSLPEAIFEAKGKKKLFVVYISGEDEESDKLNRLTWTDASGSLHQFLDPYSSVPCIAAIGFSGTQVWRTEGFITAEDLASSLEKAWLGLHIQETTASIFSAALASQNSETPVSSASSVVLPPGSVPLDAAVASPSTASSVQPSETNLFLKQGKESAEPSNLCDTTKNQPAPSVDGTKANVEHEATETPLRVQAEKEPIRPTAPGTNDNTSRVRSSVDRKRKQGTVINEEDSGVGVSGRDINLTKSVDTKETMKPKDEGGEEEDGEKSKKASDVHLNIRLPDGSSLQEKFSVTSILRMVKDYVNSNQTIGLGAYDLAVPYPRKVYTDQDLDKSLSELRLFDRQALVVVPRKRATVYQRGTSYSESNNNTDPNSGGYFAYVRRVLSYANPFSYFGGGTANASSSVPERQTRPNTEVRNNLGQVGTSFQDPSEGRSNVRNRRPTTSRIGSNIHTLNHNEDEAPFGDGNAFWNGNSTQYGGGSGGDSNDRR

SEQ ID NO: 51584 - protein, 377 aa, Pseudoalteromonas tunicata D2
MENQFIKSKAAIAWGPNQPLSIEEVDVMYPKAGEVLVKIIATGVCHTDAFTLSGQDPEGVFPAIMGHEGAGIVHAIGEGVTSVAIGDHVIPLYTPECGECKFCTSGKTNLCQKIRATQGKGLMPDGTTRFYKDGQPIFHYMGTSTFSEYTVLPEISLAKVNKTAPLEEICLLGCGVTTGMGAVMNTAKVKAGDTVAIFGLGGIGLSAIIGAQMAGASQIIGVDINPSKFELAKKLGATLCINPKDYDKPIQEVIVELTDGGVDFSFECIGNVDVMRSALECCHKGWGESVIIGVAGAGQEISTRPFQLVTGRVWRGSAFGGVKGRSELPHIVERYLAGEFKLDDFITHTMALEQINEAFDLMHSGESIRSVIHFDHK

SEQ ID NO: 51585 - protein, 685 aa, Mycobacterium bovis AF2122/97
MGSNIARNFARHGYTVAVHNRSVAKTDALLKEHSSDGKFVRSETIPEFLAALEKPRRVLIMVKAGEATDAVINELADAMEPGDIIIDGGNALYTDTMRREKAMRERGLHFVGAGISGGEEGALNGPSIMPGGPAESYQSLGPLLEEISAHVDGVPCCTHIGPDGSGHFVKMVHNGIEYSDMQLIGEAYQLMRDGLGLTAPAIADVFTEWNNGDLDSYLVEITAEVLRQTDAKTGKPLVDVIVDRAEQKGTGRWTVKSALDLGVPVTGIAEAVFARALSGSVGQRSAASGLASGKLGEQPADPATFTEDVRQALYASKIVAYAQGFNQIQAGSAEFGWDITPGDLATIWRGGCIIRAKFLNHIKEAFDASPNLASLIVAPYFRAPSNRRSTVGGVWCRRRPNWVSRPRDSRRPCRITTRCAPRGCPLHSPRPSATSSAHTPTAGSTNQASSTHYGVQTAPKYRCSGLELKGGKGVSDEISRRAPTRVRPDIQRRVHRSEPIRGRVALRRRFVHRRRLGHHHSGSGRQYDRGSRAADGRDGRPPRWHRNPAAGSADPGGKADGGVRQKPGPGARHPSDAGTRRFGVRRHGAHPQARTWRRGGHPRGSPDRIGARIVLPGRGSLHPGARYRRDGLCDRSSGNRATQDLRPAGARPGRRCGADRRRRHVGGSAKPHRGYPRRYLHPGHR

SEQ ID NO: 51586 - protein, 116 aa, Glycine max
  misc_feature (16)..(16): Xaa can be any naturally occurring amino acid
  misc_feature (29)..(30): Xaa can be any naturally occurring amino acid
  misc_feature (50)..(50): Xaa can be any naturally occurring amino acid
  misc_feature (67)..(67): Xaa can be any naturally occurring amino acid
  misc_feature (72)..(72): Xaa can be any naturally occurring amino acid
  misc_feature (80)..(80): Xaa can be any naturally occurring amino acid
  misc_feature (87)..(87): Xaa can be any naturally occurring amino acid
  misc_feature (94)..(94): Xaa can be any naturally occurring amino acid
  misc_feature (111)..(111): Xaa can be any naturally occurring amino acid
MASSSDSWMKEYNEAXKLADDITGMISEXXSFPASGPETQRHASAIRRKXTILGTRLDSLQSLLSKXPAKTXKEMNPRKXMLLNLKXKINQMAXTLNISNFANKDNLFGPXINPMP

SEQ ID NO: 51587 - protein, 509 aa, Bifidobacterium longum NCC2705
MSRLALVDWVSANGAIAPRTKLNKNRQAFMRKAKIVDTIGPSTEDYDNLLKLVEAGMDVARLNRSHGTPEDHLKVYNNVRKASEATGRNVAALVDLQGPKIRCGWFKKNADGEDKVQLQLGQEFVITTDDVEGDEHITSTTFKGLPGDCHPGDPILIDDGKVRLEVTKVEGNNVYTKVVVAGPVSSHKGINLPGVAVSLPALTEKDEADLRWAIRTGADIIAMSFVRFATDIDRAHEIMDEEGRRIPIIAKIEKPQALENLEEIVKTFDGVMAARGDMAVECPLEEVPLATKRIIELARQYAKPVIVATEVLGSMVNSPVPTRAEASDCANAILDGSDATMTSNETAVGKYPDVTVATMARISGYATDHGFDRIPELKNLDMSSTGAVSSAAVDLADKLNAKAIVAYTQTGATVHRVSRERPAAPIYGLTSNEHTYHWLALSWGTEAFLLKEDYHDKSRKDLMVYTDKVLKDAGKVADGDKIVILSSAQGDHQPGRTDSIYVHTVGACD

SEQ ID NO: 51588 - protein, 566 aa, Aspergillus oryzae
MYALNQTAKSVWLPLTQLSGTSKYDIVSRLVCTILIIRSVLTVYQNVTCYGVAGTLTNALEYCRRWISLETRAAPRKFKRVDKDIEAISNSMVQKLARHGADVRRNLSLPKEGWDIEKVEAELNELHNLDHTRWEDGRVSGAVYHGGNELLEMQTRAIGKFSVSNPIHPDVFPGVRKMEAEIVAMILAAFHGPEDGAGVTTSGGTESIIMACLAAREKAAAERGVTNPEMIIPSTAHAAFFKAAQYFKIKLHLVSCPAPEYKASVTEIRRLINRNTVLLVASAPNYPHGIVDDIPEISRLATENDIPLHVDCCLGSLVIAFLQKSGFPSPYDNSGGFDFRQPGVTSISVDTHKYGFAPKGSSVLLYRNRSYRNYQYFLFPDWSGGAYASPSMAGSRPGSLIAGTWATLVRMGESGYISSCRQIVGAAKKFEAAILTNPILKPHIEIIGYPMVSVIAFTSKNDEIETYDIADAMDARGWHLNALQSPPAIHCAFTIPTAEAVDGLISDLIDVISEILLQIQEQKQKGEHIVRQRGKSAALYGVGGSIADRTMVNQFAEGFLDTLYKA

SEQ ID NO: 51589 - protein, 310 aa, Thermosynechococcus elongatus BP-1
MVGRFVMETLRGRDLLSIADLSRAEAEYLLDLAAQMKIGKVAPQCPKVLGLLFQKASTRTRVSFTVAMYQLGGQVIDLNPQSTQVGRGEPLTDTARVLDRYLDAVAIRTYGQAELQLFADYARIPVINALTDREHPCQILADLLTLRESFGTLAGLTLCYIGDGNNVAHSLLLGCALLGVNIRVASPPQFAPLADIVAQAKALSGGKSEVAVLTDPQAAAKGAHALYTDVWASMGQEAEAGDRQPIFQPYQINDHLLALADPRAIVLHCLPAHRDEEITASVLEGPQSRVWEQAENRLHVQKALLASLLV

SEQ ID NO: 51590 - protein, 443 aa, Debaryomyces hansenii CBS767
MSIPRKTEDVLIGRSSSCDVRINGNDVSSKHCKLTLTINNNREYLCIKDLSSNGTYLNDEIIGKDSSILLRSGDKLDFAKTGGSYIFRYIIDIKNTKVQQSKSFFDDYILGEQLGSGHYAVVKEATDRSTGDVVAVKIFHPNKTNGQGNENDDVKLQQEMNLLLSINHPNIVRFISHYVEPINQYSVTSYLVLEKMNNGELFQRIINKLKLRQDETRAIFKQLLSGLMYLHENSIIHRDIKPENILLDITPRTSKDQKQTGPWDENEYDIKVKIADFGLAKFIGELKFTNTLCGTPAYVAPEILSNKRNYSTKVDLWLSGVLLYVCLCGFPPFSDELGPPNMREQILTGKYAFYSPYWDDINDSVLHLISSLLVVNPSERFDVIQTCEHYWFNEQDDSSDRVMINNDESVQRAPVRSNSLPLSLRDKYNSEIMSDANQKSSIM

SEQ ID NO: 51591 - protein, 621 aa, Bacteroides fragilis NCTC 9343
MTPYLQVDNLTKSFGDLVLFENISFGIAEGQRIGLIAKNGTGKTTLLNILSGKEGYDSGNIVFRRDLRVDYLEQDPQYPEELTVLEACFHHGNSTVELIKEYERCMETEGHPGLDDLLVRMDHEKAWEYEQKAKQILSQLKIRNFDQQVKHLSGGQLKRVALANALITEPDLLILDEPTNHLDLNMTEWLEEYLRRTNLSLLMVTHDRYFLDRVCSEIIEIDNRQVYQYKGNYSYYLEKRQERIEAKSVEIERANNLYRTELDWMRRMPQARGHKARYREDAFYELEKVAKQRFNNDNVKLEVKASYIGSKIFEADHLYKSFGDLKILEDFSYIFARYEKMGIVGNNGTGKSTFIKILMGQVQPDSGTLDIGETVRFGYYSQDGLQFDEQMKVIDVVQDIAEVIELGNGKKLTASQFLQHFLFTPETQHSYVYKLSGGERRRLYLCTVLMRNPNFLVLDEPTNDLDIITLNVLEEYLQNFKGCVIVVSHDRYFMDKVVDHLLVFNGQGDIRDFPGNYSDYRDWKEAKSQKEKEAEKPQEEKTARVRLNEKRKMSFKEKREFEQLEKEIAELETEKLQIEELLCSGTLSVDELTEKSKRLPEVNDLIDEKTMRWLELSEIES

SEQ ID NO: 51592 - protein, 244 aa, Actinobacillus pleuropneumoniae serovar 1 str. 4074
MSLKDMTGQKVPNVTFHTRQGDAWVDVTTAELFDNKTVIVFSLPGAFTPTCSSTHLPRYNELACEFKAAGVDDILCMSVNDTFVMNAWKAAQESENVTVIPDGNGEFTEGMGMLVGKEDLGFGKRSWRYSMLVKNGVVEKMFIEPQEPGDPFKVSDADTMMKYLVQGWAPKESVSIITKPGCPFCAKAKALLKEKGYTFEEIVLGRDASTISVRAITGKTSVPQVFIGGKYIGGSDDLAAYFAK

SEQ ID NO: 51593 - protein, 338 aa, Burkholderia vietnamiensis G4
MNLQRFPRYPLTFGPTPIQPLKRLSAHLGGKVELYAKREDCNSGLAFGGNKTRKLEYLIPDALAQGADTLVSIGGVQSNQTRQVAAVAAHLGMKCVLVQEHWVNYDDPVYDRVGNIQLSRMMGADVRLVADGFDIGIRRSWEDAMESVRQAGGKPYPIPAGCSEHPLGGLGFVGFAEEVREQEAQLGFRFDYVVVCSVTGSTQAGMVVGFAADGRADRVIGIDASATPERTREQITRIARHTAELVELGRPIADADVVLDTRYAGPEYGLPNDGTLEAIRLCARLEGVLTDPVYEGKSMHGMIDMVRRGEFEPGSKVLYAHLGGVPALSAYAEIFRDG

SEQ ID NO: 51594 - protein, 528 aa, Borrelia garinii PBi
MKYALIRKLLFVLRTYMMNVRAILVLDFGSQYSQLIARRIREIGVYTKVIPYYTPLKEIKNMNIAGIILSGGPASVYAKDAPTLNMEIFNLKIPVLGICYGMQLIVKLFGGLVSKDYKQEYGSSEIFLKNEKSLLFSELPNKFQIIMSHGDSIEKIPNNFKQLAFTKNCIASISNEDQKIYGLQFHPEVTHSEFGDQILKNFVFKICQSQTNWSLESNVETIVEKIKLKVGSKKVILGLSGGTDSLVCALLIKKAIKENLICVFVNTGLLRKNEDKKILELKHQYDLNIKYIDASEKFLNYLKNISDPEEKRKIIGKEFVNVFEKITLEDQNIEYLAQGTIYSDVIESKSKNNASSKIKSHHNVGGLPDKMRLKLLEPLNEFFKDEIIQIGINLGIKKEALYRHPFPGPGLAIRIIGEVTQEKINILQEAENILTEELFTNDLYYEIRQAFVVLLPVKSVGVMGDQRTYEYTAVIRCVNTQDFMTAEWTELPYNFLRKVSSRIINEVRGINRVCYDISSKPPSTIEWE

SEQ ID NO: 51595 - protein, 165 aa, Triticum aestivum
MFSRLASFANPAAKSASASGRTMLQVRYLSEKAVAGSKGRAMPFSAVRATAPAASLPATLTIRDGPVFQGKAFGANANISGEAVFTTSLVGYPESMTDPSYRGQILVFTQPLIGNYGVPSAARDEFNLLKYFESPHVQCAGIVVSDVAVNYSHWTAVESLGEWCA

SEQ ID NO: 51596 - protein, 210 aa, Xanthomonas campestris pv. campestris str. ATCC 33913
MKLTIPTWLTLLRIVMIPVLVVVFYLPYKWTNFASAGVFALAAITDWLDGWVARRYHQYSAFGAFLDPVADKLMVAVALFLIVQGHPTPWMAFWAAVIVGREIAVSALREWMAEIGQRAKVRVAMIGKVKTTAQMVALLCLLYSVTPGQMPTHEIWLGNLIFQAGYWTLAIAALLTLWSGFQYLQAAWPSLRADEKAAITNKPKKVESNS

SEQ ID NO: 51597 - protein, 353 aa, Arabidopsis thaliana
MEGKGVTFSSVIVPSVQEMVKEKVITTVLPPRYVRSDQEKGEAAIDSGENQIPIIDMSLLSSSTSMDSEIDKLDFACKEWGFFQLVNHGMDLDKFKSDIQDFFNLPMEEKKKLWQQPGDIEGFGQAFVFSEEQKLDWADVFFLTMQPVPLRKPHLFPKLPLPFRDTLDTYSAELKSIAKVLFAKLASALKIKPEEMEKLFDDELGQRIRMNYYPPCPEPDKAIGLTPHSDATGLTILLQVNEVEGLQIKKDGKWVSVKPLPNALVVNVGDILEIITNGTYRSIEHRGVVNSEKERLSVASFHNTGFGKEIGPMRSLVERHKGALFKTLTTEEYFHGLFSRELDGKAYLDVMRI

SEQ ID NO: 51598 - protein, 461 aa, Thermococcus kodakarensis KOD1
MKKFVALLITMFFVVSMAAVAQPASAAKYSELEEGGVIMQAFYWDVPAGGIWWDTIRSKIPEWYEAGISAIWIPPASKGMGGAYSMGYDPYDFFDLGEYNQKGTVETRFGSKQELINMINTAHAYGIKVIADIVINHRAGGDLEWNPFVGDYTWTDFSKVASGKYTANYLDFHPNEVKCCDEGTFGGFPDIAHEKEWDQHWLWASDESYAAYLRSIGVDAWRFDYVKGYGAWVVKDWLNWWGGWAVGEYWDTNVDALLNWAYSSGAKVFDFPLYYKMDEAFDNTNIPALVDALQNGGTVVSRDPFKAVTFVANHDTDIIWNKYPAYAFILTYEGQPVIFYRDYEEWLNKDKLNNLIWIHDHLAGGSTSIVYYDSDELIFVRNGDSKRPGLITYINLGSSKVGRWVYVPKFAGACIHEYTGNLGGWVDKYVESSGWVYLEAPAYDPASGQYGYTVWSYCGVG

SEQ ID NO: 51599 - protein, 325 aa, Bradyrhizobium japonicum USDA 110
MALPGGAAGRDQESITLGEGCTPLVQQQWGDLRPLFKLEWFNPTGSFKDRGSAVMLSFLRQIGVDAILEDSSGNGGSSMAGLGAAGGMRVKILAPASTSPAKIAQVRAYGAAVQLVEGPREESEADAIRQSSQTFYASHNWQPFFLEGTKSLAYEIWEDLGFRAPDNVIVPVGAGSSLLGCAFGFRELLKAGQIAKLPRLFAAQPQNCSPIDASFKAGVDTPVAREVSKTIAEGTAIKNPLRLREIIAALRESGGGTVALAEDEIVAALRRLARQGLFAEPTSASAAAALDKLSAAGAIKANETTVAVLTGTGLKAATIVADLVQ

SEQ ID NO: 51600 - protein, 204 aa, Zea mays
MAEEKSRPRLNERIMSSLSKRSVAAHSWHDLEIGPGAPAVFNCVVEITKGSKVKYELDKKTGMIKVDRVLYSSVVYPHNYGFIPRTLCEDGDPMDVLVLMQEPVIPGCFLRARAIGLMPMIDQGEKDDKIIAVCVDDPEYRHLTDLKELSPHRLNEIRRFFEDYKKNENKEVAVNDFLPPTTSLEAIQHSMDLYAEYILHSLRR

SEQ ID NO: 51601 - protein, 131 aa, Pasteurella aerogenes
AFCERVISGEWKGYTGKAITDVINIGIGGSDLGPYMVTEALRPYKNHLTMHFVSNVDGTHIAETLKKVNPETTLILVASKTFTTQETMTNAHSAREWFLASAKDEAHVAKHFAALSTNAKEVEKFGIDTAN

SEQ ID NO: 51602 - protein, 231 aa, Actinobacillus pleuropneumoniae serovar 1 str. 4074
MSISQNLSEIKQQIQQISQQCGRDNVRLLAVSKTKPVEAIEEAIAAGQTAFGENYVQEGVEKIAYFAQQPNLEWHFIGALQSNKTRLVAENFDWIQTVDRLKIAERLSAQRSANKAPLNVLIQINISDEASKSGIQPEELDELAKAISQLPNLRLRGLMAIPKPESEPEQQKIALRKMQQLFDRLQDEFEGIDTLSMGMSDDMAAAIECGSTMVRIGTAIFGARDYSAKSV

SEQ ID NO: 51603 - protein, 385 aa, Brassica juncea
NKKLFWIPAMAPLISVILATLIVYLTNSETRGVKIVKHIKPGFNRPSVNQLQFNGQHLGQVAKIGIICAIIALTEAIAVGRSFATIKGYRLDGNKEMMAMGFSNIAGSLTSCYVATGSFSRTAVNFSAGCETVVSNIVMAITVMVSLEVLTRFLYFTPTAILASIILSALPGLIDISGALHIWKLDKLDFLVLLAAFLGVLFASVEIGLLLAVGISFTRIILSSIRPTVEALGRLSKTDIFGDVNQYPMANKTEGLLTLRISSPLLCFANANFIRDRILNSVQNVEEEEDVGQEVKKEKVLQVVILDMSCVISVDTSGVVALEELYQELASNDTRLVIASPRWRVLHKLKRAKLDDNMKKEKIFMTVGEAVDFYVRARTTLHDMC

SEQ ID NO: 51604 - protein, 234 aa, Ralstonia solanacearum GMI1000
MSLLHQARFFTTVNHLRDLPATAVPEVAFAGRSNAGKSTAINVLCNQKRLAFSSKTPGRTQHINYFSVMPAKALDPLGFLVDLPGYGYAQVPGEAKSHWEHLLGDYIQTRSQLAGLVIMMDARRPFTDLDCQMVEWFLPTGKPIHVLLTKADKLTNNDASRALMSARKVLAGYQAQIEGEVSLTVQLFSSLKRRGIEEAQRTVAGWLCLPEAMPPSPDAEPAKKTPSPDAQRGE

SEQ ID NO: 51605 - protein, 613 aa, Chlamydomonas reinhardtii
MAKVGTLEVTLTSASFVKDVEFVGVLGVGVGKQDPYAVLVLADQTHRSKTITDGGKEPTWNEVFTFRNVTPDQTLKLEFYDENVVFRDVALGSGKVSLGNVLGGPQPVSLDIPLISRKGKARGTVKMAFRFTEGKTATAQTTNPYAPVSKTVKPGNWILPTYADTDCWKDYEPGSILGKGTFGTTYSATNKKTGEKVAVKVISKKKLVSAEEIGDVQREVQIMHHLAGHPNVVCLKGVYEDKSNVCLAMEVCSGGELFDAIVKKGHYTEKDAASLIRTIVGVVAHCHNMGVIHRDLKPENFLLSDRSAAAALKATDFGLSSFFQEGQVFTDIVGSAYYVAPEVLKRAYSKEADIWSCGVILYILLCGYPPFHGENEKKIFEAVVTKPVDFTSDPWPAISEAAKDCVRRMLVRDPKRRATATQILQHEWMRENGCAADQPIQLEVLSRMKQFSAMNRLKKEALKLIAKSLPLDEINGMRELFLEIDKDKSGTISVEEFSEALKKKGMQGLTDADVSRMIAEADVNGDGTIDYEEFLAATINRSKLEREELLKQAFSKFDENGDGVITRQELFNALSDPALGVDPKEIDEIIDQVDQDGNGTIEYGEFVAMMRGL

SEQ ID NO: 51606 - protein, 482 aa, Salmonella enterica subsp. enterica serovar Paratyphi A str.
MQLNDSTLFRQQAFIDGDWRDARGGDVIPVSNPANGKPLGNVPKMGAEETRDAINAANRALPAWRALTAKERANILRRWFNLMMEHQDDLARLMTLEQGKPLAEAKGEISYAASFIEWFAEEGKRIYGDTIPGHQTDKRLLVIKQPIGVTAAITPWNFPSAMITRKAGPALAAGCTMVLKPASQTPFSALALAELAQRAGIPAGVFNVVTGSAGDIGGELTSNPLVRKLSFTGSTEIGRQLMEQCAKDIKKVSLELGGNAPFIVFDDADLDKAVEGALASKFRNAGQTCVCANRLYVQDGVYDRFAEKLNQAVNKLAVGDGLQADVAIGPLIDEKAVAKVQEHIADALEKGARVITGGEAHKLGGNFFQPTILVDVPDNAKVAKEETFGPLAPLFRFSDEADVIRQANDTEFGLAAYFYARDLSRVFRVGEALEYGIVGINTGIISNEVAPFGGIKASGLGREGSKYGIEDYLEIKYMCIGL

SEQ ID NO: 51607 - protein, 527 aa, Clostridium acetobutylicum ATCC 824
MLTVNNVSLRYGGRKLFEDVNLKFTPGNCYGIIGANGAGKSTFLKILSGEIEPNTGDVSVDSNTRISVLKQDHFQYDEYEVLETVIMGNERLYSIMKEKDALYAKPDFSEEDGIKASTLEGEFAELNGWEAESEAATLLQGLGISTELHSKKMSELIGGEKVKVLLAQALFGNPGILLLDEPTNHLDIKSIAWLEEFLIDFEGTVIVVSHDRHFLNKVCTMIADVDYGKITLYVGNYDFWYKSSTLALEMTKDQNKKKEEKIKELKDFIARFSANASKSKQATSRKKMLDKLNLEDIKPSNRKYPFIGFKPEREPGNDILTVENLSKTIDGEKVLNNVSFIVSKDDKIALVGDNEIAQTTLFKILSGEMEPDSGSYKWGITITNAYFPKDNSEYFNDCDLSLVDWLRQYSEEKSETYIRGFLGRMLFSGEEALKKASVLSGGEKVRCMLAKTMLTNANFLMFDQPTNHLDLESITALNNGLTNYKSNLMFTSHDHEFIQTIANRIIEITNDGIIDRKCTYDEYLEIQ

SEQ ID NO: 51608 - protein, 500 aa, Psychrobacter arcticus 273-4
MTDSTDLKHMDNAEQTQTAYINGSYLAVDKALSTFDSINPVTGEVLSTIQQTTTEQINDAVIAAQKGQKVWAAMTAIERSRILLNAVAILRERNDELAVLETKDTGKAISETKYVDIVTGADVIEYYAGLAPMIEGRQIPLRDTSFVYTRQEPLGVIAGIGAWNYPIQIAMWKAAPALAAGNAMIFKPSEVTPLSALKLAEIFTEAGLPEGVFNVVQGNYEVGEALTQHPDIAKVSFTGGVPTGKKVMSSAATSSLKDVTLELGGKSPLIIFDDADIDTAADIAMMANFYSTGQVCTNGTRVFIPKALQAKFEQAIQTRVKRIKLGDPMDDSITMGPLVSFPHMDRVLGYIEQGKASGARLLCGGARVTTGSLADGAYVAATVFTDCTDDMSIVREEIFGPVMSILTYETEEEVIRRANDTEYGLAAGVVTADLNRAHRVIAQIEAGICWLNTWGESAAQMPVGGYKHSGIGRENGIQTLEHYTQTKSIQVELGAFESVF

SEQ ID NO: 51609 - protein, 524 aa, Cryptococcus neoformans var. neoformans JEC21
MRRTITLRHLLPLGIRSKHIMPTHAKLNVPSLGEVEVPVGLFINNEWVESTSRETFSTVNPATGQKLLDFAHAKKEDIDKAVIAARKAFKTTWGNNVLAAERGVLLNKLADLMERDSDKLAALESINSGKGIRIAREADVADSVACIRYYAGLADKIHGQTVSSFGKEKFVYTLHQPIGVCGQIIPWNYPIMMWAWKIAPALAAGCTVVMKPSELTPLSALALCDLVKEAGIPAGVINTVPGHGATAGDAISRHMDIDKVAFTGSVSTGRRISIAAAESNLKKVTLELGGKSPVIVFDSADVEEAADWAALAIWFNSGQDCCAGSRLYVQEGIFDKFLAAMKKRAEACAIGQPHDEKTSFGPLISEGQRDKVLNYIVSGKEQGARVVTGGQKWPESNDGYWIEPTILADTTPDMTIVKEEIFGPVVVAAPFKTEEEVLEVANDTSYGLAAAVFTNDTRQATRVSAALDAGTVWINQYALLHPGVPFGGFKQSGIGRELGTYGLEAYMQIKAVHNNLTQTSPWPV

SEQ ID NO: 51610 - protein, 452 aa, Leifsonia xyli subsp. xyli str. CTCB07
MRESQFLLPDVGEGLTEAEIVSWKVAPGDSVAVNQVIVEIETAKSLVELPSPFEGTVGELLVVEGQTVEVGTPIFTVNGGEADHGVTEPAGEAEQAAVDAAASVTHESEEPKAGAVIVGYGSAGHGTSRRRVTHPGAAARPAAFPPAESAAEPGRAPSTPVPPSGGGPVIAKPPIRKLAKDLGVDLSTVTATGAIGEVTREDVLREGTQASVFRNIQTPEWPDDREERILVKGVRKAIANAMVTSAFSAPHVSVFVDVDATRTMEFVKRLKSAPDFVGVKVSPLLIMAKAIVWAVRRNPTVNSTWTDEEIIVRHYVNLGIAAATPRGLIVPNVKEAQGMSLLELAGALEELTLTAREGKTQPADMANGTITITNIGVFGMDTGTPILNPGEVGIVALGTIKQKPWVVDGEVRPRFVTTLGGSFDHRVVDGDVASRFLADVASIIEEPALLLD

SEQ ID NO: 51611 - protein, 403 aa, Fusarium proliferatum
ILQKGMPWEDGVPGVTQCPIPPKKSFTYQFLADLYGTSWYHSHYSAQVAAGLFGPLVIYGPREKKDYDIDIGPVMLSDWYHKEYFDLVEEIMKPGGNGVVLSDSNLINGKMNFNCSSVAPGDKTPCKSNAGISKFRFKRGKVHRLRLINPSAEAIQRFSIDGHTMKVIANDFVPVQPYDTKVVTLGVGQRTDVLVRANGKLDSYWMRSNISAICSLGRAPAALAAIYYDNANQKKAPKSQAWDIPDPETCANDDLSITKPVMKLPLPPADKTIELDISSFKNASNVTLWTLGGVAARTNYNSPTLLLSKLGNHTFEPEWNVINTGKAKSVRVVVNNKTPVAHPMHLHGFNMYVLHEGPGSWDGTIINRHNPQRRDVVQIRGNGHLVIQFDAGENPGVWPFHCH

SEQ ID NO: 51612 - protein, 432 aa, Arabidopsis thaliana
MTVRSKIREIFMPALSSTMTEGKIVSWIKTEGEKLAKGESVVVVESDKADMDVETFYDGYLAAIVVGEGETAPVGAAIGLLAETEAEIEEAKSKAASKSSSSVAEAVVPSPPPVTSSPAPAIAQPAPVTAVSDGPRKTVATPYAKKLAKQHKVDIESVAGTGPFGRITASDVETAAGIAPSKSSIAPPPPPPPPVTAKATTTNLPPLLPDSSIVPFTAMQSAVSKNMIESLSVPTFRVGYPVNTDALDALYEKVKPKGVTMTALLAKAAGMALAQHPVVNASCKDGKSFSYNSSINIAVAVAINGGLITPVLQDADKLDLYLLSQKWKELVGKARSKQLQPHEYNSGTFTLSNLGMFGVDRFDAILPPGQGAIMAVGASKPTVVADKDGFFSVKNTMLVNVTADHRIVYGADLAAFLQTFAKIIENPDSLTL

SEQ ID NO: 51613 - protein, 294 aa, Burkholderia thailandensis E264
MTFDQWMRSVLERVETALGHYLPAETVAPAQLHEAMRYAVLGGGKRVRPLLCHAAGELTGASEAALNAASSALEMIHVYSLVHDDMPCMDDDALRRGKPTVHVKYDEPTALLVGDALQSQAFVALTDAAALPADRQAALVRELALASGSIGMAGGQAIDLASVGVALTRDALETMHRMKTGALLRASVRMGALAGETPSDDAMRALDAYAAAVGLAFQVVDDILDVTTDSATLGKTAGKDAANDKPTYVSIIGLDASRALAARLRADAHAALQPFGARAQRLAELADLVVNRVS

SEQ ID NO: 51614 - protein, 554 aa, Pseudoalteromonas tunicata D2
MSFQRFKKLSIKGDLFGGVTTAIISLPLALAFGVASGAGAEAGIWGAILVGLFAALFGGSTSLISEPTGPMTVIMTAILTTMVAKYPEQGAAIAFTVVMMAGAFQILLGALKLGKYVTLMPYSVISGFMSGIGVILIILQLAPLLGHAAPAGGVLGTIKHLPDIILDLHFAELLLGAMTLGILFYLPKKYRRYAPPQLVALVCVTLVSIILFDHDSIRRIGEIPNSLPALVFPVFTWDLLTTMLIDALVLGTLGCIDTLLTAVIADSLTRTEHDSNKELIGQGIANMTSGLFGALPGAGATMGTVVNIQVGARSPLSGIIRALILMLVVFVAGSLTEPIPMAVLAGIAVYVGLNILDWSFLQRAHKVSIQQTIIMYGVMFLTVFVDLIVAVGLGVFISNVLVIERLSREQAKNVKAISDADDDDVPLTPTQRSLLDKANGQVLFFYLSGPMIFSVSKAITRQHSSVSRYQVMILDLSDVPMIDMTVGLALENAIKDAIDAQCQVIIYSPNPDANDKLKRLRVDELIPSAHFVDSRTAALKLALSKLESTPEFNI

SEQ ID NO: 51615 - protein, 411 aa, Fusarium proliferatum
VHWHGILQKGMPWEDGVPGVTQCPIPPKKSFTYQFLADLYGTSWYHSHYSAQVAAGLFGPLVIYGPREKKDYDIDIGPVMLSDWYHKEYFDLVEEIMKPGGNGVVLSDSNLINGKMNFNCSSVAPGDKTPCKSNAGISKFRFKRGKVHRLRLINPSAEAIQRFSIDGHTMKVIANDFVPVQPYDTKVVTLGVGQRTDVLVRANGKLDSYWMRSNISAICSLGRAPAALAAIYYDNANQKKAPKSQAWDIPDPETCANDDLSITKPVMKLPLPPADKTIELDISSFKNASNVTLWTLGGVAARTNYNSPTLLLSKLGNHTFEPEWNVINTGKAKSVRVVVNNKTPVAHPMHLHGFNMYVLHEGPGSWDGTIINRHNPQRRDVVQIRGNGHLVIQFDAGENPGVWPFHCHIDS

SEQ ID NO: 51616 - protein, 174 aa, Bifidobacterium longum NCC2705
MGSVGVLIGQGFDAHRFAPAGSGRELWIAGLYWPVPDSCSEADAAKYEGIEGDSDGDVAAHALIDALLAAARLGDIGSLFGVGADAHGAGMHGIDMLQEVVAHLASNGYTPASASVAIIGNRPKIGTRRAEAEAALSAAVGCPVSVTATTTDHMGFTGHGEGIAAIANALVEKI

SEQ ID NO: 51617 - protein, 168 aa, Oryza sativa
  misc_feature (66)..(66): Xaa can be any naturally occurring amino acid
  misc_feature (151)..(151): Xaa can be any naturally occurring amino acid
  misc_feature (158)..(158): Xaa can be any naturally occurring amino acid
LRIWRANPRVFFDMTVGGAPAGRIVMELYANEVPKTAENFRALCTGEKGVGKSGKPLHYKGSTFHXVIPQFMCQGGDFTRGNGTGGESIYGEKFPDEKFVRKHTGPGVLSMANVGPNTNGSQFFICTVETPWLDGMHVVFGQVVEGMEVVXVIEKVGXRSGATFKEVK

SEQ ID NO: 51618 - protein, 404 aa, Prochlorococcus marinus str. MIT 9313
MNSFSSSKHPQPGTQIDAVLDPVIPALNELVAKTPGTLSLAQGMVNWPPPIAVKLAMNNALLNQESSLNRYGPARGDPDLLELIKQKLMMQNGLDLAESMVMVTAGSNMAFHAIAQVLCDPGDEVILPLPYYFNHFMAIQLAGGVPVPVNAGLIPNPGLIEAAITKRTRAIVTISPNNPSGIVFPQTLLAAINRICAQHGLLHISDEAYEDFVFGDVPHWSPGSLPGAGNHTVSLYSFSKAYGMAGWRLGYMSVPIVWSKALEKVQDTVLICPPRFCQRAAIAALLDGSDWVRQNVSQLMSRYQLLLKRFAASNDRPWRFLHEPNGAFYCLLEVDCGCNGDTLMRQLVRDYRVATIGGCSFGFKNESCVLRISVGMLEGAELIDAFNRLEAGMLNAVQQGDRTT

SEQ ID NO: 51619 - protein, 381 aa, Zea mays
MAGSAVAVVLLSAVALLCLYHLLFLSLSVPDPAAAAAVPRRAGGHHGSNVPSGSGTANVVLRFGLSGQPLRLHDPASAAGLPDIDTFRGKLERLLPPDDHDPGWSRRFDAELGPVHRYFGPDAPLDVRQRIAYLFAILDRSPRGVGVGVGVGELEAWLRWQAAARLDAVTRREMAPHDTDRDGAVTLREFFADWINMGHDKMGWWMHKFASADRDGDGSLNAVEFNDFLHPEDSSQESVMLWLLKDKLRHMDHDGDGRLSQEEFVAQSHIIISGARHADDGGHAHDLERAEAAKKFTELDADKDNYLTVEEARCVLQSLVTGEFSYATSHAKFLMKADVNHDGKLSLEEMLDDYISFYSTVYMDDHYASEGEVDSDSRDEL

SEQ ID NO: 51620 - protein, 125 aa, Vitis vinifera
MAGRLSNVASRIMGGSGVVSRSVASSLPLRSGMGLPVGKHIVPNKPLPVNDELIWDNGTPFPEPCIDRIAETVGKYEALAWMCGGLSFFASLGLLAVWNDKASKIPFTPRVYPYDNLRVELGGEP

SEQ ID NO: 51621 - protein, 340 aa, Yarrowia lipolytica CLIB122
MYNQRQGNTATPPLHHPIPQHPIPPMRSPPVEQTQHQNLQDRYAPPQQHAQHQQHPQHGAGGDQGNFFNPAGYPQFFNDGTAQVGLQVGRSAVAAGQEYMEKNFNKYVSVSQLRYYFQVSNLYVVKKLGLVLFPFLHKPWTRDVVRSETTGEIEGYAPARDDINAPDMYIPTMAFTTYIILCSVLSGVHDHFHPQLFGTLASKAVSVMVFELLVLRLATYLLSADSQLFDFAAYAGYKLVGVLITILAASLTGSTYVKWGVFLYTYIANAMFLLRSIKYLIIPDGTSPVPQGINTGNRRSSIQFLAVYAFLFQLGMMWILIPANSVLNSAPVPVIAQTMS

SEQ ID NO: 51622 - protein, 500 aa, Ophiopogon japonicus
MAFPIPARQLFIDGEWREPLLKNRIPIINPSTEEIIGDIPAATAEDVEVAVVAARKAFKRNKGRDWAATSGAHRAKYLRAIAAKITEKKDHFVKLETLDSGKPRDEAVLDIDDVATCFEYFAGQAEALDAKQKAPVTLPMERFKSHVLRQPIGVVGLISPWNYPLLMATWKIAPALAAGCTAVLKPSELASVTCLEFGEVCNEVGLPPGVLNILTGLGPDAGAPIVSHPDIDKVAFTGSSATGSKIMASAAQLVKPVTLELGGKSPVIMSEDIDIETAVEWTLFGVFWTNGQICSATSRLLVHESIAAEFVDRMVKWTKNIKISDPFEEGCRLGPVISKGQYDKIMKFISTAKSEGATILCGGSRPEHLKKGYYIEPTIITDITTSMQIWKEEVFGPVICVKTFKTEDEAIELANDTEYGLAGAVFSKDLERCERVTKALEVGAVWVNCSQPCFVHAPWGGVKRSGFGRELGEWGIENYLNIKQVTSDISDEPWGWYKSP

SEQ ID NO: 51623 - protein, 500 aa, Oryza sativa
MELLLLYAPCVILLVSSLYLLRLFSDARRNLPPGPRPLPLVGNLLELGAKPHRSLARLAERHGPLMTLRLGAVTTIVASSPDAARDILQRHDAAFSTRPVPDIVRACGHDRFAMPWLPPSSPQWRALRKVCSAELFAPRRLDAQQRLRREKARRLVSHVARMAREGAAVDVRRVVFTTLLNMLSCTLFSADLADLDEGRAGSAGELADTVAEFAGTVGVPNVVDYFPAVAAFDPQRLRRWLSRVFTRLFAEFDEQIERRMRERDAGEPPKNDFLDVLLDYRTTEDGRGFDRPTLQFLFTDLFSAGSDTSAVTVEWAMAQLLQNPPAMAKAREELARVIGSKQEIDESDIDSLEYLQAVVKETFRLHPPAPLLLSHRAETDTEIGGYTVPKGATVMVNIWAIGRDSKVWFEPDKFIPERFLQKEVDFRGRDFELIPFGSGRRICPGLPLAVRMVHLMLASLLHRFEWRLLPEVERNGVNMEEKFGIVMTLATPLQAIATPI

SEQ ID NO: 51624 - protein, 236 aa, Blastopirellula marina DSM 3645
MVVDKSETRVRRMFAEIAGKYDRMNHLLSMNVDRYWRWRTVQIVPPQGDAPILDVCTGTGDLAIAYFRAAKGKVRIEATDFCPEMLEVGEEKKNRANIGEMIRFQEADTQALPFKDDTFQIVSVAFGLRNVTNTDLGLSEMTRVCRPGGKIAVLEFSIPTWQPFKAFYLWYFRNILPMLGRLFAKNREDAYKYLPDSVGEFPYGEALAERMRAVGLHNVFYKSLTFGIATLYVGTK

SEQ ID NO: 51625 - protein, 272 aa, Thermosynechococcus elongatus BP-1
MIVMLGMGITLSWREFQAVGLMPRTVALGFIAQYVIMPTAGWLVAQLYQLSAPFAVGLILVACCPGGTASNVVTFIARAHVALSVVMTLCSTLAAIILTPLLTQLLAGQYVEVNALQLFWGTVQVVLLPILVGLALNTKAPNLVKKVLPISPLISVLGICVICGGVFAASAKAILSHGLQLLAAVVSLHSLGFLGGYYLARAVGYSERTCRTIAIEVGMQNSGLGVALARQAFANPLTAVPCAISGVVHSLIGSLLAGFWRWQQGAAAVPKI

SEQ ID NO: 51626 - protein, 427 aa, Salmonella enterica subsp. enterica serovar Paratyphi A str.
MNTNNALMQRRHNAVPRGVGQIHPIFAERAENCRVWDVEGREYLDFAGGIAVLNTGHLHPGIVSAVEAQLKKLTHTCFQVLAYEPYLALCERMNQKVPGDFAKKTLLVTTGSEAVENAVKIARAATKRSGAIAFSGAYHGRTHYTLSLTGKVHPYSAGMGLMPGHVYRALYPCPLHNISDDDAIASIERIFKNDAAPEDIAAIIIEPVQGEGGFYAASPAFMQRLRALCDQHGIMLIADEVQSGAGRTGTLFAMEQMGVAADITTFAKSIAGGFPLAGVTGRADVMDAIAPGGLGGTYAGNPIACAAALAVLDIFEQENLLQKANTLGNTLRDGLMEIAETHREIGDVRGLGAMIAIELFENGDPGKPNATLTADIVARAREKGLILLSCGPYYNILRILVPLTIEASQIQQGLKIIAQCFDEAKQA

SEQ ID NO: 51627 - protein, 226 aa, Glycine max
MATPASITNVTVEFLQFPAVVTPPASTKSYFLGGAGVRGLNIEEEFVKFTGIGVYLEDKAVSSLGAKWKGKSAAELLDSLDFYRDIIKGPFEKLIRGSKLRTLDGREYVRKVSENCVAHMESVGTYSEAEEKAIEEFRNAFKDQNFPPGSTVFYKQSPTGTLGLSFSKDETIPEHEHAVIDNKPLSEAVLETMIGEIPVSPALKESLATRFHQFFKELEANPNNEN

SEQ ID NO: 51628 - protein, 505 aa, Desulfitobacterium hafniense Y51
MGKATGFLEYQRIEPKKRAPEERIQDWREIKLPRDPEVIKTQGARCMNCGVPFCNGGVMLNGMVSGCPLHNLIPDWNELIYKGQWEEAYRRLSRTSPFSEFTSRVCPAPCEGACTEGYIMEPVTINCIEYEIIEKAFAEGWVKPKKGKATGKKVAVVGSGPAGLSTANYLNAVGHEVTVYERADRPGGLLMYGIPNMKLEKNVVERRINLMKESGIHFVLNTEVGRDVPAQDLVNQYDAVVLCIGATKARGLNVEGRDLKGVHYAVDFLKANTKSLLDSNFEGLETMAEKDGQEGGWISAQGKNVIIIGGGDTGTDCVATSIRHGCKSVHQFEIMPEPPVKRIEATNPWPEWPKKLKVDYGQEEAISLYGKDPRHYLINTKKIVGNEQGEVKEVHTVEVHWNKDSSGRMVPQEVPGSEKVWEADLVLLAMGFLGPEDVIPNELKIERDERSNLKAAYEEFETNVEKVFAAGDARRGQSLVVSALQEGKLAAREVDKYLMGRSGIR

SEQ ID NO: 51629 - protein, 97 aa, Brassica napus
  misc_feature (95)..(95): Xaa can be any naturally occurring amino acid
MAVASAFGFNQMMSSKHHNNPSSSSPIVLGTRAFPTNNKTTGGLIRCELSSSSVSALQQLKKSAIDRYTKERSSIVVIGLSIHTAPLEMREKLAXPV

SEQ ID NO: 51630 - protein, 494 aa, Burkholderia vietnamiensis G4
MSDTTPLHYLDYAATTPADPRVIEAMMACLGADGIFGNPASSSHAAGRLAKQKVEHARAQVAALIGADADEIVWTSGATESNNLALKGYAETATGKRHLITSRLEHKAILDTTANLSKHGMTVTYLSPNADGEITADAVAAALSADTGLVSLMLVNNELGTLTDIGAISRIVHAAGALLHVDAAQALGKTPIDVRALGIDLLSMSAHKVYGPKGIGALFVRRDIADRIAPQIHGGGHERGLRSGTLATHQIVGMGVACELAADKLEREAARIAALSARVKDALLALGDITHNAAAARRIPHTMSFTVDVPGFFPFMLGDALAVSSTSACNSTSGAPSHVLTAIGLDAAAASRTVRISFGRFTTEQDAEFAIACFARALEQCRAAAATGFTASRQITPAELTAIRHAGFRAVICNRPDGESADQPAFDEIAAAARELGLDARYLPVERDGIDDAQVDAFGALVDALPKPVLAYCRSGSRSALLWNRLTERRAITV

SEQ ID NO: 51631 - protein, 181 aa, Chlamydomonas reinhardtii
MADVEAKKEIIKNAIRGIPDFPHKGILFWDVTTIMLNHQAFQYSIDLFAEQYKDKKIDVVAGFEARGLIFGAPLALALGVAFVPLRKPGKLPGDKISEEYKTEYSTDKIEMHVGAIQPGQRVVLVDDLIATGGTLAAGINLVKKAGGVVVEAACVIELPFLKGRDKIQGTDLFVLVEKEGL

SEQ ID NO: 51632 - protein, 2095 aa, Arabidopsis thaliana
  misc_feature (1099)..(1099): Xaa can be any naturally occurring amino acid
MFAVENGLQGDPRLKAISDAIRVIPHFPKTGIMFQDITTLLLDPVAFKHVVDIFVDRYKHMNISLVAGVEARGFIFGPPIALAIGAKFVPLRKPGKLPGRVISEEYELEYGRDCLEMSVEAVKSEERALIIDDLVATGGTLSASINLLERAGAEVVECACVVGLPKFKGQCKLKGKPLYVLVEPNQAMSAVYCGTKRSYFDDNSSPPSSKRFRCFSPSNSPIWSSPPSSSLDQLHSAFPHIELTAFVDLKLRICLRYLSSSSSSPPVLVKALEDNGSDFNAAMKSLYSFASSEEKKAEELAAGGAATQETDAVCGGNPPTSGDDWVELLVREVLQSSGTDDAKVRAARVLEALEKMLSARAREEAGNKFQEEKVAVQQQVETLVKDNTVLKRAVAIQHERQKALEDANHQLGLLKQLVPQYQEKLRNLEVNNYALRMQLQQVEHGNSMPARFNPDPKTLLESSSSSLNNARCQASPRPLGSLRSSFDSILSLMAALASPSLIPSSLCFAAAADGPRSLSSNFSAFSDGGSNFRYHKSFLSLSSSSSSSTPYRNRRGRSLVVFATSGDYYATLGVSKSANNKEIKAAYRRLARQYHPDVNKEPGATEKFKEISAAYEVLSDEQKRALYDQYGEAGVKSTVGGASGPYTLSLTFTSSYISNQSNPFDLFETFFGASMGGFPGMDQADFGRTRRSRVTKGEDLRYDITLELSEAIFGSEKEFDLTHLETCEACAGTGAKAGSKMRICSTCGGRGQVMRTEQTPFGMFSQVSICPNCGGDGEVISENCRKCSGEGRVRIKKSIKVKIPPGVSAGSILRVAGEGDSGPRGGPPGDLYVYLDVEDVRGIERDGINLLSTLSISYLDAILGAVVKVKTVEGDTELQIPPGTQPGDVLVLAKKGVPKLNRPSIRGDHLFTVKVSVPNQISAGERELLEELASLKDTSSNRSRTRAKPQQPSTLSTAPSGSENKKDEVKEENEEPEQENYLWNNIKEFAGSPEFSSPIRQLSPPGSYGHGLFFPAKDMDTNSLMLIDNNGSFEIDDQSHVHVDASHTLEPVTLPTKRRRKKSDVWNHFTVETVSPGSAKACCNHCRKSFAYINGQKLXAGTSHLKRHIQLGICPMNRDDSSTLAQIVTPTTTTDPPKKRHRSSASYTPLDQDRCYNQMAKMIIMHDYPLHMVEHSGFTGFVQALCPQFTMASFNTIHADCVNMYLSEKHKLSNFITDIPGRVNLTVDLWTSNQSLGYAFVTGHFIDRDWKLTHRLLNVAVVPSPDSDFALNQPIAACLSDWNLERRLSSITVGQSVVNKTSIENLRCCLSARNQNVLNGQLLLGNCYARLLSSMAQDLLGAEDFKTPIKKVRDSVKYVKTKDSCQERFDELKKQLQTPSTKDLLIDNQTKWDTSYDMLLAACEHKEVFSCLGNCDLDYKILTSPEEWRKIEILCSSLKILFDAANVLTGSTRLTANDLFHEMTKLQLDLGNSATSEDQDVSNLANTLKDKFDEYWRECFLLMAVAVVMDPRFKMKLIEFSFSKAYGEDADKWIRSVDDAVHELYHDYAEQSHSLLDAYVVHGNDGFSETDMSQVHFHHEYHNSNGLSHDQIFEQPEDGNPLNEKPLEGLSGEGQPTGTESVGGNTTQGVEQEGHLGDAGTQENNIVEGQLEESKPMERVTQKPLLTEENLQSNGEPTTAQESRLTDETMEETHANQSAEEMAHETQLVEEFPCESQPSENVPLQSQSGEGNVPETLPMEEIVEDTQPVEEVMQEETSQVSRPVEEIPLENQQVDDKDITHDVQPVEEMLEDTQPVEGVDHEAQELEVHDDIQSVEEVGHEIQPEGELLEDTQPVEEGAQEAQLVEENHDDVQLVEEAGHETHAVEGILEDTQPVEEVAQEARPVEQIPENSQNPQEYSREGESVQEEQQSEQHPQSHAMPHEEEAQHDSQSHAMPQEEATFTISQEGHHVDVLLQEGHHLEASSQEFPLITIGDGFSDFELYISEVGSHQQMKSELDQYLEESLIPRSQDFEVLGWWSLNRTKYPTLSKMAADVLSVPFCTVSPDSVFDTEVKKMDNYRSSLRHVTLEALFCAKDWFKHSSSNSTSENNLKMES

SEQ ID NO: 51633 - protein, 202 aa, Shewanella sp. MR-7
MKLYLLDNFDSFTYNLVDQFRSLGCEVVIYRNDVAADYIADKLLAETEPSALVLSPGPGAPHEAGSMMALIDKVAGKVPMLGICLGHQAMVEYYGGKVERAPFVVHGKASLTFHNGTGVFANLPSPLPVARYHSLVATKVPDCLEVIATTEEMPMAILHAEHRAVGFQFHPESILTTLGSTLLTQTLRFLTQDIAHNTAGAQ

SEQ ID NO: 51634 - protein, 423 aa, Oryza sativa Japonica Group
MASRRQWGAGAGAVDVPAQERKGEAAKIARRPKTTTVVAQQPPRIRRALADVSNLVNGRAALPVVNRQKAAAAAADKCRKPIKQRNENNKAAKPEVIVISSDSEKHKKNPAQRAASRRAPIQTLTSILTKCSRASDGVISPKKELIYDIDASDSHNELAVVDYVEDIYRFYRNTENTYRPLCTYMVSQTEINERMRAILTDWLIEVHYRLMLMPETLYLTVYIIDQYLSLENVPRKELQLVGVSAMLIACKYEETWAPLVKDFLVISDNSFSRQQVLSTEKSILNKLQWNLTVPTMYMFILRYLKAALGDEELEHMTFFYAELALVQYSMLFFAPSVIAAAAVYAARCTLGLSPLWSDLLEYHTGLAEPQLLECARRLVSLHAAAPESRQKVVYKKYASPKLGAVSLHSPAKKLLPPPSPVAA

SEQ ID NO: 51635 - protein, 400 aa, Chlamydomonas reinhardtii
MYQPGPGAPGGHGDGQHPHAGQQFYSQPAGGHPMPGQHMAPQAPRSGQLPGPHTYAMPPGPPPPGPPPPGPAPPGPAPPGPMPFIPGVPGAPQPHTAYMPQQQHPQQPHQVPPQSYAPQQGYNPAYAQQHQQPYMPQQPAPGPDPSAGAAPAFGMPLNPLGLMAAGNLFSGGQNWGAQQFERMQQRVGAFTGGALHFHFAISQQYVLSKLLMLMAPYLKRWTYTRTPEQMQGGPAFKPPKVDVNSPDLYVPLSALWTYSLLVALCQAGHGKFKPDNMYPLVWSGAMAWLVHLLVAKAVLRAMALPASVPWVELAAYTGYTFVPVCVAILAGQAAGRWAYLAAWGYGSLCSAIFLVRTMKRVIFQETRGYGPGRDMTLVNYLLLGLALFQFPFAFYLGVRP

SEQ ID NO: 51636 - protein, 391 aa, Arabidopsis thaliana
MASSSTFLELTPFQWNQPLPYTQRPHHRTVLLYSKPQRRSNSIRLQISVKYKQSTSSSDPDLRSNFNPFEQIAIQVKKALDSLKKPAIAAVLLGLLLFYDPNSALAASGGRIGGNSFSSRSRSSSSSSSQSYSVPRTSNPSFSYSARTAPYYGPSPFGGGFVGPAVGFGFGGFSSFSLILVGFAAFVLVSGFLSDRSQDDSILIDTQKTSVIKLQVGLLGLGRTLQQDFNRLAESSDTSTPEGLSYVLTEATLALLRHPDYCISCYSSVDVKPSIEKGEKRFNQLSIEERGKFDEETLVNVNSIKRQSSKIRKASGFSNEYIVVTILMAAEGIHKLPPINGTTDLKEALLKLGSIPRNKIMAVEVLWTPQNEADALSERELLEDYPLLRPL

SEQ ID NO: 51637 - protein, 179 aa, Legionella pneumophila str. Lens
MITVGNKFPEFQLKATVANDVSNAFQMISNETYQGKWLVVFFWPKDFTFVCPTEIAEFGRLNSEFADRDAQILGGSTDSEFVHLAWRNQHPDLNNLPFPMLADVKRELTANLGILDDEEGVAQRATFIVDPQGITRFVMVTDLNVGRNPAEVLRVLDALQTDELCPCNWKKGEETIHIK

SEQ ID NO: 51638 - protein, 398 aa, Fusarium proliferatum
MYQNGTNFMDGPAMVTQCNIPTGASITYNFTVDQVGTYWYHSHTRSQYPDGLRQALIIQDPKNPYEGEYHEERVITLSDWYHDEMPVLMKQFVSYKNPTGAEPVPNSALMNDTQNMTLPVEPGKTYLLRLVNVGAFASQYFWIEGHTMKIVEVDGVWTKPAETDMIYIASAQRYAVLVTMKNETGVNYPMMASMDTTLFDTIPDGLNWNVTGWLEYDTDKKLPAAAVLNDFEPYDDFKLVPTDGEKLLEKADHTISLDLTMNNLGDGANYAFFNDISYVSPKVPTLYTVLSAGENATNPTVYGTDTNSFVLKHGEIVEIILNNDDSGRHPFHLHGQNFQVVHRSEENAGHYNASWTNITYPSVPMRRDTLLVYPQGNFVIRFPATNPGVWLFHCHIAC

SEQ ID NO: 51639 - protein, 389 aa, Clostridium acetobutylicum ATCC 824
MDIINMLDEKFKNIFKRHYENVFFSPGRVNLIGEHTDYNGGHVFPCALTIGTYGLVARRNDNKVLAYSLNFDNLGVIEFSLDDLKKCKKDDWANYVKGVIDTFNKHGHNIENGFEILFYGSIPNGSGLSSSASIEVLTGIILNDLFKLNINMVEIVKMCQEAENSFIGVNCGIMDQFSIGMGKKDCAILLDCSTLEYSYSKLNMTGYKIVIANTNKKRGLADSKYNERRSECEAALKELQKVKNINSLGELTEAEFEELKDIISDPVKLRRARHAVYENQRTLKAVVSLNNNDLKTFGKLMNESHISLRDDYEVTGIELDTLVSLALESKGVIGSRMTGAGFGGCTVSIVKEDYVDEFIESIKAKYTEKIGYEPSFYIVNIADGAKKIN

SEQ ID NO: 51640 - protein, 405 aa, Fusarium proliferatum
ASVHWHGMYQNGTNFMDGPAMVTQCNIPTGASITYNFTVDQVGTYWYHSHTRSQYPDGLRQALIIQDPKNPYEGEYHEERVITLSDWYHDEMPVLMKQFVSYKNPTGAEPVPNSALMNDTQNMTLPVEPGKTYLLRLVNVGAFASQYFWIEGHTMKIVEVDGVWTKPAETDMIYIASAQRYAVLVTMKNETGVNYPMMASMDTTLFDTIPDGLNWNVTGWLEYDTDKKLPAAAVLNDFEPYDDFKLVPTDGEKLLEKADHTISLDLTMNNLGDGANYAFFNDISYVSPKVPTLYTVLSAGENATNPTVYGTDTNSFVLKHGEIVEIILNNDDSGRHPFHLHGQNFQVVHRSEENAGHYNASWTNITYPSVPMRRDTLLVYPQGNFVIRFPATNPGVWLFHCHIAC

SEQ ID NO: 51641 - protein, 329 aa, Clostridium acetobutylicum ATCC 824
MSILVCGGAGYIGSHTVHELIESGKEVVIVDNLQSGHLQAVNKKAKFYKGDIRDSEFLDKVFSENKIQSIIHFAANSLVGESMEKPLLYFNNNVYGMQILLESMVKHNIKNIVFSSTAAVYGEPKKIPILESDDTNPTNTYGETKLTMEKMMKWSSKAYGINYVALRYFNVAGALDDGSIGEDHNPETHLIPLILQVPLKKRPFITVFGTDYPTPDGTCIRDYIHVIDLAAAHIKAVEYLENGGKSSIFNLGNGVGFSVKEMIDAAREVTKQNIKVVLGERRSGDPAQLVASSQKAKEVLGWSPKFTNVKDIIKDAWKWHETHPNGFDA

SEQ ID NO: 51642 - protein, 377 aa, Oryza sativa Japonica Group
MERALMSLMRRRSLLQSGGRAPPAMAAAAGGSPFFSTLQQAAAADPVQSPGILPGLKIRDSASQLIGRTPMVYLNKVTEGCGARIAAKLEFLQPSFSVKDRPAISMLEDAEKKGLITPGKTTLIEPTSGNMGIGLAFMAALKGYELILTMPSYTSLERRVTMRAFGAKLVLTDPTKGMGGTVRKAAELYENHPSAFMLQQFENPANVKVHYETTGPEIWEDTLGQVDIFVMGIGSGGTVTGVGKYLKEKNPNAKIYGVEPAEANVLNGGKPGPHLITGNGVGFKPEILNMDIMEKVIEVKGEDAVKMARELALKEGLLVGISSGANTVAALELAKKPENKGKLIVTVLPSLGERYLSSALFEELRAEAEAMQPVPVD

SEQ ID NO: 51643 - protein, 483 aa, Corynebacterium diphtheriae NCTC 13129
MLWHRSHCGHVGAAHYFFATERIHVTDHMQPSFLLTRAGRNFNGFDVDGFADHLGLPVRQLVDSTPDLAAILAAHPAATPSLFIGSGNVNFDAKAASALGVPLLLLIDAPGMHIDLAKQECEELGAVVASVFTADEAVSAEGIARIKASAVEAPVVMSAPVFESWLLEQAKSKNAHIVLPEGDDDRILQAAHQLLAQEICELTILGDPEAITARAQELGLDLSAAHLQNPETDPNAEKFAEDFAELRKSKGMTLEQARETMKDISYYATMMIHEGLADGMVSGAAHTTAHTIKPSFQIIKTKPGTSVVSSIFLMVMRGRLWAFGDCAVNPNPTADQLGEIAAVSAKTAEQFGIDPRVAILSYSTGTSGSGPDVDRAVAATKKAQELAPEYKIDGPLQFDAACDPTVAAKKAPESEVAGQANVFIFPDLEAGNIGYKTAQRTGHALAVGPILQGLNKPVNDLSRGATVADIVNTVAITAIQGGK

SEQ ID NO: 51644 - protein, 255 aa, Leptospira interrogans serovar Copenhageni str. Fiocruz L1-130
MLSEIKNDHILELYIETNEVNSLNVEFFKTFSAKLDLIAKDQSIKSVILTSKNEKFFSNGFNPEIFVDKSSEEIKNVMRIALETASKYLFLDRPVVCAMNGHSMGLGAVFAIFSDYRIMVEKKGRLGFPESQIGINFPAVAGFMLKEVVGITKARDLLYSGKALKAEEALEISLIDEVASSSDDLITRARKYCDQFKNMAIGSVVGIKVSLRDPVRIFAEHNAERDVELISKAIFSKNGQEGMKSILEKRRPVFQ

SEQ ID NO: 51645 - protein, 321 aa, Oryza sativa Indica Group
MPQVRGWVLCPLDFIYIEEWKGDCFVWLDADASLKDLKIGQINVRVGSLKKKLGTKPGKYVVQTTYEVETWKLPLDREMNVRDSFTSPKHDFRLPLVKSINVSGHKYGLIYAGIGWCIWRSKEDLPEELIFHINYLGADQPTFTLNFSKGSSQVIAQYYQLIRLGFEGYKNIMENCQENAMVLKQGLEKTGRFNIVSKDNGVPLVAFSLKDSARHNEFEISDFLRRFGWIVPAYTMPPDAQHVTVLRVVIREDFSRTLAERLVLDVEKVLHELDALPARVVANGGDAAAASASEREMEKQREVISFWKRAVLAKKKTNGVC

SEQ ID NO: 51646 - protein, 530 aa, Streptomyces coelicolor
MSEPEEQQPDIHTTAGKLADLRRRIEEATHAGSARAVEKQHAKGKLTARERIDLLLDEGSFVELDEFARHRSTNFGLDANRPYGDGVVTGYGTVDGRPVAVFSQDFTVFGGALGEVYGQKIVKVMDFALKTGCPVVGINDSGGARIQEGVASLGAYGEIFRRNTHASGVIPQISLVVGPCAGGAVYSPAITDFTVMVDQTSHMFITGPDVIKTVTGEDVGFEELGGARTHNSTSGVAHHMAGDEKDAVEYVKQLLSYLPSNNLSEPPAFPEEADLAVTDEDAELDTIVPDSANQPYDMHSVIEHVLDDAEFFETQPLFAPNILTGFGRVEGRPVGIVANQPMQFAGCLDITASEKAARFVRTCDAFNVPVLTFVDVPGFLPGVDQEHDGIIRRGAKLIFAYAEATVPLITVITRKAFGGAYIVMGSKHLGADLNLAWPTAQIAVMGAQGAVNILHRRTIADAGDDAEATRARLIQEYEDALLNPYTAAERGYVDAVIMPSDTRRHIVRGLRQLRTKRESLPPKKHGNIPL

SEQ ID NO: 51647 - protein, 135 aa, Yarrowia lipolytica CLIB122
MSSGGKSGGKAASSSKTSKSRSAKADLTFPVGRVHRLLRKGNYAQRIGAGAPIYLAAVLEYLAVEILELSGNAARDNKKSRIVPRHLQLAIRNDEELNKLLGHVTIAQGGVLPNIHQNLLPRKSAKGAKGASQEL

SEQ ID NO: 51648 - protein, 466 aa, Blastopirellula marina DSM 3645
MADAPSAYQKCLSPDCGKTYDIGQVLVACPACGELLDVKYDWDQVKPPSSWKDIEANWSRRDNPLNFSGVWRFRSLFPYATDAQIVTLGEGQTLLQQTDKVGGYVGLDSGKLHLQYEGMNPSGSFKDNGMTAAFTHAQIVGAKRAACASTGNTSASLAMYCSVTQLMKAVIFIGSGKISYGKLSQALDYGALTLQIAGDFDDAMARVREVTKDLGIYLVNSVNPFRLEGQKSVMFRVLEALRWEPPDWIVVPGGNLGNSSAFGKAFSELKELGLITRIPRLAVINASGADTLDQLYNQHGLRWNEGRFDQDLINSYYRNMDETGAKASTLASAIEINRPVNLTKCLRALHDCDGVVRQVSDQEIMDAKSQVGSGGMGCEPASAASVAGAKMLREEGVIAPSDRVVCILTGHLLKDPNATVAYHTTDQDYFNQVLGSRGVKRAAHANRAVAVKNELDEIVQAIQLYG

SEQ ID NO: 51649 - protein, 603 aa, Thermosynechococcus elongatus BP-1
MTYEPLHHKYRPQRFSDLVGQGAIATTLTQALLKERIAPAYLFCGPRGTGKTSSARILAKSLNCLRSSKPTPDPCGQCEVCRQVANGTSLDVIEIDAASHTGVDNIRELIEKAQFAPVQCRYKVYVIDECHMLSVSAFNALLKTLEEPPPQVVFILATTDPQRVLPTIISRCQRFDFRRIPLGEMVAHLQNIADKEQIDIEPEALTLVAQLSQGGLRDAESLLDQLSLYPERITVEQVWQLTGAVPEQDLRQLLGAIARRDAVSVLEHTRQLLERGRDPLTILQNLASLYRDLLLAKTVPQRRDLVALTAETWQALIALAEAWSVEEILHAQEHLRTCEGQIKQSNQPRLWLEISILGLMTERVAQPPPPAVMPAARPQPTTMTPPRTEAEVAVAAKPAEPLPQDSALSVNHPHIQATAAAAPEPALFPEPVANPEQVWQQALQVLQQMQMSTYALLSQHAHLRHLGDREVRIGIVNQTLLNLTKNNHAKIEAAFSQVLGRPTKVALEVAPLPAKTTPTPKAKEPPQSSVVIPLPPREAPPTPPGEPVPVPSPPAPTTAPDPVRESAEKLARFFNGVVIRLPDEGESPDMPMAEAPEEEELEF

SEQ ID NO: 51650 - protein, 267 aa, Escherichia coli
MHPMLNIAVRAARKAGNLIAKNYETPDAVEASQKGSNDFVTNVDKAAEAVIIDTIRKSYPQHTIITEESGELEGTDQDVQWVIDPLDGTTNFIKRLPHFAVSIAVRIKGRTEVAVVYDPMRNELFTATRGQGAQLNGYRLLGSTARDLDGTILATGFPFKAKQYATTYINIVGKLFNECADFRRTGSAALDLAYVAAGRVDGFFEIGLRPWDFAAGELLVREAGGIVSDFTGGHNYMLTGNIVAGNPRVVKAMLANMRDELSDALKR

SEQ ID NO: 51651 - protein, 262 aa, Thermosynechococcus elongatus BP-1
MLSRPLRHPLWMPAPMHPLDSPQLITLDAVGTLFGLQESVGTVYGRFAAEVGVQVDPAALDVAFFKAFRAAPPCAFPELEASQRPEAEWRWWQGVAVETFRRTGVLDQFADFEAFFAPVFAYYATAEPWCLYEDVLPALQDWQAQNIPLMVVSNFDSRLYGVLEALGLAPFFQAVWISSEVGAAKPDRLIFERAVASYGASQVWHIGDSWEEDVRGAQGAGLQAIWLRRDRPLLPEPAINESVAVPQIADLTEVQVILRGTA

SEQ ID NO: 51652 - protein, 182 aa, Klebsiella pneumoniae subsp. pneumoniae MGH 78578
MQFNIPTLLTLFRVILIPFFVLAFYLPFSWAPFACALIFFVAAVTDWFDGFLARRWNQSTRFGAFLDPVADKVMVAIAMVLVAEHYHTWWVTLPAATMIAREIIISALREWMAELGKRSSVAVSWIGKVKTTAQMTALVWMLWRPYPWVEWAGIALFLVAAVLTLWSMLQYLNAARGDLLDQ

SEQ ID NO: 51653 - protein, 454 aa, Burkholderia vietnamiensis G4
MESPKQYEYLFLGGGKGGKSLAMDLARSGKRVAIIERGMIGGSCINVACIPSKTLIQNARNMHAWRSADATAHPVADMARVHANVRAVVDGMVDVNRRAFEQSGLDLVIGSGRFVAPRRVAVRAADGSEQLFEGENVYINTGTVATIPDVPGLRDAAPLTHVEALGLDVLPARLIVIGGGYIGLEMAQAFRRLGSEVVVIHDAPRVAVREDEDVSIEIQNAFEADGIALRLSARIASVEGRSGTGVTVALADGTAVEGSHLLVATGRRPVTDDLGLDLAGVERDARGFIKVDDTLATTAQRTWAIGEVAGTPMFTHASFDDYRVLKAGIDGRGGSTASRVIPYALFTDPELARIGLNETDAKARNTPVIVAKLPMAAVPRARTNGTTRGFMKALVAPDSGQILGFTMVGSGAGEVMSAVQMAMIGKLPYTSVRDAILAHPLLAEGLNLLFATIK

SEQ ID NO: 51654 - protein, 299 aa, Acidovorax sp. JS42
MKPLVFHLPGDEGFADRLALALQAESAGLALHHFPDGESLVRLDASMAGRTVVITCSLAKPDEKTLPLLFAADAARDLGAARVVLAAPYLAYLRQDRRFRAGEAITSKTYARLLSDTFDALVTVDPHLHRYHSLDEIYSIQSRVVHSAPLIAQWVKAQVDRPLLIGPDSESEQWVTQVAADAGAPFTVLQKIRHSDRDVEVSLPDVTPWLDRQPVLVDDIVSSAHTMIQAVGNVRKVGLPAPVCIGVHALFAPDAYNELLASGAARVVTCNTVPHASNGIDVAEAMARALEQLMEGSAT

SEQ ID NO: 51655 - protein, 297 aa, Vitis vinifera
MESPFKADVLKGKVALLTGGGSGIGFEISTQFGLHGASIAIMGRRKQVLDSAVSGLCSQGIPAVGFVGDVRKQEDAKRVVESTVKHFGRLDILVNAAAGNFLVSSEDLSPNGFRTVMDIDSVGTFTMCHEALKYLKKGGPGRSFSSGGSILNISATLHYTAAWYQIHVSAAKAAVDATTRNLALEWGTDYDIRVNGIAPGPIGDTAGMSKLAPEEISNKAREIMPLYKLGEKWDIAMAALYLASDAGKYINGTTLVVDGGLWLSRPRHLPKEAVKQLSRAVEKRSRGVPVGVPKSKL

SEQ ID NO: 51656 - protein, 315 aa, Rhodococcus sp. RHA1
MTTVVKHFLRDDDLTPAQQAEVLELAARLKKAPFAERPLEGPRGVGVIFEKNSTRTRFSFEMGIAQLGGHAIVVDGRSTQLGREETLQDTGRVLSRYVDAVVWRTFGQKRLEAMASGADVPIVNALSDEFHPCQVLADLQTLVERKGSLKGLKLTYLGDGANNMAHSLMLGGVTAGVDVTIASPEGFAPLPWVVEAARARAAETGATITLTGDPQTAVVGADALVTDTWTSMGQENDGLDRVGPFRPFQINEALLAKADADAVVLHCLPAHRGEEITDEVLDGPQSVVWDEAENRLHAQKALLVWLLAQRTGDRP

SEQ ID NO: 51657 - protein, 399 aa, Rhodococcus sp. RHA1
MTGTPELQQRWSGALMNTYGVPRVALTRGQGAVLTDADGKEYVDFLAGIAVNILGHAHPAIIEAVTMQLSTLGHVSNLYASEPAIELAEKLLSHLGAPGRVFLCNSGTEANEAAFKLARATGRSKIIAAENSFHGRTMGALALTGQAAKRAPFEPMPPGVEHVPYGDLDALDRAVDADTAAVFLEPMMGEGGVVVPPEGYLAGARQITADRGALLVLDEVQTGIGRTGWFYAHQAVGIVPDVMTLAKGLGGGMPIGACIATGATADLFGPGKHGTTFGGNPVCASAALAVLRTIAEDDLISRADTLGKSLSAGIEGLGHPLIDHVRGAGLLLGIVLTQDVAPAVENSAREAGYLINAAQPGVVRLAPPLVLTDDQAEGFVAALPAILDNAQSAAQPGKQ

SEQ ID NO: 51658 - protein, 824 aa, Oryza sativa Japonica Group
MAPPCSSALVLPCLLVIAMAALQSAVVFADTVTAKRPLSGSQSALVSKRRKFALGFFQPENSQHWYLGIWYNQISKHTPVWVANRGTPISNPDTSQLTIATDGNMVLLDNSTTAIWSTNISKIASNSTVGVILDTGNLVLADESNTSIIHWQSFDHFGNTWLPGGKLGRNNKLAGVSTRLVAWKARNDPSPGVFSLELDPNGTSQYLLEWSITQQYWTSGNWTGRIFADVPEMTGCYPSSTYTFDYVNGENESESYFVYDLKDESVLTRFFLSEMGQIQFLTWIYAAKDWMPFWSQPKVKCDVYSLCGPFSVCTENALTSCSCLRGFSEQNVGEWLQGDHTSGCRRNVELQCSSNASVMGRTDGFYTMANVRLPSNAESVVVIGNDQCEQACLRSCSCTAYSYNGSCSLWHGDLINLQDVSAISSQGSSTVLIRLAASELSGQKQKNTKNLITIAIVATSVLVLMIAALFFIFRRRMVKETTRVEGSLIAFTYRDLKSVTKNFSEKLGGGAFGLVFKGSLPDATVVAVKKLEGFRQGEKQFRAEVSTIGNIQHVNLIRLLGFCSEKSRRLLVYEYMPNGSLDKQLFDNKKHVLSWNTRYQIALGIARGLDYLHEKCRDCIIHCDIKPENILLDGSFAPKVADFGLAKLMGRDISRVLTTARGTVGYIAPEWIAGTAVTAKADVFSYGMTLLEIVSGRRNVQGRRRRQEQQDDGGAAADRPFPLVAAGRLVGGGGGRREELVSAVVDGRLGGDADMGEAERACRVAFWCIQDDENARPAMATVVQVLEGLVEIGVPPIPRSLQFLAELADQSNYLQFFSDLLPSN

SEQ ID NO: 51659 - protein, 308 aa, Rhodococcus sp. RHA1
MTAISEALSGITDHQKAHVLAEALPWLQQFRDKVVVVKYGGNAMVDDALKTAFAADMAFLRTVGIQPVVVHGGGPQINAMLGKLGMTGEFKGGFRVTTPEVMDVVRMVLFGQVGRELVGLINAHGPYAVGISGEDAHLFTATKRTVMVEGKPTDIGLVGDVTTVNPEAVLDLIRAGRIPVVSTIAPDSDGVVHNINADTAAAALAEAIGAEKLVVLTDVEGLYTNWPDRDSLATEIDVDALAQLLPSLDAGMVPKMEACLRAVRGGVPTAHVIDGRVAHSVLLELFTGEGIGTMVTPGPTSPTEGVAS

SEQ ID NO: 51660 - protein, 544 aa, Zea mays
MAATDDGAVDSASAAAAARAVEEARALLPAPAPDYDDEDLEERAYEAAEKVIVSISGGPDPEDVDGDGDGAELCSSSGSSPPPFSWRKLWLFTGPGFLMSIAFLDPGNLEGDLQAGAVAGDTLLWLLMWATAMGLLVQLLAARLGVATGRHLAELCRDEYPDWARRALWLMAEVAMVGADIQEVIGSAIAIKILSRGYLPLWAGVVITALDCFIFLSLENYGVRKLEAVFALLITTMAVSFALMFTDTKPNGKDLLIGILVPKLSSRTIRQAVGVVGCVIMPHNVFLHSALVQSRKIDQNKEYQVREALRYYSIESTIALAVSFMINLFVTTVFAKGFYGSKEAGNIGLENAGQYLQEKFGGGFFPILYIWGIGLLAAGQSSTITGTYAGQFIMGGFLNLRLKKWVRALITRSFAIVPTITVALFFDTSDSALDILNEWLNVLQSIQIPFALIPLITLVSKEQVMGVFKIGPNTQAVTWTVATLLITINGYLLMDFFSSEIRGPLSGSLLCVAVLIYASFVLYLILRGTELSEKIAKAIRGSFS

SEQ ID NO: 51661 - protein, 67 aa, Zea mays
MTTSRRLADRKSAKFQKNITKRGSVPETTVKKSNDYPVGPIVLGFFIFVVIGSCKHRTKPLLASLLF

SEQ ID NO: 51662 - protein, 493 aa, Actinobacillus pleuropneumoniae serovar 1 str. 4074
MKDLNVFDKNYGLLINGKWTQGSGNDLLPSYNPANGEVLAHFVDATDADVDAAVKAAQEAFKSWRKTTVAERAAILNKIADVIDENSELFALQETLDNGKPIRETRAADIPLASDHFRYFASAIRAGEGSLNQINQEELSLVLREPIGVVGQIIPWNFPFLMAAWKIAPALAAGCTVVIHPSSTTSLSLLSFAQKINHLLPKGVLNVITGKGSKSGEYMLHHKGFNKLAFTGSTEIGRHIAISAAELLIPATLELAAKSANIFFDDMPFDKALEGAQKGILFNQGQVCCAGSRIFVQEGIYDKFVAALAEEFKKVKVGLPWEDDTQMGAQVNAGQLNTILKYVKIGEEEGCRIITGGRKVLSDNLACGEFVEPTLIESKDNNSRIAQEEIFGPVATVIKFKTEEDVIRMANDSEYGLGGGVWTKDINRALRVSQAIETGRVWVNCYNILPAGAPFGGYKSSGIGRETHQMMLDAYTQVKNIYISTREEREGMY

SEQ ID NO: 51663 - protein, 356 aa, Clostridium acetobutylicum ATCC 824
MLYALVLAGGKGTRLYPLSRKESPKQFLKFIHNKSFLRNTVDRIKTLVDKENIYIVTNERYINKIQEELPEINRSNIFTEPENKETATCIGLSAVKLLKKDSDATMIVLPSDHYIENEKEFIDTLRQGVEVVERKRCLVTMGITPTRPETGYGYIQMGDKVINYESIYKVERFLEKPNIEVAKDLLSKGNYLWNSGMFVWRADTYLREMNKYLPKMYKAMMEIYENVGTKTEEETINEKYKIIDGISVDFGIMQKTRKAYVVKANFEWDDLGNFSSLARFLKSYEGGNTISDNVFLEDTENCSIFGSENLIICFGVKDLIVVDAGNVVLIMDKNRDQELKHLVEELKNKKEIEDYL

SEQ ID NO: 51664 - protein, 134 aa, Oryza sativa Japonica Group
MAGRLTAAGSRVLGGQGAAARAAVSALRHRAGMGLPVGRHIVPDKPLPTNDELVWDNGTPFPEPCIDRLAPHIGKYEALAWLCGGLGFFATLGLAATLNDKASKIPYVSAKYFIVIFYFLLDGQTVELLAFQQQ

SEQ ID NO: 51665 - protein, 442 aa, Pseudomonas syringae pv. tomato str. DC3000
MTFASLGLIEPLLRALEALGYQTPTPVQTQAIPPVLAGRDLMAAAQTGTGKTAGFALPLLQRLTMEGPKVAPNSIRALVLAPTRELADQVHESIRQYAEHLPLSTYAAYGGVSINPQMMKLRKGVDVLVATPGRLLDLYRQKAIRFSQLQTLILDEADRMLDLGFAEELRGIYAVLPKQRQTLLFSATFSDEIRLLAAQMLNDPLTIEVSPRNVAASSVKQWVVTVDKKRKADLFIHLMKKHRWGQVLVFAKTRVGVDQLVDRLQGLGLNADGIHGDKPQATRQRALDRFKSNDVKILVATDVAARGLDIDDLPTVVNLDLPIVAEDYIHRIGRTGRAGQTGEAISLVCADEVELLSAIEVLTRQTLERKEEPDFEPEHRVPSTDASGQILKKPKKPKKPKVSSSKRNLGKWVDSGESEPTPAVKPVRKVPVFNTGPRKKKP

SEQ ID NO: 51666 - protein, 530 aa, Agaricus bisporus
PVDGIRSQIEWNTTLNVSDAPVPTETTKYHRKTAIIATIGPKINTVEKLTDVRLAGVNIVRMNFSHGTHEYHQSVIDNTRQMIKNDPHGRPVAIALDTKGPEIRTGQTRDGNDYPIKAGDEFIVTTDPKYSDICDNKVLFVDYANLASVTAPGKLIYIDDGIISLLILSIDGMNLHVRALNNGTLSSRKGVNLPKTDVDLPPLSEKDKDDLRFGIRNGVDMIFASFIRRGEDVRQIREVLGPDGASIKIIVKIENEQGVANFDEILKEADGVMVARGDLGIEIPASQVFLAQKMMIAKCNIVGKPVIVATQMLESMTYNPRPTRAEVSDVANAVLDGSDCVMLSGETAKGSYPVQSVLMMAETCLLAETAICYPPLYDDLRAVQARPTETAETVAIAAVAAAAEQDAKALLVLSTSGETARLVSKYRPKIPIITVTRNEQTARQIHLHRGCYPFWYPEPRGVQNHQWQTDVDNRIRFGLRNALALNVIQPGASIIAVQGWKGGLGHTNTLRILTVPTDPADLELQPLGSL

SEQ ID NO: 51667 - protein, 512 aa, Ulva fasciata
MRSIMITTSAIKFAGARGSRAQGTHGLRCSRAIQARAYESTTEYDYDMFTLGGGSGGVRASRMSSGFGAKVACAELPFGYISSESAGGLGGTCVLRGCVPKKLVMYCSEYAEHVKDAEGFGWEIGESKLHWDKFMEKKRKELQRLNGVYGNIMGNAGVEIIEGRATIKDKHTVVVNGKEYTSKYICIAVGGTPHMLGVPGVEHCINSDGILELDSVPKRLAIIGAGYIGVEFGGMFNNLGSDVQFFIRSDKVLKGFDEEVRDHIMTEYDRRGIKINTGCSPKQVKKNDDGTLDMTYSSPDGDVTGTFDQILMATGRTPNTANLGLEAAGVETNKQGFVVVDEFSKTSVDNIFAVGDITDRMALTPVALMEGMCLAKTLFNDQPIAPDHKNIPTAVFSQPHIGTIGYGEEEAVEKFGDVDVYSSSYRPMRNTISGNESRGFMKILVDASTDKVVGIHIVGPEAGEMMQGFGVAVKMGATKADLDSCVGIHPTAAEELVTMRTTSRQWRGKKQI

SEQ ID NO: 51668 - protein, 335 aa, Ehrlichia ruminantium str. Welgevonden
MKIGINGLGRIGRCLIRCIYENNSIYKDSLELSALNGSTSPEIHAHLIQYDSVHGKFPHDVTYGKDYIAINNKEIPLSIEKEPNNIPWEKHNVDIVLECTGKFNKKPLAKGHINSKVKKVVVSAPMEDPDVTIVYGVNNEILKKEHQVISAGSCTTNCIAPILKIMNDTIGIKNGFITTIHSYTNDQNLVDNNHKDLRRARASAMSMIPTTTGATKTINSIIPELKGKLNGTAIRVPTPNVSMIDLVFNSIKSTNSTEINNIIKELSQNSQVINITDKKLVSIDFCHSIYSAIVDAEETYVTDNNLCRIAAWYDNEWAFAMRMLDIVCLLSQHIN

SEQ ID NO: 51669 - protein, 271 aa, Ehrlichia ruminantium str. Welgevonden
MNILLIGCGNLGSILLNKWSLNDQISDIVVVQPSLSKKNIFNTINKITFVRDHKEINKSFMPQIVVIAIKPQQVANAIPDYKAYNKSASFISLCAGIDIEFLKKHLDSTTIIRVMPNIAMSLGESVNLAYMEEEIDQEKQKVHTVFNGTGLLYWLQKEDVFDKLSPITGSGPAYFFSLAEELVKNTMKAGIREEDAITLISQTFIGSAKLLETRKDSISNLISSITSRGGITQAALEILNSHLPNIMSLSLKSATERLVHLKNSDDNKKNT

SEQ ID NO: 51670 - protein, 487 aa, Ehrlichia ruminantium str. Welgevonden
MSFALKYRPSSFNDLIGQDVLVRILRNAFHLNKVPQSILLTGSSGIGKTTAARIISMCLNCISGPTSNPCNTCNNCISIKNFNHPDVIEIDAASNTSIEDVKIILENSHYVPITSKFKVYIIDEVHMLSNSAFNALLKVLEEPAPYVKFILATTEVKKIPVTIISRCQRFDLQRIPTESIVNHLRIIAKEENILFDEESIKLIAYNSDGSMRNALSLLEQSAIYSNKNLSEESTKKMLGYVNRHVLLKIIESITNGNITEALNKFEEVCNMYSPVIVLDNILQMIYEICYFSITKKNDFLPDSDIITSTQNNKIQSPIFLSRLWQILSKGIQEVKSSACVKQAANMLIIRLCYLSDLPSPKQIIEKLQNNVKANENGLEINRKMLLALLKTNNMEDLYNQLSKSLLEITYNNDCTSNIILNTMLPNNSQKELLNFLSNLTSKKWNICIKKNNDPCYNSQLNSTISDILQEFDGAKVINIETIKKEQQ

SEQ ID NO: 51671 - protein, 393 aa, Chlamydophila pneumoniae J138
MIFEFRFPKIGETSSGGSIVRWLKNLGDHVARDEPLIEVSTDKIATELPSPKAGRLVRFCVNEGDEVASGDVLGLIELEEISEADDESTSCPLTSCETKSEAGSSSSSVWFSPAVLSLAQREGIGLDNLQKIAGTGKGGRVTRQDLEAYISESQQVSIPEIFQGEVNRIPMSPLRRAIASSLSKSSDEVPHASLVVDVDVTDLMNLISGERQRFLDTHGVKLTITSFIVQCLAQTLRQFPLLNGSLDGTTIVMKKSVNVGVAVNLNKEGVVVPVIHNCQDRGLVSIAKALADLSSRARLNKLDPSEVQDGSVTVTNFGMTGALIGMPIIRYPEVAILGIGTIQKRVVVRDDDSLAIRKMVYVTLTFDHRVLDGIYGSEFLTSLKNRLESVTMG

SEQ ID NO: 51672 - protein, 476 aa, Xanthomonas campestris pv. campestris str. ATCC 33913
MHNTLILFGATGDLAQRYLFPSLLRLFVDGLLPEDFRIRALALSQHDTDAFREVLRPRLAQALPIATAAQIDALLQRIDYRSADLRNAESVAEAVRELASRQCVSYLAIPPGLYISTCQGLALGGALAAPHRLMLEKPIGHDSDSAREILQSIGALIDEDRVFRLDHYLGKAAVQNLVALRFGNTLLEAVWNRTYIESVQILVAESEGVDGRDAYYARSGALRDMVQSHILQLLCLVAMEPPASLEADRIRDEKVKVLRALRPMTAEHAAQDSVRGRYTAGSINGEPAQAYHPPEGSDVETFVAVTAHIDNWRWAGVPFHLCTGKRLAERSTRIVVTLKPVTHWLFERPDRQNAVPNRLTFQLQPLENIELGLMSSLAGPEWGAIELQPLELELSVPTGLHRRIAYERLFVDAFNGNPALFVRDDEVKAAWAWIDSVSDAWSDAQLPLQPYPAGSWGPETAAPFLPPATDAQGNNA

SEQ ID NO: 51673 - protein, 461 aa, Oryza sativa Indica Group
MPEQSIPKEAAYQIINDELMLDGNPRLNLASFVTTWMEPECDKLIQASVNKNYVDMDEYPVTTELQNRCVNMIAHLFNAPLGDSETAVGVGTVGSSEAIMLAGLAFKRRWQNKMKAAGKPCDKPNIVTGANVQVCWEKFARYFEVELKEVKLSDGYYVMDPAKAVDMVDENTICVAAILGSTLNGEFEDVKLLNDLLTKKNAETGWDTPIHVDAASGGFIAPFLYPELEWDFRLPLVKSINVSGHKYGLVYAGIGWCIWRSKEDLPEELIFHINYLGADQPTFTLNFSKGSSQVIAQYYQLIRLGFEGYKNIMENCQENAMVLKQGLEKTGRFNIVSKDNGVPLVAFSLKDSARHNEFEISDFLRRFGWIVPAYTMPPDAQHVTVLRVVIREDFSRTLAERLVLDVEKVLHELDALPARVVANGGDAAAASASEREMEKQREVISLWKRAVLAKKKTNGVC

SEQ ID NO: 51674 - protein, 287 aa, Glycine max
  misc_feature (116)..(116): Xaa can be any naturally occurring amino acid
MEGKEEDVRVGANKFPERQPIGTSAQSDKDYKEPPPAPLFEPGELASWSFWRAGIAEFIATFLFLYITVLTVMGVKRAPNMCASVGIQGIAWAFGGMIFALVYCTAGISGGHINPXAVTFGLFLARKLSLTRAVYYIVMQCLGAICGAGVVKGFQPKQYQALGGGANTVAPGYTKGSGLGAEIIGTFVLVYTVFSATDAKRNARDSHVPILAPLPIGFAVFLVHLATIPITGTGINPARSLGAAIIFNKDNAWDDHWVFWVGPFIGAALAALYHVIVIRAIPFKSRS

SEQ ID NO: 51675 - protein, 450 aa, Mycobacterium bovis AF2122/97
MTATPLAAAAIAQLEAEGVDTVIGTVVNPAGLTQAKTVPIRRTNTFANPGLGASPVWHTFCIDQCSIAFTADISVVGDQRLRIDLSALRIIGDGLAWAPAGFFEQDGTPVPACSRGTLSRIEAALADAGIDAVIGHEVEFLLVDADGQRLPSTLWAQYGVAGVLEHEAFVRDVNAAATAAGIAIEQFHPEYGANQFEISLAPQPPVAAADQLVLTRLIIGRTARRHGLRVSLSPAPFAGSIGSGAHQHFSLTMSEGMLFSGGTGAAGMTSAGEATVAGVLRGLPDAQGILCGSIVSGLRMRPGNWAGIYACWGTENREAAVRFVKGGAGSAYGGNVEVKVVDPSANPYLASAAILGLALDGMKTKAVLPSETTVDPTQLSDVDRDRAGILRLAADQADAIAVLDSSKLLRCILGDPVVDAVVAVRQLEHERYGDLDPAQLADKFRMAWSV

SEQ ID NO: 51676 - protein, 430 aa, Yersinia pestis KIM
MASEYIEHLAVFHAEDTLLPAKGSFFMSPIEKSSKLDNVCYDIRGPVLKEAKRLEEEGNKVLKLNIGNPAPFGFDAPDEILVDVIRNLPTAQGYCDSKGLFSARKAIMQHYQARNIRDLTVEDIYIGNGVSELIVQSMQALLNLGDEMLVPAPDYPLWTAAVSLSSGKAIHYMCDEESGWFPDLDDIRSKITPRTRGIVIINPNNPTGAVYSKELLLEIVEIARQNDLIIFADEIYDKILYDDAQHHSIAALAPDLLTVTFNGLSKTYRVAGFRQGWMVLNGPKKHAKGYIEGLEMLASMRLCANVPMQHAIQTALGGYQSISEFIQPGGRLYEQRDRAWELINQIPGVSCVKPQGALYMFPRIDQKRFNLKDDQKLVLDLLLQEKVLLVQGSAFNWPYPDHVRIVTLPRVDELEMAVRKLGRFLETYHQ

SEQ ID NO: 51677 - protein, 157 aa, Brassica napus
  misc_feature (14)..(17): Xaa can be any naturally occurring amino acid
KSNTTTIESTCPPXXXXYDLCVSALKSDPRSPTADTKGLAAIMASVGMTNATATASYIAKNLTATANNTVLKKVLKDCSDKYILAADSLRLTIQDLDDEAYDYAYMHVLAAQDYPNVCRNIFRRAKGLVYPAEISRCEVSLRSICVVVSGILDRLAE

SEQ ID NO: 51678 - protein, 376 aa, Magnaporthe grisea 70-15
MTSEQQPPSPPTASQKRHAFSWFTDANYLSINQLKTLPEPKSDFTGKTVIVTGGNSGLGREAARYFARLGAAKVILACRDTAKGEVARADIEVSTRSSRPPSAAGVRLAVEVWQVDMSSGSSVHDFCARVERELPRLDSLVLNAGVAIGAFVECEGGWESSVAINVIGTFLMAVLCLPIMRRTAAQHNVAPTIAVVASEAHVFASFAERKRQGLIFDAFKSAADMNEDRYNVTKLLDVLLARELAARLGPDSPVVVNALNPGLCQSELFRHCPFPLSALLRLGLMILGRKTEVGSRTLVAAAAAGRETHGKYMDSCELANESAFVRSDEGRASGVRVFDELMGIMEGLAPGARGNLNASTTTSMATAPASTAQASS

SEQ ID NO: 51679 - protein, 459 aa, Bacillus cereus G9241
MSKLVVIGGGPAGYVAAITAAQNGKDVTLIDEADLGGTCLNVGCMPTKSLLESAEVHDIVRKANHYGITLNNGSISIDWKQIQARKSQIVTQLVQGIQYLMKKNKIQVIQGKAKFETDHRVRVTNGNKEDIVDGDQFIIAAGSEPTALPFAPFDGKWILNSSHAMSLENIPKSLLIVGGGVIGCEFASIYSRLGTKVTIVEMAPQLLPGEDEDIAHILRGKLENDGVEIFTGAALKGLNNYKKQASFEYEGSIQEVNPEFVLVSVGRKPRVQQLDLEKAGIQYSNKGISVNEHMQTNVSHIYAAGDVIGGIQLAHVAFHEGTTAALHASGEDVKVNYHAVPRCIYTAPEIASVGLTEKDAREQYGDIQIGEFPFTANGKALIIGEQTGKVKVIVEPKYQEIVGISIIGPHATELIGQGTVMIHTEVTADIMRDYIAAHPTLSEAIHEALLQAVGHAVHA

SEQ ID NO: 51680 - protein, 399 aa, Bacillus cereus G9241
MAVEVVMPKLGMAMKEGIITSWNIKAGDHVSKGELIASINSEKIETEIEAPADGTVLDIAVSEDEGVPPGTVICYIGKSNEKVEVYESTNVVEEKTSNPEPKKVPHPDPYVIDLTKQRVKISPVAKKIAKTENLDIKSLLGTGPGGRITKVDVLKALEERVAVPEVLEQEESKVIPVTGMRKAIANRMHASLQNSAQLTLTMKVDVTDLVALHKEIADVVQKRYDNKLTITDFVSRAVVLALGEQKEMNSAYINDTIHQFEHVHLGMAVALEKGLVVPAIRFANNLSLVELSKQIKNVAQKAREGSLSSDDMQGTTFTISNLGSFGIEYFTPVLNTPETGILGVGAIEHVPVYKGKKIKKGSMLPLSLTFDHRVLDGAPAAAFLRTIKRYLEEPVTILL

SEQ ID NO: 51681 - protein, 453 aa, Yarrowia lipolytica CLIB122
MSHHQSSNVVGVHYRVGKKIGEGSFGVIFEGANLLNTQQVAIKFEPRKSEAPQLRDEYRTYKHLAGCVGIPNVYYFGQEGLHNILVIDLLGPSLEDLFDWCGRRFSIKTVVMVAKQMLSRVQTIHENHLIYRDIKPDNFLIGREGTKTASLIYVVDFGMAKQYRDPKTKQHIPYRERKSLSGTARYMSINTHLGREQSRRDDLEALGHVFMYFLRGGLPWQGLKAATNKQKYEKIGEKKQTTHIKDLCDGFPEQFEQYLSYVRGLGFEETPDYDYLRALFTQALKSTGETEDGVYDWMKLNGGKGWDSGNRKPNLHGYGHAYPPDRSGNANSRQAHISSARLNATPPPLPEPAAVARQNSKGRHGARNPQARLSKNAQTPGYYQQSPSQSHGVQGGAGAGTGAMSSQQKQSSVHQQLSQSNQANYNQATDPANAEYEAPKKGFWAKISGFCCA

SEQ ID NO: 51682 - protein, 324 aa, Kluyveromyces lactis NRRL Y-1140
METSKRMSTNSIKLLAGNSHPELAQNIARTLGLRLSNIGVYQYSNQETSVTIGESIRDEDVYIIQTGTGEQEINDFLMELLIIIHACRTASARRITAVIPNFPYARQDKKDKSRAPITAKLVAQMLETAGCDHVITMDLHASQIQGFFHIPVDNLYAEPSVLKYIQHKTDIGNAILVSPDAGGAKRVASLADKLDLNFALIHKERQKANEVSRMVLVGDVTGKSCLLIDDMADTCGTLVKASDTLLEHGAKEVLAIVTHGIFSGSAEQKLKNSKLSRIVCTNTVPVDLDVNILDQIDISPTLAEAIRRLHNGESVSYLFTHAAI

SEQ ID NO: 51683 - protein, 328 aa, Klebsiella pneumoniae subsp. pneumoniae MGH 78578
MSLQNLTRFPRLELIGAPTPLEYLPRLSDHLGREIFIKRDDTTPLAMGGNKLRKLEFLAADALREGADTLITAGAIQSNHVRQTAAVAAKLGLHCVALLENPIGTRAENYLSNGNRLLLDLFNTQVEMCDALTDPAAQLDELATRIEAQGYRPYVIPVGGSNALGALGYVESALEISQQCEDAVAISSVVVASGSAGTHAGLAVGLEQLMPQAELIGVTVSRSVADQLPKVVALQQAVANSLELQAKAEIILWDDYFAPGYGTPNEDGMAAVKLLAQLEGILLDPVYTGKAMAGLIDGITQKRFKDEGPILFVHTGGAPALFAYHPHL

SEQ ID NO: 51684 - protein, 363 aa, Haemophilus ducreyi 35000HP
MGFKCGIVGLPNVGKSTLFNALTKAGIEAANYPFCTIEPNTGVVPMPDPRLDALAEIVNPERVLPTTMEFVDIAGLVAGASKGEGLGNKFLANIRETDAIGHVVRCFENDDIVHVAGKIDPADDIETINTELALADLDSCERAIQRLQKRAKSGDKDAKFELSILEKILPVLENAGMIRSVALDKDELHAIKGYNFLTLKPTMYIANVNEDSFENNPYLDRVRQLAEQEGAVVVPVCAAIEAEIAELEDEEKVDFLQDLGIEEPGLNRVIRAGYRLLNLQTYFTAGVKEVRAWTVAVGATAPKAAAVIHTDFEKGFIRAEVIAYDDFIQFKGENGAKEAGKWRLEGKDYIVQDGDVMHFRFNV

SEQ ID NO: 51685 - protein, 329 aa, Actinobacillus pleuropneumoniae serovar 1 str. 4074
MNNLMQNQFYRGRFSVAPMLDWTTRHCRYFHRQFSRHALLYTEMITAPAIIHAKYDLLEYDPSENPVALQLGGSDPAQLAHCAKLVEERGYAEINLNVGCPSDRVQNGMFGACLMAKADLVADCIKAMQDAVQIPVTVKHRIGIDDLDSYEFLCDFIEKVQPYSNDFIVHARKAWLSGLSPKQNREIPPLDYERVYQLKRDFPHLNISINGGIKTIEEIKRHLAFVDGVMVGREAYQNPSLLGEIDSQIFGENRPLVTAREAVEKMLPYIAVQTQKGVYLNHIVRHMLGAFQNCKGARQWRRHLSENATKQGAGVEVVEQALSFVQESN

SEQ ID NO: 51686 - protein, 421 aa, Chlamydomonas reinhardtii
MLPALTGKLLKQATGSLAALSQCQQLRFFNVHEYQGAQIMSKFGVNVPPGIPATTLDEVKKAVDQMADEKGEVVIKSQILAGGRGLGKFTNGLQGGVHIVPKAKALELAKQMLGATLVTKQTGPAGKPVNTLLISKKMKLKREMYFAILLDRKTAGPMMIGCSEGGTSIEDLAEKFPEKIIKIPIDIRVGITDAQAMQMVEGLRVTGDKAAAAKQIKALYTLFDKSDCTMVEVNPLAEGLDGSLIAADAKLGFDDNAAYRQKPIFDMKDESQIDPREVAASKYDLNYIGLDGSIGCMVNGAGLAMATMDIIKMHGGAPANFLDVGGSANEQQVVEAFKILTGDKQVKAILVNIFGGIMKCDVIASGIVNAAKQVGVQVPLVVRLEGTNVARGKEILATSGMTIITADDLDDAAKKAVASIA

SEQ ID NO: 51687 - protein, 429 aa, Vitis vinifera
MALYSLFRSAPSAAAAAAATVVDSSRPSDRCKVSCIGFNSNADSLKVQTTIFGTPCIGNSSSLQKCSARSLQPIKATATELPPTVQKSWSSGQTKIGINGFGRIGRLVLRVATSRDDIDVVAVNDPFVDAKYMAYMFKYDSTHGVFKGTIKVLDESTLEINGKQIKVTSKRDPSEIPWGDYGIDYVVESSGVFTTTEKASAHIKGGAKKVVISAPSADAPMFVVGVNETSYKPSMNIVSNASCTTNCLAPLAKVVHEEFGIVEGLMTTVHATTATQKTVDGPSMKDWRGGRGASQNIIPSSTGAAKAVGKVLPELNGKLTGMAFRVPTPNVSVVDLTCRLKKSATYEDVKAAVKYASEGPLKGILGYTDEDVVSNDFVGDSRSSIFDAKAGIGLSASFMKLVAWYDNEWGYSNRVLDLIEHMALVAASK

SEQ ID NO: 51688 - protein, 382 aa, Chlamydomonas reinhardtii
MSKFGVNVPPGIPATTLDEVKKAVDQMADEKGEVVIKSQILAGGRGLGKFTNGLQGGVHIVPKAKALELAKQMLGATLVTKQTGPAGKPVNTLLISKKMKLKREMYFAILLDRKTAGPMMIGCSEGGTSIEDLAEKFPEKIIKIPIDIRVGITDAQAMQMVEGLRVTGDKAAAAKQIKALYTLFDKSDCTMVEVNPLAEGLDGSLIAADAKLGFDDNAAYRQKPIFDMKDESQIDPREVAASKYDLNYIGLDGSIGCMVNGAGLAMATMDIIKMHGGAPANFLDVGGSANEQQVVEAFKILTGDKQVKAILVNIFGGIMKCDVIASGIVNAAKQVGVQVPLVVRLEGTNVARGKEILATSGMTIITADDLDDAAKKAVASIA

SEQ ID NO: 51689 - protein, 133 aa, Oryza sativa Japonica Group
MAAKAALVLAVSLLVVAVASACTYCPEPPTPKPKPPAPRPPKPGGGAGSCPRDALKLHVCANVLGLVKAKIGAVAPYEPCCSLLDGLVDLDAAVCLCTAIKANVLGLNLNIPIDLSLILNNCGKICPSDYQCA

SEQ ID NO: 51690 - protein, 238 aa, Chlamydomonas reinhardtii
EQQAAHDKFLAHLTDTKQLLVGHDDRYTLLRFLKARQWDVNKATIMYTNMTKWRAEHGTDRLYETFTFPEEDQVIEHYPHFYHMTDKFGRPLYIELLGHTDAAKILEHTSMERLMDYHIVEWERLKREILPRCSLLAGKPIITKNVILDLKGVSMKNFGHAAREILTKIAAIDQDYYCESLGQMFIINTPTVFRLIWAVVNPMLEERTRRKIIILGSDYMPTITQLIPEDNLPACLGG

SEQ ID NO: 51691 - protein, 801 aa, Agaricus bisporus
MSGMPGTSSLPPYLAGQLDVLMIDNFDSFTWNLYQQLCLLGASVTVIRNDAISPDLFPQLKINSLIISPGPGHPHTDSGVSKDAIRYFTGKVPILGVCMGLECLVDVYGGSIQYAGEIMHGKVSRIRHDNRGCYRDAPQGLKSIRYHSLSASYETLPAELAITSVTEESGVIMGVRHRKYTVEAIQYHPESILSEGGDNLVKNFLSLRGGLWEQNPGAHVLDATMPPFLPEIPDDVSTPVTTQKKVPSILDKIYKQRLLDVDQAQATPGSTTQDLQTLHSLNISPPQIDFTVRIRQGTSPDCPAMFAEIKRASPSKGPIALNINPAAQALKYALAGAHTISVLTEPKWFLGSLHDMLHARQAVAHLPNRPAILRKDFILSRYQVLESRIWGADSILLIASMLSESSLRDLYSYALELGMEPLVEVNNAQEMELALSLPAKVIGVNNRNLHDFKVDMNTTSRLSDMTKGKNVVLCALSGIASRNDVERYKGQGVGAILVGESLMKAKDVGEYIKELMGTPSVDAKKEEQGTPLVKICGVKTKDQALAIADAGADLLGLMFAKSKRRIDRQVAKEIAAAIRDRRFNFDFKPISTSSANEPWFSMNAKRLANITQQTRPLLVGIFQNQPLEEILETVADVQLDIVQLHGNEPVEWATQIPVPVIRAFHLGFKDGRIRGVENITHPGKNHFILFDSVRGDGLSGGSGKIVDWAFAKKVADGGEILLNGPRAYLGSEDTSSTTNSLDGSRLPIILAGGLTPENVAEAVKQVRPWAVDVSGGVETEDGDLKDLEKVRLFIARVKLLD

SEQ ID NO: 51692 - protein, 626 aa, Vitis vinifera
MGRMKNLAELEDGKKLNGSNKEDQPVKVFWRLRRRIIHYENGKTRDGYFEEQLSVFYSTVSKRWLVYNTLGGSHGVPKVHYKGKQGDYYVMVLDILGPSLWDVWNSSGQAMSSEMVACIAVESLSILEKTHSRGYVHGDVKSENFLLGKPSTPQEKKLFLVDLGLATKWRDSANGQHVEYDQRPDMFRGTVRYASVHAHLGRTANRRDDLESLAYTLIFLLAKRFLYLLYFILLNQFQLFELFLYFIEIQPTLRTTVKTSNVQTQRTLKSKRTSVLDKSISGAAISSKNKEKLVPSSLPESIGFVGPYQPAQGELPPDGNASTSTNTSDINNRRKSDRRRSFTLSLMTRSKQLEEHGEFRKLEKLPSIDDNCNHLEVAEYVEEIYQYYWVTEAQNPSMQNYMSIQSDITPQMRGILINWLIEVHYKFELMQETLYLMVTLFDRYLSLVPIKKNRHALCVHFIFMFRLVQVKDLISISAESYTRDQMLGMEKVVLNKLKFRLNVPTPYVFMMRFLKAAQSDKRLEHLAFYLIELCLVEYEALKYKPSLLCASAIYLARCTLQRAPAWTPLLHKHARYEESQIRDCAEMILKFQKAARTGQLKVTYEKYMRPDQSGVAAITPLNRLPR

SEQ ID NO: 51693 - protein, 499 aa, Triticum aestivum
  misc_feature (260)..(260): Xaa can be any naturally occurring amino acid
  misc_feature (419)..(419): Xaa can be any naturally occurring amino acid
  misc_feature (462)..(462): Xaa can be any naturally occurring amino acid
  misc_feature (474)..(474): Xaa can be any naturally occurring amino acid
  misc_feature (486)..(486): Xaa can be any naturally occurring amino acid
NKFVQKSRLVPVRNSRDIVDPRVRSVARFDFSWKDATYHQETLDNLRKAAQNVKKLCPIMLDTVGPEIQVHNSTGGAIELIGGNHVTITPDLSKAPSADILPIKFGDLAKVVKKGDTLFIGQYLFTGSETTSLSLPVTETSGAEVICYVKNTATLSGPIFTLHVSQVHISMPTLSEYDKQVISTWGLQNSVDIISLSHTRSSEDVRELRAFLKSHDLQDTQIYAKVENAEGLEHFDEILQEADGIIISRGDLGIDLPPEXVFMSQKTGIHKCNMAGKSVIITRVVDSMIDNLRPTRAEATDVANAVLDGTDGILLGAETLRGQYPVDAVRTVGRICAEAETVYNQSLHFKKVVRHVGEPMAHEESVASSAVRSANEVKAAAIVVFTFSGRAARLFAKYRAPMPVLAVVFPREGSDPSKXRSYGTTQARQWFSVRGVYLWMGSTDEAETGGLPKEEYGIKFPXNNGGSVGIIKPXQRVIIFEKNGDXSFVKIIECDDSER

SEQ ID NO: 51694 - protein, 815 aa, Clostridium acetobutylicum ATCC 824
MKAIIMAGGQGKRLRPLTCNLPKPMMPIMQKPVLQYIIELLKKHGINEIGITLHYLPDEVMDYFGDGKELGVNIHYFIEQSPLGTAGSVRNAESFLDETFVVISGDALTDVNLTNILQYHKEKNAMVTIVLKKVTIPLEYGVAITDTEGRISNFIEKPGWGEIFSDKANTGIYVMEPGIFEFYNKDKKFDFSEELFPELLKSGKEIFGYVVNDYWRDIGNIEQFMKCNFDILNGYVDVDVDIDASQHQKGVWIGKNTIVSDNVKVIPPVYIGDNSEIRYGAEIGPFAVIGRNNIISEMATIKRSIIFENCYIGSGAELRGSVVSNNVQVGGGVSTFEESAIGTGSLVGEKSVVKAGVKIWPDKVIGSKTIIKTNVVWGENRCKVLFGKEGISGEINVELTPEFVSKLASAFASNLRMNSKVVVCSDYNLAAEMLKYSFVSGLISMGIEVYSAKEMTIPMLRFSTAYFKADAAVYIYCKGSNKEKVNILFIDKDGIMISRSMEKKIANSFLREDFRRTRANNFKRLRDFGECMGYYEDYIKENLCIQEIRNSGLKVAVSMENKLIKNEVKSIFSDLKIQYSIYDNYADLEGLKKEVIEKKMDFGVCISENCDKAIIIDENANIISTQMYESIKALILISVYKFKTIVAPVNSSKALKYIAKRYNCKYVKSKISERYILNEYILNEKDKNIKEVLFSYLSSTDALNIVINIINILARGKIKLSELMERIPNYILREKEIACSWDNKGKIMRSLIEENISKSIELIEGIKVNYEDAWVLIIPDSDEPICKIYAESNDEEKTDKIINEFESEIELFMKN

SEQ ID NO: 51695 - protein, 432 aa, Bifidobacterium longum NCC2705 [sequence omitted]

SEQ ID NO: 51696 - protein, 214 aa, Paeonia anomala
IVESVGEGVTDLKPGDHVLPVFTGECKECRHCKSEESNMCDLLRINTDRGVMLNDGKSRFSINGQPIFHFVGTSTFSEYTVVHVGCVAKINPEAPLDKVCVLSCGISTGLGATLNVAKPKKGSSIAIFGLGAVGLAAVEGARIAGASRIIGVDLNPKRFEEAKKFGVTEFVNPKDYNKPVQEVIAEMTDGGVDRSVECTGSIMAIISAFECVHD

SEQ ID NO: 51697 - protein, 483 aa, Pseudomonas aeruginosa UCBPP-PA14
MSVRRTKIVATLGPASNSPEVLEQLILAGIDVARLNFSHGTPDEHRARARLVRELAAKHGRFVALLGDLQGPKIRIAKFANKRIELQVGDKFRFSTSHARDAGTQEVVGIDYPDLVKDCGVGDELLLDDGRVVMVVEEVAADELRCRVLIGGPLSDHKGINRRGGGLTAPALTDKDKADIKLAADMDLDYVAVSFPRDAKDMEYARRLLTEAGGKAWLVAKIERAEAVADDDALDGLIRASDAVMVARGDLGVEIGDAELVGIQKKIILHARRNNKVVITATQMMESMIHSPMPTRAEVSDVANAVLDYTDAVMLSAESAAGEYPVEAVQAMARVCQGAEKHPTSQKSSHRLGQTFDRCDESIALASMYTANHFPGIKAIICLTESGFTPLIMSRIRSSVPIYAYSPHRETQARVAMFRGVETIPFDPAALPAEKVSQAAVDELLKRGVVTKGDWVILTKGDSYTAQGGTNTMKVLHVGDLLV

SEQ ID NO: 51698 - protein, 273 aa, Triticum aestivum
MASSSDVVPAAARKLDGKVALITGGASGIGEGTARLFVQHGASVVLADIQDDLGARLCAELGPAASSYVRCDVTKEEDVAAAVDHTIARFGKLDIMFNNAGIGGAACHSIRDSTKEDFERVLAVNLVGPFLGTKHAARVMVPARQGCIIGTSSLASAVGGVASHAYTCAKRALVGLTENAATELGQHGIRVNCISPAAAATPLATGYVGLDGEAFEMAMESFANLKGVGLRVKDIAAAVLFLASDDARYVSGHNLLIDGGISVSNLTFGIFKE

SEQ ID NO: 51699 - protein, 214 aa, Paeonia anomala
IVESVGEGVTDLKPGDHVLPVFTGECKECRHCKSEESNMCDLLRINTDRGVMLNDGKSRFSINGQPIFHFVGTSTFSEYTVVHVGCVAKINPEAPLDKVCVLSCGISTGLGATLNVAKPKKGSSIAIFGLGAVGLAAVEGARIAGASRIIGVDLNPKRFEEAKKFGVTEFVNPKDYNKPVQEVIAEMTVGGVDRSVECTGSIMAIISAFECVHD

SEQ ID NO: 51700 - protein, 114 aa, Deschampsia antarctica
NETEVGGRKIKVNVTESFLPNIDPSAPEAEPAFVDSQYKVYVGNLAKTVTMEVLKNFFSEKGEVLSATVSRVPGTPKSKGFGFVTFSSDEEVEAAVSTFNNTELEGQAIRVNRA

SEQ ID NO: 51701 - protein, 382 aa, Ehrlichia ruminantium str. Welgevonden
MSKSDYYDLLGLSKNATPEEIKKAYRKMALKYHPDKNPGDKAAEEKFKELSEAYDVLIDKDKRAAYDRYGHSAFSDGSGRGGFDFNSGFSTDFSDIFNDLFGGGFRGGRSSSKRQDGGTVGSDLRLDIEITLEDSFNGTKVPINYVTHVKCSSCSGSGSEGSVKSVQCNTCHGAGNIRTQQGFFTIERTCHVCNGEGEIIKNKCKKCSGSGRVRDEVNLLVTVPKGIESGDKIRLNGKGEAGYRGAQSGDLYVYPNIKKHKFFTRNGADLYCNVPIKMILATLGGHIEMPSIDGTWTKVKVPEGSQNGDKLRLKEKGMPVINSSRRGDMYIQITVETPINLTKQQKELLKKFDEEPNTVECNPQSTGFFQKVKSFWNDIRSS

SEQ ID NO: 51702 - protein, 1455 aa, Aspergillus oryzae
MPAHLHAHPPGSTSLAANHEAESPSDSVSSPRVFLSHDDEDAIAEIRRTLTEISHHNSKQGYPEPHSSFDKFLEAELQAGRKKSNLGVCFQSLSTWGDGEEHTDVKTLGTALWRTLTFQDVYEWTIQPWLSRKEPQSGRPLIRDFSGAVRSGEIMLVLGRPGAGCSTFLRTIAGHHSSFLGVTGSLDYSGLSLEEVKKHYRGQVAYVPEDDVHFPTLTVQQTLEFALQSKTPQRYQDRIPRYLEIYGRVFGMSHTMNTLVGNEYIRGVSGGERKRISIIESLATDSSVSCWDNSTRGLDASSALDYARSLRIMTDTCGKATLMTLYQASDAIYDLVDKVLLIDEGRMLYQGPAREAKRYFEDLGYECAEMQTISDFLTSITVPERRRFRLGWEHRAPKGPIELEEAFRKSSAYQKVQYDVQHYEDQRLGGKSVRCSQIDSDDGSLEDFKKAIQTDKSRFVSPKSPYTISVFRQVVLCAKRQLWQIRGHMSPLYIKIISSVVYGLLVGSMFYNQPQTTAGMYSRGGVIFYSSILLAWLQMSELEEAMQGRDILSRQKKFAFVRPSAVCLARVITDFLIAAVITFLYLIVVYFLSGLKSDAGAFWIDFLFIYLCTICLTAQFRLFAAASSNFEVALRYCGVSVLFCIVFGGYVLSVDRMIKDVPWVGWIAYTTPALYTYEAMMAAEFHNANFTCSPESIVPSGANYTNIAYQTCGYAGSQIGTTVVNGDDYLAAQYGFSFGHVWRNFGILCLFTVVYIVCTCWLSEIMEWEPDSAGPIEYKKSRRNSRRSHRQGLDEESNPVHRDVTMPDSANNFERSGQAITGSMSTFTWDNLELFVQVGKETRKLLNGVSGYCKPGTLTALVGASGAGKSTLLTALTQRPNSGKLTGTMYVDGHAVDESFNRQIGYCQQMDIHDESSTVREALEFSALLRQNPGVPDKEKLAYVNTVIETLDLIELQNALIGSLDIEKKKRVTIGVELCARPELLLFLDEPTSGLDSQGASSIVALLRRLADQGLAILCTIHQANQQQFEDFDRVLALSPGGSTYYFGEVGESGCSIFEYFSKNGHKPENVTNAADYLIEVVVGGMKKDTTHQVNWADVWNRSAEADMVKKDICDIRSKGAEAGVSQHAKEISQPPLYRQVGLLTQRTLRQYWRSPEYPYSRLYASFLHALINGLTYLQIGNSSTDLQSKAFSCFLVLMLVPEFINAISMRFIMNRDIWKAREGPSGVYGWVAFCTAQIVSEIPYAIISAVVFYVLYYFIVGLPLGFAAGYSFLMFFLFFLFATSWGQWIAALSADSMVAATLMPFFIIMCELFNGILQPHENMPVFWKYTMYYATPFTYWIGGVLTAVLRGMPVICDSSELTMFESPPNMTCAEYAGPWLAEHGVGYLSNPDDTSKCGYCKYSYGDDYLSGIGLDSSKIWPYFGIFLAFVISNYSMVYVLVYVRSVMKPFWGRK

SEQ ID NO: 51703 - protein, 418 aa, Pseudomonas aeruginosa UCBPP-PA14
MAVPADASPLRKLALFVGPGLLVSVGYMDPGNWATAIEAGSRFGYALLFVVVLASFSGMLLQSLCSRLGIATGRDLAQLSRERYRPGVARGQWLLAELSIVATDLAEVLGAALAFHLLLGVSITTGVVLTAFDTLIVLALQGANFRRLEAIVLGLIATIGACFFVELVLIGPYWPDVAAGLRPSWDTLSSQEPLYLAIGILGATVMPHNLYLHSSVVQTRVSGDDAASKRSAIRFSRLDTIGSLSLALLVNAAILILAAAAFHGSGHTEVVEIQDAYHLLDPLVGGALASFLFGFALLAAGQSSTFTGTIAGQVVMEGFLRAKIPCWQRRLITRGLALVPALIGVLWLGEGAVGKLLVLSQVVLSLQLPFALWPLIRFSSDRNLMGEFVNPRWVSALAWSLFGLISAANLTLLYFWFG

SEQ ID NO: 51704 - protein, 214 aa, Paeonia anomala
IVESVGEGVTDLEPGDHVLPVFTGECKECRHCKSEESNMCDLLRINTDRGVMLNDGKSRFSINGQPIFHFVGTSTFSEYTVVHVGCVAKINPEAPLDKVCVLSCGISTGLGATLNVAKPKKGSSIAIFGLGAVGLAAVEGARIAGASRIIGVDLNPKRFEEAKKFGVTEFVNPKDYNKPVQEVIAEMTDGGVDRSVECTGSIMAIISAFECVHD

SEQ ID NO: 51705 - protein, 167 aa, Zea mays
  misc_feature (37)..(37): Xaa can be any naturally occurring amino acid
  misc_feature (69)..(69): Xaa can be any naturally occurring amino acid
RELTREVLLPKDGHQEVAEVALQLGKYCIDDPVKSPXADGGWLFVLPKEWEVVYCSVPTSPGGLYRTPXGRLVFKTDEMVQAVEAPDVVRNKVSFSVFGLEGAVSLKGKLNVLDSKWIQVVFEAPELKVGSLGFQYGGESEVKLEKGRRWEKTTARGRRIVIRSLND

SEQ ID NO: 51706 - protein, 550 aa, Leptospira interrogans serovar Copenhageni str. Fiocruz L1-130
MQICRGKETCKAGRVLKMEKQKRVDQISKLQKESFDILVIGGGSTGAGAAFDAAKRGYKTALIERKDFASGTSSRSTKLIHGGVRYLAQFHFKLIHEALTERQRLLENAPHLVKPLKFVLPAYRFYERPYYGIGLTLYDILASKGKLPSHKTVSKSETISEFKAIKKEGLFGGITYYDAQFNDARLNVLLARSAQKEGAVVANRIELVSFIKKSGKIVGANLKDLETAKTFPVYTKVIANTTGIWVDHIRKLDDPRTFNVLSPSQGIHLVFSKERVPCTSAMIIPKTKDGRVVFIIPWEDHVILGTTDTPIENPGEEPLPIGNEVQFLLDTGNEYLENPVTEKDILSVFVGIRPLISPEGNQDTKNISREEVILVSNSGLVTMGGGKWSTYRKMAEDLVDKLIQIGNLEVREKCSTKFYVYPGAADYSESLYQEIEKTYKIDTIFAKRLQNYYGTEVFEVLGKKPKLLGKGIPYFEEEVLFAVNEEFALGVTDVLARRFRILFVDLSLAQKMVAPVAMVLSKQLKWKDKTKKAEESAAMELIESLRKSYR

SEQ ID NO: 51707 - protein, 184 aa, Triticum aestivum
QAIYLHSTPWAPTVMASWATSVAPFQGLKSTAALPVSRRSNGASLASVSNGGRIRCMQVCPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEDSPNP

SEQ ID NO: 51708 - protein, 360 aa, Vitis vinifera
MATAPTLCITATNLLILLIFFLPSLVLSDCSCDEAEHSDHPINGGESLKYKLAAIASILVAGAAGVSIPLLGKKVPALNPENHIFFMIKAFAAGVILATGFIHILPEAFERLTSPCLGENPWGKFPFTGLVAMMSAIGTLMVDTFATGYYKRQHFSKPKQVTADEERGQEHAGHVHVHTHATHGHAHGSASPSDEESLSDLIRRRIVSQVLELGIVVHSVIIGVSLGASQRPETIKPLLAALSFHQFFEGLGLGGCISQAKFRFSTMAMMVLFFSVTTPVGIVLGIGISRIYHENGPTALIVEGVFDAASAGILIYMALVDLLAADFMNPRLQSSLRLQLGANISLLLGTGCMSFLAKWA

SEQ ID NO: 51709 - protein, 717 aa, Shewanella sp. MR-7
MSRNIMLIPIGTGVGLTSLSLGMVRALERHGVKVQFFKPISQLRPNDNGPERSTTILSKSPTVNPLEPFDMAHAEALIRADQTDVLMEQIIARAAECASNTETLIVEGLVPTRNHPFADDVNYAIAKAMDADVIFIATPGSDTPTGLMNRLEIAYNSWGGKNNKRLIGAVINKIGAPVDDEGRARPDLSEVFDHQGVQRSDSSIMFQLPGKSPLRILGSVPYNLDLVAPRASDLAKHLRARILNAGEMNTRRLRKVTFCARSLPNMVNHIKTDSLLVTSGDRSDVIVSACLAAMNGVKIGALLLTGSYEPEPEILKLCEQAFETGLPVFLIDTNTWQTSLNIQRFDHEVPVDDAVRIDLVQEYVAGHIDQTWIESVTKNSPREHRLSPPAFRYKLTELARAAHKTVVLPEGDEPRTIKAAAICAERGIARCVLLGKKDEILRIAAQQDVVLGDGVVIVDPDEVRDRYVEPMLDLRRNKGLTEVVAKEQLEDNMVLGTMMLAQDEVDGIVSGAVNTTANTIRPPLQLIKTAPGSSLVSSIFFMLMPDQVLVYGDCAINPDPNAEQLADIAIQSAESAKAFGIEPRVAMISYSTGNSGTGSDVDKVREATRIAKEKRPDLVIDGPLQYDAAVMPNVARSKAPNSPVAGQATVFVFPDLNTGNTTYKAVQRSADLISIGPMLQGMRKPVNDLSRGALVDDIVYTIALTAIQASQNDASKA

SEQ ID NO: 51710 - protein, 101 aa, Zea mays
  misc_feature (35)..(35): Xaa can be any naturally occurring amino acid
  misc_feature (52)..(52): Xaa can be any naturally occurring amino acid
  misc_feature (64)..(64): Xaa can be any naturally occurring amino acid
  misc_feature (87)..(87): Xaa can be any naturally occurring amino acid
  misc_feature (94)..(94): Xaa can be any naturally occurring amino acid
MDTHIGSVNGAASNQTVWLPGVGGLTRWRPRGARXTSVAAGCVAGGHLARRXVQVGVNELFAVXPGDFKLTLLDHLIAEPALRLVGXCNELNAXYAADRYA

SEQ ID NO: 51711 - protein, 325 aa, Triticum aestivum
MAASLLHAAASSPLAGPNPAARAAFRPLASSPFLRLARSSPDRRARLDASLRALSGGARLAAGVAAPRSRRFVAALAGEEPMSSELGDDKEKETEKIEIEPEEAQEVWREMLKQFKAEAIRMQALTTQAYDVYSKRAREVLLEASEKLRIQADKAQKDLTIIAAEVGEEGQEYLQLAAKNSPDSIKDITETINAVGNLNGPSEYKDYHVGISFGTFLTVGGFLNFMLTGSTSAIRFGFVLGFALLALGISSLRSQRAGGRQPRLLLKGQAAIASVIFFKDLSVFFRHGWFPNVFAVLLSGMVATFYIHRIVTGGHKGSTESSSDN

SEQ ID NO: 51712 - protein, 200 aa, Brassica napus
ARGTDTAAVTLEWAMASLLKNPEVLKKAKAEIDDKIGHERLVDEPDILNLPYLQNIVSETFRLCPAAPLLVPRSPSEDLKIGGYDIPRGTIVLVNSWAIHRDPRLWDEPERFMPERFEDKEAANSNKLMIGGNGRRTCPGAALGQRMVSLALGSLIQCFDWEKVKGEEIDMTENPGMAMRKLVPLRAVCHQRPIMTNLLA

SEQ ID NO: 51713 - protein, 427 aa, Oryza sativa Japonica Group
MPRTVAVVGAGAAGLVAARKLLRKGHAVTVFNRLYASLRTNLPRELMGFSGFALAGRVFAGDPRTFPGHREVLAFLDAFAVESGVAGRVRLRAEVVRVGPLAGHGERWTVAWRGEGGVEEEEEEVFDAVVVCNGHCTVPLVPKLRGIGNWQGKQMHSHNYRTPEPFQDQVQDAVSVTVSIVVVVGLGASGVDIAREISNVAKEVHIASRYTEDRLGKVDTFQNTWLHSEVDCIQDDGQVRFSEGSASIAADTFLYCTGYRYHFPFLDVEGVTVDGNRVGPLYKHVFPPKHAPNLSFVGLPVKTIMFQSFELESRWVARALSGRAELPGEEAMAAAVEEDYRRMDAAGKPKRHTHALMPDWLTMFRPLVAATIDERQVEYMDWVAAQVGEPPMEARRREIYEKALRCIWSLDDSYRDSWEEEEEEENR

SEQ ID NO: 51714 - protein, 214 aa, Paeonia anomala
IVESVGEGVTDLKPGDHVLPVFTGECKECTHCKSEESNMCDLLRINTDRGVMLNDGKSRFSINGQPIFHFVGTSTFSEYTVVHVGCVAKINPEAPLDKVCVLSCGISTGLGATLNVAKPKKGSSIAIFGLGAVGLAAVEGARIAGASRIIGVDLNPKRFEEAKKFGVTEFVNPKDYNKPVQEVIAEMTDGGVDRSVECTGSIMAIISAFECVHD

SEQ ID NO: 51715 - protein, 779 aa, Oryza sativa
  misc_feature (550)..(550): Xaa can be any naturally occurring amino acid
MPHRRRLLNPAPSLPPPPAAAPAGFHHHLLAVDDTRLPLLADYALLQGDAAAAPASAEWSAGSGFTGISTDPATATTATTASTATAPGSASNLTAATAGGGGRETWVRRAREGYYLQLSLAIRLTSEAFLAGVPPELLIGCGGGGEAENHADVAADAAAVSYRLWVNGCLSWGDKIAHGFYNILGVDPHVWAMCNAAAEDGRRLPTLVALRAVDSGESSVLEVVLVDKCGDPALADLERRALDLYRAAGVSLDLVRHLAVLVSDHMGGALRSEDGDLFMRWKAVSKQLRKRHRCVVVPIGSLSIGFCRHRAILFKSLADFIGLPCRIAQGCKYCSAPHRSSCLVKIDNERRFVREYVVDLVVEPGRLSSPDSSINGQLLSSVPSPFKTSCTMSSANYATPAASWNRAISGDRRNSILSNPQYSVAKYCVAEEKSSVQVATKEAMLPKCGQITQNGNCNKNSMAVFEVSKQMKAMEISSESGDKDNISSATPLKRLSIEPSFCADWLEISWDEIELKERVGAGSFGTVYRADWHGSDVAVKVLTDQDVGEXAQLKEFLREIAIMKRVRHPNVVLFMGAVTKCPHLSIVTEYLPRGSLFRLINKASAGEMLDLRRRLRMALDVAKGINYLHCLNPPIVHWDLKTPNMLVDKNWSVKVGDFGLSRFKANTFISSKSVAGTPEWMAPEFLRGEPSNEKCDVYSFGVILWELMTMQQPWNGLSPAQVVGAVAFQNRRLPIPQETVPELAALVESCWDDDPRQRPSFSSIVDTLKKLLKSMLGGS

SEQ ID NO: 51716 - protein, 228 aa, Aspergillus nidulans FGSC A4
MNIVEWAFGKRMTPAERLRKHQRALDRTQRELDRERTKLENQEKKLIQDIKKSAKNGQIGACKIQAKDLAISLRIQTVRSNEQMMQSMKGATMLLGSMNRQMNLPALQRIAMEFERENDIMDQRQEMMDDAIDEATGIEGEEEEGEDIVKEVLDEIGVDLSQAVRILLLVYVDMDRTNASLKQLGETPSGIQKESVSEGRVAQAIGAGGAGGASDDDDLQARLDSLRR

SEQ ID NO: 51717 - protein, 496 aa, Thiobacillus denitrificans ATCC 25259
MTVTKDASVENMPCSFVIFGATGNLASNKLLPALYHLEAAARLAESLSIIAFSRRDWDTASWREHMREVLRDKIKGPLDTPTFDRFLARFAYHKGDLNDPHAYHALAERLPPESSCSATVFYLAIKPAEFGAVIQNLEAAGLNKPRGLNRVVIEKPFGEDLESAQTLNRLLHQHFEEQQVYRIDHFLGKETVQNLLVFRFANTLIEPLWNRNFIDHVQITVAESGGIDKRADYYDRAGALRDMLQNHLMQLMTVVAMEPPPALEADALRDEKVKVLRSVRPISKRAVHAHAVRAQYSRGSVEGQIARAYQQEDNVEDNSTTETFVAAKFYIDNWRWRGVPFYLRTGKRMPRQTQIIAIRFRQPPQQLFRETPFESVAPNWVLLSIQPEESMHMEIHVKQPGLDMGTRVMQMNASFLKTDEQTLDAYETLLLDVIEGDRSLFIRFDEVEWAWRVVDPILKNWAVEREFIPTYPAGSWGPAEANRLFDSDDQTWRNEL

SEQ ID NO: 51718 - protein, 214 aa, Paeonia anomala
IVESVGEGVTDLKPGDHVLPVFTGECKECRHCKSEESNMCDLLRINTDRGVMLNDGKSRFYINGQPIFHFVGTSTFSEYTVVHVGCVAKINPEAPLDKVCVLSCGISTGLGATLNVAKPKKGSSIAIFGLGAVGLAAVEGARIAGASRIIGVDLNPKRFEEAKKFGVTEFVNPMDYIRPVQEVIAEMTDGGVDRSVECTGSIMAIISAFECVHD

SEQ ID NO: 51719 - protein, 214 aa, Paeonia anomala
IVESVGEGVTDLKPGDHVLPVFTGECKECRHCKSEESNMCDLLRINTDRGVMLNDGKSRFSINGQPIFHFVGTSTFSEYTVVHVGCVAKINPEAPLDKVCVLSCGISTGLGATLNVAKPKKGPSIAIFGLGAVGLAAAEGARIAGASRIIGVDLNPKRFEEAKKFGVTEFVNPKDYNKPVQEVIAEMTDGGVDRSVECTGSIMAMISAFECVHD

SEQ ID NO: 51720 - protein, 826 aa, unidentified eubacterium SCB49
MVSIVIVSHSKKLAEGVKELATQMSQNKVKIAAAGGLDDPSSPIGTDAFKIQEAIELVDSEDGILVLMDIGSAVMNAELATEMLPEEIMKRVLLCEAPLVEGAIAAAAQSMVGANIETVAKEARNGTQGKQMLLCSPEEEENLSQTIAPQGREIRLEVPNQLGLHARPSVRLVEITNRFNNEVSVSVNNKPFVSATSISQVGTLGAKKGDILVFNVQGEEHIEFENALKQFGEDNFGDPLNETIQKTETAKTPTPLTTKSDYIQGVPASKGISIGKAKVIKNETIIVEETTIENSLEELNKLKNAVLKVASEIEEIRQKTMGHFGKDDAEIFDFHLLLLNDKEKLKEVELLIEKNHFSAAYAWFKVFLELEKMYQNMSDEYLRERASDIVEIRNKVIDEISDSHQTKITLTEPSILVVSEIGPAQTLTLDTDNVLGIISKIGGLTSHATILARSLGIPSITGLENQTDAIKNGDIIGIDGSTGIIYLEKTHPEKINELKEAQQIEQKLFKERFSKAKLPAKSKDAIEFKIQANVSSPKEAKLAYTNGADGIGLYRTEFLYMNRETPPKEEEQYEIYKQVCENMNGLPVTIRTLDVGGDKPIPYLGIPKETNPFLGLRGIRYCLQNKAIFKTQLRALCRISADYNIRVMYPMVGMLEEVIEANAILAEVREELDLEKIAYSKTMKIGIMVEVPSVVFILPQLAKELDFLSIGTNDLTQYLLAMDRENTSLSKHYNALHPAVLNALLKIIEGANDQGIEISLCGELASNPNATALLSALGLRKYSMSGPIIPRIKEAIRNMNVSKNKEIVQNLKEWGTLNLVKKAINL

SEQ ID NO: 51721 - protein, 560 aa, Rhizopus oryzae
MPSIKIGQHLLNRLKEINIDVVFGVPGDFNMPLLDIIEDDPELTWGNNANELNASYAADGYARIRGAGAVVTTFGVGELSAVNGIAGSYSEMLPVIHIVGTPSTKSQAAGAMLHHSLGDGNFDVFFNMSSMIACASAHLKKQTAIAEIDRVISQAVLSKRTGYIGIPIDLIKTEVEVPEPIPALKTELPKNPADVQAIALRVVTDAIAKAQFPVIIVDGCVLRQRCQKAVQAFIERSGFPTYVAPMGKGAVDESSVSYRGCYSGNVTLEAVNEEIKQADLIIEVGSIKSDFNTGNFSYSLDRSKTITLHSFATIVFCAEYQKVSMLEFVPLLTQALPEQPRQFNLGPRPRPVPIQPGTEITHNYFWHKVPEFMDENAIVCAETGTAEFASLNMDGPKGTTYITQFLWGSIGFSVGAAVGAAIAARDRRVYLFVGDGSFQLTCQEISGFLRHGLTPVVFLLNNDGYLIEKLIHGPERAYNNYQMWNYSKSLDYFGAHLEHNKSMGVPPVGFEGKVATRDEFESAMRQVQANPDKIHFLEVIMPQFDSPRELELLVANSENR

SEQ ID NO: 51722 - protein, 234 aa, Mycobacterium bovis AF2122/97
MIFGAGVLGGAQADLLAVPAADFQVLKIPEGITTEQALLLTDNLATGWAAAQRADISFGSAVAVIGLGAVGLCALRSAFIHGAATVFAVDRVKGRLQRAATWGATPIPSPAAETILAATRGRGADSVIDAVGTDASMSDALNAVRPGGTVSVVGVHDLQPFPLPALTCLLRSITLRMTMAPVQRTWPELIPLLQSGRLDVDGIFTTTLPLDEAAKGYATARARSGEELKVLLTP

SEQ ID NO: 51723 - protein, 284 aa, Nicotiana tabacum
MASYSLPSPIAKRLEGKVALITGGASGIGAATARLFVQHGAKVTIADIQDNLGTSLVQEIGNEHTIFVHCNVAVESDVQNVVDATIAKFGKLDIMFSNAGIGGKSISSILDVDYDIIKTVFDVNIVGAFFCAKHAARVMIPFKKGSIIFTASAATVVSGIVPHAYSASKGAVLGFSKNIGVELGKYGIKVNCVSPHYISTPLVLNALGIAEREIAEKWFAAGGNLKGALLDEEEVAKAVLYLASDDSKYVSGMNLVIDGGFSTTNVALTEAYNKLFSSENTHQC

SEQ ID NO: 51724 - protein, 193 aa, Bacillus cereus G9241
MNAIPYVVEQTKLGERSYDIYSRLLKDRIIIIGSEINDQVASSVVAQLLFLEAEDAEKDIFLYINSPGGSTTAGFAILDTMNLIKPDVQTLCMGFAASFGALLLLSGAKGKRFALPNSEIMIHQPLGGAKGQATEIEITAKRILKLKHDINKMIAEKTGQPIERVAHDTERDYFMTAEEAKAYGIVDDVVTKK

SEQ ID NO: 51725 - protein, 212 aa, Debaryomyces hansenii CBS767
MTSVLFTSGATVTFRELIEVITSYDFIVETIIGNGITRMIVQYGNEIETGTQKHVSEEFYRQCVEDKELKQLLQLEVVLGSQNDSNVVTYRSNKYRGFEMVVFPFSNDIGLFISESDVVISHAGTGSIIDTLRLEKPLIVVTNDKLMNKHQEEVADELVKLGCCRKMTIEDMKLSQLKDCISEILSGPETFNKLPECSTTEVEGIIYHELVK

SEQ ID NO: 51726 - protein, 332 aa, Prochlorococcus marinus str. MIT 9313
MTSFLTAARTEQESISYDMQRLRLFSGTSNPALAREIAAYLGVPDGPRICKRFADGELYVQIQESIRGCDVFLIQPTCAPVNDNLMELLIMVDACQRASARQITAVVPYYGYARADRKTAGRESITAKLTANLLVKSGVNRVLAMDLHSAQIQGYFDIPCDHIYGSPVLVDYLAAQELNEVVVVSPDVGGVARARAFAKQMRDAPLAIIDKRRSGHNVAESLTVIGDVAGKTAILIDDMIDTGGTICSGARLLRQQGAKRVIACASHAVFSPPACERLSEEGLFEQVLVTNSIPIAAERHFPQLQVLSVANMLGEAIWRIHEESSVSSMFRG

SEQ ID NO: 51727 - protein, 621 aa, Glycine max
  misc_feature (313)..(313): Xaa can be any naturally occurring amino acid
NQTFLPTTPIPTFRQHGRGLRHADGSSSSNPILKVGEEKEIGKEGLKKKLLKEGEGWDTPEVGDEVQVHYTGTLLDGTKFDSSRDRGTPFSFTLGQGQVIKGWDQGIITMKKGENSLFTIPAELAYGETGSPPTIPPNATLQFDVELLSWTSVKDICKDGGLFKKILTKGEKWENPKDPDEVLVKYEACLEDGTLVAKSDGVEFTVNDGYFCPALSKAVKTMKKGEKVLLTVKPQYGFGEKGKPAHDEEGAVPPNATLQITLELVSWKTVSEVTEDKKIIKKILKEGEGYERPNEGAIVKLKVIGKLQDGTLXLKKGHDDEGELFEFKTDEEQVIDGLDRAVLTMKKGEIALLIIGPEYAFGSSESQLELAVVPPNSTVYYEVELVSFEKEKESWDMDTPEKIEAAGKKKEEGNALFKAGKYARASKRYEKAVKFIEYDTAFSEEEKKSSKALKVACNLNNAACKLKLKDYKQAEKLCLFFVVLLHLFLQSLVLKAQSGSSTTCAQELIPCVNFLNGTTTPPSSCCDPLKQTVENQLDCLCNIFFSPGLLQSFNVSVDQALALSRRCGVTNGITSCTNGSAPAPGSGPPPVTPGGDKGGAGRVTFTGLSFLLLFWVSMLFN

SEQ ID NO: 51728 - protein, 369 aa, Yarrowia lipolytica CLIB122
MTQAAAEHVLVTGGAGYIGSHTVIALVEAGRKPVIVDNLDNSCEEAVRRIEQIVGEKIPFFEVDIRDTNGLDEVYKQYPTITSVLHFAGLKAVGESGQIPLEYYNCNVAGSINLLQWCQKHNIHNFVFSSSATVYGDVTRFEGMIPIPEECPTGPTNPYGRTKMMIEDIIRDHVRANAPWNAAILRYFNPMGAHPSGLVGEDPLGIPNNLLPYLAQVAVGRREKLFVFGDDYPSRDGTPIRDYIHVCDLAAGHVAALEKLEAVDKERKQLPQGSPELKHGFSREWNLGTGHGSTVLEVVKAFSNAVGKDLPYEITGRRDGDVLDLTAKPGRANSELNWKAEKTLDESCSDLWRWTSENPYGYKKDRHDK

SEQ ID NO: 51729 - protein, 140 aa, Rhodospirillum rubrum ATCC 11170
MAIERTLSIIKPDATRRNLTGAINARFEEAGLRIVGQKRLRLTTAQAEGFYEVHKERSFFGSLVEFMTSGPVVVQVLEGENAVLKNREVMGATNPANAAEHTIRKDFAESIEANSVHGSDSAENAAHEIAYFFAQTEIVA

SEQ ID NO: 51730 - protein, 220 aa, Bacillus cereus G9241
MNLKQLAGEYAAYFVNDGMKIGLGTGSTVYWTIQKLGERVKEGLSFQAVPTSKETEALAHQLNIPLISLNDVQSLDLTIDGADEIDSNLQLIKGGGGALLREKIVASSSKELLIIVDESKLVTHLGTFPLPVEIIPFSWKQTERKIQSLGCQTTLRLKNNEIFITDNNNMIVDCIFPNHIATPSALHKRLKMITGVVETGLFVNMTSKAIIGTKNGIKEL

SEQ ID NO: 51731 - protein, 330 aa, Coccidioides immitis RS
MKAASIKLNSGYEMPLVGFGLWKVNNDTCAEQVYNAIKVGYRCFDGACDYGNEVEAGQGVARAIKDGLVKREDLFLVSKLWNTFHDPEHVEPICKKQLADWGIDYFDLYLIHFPIALKYVDPSVRYPPGFTYEGNKIILSNASTQQTWTAMESLVDKKLTRSIGISNFNAQLIMDLLRYARIPPATLQIEHHPYLTQPDLVRYAQKSGIAVTAYSSFGPQSFVELEMEAAKRAPLLLEHPDIKSIAQDHGKAPSQVLLRWATQRGIAVIPKSNNPNRLAMNLDVLGFDLTEDEIKTISGLNQGLRFNNPPRVSFDLLESSSHQRAIWLTC

SEQ ID NO: 51732 - protein, 645 aa, Rhodospirillum rubrum ATCC 11170
MLHIKSLTYRIGGRTLLDEATAHIPEGQRIGLIGRNGTGKTTLFRLILGELSGDGGSIAVRPRARVGQVAQEAPDGDTTLLDCVLAADAERASLLAALEGDTDPHHLGEIHDRLNAIGAHSAPARAGAILSGLGFSAEAQARAVGEFSGGWRMRVALAAALFSRPDLLLLDEPTNHLDLEATLWLEGFLANYPGTLLIISHDRDLLNRAVGRIIHLDNGKLVAYAGNFDRFERTRRERMEHQSKAFVRQTEERKRIQAFVDRFRAKATKARQAQSRLKMLERMQPVEAVVEDSTIPFDFPDPDQLPPPIVAFDDVAAGYDGVAVLRGVTLRLDMEDRVALLGANGNGKSTLAKVLAGRLAPLSGEIRMPSKLRIGYFAQHQTDELRMGESPLLHGRRLMGELSDQKIRGHLGRFGFGEDRVHTPVANLSGGEKARLLIALTCREAPHLLILDEPTNHLDIDSRESLMQALNVFQGAVLLISHDPRLVEMVADRLWLVDGGKVTSFEGDMDDYRKLLLERARDARREASSDSANAGEAAAEGAATSASARQDRRRAAAEARVRLAPLRRVAEKAEAQVDKLTTEKAKIQAALADPALYRGPKEKVALLQQDLGRVDRALAGAEDAWLSAQEALDSATAAEPALAEG

SEQ ID NO: 51733 - protein, 303 aa, Vitis vinifera
MLRGEYRIGTIPLDQVAGRSISRKNPPLFAATLKHFPNLRLQRRTQLQRRPHLLRIPESFMAESGSRASSESDCNGDPKLGPVDPGYAEIIVVRHGETAWNADGRIQGHLDVELNEAGRQQAAAVADRLSKGPRISAVYSSDLKRAFETAQAIATSCGRFEVIKDPDLRERNLGDLQGLVYHEIAKINPEAHKAFLSHRTDQEIPGGGESRDQVYQRCTLSLKRIGSKHKGERVVVVTHGGVIRALHKRASPNGRAGKIMNTSVNIFHLCDGDKWVIKAWGDISHLDETKFLESGFGGDRTSG

SEQ ID NO: 51734 - protein, 553 aa, Listeria innocua Clip11262
MFKHILLSLNGYKASYLRNDVISGVGVAALTIPVAMGYAQVAGLPPIYGLYASFLPVIAYVIFASSPQLIFGIDATASAITGSIILGTAGLAAGSKEAIALAPILAFFCAVFLVLFSILKLGRFAKYISAPVLSGFISGLSVSIIMGQIPKIMGLKESGDSFFSSLGIIFGQFFQSNWISFAMGIVTIIIVITCKKVIPKIPMSLVVLVLGTMAAYFFKLDQYNVDIVGKIPVGFPSLALPDFGASSWALAIGGGLVCAIATFAGSLLPSESFAMRNKYTIDDNRELFAYGISNFVAAFSGCSPASASVSRTAANEQFRGKTQMVSIVAATIIALIVAFLSGLLYYMPQPVLSGIVFAALVGIIDVDVLKGLFRVSRREATVWIVAALGTLLVGVIFGVLLGIFLSFINVVSRSMKSPIAILGVIDGRHGYFDLKRKPEAKPIPNVVIYRYSASLFFGNFNKFADGLKEAVQDDTKLVIFEASAIINIDTTATESMKDLLKWLDDKGIEYYFADLIDHLKTSFRKHDLGYIIDNGYTKKTVEDALDAYYAEHK

SEQ ID NO: 51735 - protein, 112 aa, Brassica napus
MASNLLKALIRSQILPSSRRNFSVAAASTQLDIPTNDLVGNHTAKWMQDRSKKSPMELINEVPPIKVVGRTAACEGDTNPALGHPIEFICLDLHEPAVCKYCGLRYVQDHHH

SEQ ID NO: 51736 - protein, 317 aa, Medicago sativa
MENFPVVDMGKLNTEERKATMEMIKDACENWGFFECVNHGISIELMDKVEKLTKEHYKKCMEQRFKEMVASKGLECVQSEINDLDWESTFFLRHLPSSNISEIPDLDEDYRKTMKEFAEKLEKLAEELLDLLCENLGLEKGYLKKVFYGSKGPNFGTKVSNYPPCPKPDLIKGLRAHTDAGGIILLFQDDKVSGLQLLKDDQWIDVPPMPHSIVINLGDQLEVITNGKYKSVMHRVIAQTDGARMSIASFYNPGNDAVISPASTLLKEDETSEIYPKFIFDDYMKLYMGLKFQAKEPRFEAMMKAMSSVEVGPVVTI

SEQ ID NO: 51737 - protein, 387 aa, Vitis vinifera
MVYSGAVDRIIGRPPPRTGDVVVVADGTEKPIGWGLYNSVSMFCVRLMQQEEEATRDPSCALNMEKLLETRIDAAIELRRNLGLPSANTNAYRLVNSEGDRLSGLIVDVFGDLAVIASSAAWVEKYKPQVEACISRIDEINHINWRQSVEMLKEEGLDLTDLKGIHLPTSHQRVKVIENGISYAISPEGQKTGFYADQRENRHFISTISEGQRVLDMCCYSGGFALNAVCGGAVNVTGVDTSMPALELANENIILNNLDPGKISFLRRDATEFMKDAVARNESWDIVILDPPKLAPRRKVLQSASGMYRNLNSLAMQLTRRGGLLMTCSCSGAMTQSGTFMRILQATASMAGRKITLLRQAGAACDHPIDPSYPEGAYLSNILFRVL

SEQ ID NO: 51738 - protein, 463 aa, Medicago sativa
MASSSLLSSVPSHSASLSILDTNIKGKLKLGTNGLRFNNEGINNFSNLRSSGRICMAVATNVSRFEGIPMAPPDPILGVSEAFKADTSDVKLNLGVGAYRTEELQPYVLNVVKKAENLMLERGENKEYLFIEGLAAFNKATAELLLGADNPAIKQGRVATVQGLSGTGSLRLGAALIERYFPGAKVLISNPTWGNHRNIFNDARVPWSEYRYYDPKTVGLDFEGMIEDIKSAPEGTFVLLHGCAHNPTGIDPTPEQWEKIADVIQQKNHFPFFDVAYQGFASGSLDEDAASVRLFVSRGMEVLVAQSYSKNLGLYAERVGVISSSPESATRVKSQLKRLARPMYSNPPVHGARIVANIVGTPALFDEWKAEMEMMAGRIKTVRQALYDSISSKDKSGKDWSFILKQIGMFSFTGLNKSQSDNMMTNKWHIYMTKDGRISLAGLSLAKCEYLADAIIDSYHNVS

SEQ ID NO: 51739 - protein, 322 aa, Shewanella sp. MR-7
MSKIFEDNSYTIGNTPLVRLNRVSQGKVLAKVEARNPSFSVKCRIGANMIWDAEKKGLLTKDHELIEPTSGNTGIALAYVAAARGYKLTLTMPNTMSLERRKLLKALGANLVLTEGAKGMKGAIDKAEEIRQSAPEKYIMLQQFNNPANPEIHEKTTGPEIWNDTDGAVDVFVAGVGTGGTITGVSRYLKKVAGKAITSVAVEPADSPVITQTLTGLPVQPGPHKIQGIGAGFIPGNLDLELIDRVETVTNDEAIDMARRLMQEEGILVGISSGAAVVAANRIAALPEFADKNIVVILPSAAERYLSSVLFQGQFGDEENIQ

SEQ ID NO: 51740 - protein, 349 aa, Vitis vinifera
MSSNVPSSSSGAAGSADSSAPRRNSKRPKYSRFTQQELPACKPILTPRWVISAFMLVGIIFIPIGVAALFASRDVVEIVDRYETDCIPEEFRNDKVNYIQKPGNKPCNRTLTVPKKMKQPIYVYYQLDNFYQNHRRYVKSRNDEQLRSGNSANETSDCKPEDYANGAVIVPCGLIAWSLFNDTYNFSRNNEQLSLNKKGISWKSDREHKFGKDVYPKNFQNGTLIGGATLNESIPLSEQEDLIVWMRTAALPTFRKLYGKIEVDLQINDTIQVSLENNYNTYSFNGKKKLVLSTTSWLGGKNDFLGIAYLTVGGICIFLAMAFTVVYLVKPRRLGDPSYLSWNRNPGGH

SEQ ID NO: 51741 - protein, 530 aa, Vitis vinifera
MTYGSQLLFIVSEGFSRFGFHNLLLICHFYRQNFLIQISMDPQSAIAQVKRAGLFRTQGLIGGKWMDAYDGKTFEVYNPATGEVLANVACMGKKEANDAIASAHAAFTSWSKLTTAERSKLMRKWYDLLIAHQTELGQLITLEQGKPVAEGYNEVLIGASCLEFFLEEVKHCYGDIIPQTQADRRMFVLKQPVGVVGAITPWNLPLAMALRKVSPAMACGCTVVIKPSELTPLSALAVAELALQAGIPPGVFNMVMGFAPEIGDAFLASPKVRAITFTGSTAVGKMLLAGAAQTVKKTSMELGGNAPSMIFDDADLEVTVKGLMIVKFFNCGQTCISPNRILVQEGIHDKFAAALTKAVQTLRVGHGFDEGVTQGPLINQAALHKIEALVEDAVSQGAKVLVGGKRHSLGLTFYEPTVLVDVTSDMLISSTEIFGPVLALQRFKTEEEAIHLANDSNAGLAGYIYTENLRRCWRVAEAIEFGIVGVNDGLIPAASAPFGGFKQSGLGREGSKYGLDDFLEIKYLCLGNMV

SEQ ID NO: 51742 - protein, 365 aa, Rhodococcus sp. RHA1
MSGATANISDTRIGVLLGDGIGHEIVPATQRVVSAAVVAAGGGAVDWVELPLGLGAIESHGTPIPDSTLSALDALDAWILGPHDSAAYPEPFRGRLTPGGVVRKRFDLFANIRPARSLEGVASTVPDMDLVIVRENTEGLYADRNMFAGSGEFMPTPDVALAVGVVTRKACERIAHTAFALARTRGRHVTIVHKANVLSMTTGLFRDVCREVGQRDYPDVRIDDEHVDAMTAHLVRRGRDFDVVVTENMFGDILSDLTGELSGSLGTAPSINSSETKVMAQAAHGAAPDIAGHNRANPTALMLSAAMMLEWLGDRRADRNLGGAAHRIRDAVRATIASGVATADLGGLASTSEFTETVLARTLRR

SEQ ID NO: 51743 - protein, 493 aa, Vitis vinifera
MEAQSVITRFQNSGVFRTQGLIGGKWTEAYDGKTIQVHNPATGEVIADVPCMGQPETNDAISSAYEMFNSWSKVTAIERSQCLWKWHDLLIAHKEELGQLITLEQGKPLNEAIIEVIIAAGYLEFFAEEAKHVYSDIIPSTVADCQLFVIKQPVGVVGAITPWNFPLAMLTSKVGPALACGCTVVLEPSELTPLIAFAAAGLALEAGIPSGALNVVTGNAPDIEHALLASPKVRKITFTGLSAVEKKIMPGAGETLRKVSLEPGGNAPCIVFDDTDLGVAVKSILAVKFHNSGQTCISANRILVQEGIYEKFATAFSKAVTSLQVGDGFCEGVTQGPLINEAAVQTVESLVQDAISKGAKLLLGGKRHNLGMTFYEPTVIGDVNNKMLISRNKICGPIAALLRFKTEEEAICIANDTDEGLAAYIFTKNLQRSWRVSEVLEYGLVGVSEGLIPTVMAPVSGFKNTGLGQEGSKKGMLEYLELKYICLGNMNNI

SEQ ID NO: 51744 - protein, 434 aa, Triticum aestivum
HASALRGKRRRETVCYAAKDASCPDGLARVNRVVRGNLRLRLGDLVTVVPCPGVKDAARVAISPFEDSVDGISGNLFDAYVKPYFIGAWRPVRKGDRFVVHGHMHAVEFPRVRARPGGRVGVAAGTQVFCDDASPVKREDEERLDGPGYDDVGGVRKQLAQIRELVELPLRHPKLFKTLGVKPPKGILLYGPPGTGKTLLARAIAAESGANFVVVNGPEIMSMMAGQSEDNLREVFARARAQAPSIIFMDEIDAIAPNREKTHGEVERRVVSQLLTLMDGLRPRAQVMVIGATNRPNSLDPALRRFGRFDKEIDIGVPDEVGRLEILRIHSKDMPLSDDVDLERIGKDTHGFVGADLAALCSEAAFQCIRQKMDVIDLEADTIDVEVLNSMSVIMDDLVHAKEVTKPSALRETGLVEVPKVSWEDVGGLEDVSG

SEQ ID NO: 51745 - protein, 302 aa, Triticum aestivum
MATAGCAGRWAPLALALLLAAVVALALIPQAALAASGGVMGGRSYSSSEPDDSSSSNSYSFYDSSSHISIGAPSRRRAAKDDDDDDNSDVIFWMVFVGLVLLIAAVWYYYEYERQRTTVVKLQVALLGWAKPFQKELNEIAERVQASNKHSYKFMLTETICSLSRHRDCCVFSSLSVNVKNGADTWEAHFDKLSIKERSKFDEETLYNLEGIKRTKEYSKKLDGSRNEYIVVTILVAAKGALKFPKIRRPADLEAVVEKLNSIPNREIRGVHVLWTPQDENDILSEEKLRADYPNLKPHNDY

SEQ ID NO: 51746 - protein, 493 aa, Vitis vinifera
MDTQNLVARLNSSGLLRSQCLIGGKWTEAYDGKTIPVHNPATGDVLVNVPCMGGQETNDAISVAYEAFLSWSKLTAAERSKRLRKWYDLLIANKEELGQIITLEQGKPLKEAIGEVNYGAAFIEFSAEEAKRIYGDIIPSPLADRRLLVLKQPVGVVGAITPWNFPLAMITRKVGPALACGCTVVIKPSELTPLTALAAAELALQAGIPPGAVNVVFGNAPEIGDALLASRQVRKITFTGSTAVGKKLMAGAAQTVKKVSLELGGNAPCIIFDDADLEVAVKGALGTKFRNSGQTCVCANRILVQEGIYEKFAIAFSQAVQSMQVGEGFTEGVVQGPLINEAAVQKVESFVKDAVSKGAKVLLGGKRHSLGMTFYEPTVIGDIKNDMLIARNEVFGPVAPLLRFKTEEEAIRIANDTNAGLAAYVFTENVQRMWRVTEALEYGLVGVNEGLVSTEVAPFGGVKESGLGREGSKYGMDEFLEMKYVCFGNISSN

SEQ ID NO: 51747 - protein, 249 aa, Aspergillus nidulans FGSC A4
MPRKFFVGGNFKMNGNAESTTSIIKNLNSANLDKSVEVVVSPPALYLLQAREVANKEIGVAAQNVFDKPNGAFTGEISVQQLREANIDWTILGHSERRVILKETDEFIARKTKAAIEGGLQVIFCIGETLEEREANKTIDVVTRQLNAAAKELSKEQWAKVVIAYEPVWAIGTGKVATTEQAQEVHSAIRKWLKDAISAEAAENTRIIYGGSVSEKNCKDLAKEADIDGFLVGGASLKPAFVDIVNARL

SEQ ID NO: 51748 - protein, 96 aa, Brassica napus
  misc_feature (57)..(57): Xaa can be any naturally occurring amino acid
  misc_feature (61)..(62): Xaa can be any naturally occurring amino acid
  misc_feature (65)..(66): Xaa can be any naturally occurring amino acid
  misc_feature (68)..(68): Xaa can be any naturally occurring amino acid
  misc_feature (70)..(70): Xaa can be any naturally occurring amino acid
  misc_feature (74)..(74): Xaa can be any naturally occurring amino acid
MVKICCIGAGYVGGPTMAVIALKCPSVEVAVVDISVPRITAWNSDQLPIYEPGLDDXVKQXXGKXXFXPXNLQXLSQSALLTLTLYYRLPPPLPRS

SEQ ID NO: 51749 - protein, 444 aa, Coprinopsis cinerea okayama7#130
MSKEKFLGAASSDGFGFCSVVFGWDMHDTVYSRELLISTKANGYRDIIASIDISTFRRIPWENNVPFFLLSFNDPDTKKPLPVDPRGTLQKTMDQAENMGFVPYAGVEYEYFNFKETPESAFDKKFHGLQPLTPGMHGYSLLRTQLNNKYFHELFDQSLAFDVDIEGHHTETGPGVLETALAYTSALRMADNAVLFKYLAKSVGMMNGIIPSFMAKPWANLPGCSGHIHVSMRDAEGKRNLFAVSDEELKTGRTGAANEDTRFISQEAEWFLAGILDGLADIMPTLVPNINGYKRLVVGDAYWAPNAVTYGYDSRAASVRIISPPSCPPAATRFEIRVPGADMNAYFALSAIFRLGLRGIEKKLPLTILPISKHEPEDRVNGKIQMLPLSLEAATARMMRPESIAREIFGDEFVNHYGGTREHEVRLWNEAVTNWEVERYLELA

SEQ ID NO: 51750 - protein, 214 aa, Paeonia anomala
IVESVGEGVTDLKPGDHVLPVFTGECKECRHCKSEESNMCDLLRINTDRGVMLNDGKSRFSINGQPIFHFVGTSTFSEYTVVHVGCVAKINPEAPLDKVCVLSCGISTGLGATLNVAKPEKGSSIAIFGLGAVGLAAAEGARIAGASRIIGVDLNPKRFEEAKKFGVTEFVNPKDYNKPVQEVIAEMTDGGVDRSVECTGSIMAMISAFECVHD

SEQ ID NO: 51751 - protein, 560 aa, Rhizopus oryzae
MPSIQIGQHLLNRLKEINIDVVFGVPGDFNMPLLDIIEDDPKLTWGNNANELNASYAADGYARIRGAGAVVTTFGVGELSAVNGVAGSYAEMLPVIHIVGTPSTKSQAAGAMLHHSLGDGNFDVFFNMSSMIACASTHLRKQTAIAEIDRVISQAVLSKRTGYIGIPIDLIKTEVEIPEELGPFQTTLPKNNPEVQAIALKVVAEAIQSAKHPVIIVDGCVLRHRCQKPVQEFITRSGFPTYVAPMGKGAVDESIENFRGCYSGNVTLEAVNEEIKLADLIIEIGSIKSDFNTGNFSYSLDRSKTITLHSFATVVFCAEYQKVSMMEFIPLLTEALPQQPRTFNLGPRAKPVPIQPGTEITHNYFWHKVPEYMEENAIVCAETGTAEFASLNMDGPKGTTYITQILWGSIGFTVGASVGAAIAARDRRVYLFVGDGSFQLTCQEIAVFLRHGLTPVIFLLNNDGYLIEKLIHGPERAYNNYQMWNYSKSLDYFGAHLEHNKSMGVPPVGFEGKVATRDEFESAMKQVQANPDKIHFLEVIMPQFDAPRELELLVANSENR

SEQ ID NO: 51752 - protein, 214 aa, Paeonia anomala
IVESVGEGVTDLKPGDHVLPVFTGECKECRHCKSEESNMCDLLRINTDRGVMLNDGKSRFSINGQPIFHFVGTSTFSEYTGVHVGCVAKINPEAPLDKVCVLSCGISTGLGATLNVAKPKKGSSIAIFGLGAVGLAAAEGARIAGASRIIGVDLNPKRFEEAKKFGVTEFVNPKDYTKPVQEVIAEMTDGGVDRSVECTGSIMAMISAFECVHD

SEQ ID NO: 51753 - protein, 371 aa, Ehrlichia ruminantium str. Welgevonden
MENLLNSFNSNKHIIKKSIAELRTGIPVLLYNHKSNLLVFPSEMIDNQILHKIQKYSDNAYILITGNRLNFILQSPGNQLSRITLKESYSIDYISYLLIGKKPHSSFDHIDTNHITTSTNPLDITSISLIKLTKLLPSAIVTEIKHPDILQWCNKYNITPIKQEIIDNHNQEYELHEVCSSPLFLKNCCNANVNSSINIYRSDIGEPEHYALIIGEPDYSNPLVRIHSSCYTGDLLDSLSCDCRSQLHLSIKLMVENKGGIILYLAQDGRGIGLTNKIRTYQLQIKYNFDTVDANRFFGFEDDERAFIAAIKILEKLGISKLQLLTNNPNKAEEIKKYGINITKILPIFVDINQHNINYINTKAKRLGHVS

SEQ ID NO: 51754 - protein, 581 aa, Pseudomonas syringae pv. phaseolicola 1448A
MLSTSPSNPLASPVERELSLRAVITGVVLGILLTPSNVYAGLKIGWSFNMSIIALLIGYAIWQGLSKRSSAHLPWTLHESNINQTVASAAASIISGGLVAPIPAYTLLTGQQLDAVPMIAWVFSVSFLGIWIAWYLRPSLLNDKSLKFPEGMATLETLLHIYNHGREAAIRLKVLLSTALLSALAKWVDTFIWAFPRWSPSAHLERLTFTADPSLLLVGFGAIIGIRVGITLLLGALLAWGGVGPWLLEQGLVILPADSSGPQFAALVEWLLWPGVSLMVCSTLASLVIRLWALHKSTRASGGTTWSMPKAGPAAGFVLAIILVVSLQALLFGINLWMALLTIPLAICLAAVAARVVGATGIPPIGAIGQLSQLSFGIVAPGQVPINLMSANTAGGSAGQCTDLMNDFKVGRAIGATPRKQLIAQTLGIFVGSIVGVLAYMALIPDPQSMLLTEEWPAPAVATWKAVAQTLTHGLDSLSASIRWAIFIGGLAGLLLGILDSTLPAHRTRYMPSAAALGLAFVLPASVSLMMALGAVLTWLVNCCWPSLTERFAITAAAGLIAGESITGVGASLWQMVGNVG

SEQ ID NO: 51755 - protein, 117 aa, Citrus limon
HNVGALVVVKPGEQKSAAGIITERDYLRKIIVQGRSSKSTKVGDIMTEENQLITASPDTKVLRAMQLMIDKRIRHIPVIDDKGMIGMVSIGDVVRAVVSEHREELNRLNALYKEVTR

SEQ ID NO: 51756 - protein, 214 aa, Paeonia anomala
IVESVGEGVTDLKPGDHVLPVFTGECKKCRHCKSEESNMCDLLRINTDRGVMLNDGKSRFSINGQPIFHFVGTSTFSEYTVVHVGCVAKINPEAPLDKVCVLSCGISTGLGATLNVAKPKKGSSIAIFGLGAVGLAAVEGARIAGASRIIGVDLNPKRFEEAKKFGVTEFVNPKDYNKHVQEVIAEMTDGGVDRSVECTGSIMAIIPAFECVHD

SEQ ID NO: 51757 - protein, 214 aa, Paeonia anomala
IVESVGEGVTDLKPGDHVLPVFTGECKECRHCKSEESNMCDLLRINTDRGVMLNDGKSRFSINGQPIFHFVGTSTFSEYTVVHVGCVAKINPEAPLDKVCVLSCGISTGLGATLNVAKPKKGSSIAIFGLGAVGLAAVEGASIAGASRIIGVDLNPKRFEEAKKFGVTEFVNPKDYNKHVQEVIAEMTDGGVDRSVECTGSIMAIISAFECVHD

SEQ ID NO: 51758 - protein, 372 aa, unidentified eubacterium SCB49
MKEDFYDILGISKGATAAEIKKAYRKKAIEFHPDKNPGDSSAEEKFKKAAEAYEVLSDPNKKARYDQYGHQAFEGGGGFGGGGRGGMNMDDIFSQFGDIFGGGGGGFGGFGGGGGRRTVKGSNLRVRIKLTLEEIANGVEKKIKVKRKKVAAGTTYSTCSTCNGSGQVTRIQNTILGRMQTSAPCTTCGGSGQMIDKKPSNADANGMLSTEETVSIKIPAGVVDGMQLKVTGKGNDAPGNGIAGDLLVAIEELPHESLSREGDNLHYDLYVSYSDAALGSSKEIDTVTGKVRIKIEPGVQSGKILRLRSKGIPSINGYGTGDLLVHVNVWTPKTLTKEQKEFFEKMSADEHFQPKPESEDKSFFEKVKDMFS

SEQ ID NO: 51759 - protein, 395 aa, Ehrlichia ruminantium str. Welgevonden
MLESHDFTFANMKKIQDFSCRGKTILLRVDLNVPVDDNKVVLDDTRIVRLTTTVKYLLSNNAKIVMISHYGSPKSYDREFSLKFLVEYLNKIFATNVLFVDGVIGSYVEQAVQSVPLGSVLLLENLRFYVEEEKNDLNFAKQLALLADVYVNDAFSCMHRKHASIDAVARLLPSFIGFNFQEELKYLSYVVSNSDKPVGVIVGGAKISTKIHMLRNLTQKVNFLILGGAIANNFLLSQGLKIGNSLCEKLDEDPFVDVINFAKKYGCEIIVPEDYLVTKDLVSNEAVVKNNQELAPDDIILDIGPHTINIITSIIGKCRTVLWNGPMGMFEKEPFSHGTFSIARLLAEFTKAGKLKSIVGGGDSICAIKLSGLLSEDFTYISTGGGALLHFLSLA

SEQ ID NO: 51760 - protein, 127 aa, Prochlorococcus marinus str. MIT 9313
MLNATARRGMSKAPQRVERPWGWYEDLLEGEGYKVKRFLVFAGQQLSLQRHQHRSENWTVVSGQGQLFCKNTWHDAQAGTTLYIPLGVLHRARGGQSDLVVIEVQHGQLLQESDIERLEDDYGRVIS

SEQ ID NO: 51761 - protein, 316 aa, Bacillus cereus ATCC 10987
MPKKVLLFTDLGIDDVFAILYTFFRKDIQLVGIVADYGNVSRENAIKNINYLKYISGRKEIPVFLGASVPLTGILVQYFPEVHGKVGLGPIIPPEIPYPIYPINDIYKIINSNLDDLTIINLGRLSSLATSFILNLEAMRNVKEYICMGGAFFYPGNVTAVAEANFYADPYAANLILQHAKNLTIIPLNVTQHAIVTPEMVQQIDAFHRNTQDLAGLIIKPMLDYYYNFYSKSNPGIGGSPMHDFVTIWYLLNPDAVRLSKVPIKVIPDQGEGFGQSIADFRFVTNPGYKTHNIAFQFNYERFKRDIMETFLRKRL

SEQ ID NO: 51762 - protein, 144 aa, Plantago major
VGLESQTIKHMVEDECADSIIPLPNVTGKILSKVIEYCKRHVDAAAYSAAAKSDDKLASTATTDDDLKSFDTDFVKVDQSTLFDLILAANYLNIKPLLDLTCQTVADMIKGKTPEEIRKTFNIKNDFTPEEEEEVRRENQWAFE

SEQ ID NO: 51763 - protein, 371 aa, Kluyveromyces lactis NRRL Y-1140
MSFYRTSNSSSSSTPSTMATEKDLANDIVLNNAAEDSISDIAFSPQSDFMFSVSSWDSKVRIWDVQSGSPQGRAQYDHQAPVLTTRWSIDGTKVASGGCDNVLKVFDVTTGQAQQIGQHNSAVQSLRFVSCGPTNQECIATGSWDKTVKYWDLRSPQPIMTLQMPERVYCMDASQKLMVVGMAERHIAVIDLNNPGQIFKTSLSPLKWQTRSISCYNEGNGFAIGSIEGRCAVQYIDEQEQRKDGFSFKCHRQQVQNNGAAGGRTSTEVQVYPVNSIVFHPIHGTFATAGGDGSFHFWDKNHRHRLKGFPKLNYSIPVCQFNRTGSVFAYALSYDWHQGHIGNRPDYPNVIRLHATTDEEVKAKKKTTGTR

SEQ ID NO: 51764 - protein, 186 aa, Plantago major
QIISLYLSIHHHLKRNDVVFRRKQEDHPPQLRWQRYSKWTNQVAVESQTIKHMIEDDCADNVIPLPNVTGKILSKVIEYCKRHVDAAAANTAAKAEDKLASTAPTDDDLKAFDTDFVKVDQATLFDLILAANYLNIKSLLDLTCQTVADMIKGKTPEEIRKTFNIKNDFTPEEEEEVRRENQWAFE

SEQ ID NO: 51765 - protein, 91 aa, Plantago major
DDKLASTATTDDDLKSFDSDFVKVDQSTLFDLILAANYLNIKPLLDLTCQTVAEMIKGKTPEEIRKTFNIKNDFTAEEEEEVRRENQWAFE

SEQ ID NO: 51766 - protein, 619 aa, unidentified eubacterium SCB49
MKNIFTNLRGNLFGGITAGIVALPLALAFGVQSGLGPSAGLYGAIMIGFFASLFGGTNTQISGPTAPMTAVSMVVIAGIIAANNGSIEQALPYILLVFMLAGVFQIILGLIGLGKYIKYIPYPVVSGFMTAIGVIILLTQILPVLGYYSKDDQALIEDFKPQAQEVLLDKILKEEAGEKILVLENFEETVKRAKVITDDEILQEARILATAAGSGVVGSVKSIPRAIASISWLEVSLAFATIFIIFGFKRITTKVPSTLVALIVVSIGANIAQHYLGWEFARIIPIEKGLPTLNLSIFTSFDVSIISPYIFTALTLAFLGAIDSLLTSVVADNMTKTKHNPNRELIGQGIGNSIASLFGGLPGAGATIRTVVNINSGGTTKLSGMIAAIILLIITLLMADIASQIPAAVLAGILITVGIGVMDYKGLKAIPNIPRSETIIMIVVLVLSVFWDLVYAVGIGLIMAALIFMKKIGDSTSSTSNVIKLEESEELSLSWSDELALPKKLKEEVFIKRLSGPLFFGNTNDFQELSKQIPVTATHLIIRMGKVNYIDQSGLYAMEELILRLKQEGVDVLLVDLLEQPRVLMEKIDIIPDLIPEERIFKKFKNATIWIKNNVKDVA

SEQ ID NO: 51767 - protein, 1541 aa, Vitis vinifera
MANATPLLSQSELSQPLSPSSSIESETPSVEKVLPSLDEFIEQSIGGFAWAQLLHAILVSLAWLFDGQQTFISIFTDAEPTWHCNHLSTEDCNSGLPATSFFMGCLLGGFLLAPVADSSFGRKNMLFLSCLTMSVAALLTVFSTNIWMYSALRFISGFGRASIGASALVLSTETVGNAWRGQVGTIGFLCCTLGFLSLPAMAYMNRSSSWRLLYVWTSIPAIFYCLLIRFLVCESPRWLFMQGRKEEALATLEKLAPMENNTSLKSLDLCLSGALLKQEKMKMNLHLSIKMLLEKRWASRRLLAVMVIAFGIGIMYYGMPLGVGNLAYNLYLSVTLNVLAEMPSSLITMFYIGKWSRRSSVLALTTISGVSSIMCVVVGHGMKELQVGLELISFFCACTVFSVLMIYTLELFPTCVRSLAVAMVRQALMSSGTVSTILIAAGKTNAFLSYGVFGLLILCCGLFVVCLPETKGLSLSLPLRLKFIHMADPTPLLSQSHLADPEPMLIPKHLPSLDETFERYIGDFGWAQLLQAFLVSFAWVFDAQQTFISLFTDAEPPWHCTELGTELCTSVSNICQLPKGSWAWDRAADTSIVSEWTLVCAGSIIKSLPASSFFMGCMVGGLVLATLADSSLGRKNMLFFSCLLMSATGILTIFSPNVWIYSGFRFLSGFGRATIGTCAIVLSTELVGKRWRSQVGVCGFFLFTLGFLSLPAIAYLSRGSSWRYLYLWTSVPALSYCVLVHFFVRESPRWLLVRGRKEEAVATLKSIGAVNNSSFTLSFSGLPFEDEETTNLHLCSVISILLEKRWALRRLSAVMTVGFGVGMVYYGMPLALGNLPFNLYWNVTFNALSELPASLIAFFFIERLNRKSSVLVFTMTSGVCSIMCVVMGEEWASLKIGLELVSFFSTCTAFDILLIYTIELFPTCVRNSAMAMVRQALVFGGVFCPVIVEIGMGNGYLSYGVFGVVIISCGLFVGCLPETKGGTLCDTMEEEENKERAASIFTTLLTNTSTSSHTWQIQPLSSLNPTRPTQNLLLIPKHLPSLDETFERYIGDFGWAQLLQAFLVSFAWVFDAQQTFISVFTDAEPPWHCTELGTELCTSVSNICQLPKGSWAWDRAADTSIVSEWTLVCAGSIIKSLPASSFFTGCMVGGLVLATLADSSFGRKNMLFFSCLLMSATGILTIFSPNVWIYSGFRFLSGFGRATIGTCAIVLSTELVGKRWRSQVGVCGFFLFTLGFLSLPAIAYLSRSSSWRYLYLWTSVPASLYCVLVHFFVRESPRWLLVRGRKEEAVATLKSIGAVNNSSFTLSFSGLPFEEEETTNLHLYSVISILLEKRWALRRLSAVMTVGFGVGMVYYGMPLALGNLPFNLYWNVTFNALSELPASLIAFFFIERLNRKSSVLVFTMTSGVCSIMCVVMGEEWASLKIGLELVSFFSTCTAFDILLIYTIELFPTCVRNSAMAMVRQALVFGGVFCPVIVEIGRGNGYLSYGVFGVVIISCGLFVGCLPETKGGTLFFIFHHLLLFHYLSLMYKMKISYFLQKP

SEQ ID NO: 51768 - protein, 525 aa, Ralstonia solanacearum GMI1000
MHHTDASHLDCDLLVVGGGINGVGIARDAVGRGLSVVLCEKDDLAQHTSSASTKLIHGGLRYLEYYEFSLVRKALLEREVLLRMAPHIMWPLRFVMPHDRSQRPAWMIRAGLFLYDHLARRRFLPGSEAVRLAQHPAGGPLKPGFARGFVYSDGWVDDARLVVLNASDAADRGAQILTRTRCLNAERRADGWHASLAGPDGIRSVRAKAIVNAAGPWAAEFARAAHALPDTRGLRLIKGSHIIVRRMFDHPFAYIFQNPDGRIVFAIPYQDDFTLIGTTDLEYTGPLDQVAIDAGEINYLCEMANRYFARQLTPADVVWNYSGVRPLLDDSAASASAITRDYLVECETGADGRAAPLINVWGGKITTYRKLAEEALDKLAPHLPAAGAPSWTATAALPGGDLEAPGQLVGQYTFADFVTRLQKRLPWLPARLAKRYAHQYGTRVTTLLAGAARLDDLGAEVTPGLYEAEIRYLIEYEWARTAQDILWRRTKLGLYAAEADRGRLEAWLTRHPPTVEADPEALRAP

SEQ ID NO: 51769 - protein, 261 aa, Aspergillus nidulans FGSC A4
MASFFSRTTFRTLNTLFKATPCSKTPITAPLAQPLARRFIGTLPREQPRLRLGSTAPNFEALTTQGKIDFHQWMDGCWTILFSHPADFTPVCTTELGAFAKLKGEFAKRGVKMIGLSANDLGSHGDWIKDINEVTGSDVQFPIIADADRKVAWLYDMIDESELANLAEKGIAFTIRSVFIIDPAKKIRLVMSYPASTGRNTAEVLRVIDSLQTADKKGIATPIDWQVGDDVIVPPSVSTEDAKKKFGEVRELKPYLRYTKY

SEQ ID NO: 51770 - protein, 335 aa, Vitis vinifera
MGKKAVLIGCNYQGTKAELKGCINDVNRMYNSLVNRFGFSQDDITVLIDTDPDGVQPTGKNIRRALLNLIRSAQPGDILFVHYSGHGTRLPAETGEDDDTGYDECIVPTDMNLITDDDFRSFVDKVPEGCRITIVSDSCHSGGLIDEAKEQIGESTRLQQEQESGSGFGFKSFLHQTEDVDEGGYGDRGYVKSRSLPLSTLIEILKQKTGKDDIDVGKLRPTLFDVFGEDASPKVKKFMNVAARGGGALPDNGILISGCQTDQTSADASPSGNSAEAYGALSNAIQTIIEESDGSIRNQELVLKARETLKRQGFTQRPGLYCSDHHADAPFICDI

SEQ ID NO: 51771 - protein, 197 aa, Malus x domestica
EESESEEDILDEGDDDAEEEHDHELEVPVNPEPVVKKPAYVPAPPKEAEKQLSKKERKKKELAELEALLADFGVAPKESDSQDESQGVALEKDNAPNGDGEKKENQSAESKSAKKKKKKDKASKEVKESQDQPNNSGATNGPSEVTGAEQAEEDTSNIDVKERLKKVVSGKKKKSSKELDAAAKKKEKNHYNQQPVR

SEQ ID NO: 51772 - protein, 75 aa, Malus x domestica
ACVDVLGGLIHIGIGSSAKDACCPVLQGLVDLDAAICLCTTIKAKLLNINLIIPIVLQVLIDCGKTPPSGFQCPA

SEQ ID NO: 51773 - protein, 167 aa, Citrus limon
LTSISRRLWTISELPCTTPRSSVLSCSIPRGPGFELGFLKDGKPIQLKEGQEITVSTDYDFKGNEEMITMSYKKLPVDVKPGNTILCADGTITLTVLSCDPKSGTVRCRCENTAMLGERKNVNLPGVVVDLPTLTEKDKEDILRWGVPNNIDMIALSFVREGSDLAM

SEQ ID NO: 51774 - protein, 263 aa, Pseudomonas syringae pv. phaseolicola 1448A
MSSAIGIKTEQDLVQLRIAGRLAADVLAMITPYVKAGVSTEALDDICNEYIVKELKVIPANVGYHGFTKTTCISPNAVVCHGIPSATDILKDGDIVNIDVAVIKDGWYGDTSRMYLVGEVSPLAKRLVETTYEATRAGIHAVRPGATLGDIGYAIQSIAHREGFSVVREYCGHGIGRKYHEEPQVLHYGAQGKGLKLKPGMVFTIEPMINAGRAGTRTLPDGWTVLTSDLSLSAQWEHMVAVTSTGFELLTPWPEGTGDYPAI

SEQ ID NO: 51775 - protein, 214 aa, Paeonia veitchii
IVESVGEGVTDLKPGDHVLPVFTGECKECRHCKSEESNMCDLLRINTDRGVMLNDGKSRFSINGQPIFHFVGASTFSEYTVVHVGCVAKINPEAPLDKVCVLSCGISTGLGATLNVAKPKKGSSIAIFGLGAVGLAAAEGARIAGASRIIGVDLNPKRFEEAKKFGVTEFVNPKDYNKPVQEVIAEMTDGGVDRSVECTGSIMAIISAFECVHD

SEQ ID NO: 51776 - protein, 632 aa, Clostridium acetobutylicum ATCC 824
MNLITLENISKSYGEKTLLNKISLSISEGEKIGLIGINGTGKSTLLKILCGIQEYDSGNIITSNSLSMSYLSQNENFYDNATVLEQIFQGNSKEMNLLREYETALENSAMHPDDEKVQKTLLNLTEQMDALDLWNIESNAKTILTKLGIKNFNAKIKTLSGGQKKRICLAQTLITPSNLLVLDEPTNHLDNETIEWLEQYLTSTKSSVFMITHDRYFLDRISNKIFELYNGNLYSYVGNYSVYLEKKLEREQLEISSKQKKDNLLRRELAWIRRGAKARSTKQKARIQRFDELNSQDDTIIQDKIEISTSGSRLGKKVIEIKNLNKSFNGTEFIKNFSFIFSKGDRIGIVGHNGIGKSTLLNIICGKTSPDSGTIDLGATVKIGYFSQDSSNMNENLRVIDYIKEGAEFIRDSNNELISASKMLEKFLFSSEMQWTPILKLSGGERRRLYLLRILMEAPNVLILDEPTNDLDIQTLTILEDYLQYFEGTILTVSHDRYFLDKLANKLLIFKGNGVIDYNTGNYSDYLEKSKSEEKLEMANTPTKNKVKSEKPKSTKLKFSFKEQMEYEKIDSVIEAAENELTSIEAKINSAGSDYMLLEDLMPQKKELEEKLQTLYDRWEYLNELAERIKNS

SEQ ID NO: 51777 - protein, 214 aa, Paeonia veitchii
IVESVGEGVTDLKPGDHVLPVFTGECKECRHCKSEESNMCDLLRINTDRGVMLNDGKSRFSINGQPIFHFVGTSTFSEYTVVHVGCVAKINPEAPLDKVCVLSCGISTGLGATLNVAKPKKGSSIAIFGLGAVGLAAAEGARIAGASRIIGVDLNPKRFEEAKKFGVTEFVNPKDYYKPVQEVIAEMTDGGVDRSVECTGSIMAIISAFECVHD

SEQ ID NO: 51778 - protein, 123 aa, Picea sitchensis
MALLSTQSCVPQQLNIGVNGSNRHLRGISKPNSHAGVSARVAGGRHRINAFFNPPDDPIVQKALKEPIAFFGGVFAGLLRLDLKEDPLREWVAKTTEAAGLDEDQDPEPKSEEDTTPQQIEIE

SEQ ID NO: 51779 - protein, 214 aa, Paeonia veitchii
IVESVGEGVTDLKPGDHVLPVFTGECKECRHCKSEESNMCDLLRINTDRGVMLNDGKPRFSINGQPIFHFVGTSTFSEYTVVHVGCVAKINPEAPLDKVCVLSCGISTGLGATLNVAKPKKGSSIAIFGLGAVGLAAAEGARIAGASRIIGVDLNPKRFEEAKKFGVTEFVNPKDYNKPVQEVIAEMTDGGVVRSVECTGSIMAIISAFECVHD

SEQ ID NO: 51780 - protein, 438 aa, Desulfovibrio vulgaris subsp. vulgaris str. Hildenborough
MAFEYIGPLLEEAVNSGPSVEVRGRVEQVVGTIIRAVVPGVKVGELCLLRNPWDDWNLRAEVVGFVKHVALLTPLGNLQGISPATEVIPTGEILSIPVGEDLLGRVLDGLGDPIDGGPPLKPRTRYPVYADPPNPMTRRIIDRPISLGLRVLDGVLTCGEGQRMGIFAAAGGGKSTLLSSIIKGCSADVCVLALIGERGREVREFIEHDLGPEGRKKAVLVVSTSDRSSMERLKAAYTATAIAEYFRDQRRSVLLMMDSVTRFGRAQREIGLAAGEPPTRRGFPPSVFSTLPRLMERAGNSDRGSITALYTVLVEGDDMTEPIADETRSILDGHIVLSRKLAAANHYPAIDVQASVSRVMNAIVGKEHKGAAQKLRKILAKYAEVELLVQIGEYKKGSDKEADDALARVGAVNAFLRQGLDERSTFDETLAALYKATE

SEQ ID NO: 51781 - protein, 501 aa, Aeromonas hydrophila
MRCPYLHGLITCWQEVKINMAVIPVIMAGGSGSRLWPMSREHFPKQFLNLYGNNSMLQETVNRLAEIECTAPLILCNEKHRFIVAEQLRQLDILANNIILEPVGRNTAPAIALAAIQSLKDVDDTHDPILLVLAADHLIKDQRAFTNAVNSAIPFAESGKLVTFGIVPNAPETGYGYIHRGSELKSFLNEDKAYGVNQFVEKPNLAVAKGYLTSGEYYWNSGMFMFSARRYLAELKLSRPDIYQACVASMNDIRSDLDFIRINNDEFKQCPSDSIDYAIMEKTSDAVVIPMDAGWNDVGSWSSLWDISDKDACGNVSRGDVILTESHNNYVSAESILVSTIGVDNLVIIQTKDAILVSNKDKVQDVKSIVEELKRCGRKEYKTHREVYRPWGQYDSIDDGNGYQVKKILIRPGERLSTQMHHHRAEHWIVVSGTAKVTNAEREFLITENESTFIPIGAIHSLENPGKVDLELIEIRSGKYLEEDDIIRFSDKYGRVDGGEK

SEQ ID NO: 51782 - protein, 130 aa, Picea sitchensis
MAESKPDDDAVLIEFLSSLMDYTPTIPDELAEYYLSKSGFQCPDVRIIRMVSIATQKFIAEIASDALQLCKARQSAVNKEKRDKQQKDKSLVLTTEDLSLALREYGVNMKRQEYFADNPSAGTNPTSKDE

SEQ ID NO: 51783 - protein, 214 aa, Paeonia veitchii
IVESVGEGVTDLNPGDHVLPVFTGECKECRHCKSEESNMCDLLRINTDRGVMLNDGKSRFSINGQPIFHFVGTSTFSEYTVVHVGCVAKINPEAPLDKVCVLSCGISTGLGATLNVAKPKKGSSVAIFGLGAVGLAAAEGARIAGASRIIGVDLNPKRFEEAKKFGVTEFVNPKDYNKPVQEVIAEMTDGGVDRSVECTGSIMAMISAFECVHD

SEQ ID NO: 51784 - protein, 346 aa, Corynebacterium diphtheriae NCTC 13129
MSATEFPSAFTAAVVDKFGSELNIHDVDLPEPGQHQALVKVLTSGICHTDLHAAEGDWPVKPKPPFVPGHEGVGEVVKLGPGEHSVALGDMVGNVWLWSACGECEYCRTGWETMCEKAEYGGYTVDGSFGQYMLVDTRYCARIPDGCDLLEVAPILCAGVTVYKGLKVTETRPGQFVVISGVGGLGHIAVQYAVAMGMRVIAVDIADDKLELAKKHGAEFVVNAREEDPTEAIVKYTKGGAHGVLVTAVHPQAFGQAIGMARKNGTIVFNGLPPGEFPAPIFDIVFKGLTIRGSLVGTRQDLEEALDFYARGMIKPTVTECKLDDVNSVFADMKQGKIDGRMAIRY

SEQ ID NO: 51785 - protein, 404 aa, Zea mays
  misc_feature (135)..(135): Xaa can be any naturally occurring amino acid
  misc_feature (224)..(224): Xaa can be any naturally occurring amino acid
MADYVYGPGRTHLFVPGPVNIPDPVIRAMNRQNEDYRSPAVPALTKVLLEDVKKIFKTTTGTPFMIPTTGTGAWESALTNTLSPGDRVVSFLIGQFSLLWIDQQRRLGFDVDAVESEWGQGADLAALERRLREDXARHAIKAVGARYYETATAVTYGLAAVRALLDKHAHPALLLVDGVSSICALDFRMDEWGVDVALTGSQKALSMPTGMGIVCASPRALEAXSKTARSVRVFFDWKDYLRFYDMGTYWPYTPSIQLLYGLRTALDLIFEEGLDNVVRRHNRLGTATRLAVEAWGLSNCCQKEEWFSDTVTAAVVPPNIDSAEVVRHAWKRYNLSLGLGLNKVAGKVFRIGHLGNLNELQLLGCLSGVEMVLKDVGYPVKLGSGVAAAAAYLSNSTPLIPSRI

SEQ ID NO: 51786 - protein, 506 aa, Corynebacterium diphtheriae NCTC 13129
MTVYAYPGTPGAVANYKKRYDNYIGGQWVPPVGGEYLDNITPVTGEVFCQVARGTAADVEKALDAAHDAAKTWGHSSPAERALILHRIADRMEEHLEEIAVAETWDNGKAVRETLAADIPLAIDHFRYFAGAIRAQESRTSQIDHNTVAYHFHEPIGVVGQIIPWNFPLLMAAWKIAPALAAGNTIVLKPAEQTPASILFWIDIVGDLLPDGVLNIVNGLGEEAGVALSSSNRIGKIAFTGSTQVGKIINRAAADKIIPVTLELGGKSPSIFFADIMDYDDPFREKCIEGLAMFALNQGEVCTCPSRALVHESIADEFLELGVQRVKNIKLGNPLDTETMMGAQASMEQMDKISGYLDIGPKEGAEVLTGGHVNKIDGLENGYYIEPTVFKGTNDMTIFREEIFGPVLSVATFKDFDEAIRIANDTNYGLGAGVWTRHQNTAYRAGRAIQAGRVWVNQYHNYPAHAAFGGYKESGIGRENHLMMLDHYQQTKNLLVSYDENPTGLF

SEQ ID NO: 51787 - protein, 538 aa, Acidobacteria bacterium Ellin345
MPTPKPLVLIILDGWGYAPPSNANAISLARKPNYDKLLTDFPNTLIHTSGRYVGLPPGQMGNSEVGHLNIGAGRVVYMDITKIDLAIENKSLFKNQTLLDAMKHAANGRQLHFFGLLSDGGVHSHQNHLYALLRMAKENGVERVFVHPFMDGRDTLPTNGVKYVDQLQQKMREYGIGKIASISGRYYAMDRDKKWDREKLASDAMLHGRGEGGRYKDPVQGIKESYNKGVTDEFIIPFVCVDDNDQPIGVIRDGDACINFNFRADRARQITRVLARNSGITKDGGRELDAADTLDATIPRDTIPKDLHYTCMTQYDPKFTLPIVIPPDTLTHILANEMAAMNMRNLRVAETEKYAHVTYFFNGGIEKPYPGEERELVQSPKVATYDLKPEMSANGIADVIEHAVEKGAFDVIVVNFANADMVGHSGKIPPTITAVETVDSCLGRVYNVVRKKGGAMLITADHGNAEQMIDPETGGPQTAHTTNPVPFIFVAEDAKKRFSLRPDGALQDISPTMMGILGIPQPKEMTGHDLRVDLTVKK

SEQ ID NO: 51788 - protein, 214 aa, Paeonia veitchii
IVESVGEGVTDLNPGDHVLPVFTGECKECRHCKSEESNMCDLLRINTDRGVMLNDGKSRISINGQPIFHFVGTSTFSEYTVVHVGCVAKINPEAPLDKVCVLSCGISTGLGATLNVAKPKKGSSVAIFGLGTVGLAAAEGARIAGASRIIGVDLNPKRFEEAKKFGVTEFVNPKDYNKPVQEVIAEMTDGGVDRSVECTGSIMAMISAFECVHD

SEQ ID NO: 51789 - protein, 410 aa, Bacillus cereus G9241
MKIIVQKFGGTSVRDENGRKHALHHIKKSLDAGYKVVTVVSAMGRKGEPYATDTLLSLVNQEESHISNREQDLLLSCGELISAIVFSNMLNENGIKAAALNGAQAGFITNDDFTNAKIIEMNCDRIHEELEDVDVIVVTGFQGQTKKGDTTTLGRGGSDTSASALGVALHAEYIDIFTDVEGVMTADPRIVKDARHLQTVTYNEICNMAYQGAKVVHPRAVEIAMHAKVPLRVRSTYSDSEGTLIAAYDGATKGQDVEERPVTGIAHVSNVTQIKVLAKETAYDIQQHVFKEMANEGISVDLINISPTGVAYTVNDNVSARAVEVLKQLGYEPIVTEHCAKVSIVGAGMAGIPGVTAKIVTALAEKGIQILQSADSHTTIWVLVKETDLVEAVNALHSAFELSKEKQLEQ

SEQ ID NO: 51790 - protein, 498 aa, Triticum aestivum
MAMATAMAATYGAPITAPAPAAFSPRRAAGGRRVRAVTARPRPLFSPRAVSDSRNSQTCLDPDASTSVLGIILGGGAGTRLYPLTKKRAKPAVPLGANYRLIDIPVSNCLNSNVSKIYVLTQFNSASLNRHLSRAYGNNIGGYKNDGFVEVLAAQQSPENPDWFQGTADAVRQYLWLFEEHNVMEFLILAGDHLYRMDYQKFIQAHRETDADITVAALPMDEERATASGLMKIDDEGRIVEFSEKPKGEKLKAMMVDTTILGLDSERAKELPYIASMGIYVFSKDAMLRLLRDNFPSANDFGSEVIPGATEIGMRVQAYLYDGYWEDIGTIEAFYNANLGITKKPVPDFSFYDRSAPIYTQSRYLPPSKVLNADVTDSVIGEGCVINHCTINHSVVGLRSCISEGAVIEDSLLMGADYYETENDKKVLSESGGIPIGIGKNAHIRKAIIDKNARIGENVKIINVDDIQEASRESDGYFIKSGIVTVIKDALIPSGTVI

SEQ ID NO: 51791 - protein, 118 aa, Haloferax larsenii
PLLLFDLGQAPTVTTDPEEAIDGADVVYTDVWISMGQEDQRDEKLEAFDGFQLNGELLDGSDAQVMHCLPAHRGEEITGDVLEGEQSLVWEQAENRLHAQKGLIVELLEEKVGFGFIL

SEQ ID NO: 51792 - protein, 118 aa, Haloferax larsenii
PLLLLDLGQAPTVTTDPEEAIDGADVVYTDVWISMGQEDQRDEKLEAFDGFQLNGELLDGSDAQVMHCLPAHRGEEITGDVLEGEQSLVWEQAENRLHAQKGLIVELLEEKVGFGFIL

SEQ ID NO: 51793 - protein, 125 aa, Thermococcus kodakarensis KOD1
MATFKLVISNPKNGVAKQVEISGPEADKLIGRRIGEEIPASELGLNLSEIFGEEIPADAKLKITGGTDKDGFPMRPDVHGPRRVKILLSRGPGFRPRERGERRKKTVHGNTISPNIVQVNMKIVF

SEQ ID NO: 51794 - protein, 336 aa, Oryza sativa Japonica Group
MGNCASFTPKWGLSDLHCKGMVPIDEDETHEGIKTIRIQKACEFTTSSVLCVCIITWNMNGKMSVEDVTKLVSSNRKFDLLVFGLQEVPKCDVAQVLQETMAETHILLCQKTMQSLQMFLFGAKSSEKYIRELKVDKHAVGGCGGIIGRKKGAVAMYINFSGIRMVFVSCHLAAHENKVEKRNSECQHISHSLFSKNDIQYTKSADITVWLGDLNYRLQGISSIPARKLIEENRQSKLRGKDQLLQEAEKGEVFNGYCEGTLLFKPTYKYNIGSSNYDTSYKIRVPSWTDRILFKVDHTSGLDAVLNSYEALDCIRSSDHKPVRAHLCLKVHGDSA

SEQ ID NO: 51795 - protein, 317 aa, Vitis vinifera
MTLGFGRIGRLVARVALQRDDVELVAVNDPFITTDYMTYMFKYDSVHGQWKHHELKVKDSNTLLFGEKPVTVFGIRNPEEIPWGETGAEFVVESTGVFTDKDKAAAHLKGGAKKVVISAPSKDAPMFVVGVNEKEYKPELHIVSNASCTTNCLAPLAKVINDRFGIVEGLMTTVHSITATQKTVDGPSMKDWRGGRAASFNIIPSSTGAAKAVGKVLPSLNGKLTGMAFRVPTVDVSVVDLTVRLEKAATYEQVKAAIKEESEGKMKGILGYTEDDVVSTDFIGDNRSSIFDAKAGIALNEKFLKIVAWYDNEWGYR

SEQ ID NO: 51796 - protein, 458 aa, Bradyrhizobium sp. BTAi1
MLSNSLIELDRAHLVHPVASYRGHEASGARVLTSAKGAVVTDASGHQLVDGFAGLWCVNAGYGHESIVEAAAKQMRELPYATGYFSLASEPAIRLAAALAERAPGDLNHVYFTLGGSDAVDSTVRFIHNYWHVKGQPQRDQFITLQQGYHGSSTVGAGLTALPAFHANFGVPLNWQHKIPSHYPYRNPVGRNADAIIAASLAALDAKIAELGGPERVAAFYAEPIQGSGGVLVPPDGWMKAIRARCRQHGILFVADEVITGFGRTGPLFACTDDEVVPDLMTVAKGLTSGYVPMGAVLMSDHVYGVIADGAGAAAVGHGYTYSAHPVSAAVGLAVLDLYESGLLENGRRAGARLMAGLRAMQDHPLVGEVRGRGLLAAIELVVDKEKKTPLPASAEPSRRIFDRAWANGLVIRAFPTGVLGYAPPLCCSESDIDAIIARTARTLDQTLADPDVRQAMP

SEQ ID NO: 51797 - protein, 626 aa, Ashbya gossypii ATCC 10895
MDSGMCHVLVTKFADTSTKQEMSNSRSYLTTTAHQSLSSEALSMGSLDARSPQKDVWYTRLLNDFKRADEGETTRSVADSDMEVDGKRYKEMTDVERAVCDAARNSSQLSKNLSIRHLLTLAVGGAIGTGLFVNSGASLNTGGPGSILIAWTLISTCLFTIVNSLGELASAFPVVGGFNVYITRFVEPSFGFAVNISYLAQWAVLLPLELAAASITIKYWNNKINSDAWVAIFYVCIALANMLDVKSFGETEFVLSMVKILAIFGFAILGTVLICGGGPVGGFIGAKYWHDPGAFVGDTPGAQFKGLCSVFVTAAFSYSGTELVGVSAAESINPRYTIPRASKRSFWLITSSYLLVLTIAGCLVPSNDPRLLNGMSSVDVAASPLVIAIENGGIRGVPSLMNAIILIAIISVANSSVYACSRCMVSMAQVGNLPKVFNYIDRKGRPLVAILATLVFGLLSFVAASDKQEAIFTWLSALSGLSTLFCWFAINISHIRFRRAMCAQQRSLDELPYLSLTGVLGSWYGAAVLLFVLVLSFWTSLFPPGSSGPSAESFFEGYLSFPIFLICYISHKLYKRDWRLFIPAGQIDVDSGRRALDIEELKEQKLREQAETAKKPFYVRWWIFWC

SEQ ID NO: 51798 - protein, 472 aa, Bradyrhizobium sp. ORS278
MRRHRRAKIVATVGPASNSPDMLKELFLAGVDTFRLNFSHGTQADHAKVHAAIRALEKDVQRPIGILMDLQGPKIRVGTLRDKKIQVEAGETIRFVLNGTEGDKTSIPLPHPEIFAAVAPGHDLLIDDGRVRVRVTGLGDDWIEAKVIVSGAISNHKGVNLPGTILELSPLTAKDRSDLTFGLDLGVDWVALSFVQKPSDVIEARGLIDGRAGIMSKIEKPAALDRIDDIIQLSDAIMVARGDLGVEIPNEDVPGKQKELVRACRLAVKPVIVATQMLDSMVATPTPTRAEVSDVATAIYDGADAVMLSAESASGQYPREAVAMMDSIIKSTEKHKMYASIIQATQPDEEQTPPHAVATAAADLASAIHAKAIVAYTSSGTSASRVARKRPSLPILAITPNEDTSRRMCLLWGAHSVLSQDVQSYEEMVERATFFAVQEEFADKGDLLVVVAGIPFAQAGTTNNLRVVTVPR

SEQ ID NO: 51799 - protein, 334 aa, unidentified eubacterium SCB49
MNERLKFAVIGGGSWATAIVKMLCENLDQVGWYMRNEAAIAHIKKEQHNPNYLSAVEFKTEQLLLSNDINELVSYADVLIFVVPSAFIFSELEALSVSLDEKIVFSAIKGIVPETSLIVGDHFNTHLGVPFNNIGVISGPCHAEEVALERLSYLTISCADEKKAKQVAKQLSCDYIKCTTSDDVIGTEYAAMLKNIYAIAAGIAHGLGYGDNFQAVLMSNAIREMKRYVKKVHKMKRDINDSAYLGDLLVTGYSVFSRNRMFGNMIGKGYTVKSAMMEMSMVAEGYYASKSAFHLNKEKGSKKAKTPIINAIYGILYENKDPKKIFNKLTDKLN

SEQ ID NO: 51800 - protein, 357 aa, Bradyrhizobium sp. ORS278
MRTHSIAAIPADGIGPEVISAGVRVLEALARRAGDISFNVKTFDWGSDYYKKHGVMMPADGLVELKRFDAIYFGAVGAPDVPDHITLWGLRLPICQGFDQYANVRPTKILPGVASPLRNVGVGDLDWVIVRENSEGEYAGMGGRAHRGLPEEVGTEVAVFTRVGVTRIMRYAFRLAQSRPRKLLTVVTKSNAQRHGMVMWDEIAAEVAREFPDVTWDKMLVDAMTVRMTLQPKSLDTIVATNLHADILSDLAGALAGSLGVAPTGNIDPERRYPSMFEPIHGSAFDITGKGIANPVATFWTGAQMLEHLGEKDAAARLMAAVEKVCAAGVLTPDVGGKATTKEVTDAVIDAIHGSNV

SEQ ID NO: 51801 - protein, 247 aa, Actinidia chinensis
LCFDLLESWLANNPEPAGFMRDGQSIFRELALFQDYHGLPAFKNAMVDFMSEIRGNKVSFDPKKLVLTAGATSANETLMFCLAEPGEAFLLPTPYYPGFDRDLQWRTGVEIVPIHCTSANSFQITDSALEEAYQSAQKRNLRVKGVLVTNPSNPLGTTLTRPELNLLLTFITSKNIHLISDEIYSGTVFSSPDFVSIMEVLKDSSHSTEVWNRVHIVYSLSKDLGLPGFRVGAIYSNDDVVLAAAKK

SEQ ID NO: 51802 - protein, 374 aa, Cryptococcus neoformans var. neoformans B-3501A
MSPVRVPSHGDGWASTPQTKQVYYIASIPADGIGPEVVEAAITVLKAIAKKRGTFQLDFTNFDWSSETYKKTGRYVPDNHLDILRKFDAILFGAVGAPDVPDHISLWGLRLAICQPLQQYANVRRTRVLPGTESPLRNCKPGQLDWVIVRENSEGEYAGHGGRSHNGYNHEVATEISIFTRVGVERIARFAFQLAQSRPRKKLTYVTKSNAQRNGMVMWDEVVNEVAKEFPDVELDHMLVDAMTVRMVLHPESLDTIVATNLHADILSDLAAALAGSIGIAPTANLDPSRQNPSMFEPIHGSAFDITGKGIANPVATFWTAVEMLEWLGEKEAGQQLMEAVEAVCVDGIKTKDLGGSATTKEVTDAVVKRILQG

SEQ ID NO: 51803 - protein, 124 aa, Arabidopsis thaliana
MQMLRNLSTRTRSRRGGYERVSDDSTFSLLGAKLRRSTSVPYYAPSIRLGGDFPVILEKLPRQKPTKTVVTSKLSHPIFSLFDGYRRRSKKKATAKPEFSRYHEYLKESGMWDLRSNSPVIYFK

SEQ ID NO: 51804 - protein, 337 aa, Pseudoalteromonas tunicata D2
MNKPLNKGSSPANTVDTAFRRFSIAPMLDWTDRHCRTFHRKLTQHAVLYTEMITTGAIIYGRGDYLHFGQHEQPVALQLGGSDPAALALCAKQADERGYQEINLNVGCPSDRVQNGRFGACLMAEPNLVAQCVAAMKEQTNMPVTVKTRIGIDDQDSYEFLCALIDACIAVDCNDFIIHARKAWLSGLSPKENRDIPPLDYERVYQLKKDYPQTHISINGGVKTIEQSLAHLQFIDGVMMGREAYANPYLLTQVDSAIYGDASTPVLSRHQAVRAMYDYFEAEMTGGASFWHVARHMLGIFQGVPGGRAFRRHLSENGHKKDADISVMEQALGFVAE

SEQ ID NO: 51805 - protein, 443 aa, Ipomoea nil
MLEELDVSHNNLSGTLRVLSTIQSLTFINISHNLFSGPVPPSLTKFLNSSPTSFSGNSDLCINCPADGLACPESSILRPCNMQSNTGKGGLSTLGIAMIVLGALLFIICLFLFSAFLFLHCKKSVQEIAISAQEGDGSLLNKVLEATENLNDKYVIGKGAHGTIYKATLSPDKVYAVKKLVFTGIKNGSVSMVREIETIGKVRHRNLIKLEEFWLRKEYGLILYTYMENGSLHDILHETNPPKPLDWSTRHNIAVGTAHGLAYLHFDCDPAIVHRDIKPMNILLDSDLEPHISDFGIAKLLDQSATSIPSNTVQGTIGYMAPENAFTTVKSRESDVYSYGVVLLELITRKKALDPSFNGETDIVGWVRSVWTQTGEIQKIVDPSLLDELIDSSVMEQVTEALSLALRCAEKEVDKRPTMRDVVKQLTRWSIRSYSSSVRNKSK

SEQ ID NO: 51806 - protein, 1690 aa, Opitutaceae bacterium TAV2
MNTKISTNRVLAVLPLLLLFASTAVAIAASAISLSGDLSFGNVIVDQTTTRTLTIRNTGSTSLAIYSITYPNGCFSGDWSSGTIAAGGTRNVTITFTPTAAQSYGGNITIVSNAASGTNTQEVSGSGIAFALSGDLFFSNVLVGQTATRKLTISNTGNTSFEVMNITYPVGFSGNWSSGTIDAGETRNVTVSFVPAATQRHEGNVTVVTNAVGGTKTRSVFGNGIPAAGSSIVAVSAGNHSLFLSSNGIVWGSGWNDGQLGDGTTTHRSIPVQITSDGVAISASLGHSLFLRNDGTAWASGSNYYGQLGDGTKIDSHTPVQIMTDVAAVSVGAWHSLFLKVDGTAWASGYNYLGRLGDGTTTNRSTPVQVMRDVAAISGGGSHSLFLKSDGTAWATGYNGSGQLGNGTTTNRSTPVQVMRDVVAISAGSSHSLFLKSDGTAWATGYNSSGQLGNGTTTNCSTPVQVMRDVVAISAGSSHSLFLKRDGSVWACGSNEYGQLGDGTTDNRTTPVQVMNKATGISAGNQHSLFQRSDGTAWASGSNGSGALGDGTTIPRRSAVRSDIEATRIVAFSGNLSFGNVTVGQAAVRVLEITNVSASTLNVTGIIYPSGITGDWNGQIIPRGETEIVTVMFKPTAAQSYGGDVAIRVNHSGDTDTRSVSGIGIAAENAPDVVVVSAGSSSSFFLKADGTAWASGSASGMTIPVQIMNDMVAVSDNSHSLFLKNDGTVWASGSNGFGQLGDGTRTNRSTPVQVMDGAASISAGGNHSLFLKADGTVWASGYNSDGQLGDGTKTDRDTPVQVMSDVTAVSAGYSHSLFLKRDGTVWAVGSNNFGQLGDGTKTDRSTPVQTMSGVMAISAGDSHSLFLKRDGTVWASGINESGRLGDGTTTNRSTPVQIMGNVAAISAGGSHSLFLKADGTVWTTGWTFENYAPVHIMSEVTAISAGTSHSLYLKNDGSAWASGYNYYGQLGDGTRTKRDEPVQAIAPVPTRVIALSGDLSFDSVIVGQTATQTLTISNTGTAFLTVTGISFPSGFSGDWNSGTITAGGTQAVTVSFKPTAALSYSGKVTILSDATSGTNTCVVSGIGTTFSVFPVIMTQPVSQNKWQGESATFSVSATGQGTLSYQWYFNGKAIKGATGSSYTIAKVVAKNAGNYTVTVKNANGTATSDAASLTVNVPQKPKVTSKPTSKMETGLGKSVTLSVTATGNPPPTFQWLLNGNPISGATGATCTIENVGEQNLGSYSVVVTSGPNTITSKVTTLSAILPPVIETPAAGESDFTYALATKGAKLTVKLAKNKAKPTYQWLLDGNPIPGATKASYTAKTDGQYSVRVTNGAGTVERVIANVKLIVPPKFDAKAGLIADRTEIVADVGQSVTFTAKLAEGTGPFTWTWLDGKTVLKTHMSSSLTDTFTLTNVAKAQKISVQVESVKDAKGKPLAKAKSKAVVIKIVLPPQIVSLTVKPGEEIAPGKTATLTVKATGTKKLVYEWRGPDGEVIRDARGPVNKASLTLKPASKTATVTAGTYAVRVSNGAGDSYARTASVTIKVQASAATAKTAGISGITALSSTAESTSSGSNAASVTGRLPTAADTLRLTDLITGETSLLDLGDSSRQNLRSEWLVHGTVRVSFDQLSGHAVGEDTIWEAVTLDLTFDGDDSGLYMMTSVRVRVAANGDLVEDPESGTGFGVFELE

SEQ ID NO: 51807 - protein, 357 aa, Oryza sativa Japonica Group
MAEARTIGSISVPNVQELAGTCNGIDEEIPERYIRPEVSSDEVIKNNHGDMSIPIIDLDKLISPQSSQEECVKLISACQYWGFFQLINHGVPDEVIANLKNDLVEFFSQPLDAKKEYSQLPNNLEGYGQAFVVSDNQKLDWADMLYLQVCPTDSRDLRFWPNYPASFRHSIDAYSSETENIGLCLLQFMAKAVGVEPKSLLSVFEGQARGLRMNYYPPCLKADKVLGLSPHTDPGGLTLLLQVNDVQGLQINKDGKWFSVNALNGALIVNIGDTLEILSNGKFRSVEHRAVVHPSRERISAALFYYPCQDMVISPLPDFVKDGKVKYKTISYQDLLTEYFTAELDGRNRLKKMKLEP

SEQ ID NO: 51808 - protein, 217 aa, Actinobacillus pleuropneumoniae serovar 1 str. 4074
MSETIENQACIVIAIAGASASGKSLIASTIYKELKEELNSDDIGIISEDAYYKDQTHLTMEERVKTNYDHPNSMDHHLLVEHLRQLKQGEAIEIPEYDYSEHNRKTTTKNFTPKKIIILEGILLLTDEEIRNEINVSIFVDAPLDICFIRRLQRDMLERGRTMDSVIAQYRKTVRPMFLQFIEPSKQYADIIVPKGGKNRIAINILKAQIKQLLSKR

SEQ ID NO: 51809 - protein, 160 aa, Zea mays
  misc_feature (27)..(27): Xaa can be any naturally occurring amino acid
  misc_feature (100)..(101): Xaa can be any naturally occurring amino acid
  misc_feature (110)..(110): Xaa can be any naturally occurring amino acid
  misc_feature (133)..(133): Xaa can be any naturally occurring amino acid
  misc_feature (151)..(151): Xaa can be any naturally occurring amino acid
MARKRTAHALGEGDLIVKKVFPGPHLXVPLNDAQKITDNTRIHASVPTIWFLLKKGAKVILDRHLRRTKSVTPKDSLKTLDLSLSEILAVECTMTNDCLXXRRVHKLAAXALPQGAVLLLQNVTFYDDDDEEXPEIANKITSVADLYVNDXAFGTAHAAH

SEQ ID NO: 51810 - protein, 360 aa, Oryza sativa Japonica Group
MVGGFDKLKVEFIDQDESVQVVADTIRSSGEIPERYARPEMEADPVIIDTDGYNLPVIDMSRLINPEFSEEEIAKLGSACEDWGFFQLVNHGVDGELLQRIKDDITEFFRLPLQEKMSVAIPPNGLQGFGHHFVFSKEQKLDWVDLLFLTKRPVEDRTTEFWPTKPPTFRDSLDKYSLEIANVSAKLFKFMAINLGVDEEALLAAFKPEQPQSVRINHYPPCSQANKVLGLSPHTDGVGMTLLLQVNDVQGLQIRKDGRWFAVKNLPGALVVNVGDVLEILTNGKYKSIEHRAVINPDKERITLAAFQSVPLSSTVGPLQELLMKGEARYKTVDGAEFTKGYFAAKLEGRRYLESLKLGV

SEQ ID NO: 51811 - protein, 219 aa, Clostridium acetobutylicum ATCC 824
MKTTVLLVRHGETEWNVQGRFQGCHDINLTDNGIEQAKRVAKRLEGSFDCVYASPLKRAFNTAKLIASTKGISPIIEDDLREINFGLWEGLTIKEMKSKFPKEFDIWRNDTEDGPLCGGDLSIKRASIRVEHAVLKIVNDNKGKNIVVVAHGGIIKAALIALFNWNMAMYHRILLGNTSICKIEFNENNIPKIVTINDVSHLPEEYAEKDPMHDKKEIV

SEQ ID NO: 51812 - protein, 135 aa, Glycine max
  misc_feature (110)..(110): Xaa can be any naturally occurring amino acid
MEIDLSPQLAKKVYESNGGSYHAWSPSELPMLPEGNIGAAKLALQKNGFALPCYSDSSKVAYVLQGSGVAGIVLPESEEKVVAIKKGDALALPFGVITWWYNREDTELAXLFLGDTLKAHKTGEFTDFYLTGPNG

SEQ ID NO: 51813 - protein, 248 aa, Triticum aestivum
VTSRTSLYKKAGWYRSGIPGISSTHASDENYKRIFVPEGHPLKGEANEPLRVNVLFKHIQDMLTGDSAVLAETGDSWFNCQKLKLPEGCGYEFQMQYGSIGWSVGALLGYAQGASDKRVIACIGDGSFQVTAQDVSTMLRCEQNSIIFLINNGGYTIEVEIHDGPYNVIKNWNYTALVEAIHNGEGKCWTAKVKCEEELTAAIETALGEKKDSLCFIEVIAHKDDTSKELLEWGSRVSAANSRPPNPQ

SEQ ID NO: 51814 - protein, 266 aa, Pseudoalteromonas tunicata D2
MNNMTPEYDNRFGGVRRVYGTEQLTWLSQAHFCVIGIGGVGSWVAEAFARSGVGQITLIDLDDICTTNINRQIHALTSTIGSEKIVAMKERILAINPDCQVHLIDDFLTLDNITTHLVEFDYVVDCIDQVPVKAALIAHCKRQKIPVFTTGGAGGQSDPSQIQYGDVAKTTQDPLLAKVRYLLRKKYNFSDNPKRKFGVDCVFSTEQLTYPMADGSVCQAKQQADGSLSMDCANGFGSLTMVTGTFGFFAASKAIKKYLEKQQRNK

SEQ ID NO: 51815 - protein, 305 aa, Ehrlichia ruminantium str. Welgevonden
MYTGYKSINSFIDLDLHTYEELRKILDYGSLIKKHPDKYNKHLSNKNVALIFMQPSTRTRISFEVGVNQLGGSAIVLDWQNSQLTRGESIYDTAKVLSRYVNLVVIRILDHSSLLEFRKHSSVPIINSLTQYSHPCQVLADIMTYEEKIGSIEHATVSWIGDFNNMLVSWIHAATMLNFKLNVSTLEHSKDLELLLESAKKQGANIVYDRNPNNIIQDANVITTDSWVSMGDKNNIKSEFFNYQVNATLLKNARPDYMFLHCLPAHRGEEVTSEIIDGPNSYIFDEAENRLHIQKSIMLWCLNLL

SEQ ID NO: 51816 - protein, 264 aa, Picea sitchensis
MKGSQGINNAQNASIKFRMPTSENLIPIRLDIEIDGLRLKDAFTWNVNDPDSEIHVFVRRTIKDLKYPGTFITPIVQSIQAQLAEFRSFEGQEMNTGQKVLPLKLDLRVNKTVIKDQFLWDVNNLESDPEYFARVLCKDLEIEDREVGPAIAVAIREHLYEFAIQNVTSGRESRISKKARRDRGVDFTPTSKVGVAAFDLMKRVGNKISVLRRRREWDFYEPVVNVLSNEEVEALDAREERNARLKRKLDDKDDGGYSMRYMRV

SEQ ID NO: 51817 - protein, 273 aa, Pseudomonas syringae pv. phaseolicola 1448A
MRTLELAGRTVPVLGQGTWHMGEKGHLRSAEIAGLCLGIEQGLTLIDTAEMYADGAAEEIVGQAITGQRDKVFVVSKVYPHNASRSGIPAACEASLRRMNTDYIDLYLLHWPGQYPLTETVEAFERLQEAGKIGAWGVSNFDVPDMIELNNPRCATNQVLYNPEQRGIEFDLMLWSADRHLPLMAYCPIGQAGDLLYHPALHEIAKRHDATPAQISLAWVLRQDNMIAIPKATNPEHIRLNIAAEQIRLTERDLADIDLAWPAPTRKVPLAMV

SEQ ID NO: 51818 - protein, 404 aa, Pseudoalteromonas tunicata D2
MLSPEMLRDDFPIFSSSINDNSLIYLDSGATSQKPKQVIDRLNQFYSQENANVHRGIHFLSENATRNYEEARVKLANYLNAKSNEIVWTKGATESINLIAHGLSHLLTSADSVAISALEHHANIVPWQQACEKTGANLIILPINELGILDLAQAKILLEKYQPKILALSHASNALGNIQPIAELIQYIKPYNTISVIDGAQGFLHLRPDIKQIECDFYVLSAHKALGPTGLGAFYGRYELLCQMPVYQTGGEMIKHVSFEKTTFALPPGKFEAGTPNISAVIAFATALDYLQQLEHQKVQQYEQSLFQYLVSELQRIDGIKLYGDLKNNIGTLSFNYKEEHPFDIATLLDQFGVAVRSGHHCTQPLMQCLQVTGTVRVSLAFYNNKNDLDLFINALNSTISMLE

SEQ ID NO: 51819 - protein, 330 aa, Physcomitrella patens subsp. patens
ELLQKPENRVCADCGAPDPKWASTSIGVFLCIKCCGVHRSLGVHISKVVSTTLDTWSDEQVDLMEAIGGNASANSVYEACIPSGTRKPPPNASVEERSEFIRRKYEDQDFLKPNLRMKSQSTSRARPPTGLETDDLSAPSDRAPVHSRTSSYSNRESINRTSSSAGMVEFLGMLKVRIVRGINLAVRDLLSSDPYVTATLGTQTVKTRVVNRNLNPVWDEEHMLSVPSPPQPLKLQVFDHDVFSADDSMGDAAIDLNPLILAAQMHQGMFEEFGCEQIGRWLATNDNALVKDSNIEVIDGQIKQDVHLKLWNVERGEIEVSLEWVPLNGI

SEQ ID NO: 51820 - protein, 215 aa, Ehrlichia ruminantium str. Welgevonden
MVEISGSILSADFANLGKSVEMLTVAGVDYIHVDVMDGSFVSNITIGPVVISAIRQYTKIPFDVHLMINASSNYIENFVDAGADIITIHAESEVHLDGVIKKIKAYGKSAGISLVPTSHHNILEYIICDLDLVLVMTVNPGFGGQRFITSQLNKISSIRNIIQKYSLNTKIAVDGGVNIENAKDIIDAGADILVIGSALFKSNNMSEYIKQLKSL

SEQ ID NO: 51821 - protein, 379 aa, Zea mays
MATAGKVIKCRAAVAWEAGKPLSIEEVEVAPPQAMEVRIKILYTALCHTDVYFWEAKGQTPVFPRILGHEAGGIVESVGEGVTELAPGDHVLPVFTGECKECAHCKSEESNMCDLLRINVDRGVMIGDGKSRFTISGQPIFHFVGTSTFSEYTVIHVGCLAKINPEAPLDKVCILSCGISTGLGATLNVAKPAKGSTVAIFGLGAVGLAAMEGARLAGASRIIGVDINPAKYEQAKKFGCTEFVNPKDHDKPVQEVLIELTNGGVDRSVECTGNVNAMISAFECVHDGWGVAVLVGVPHKDDQFKTHPMNFLSEKTLKGTFFGNYKPRTDLPNVVEMYMKKELELEKFITHSVPFSEINTAFDLMLKGESLRCIMRMED

SEQ ID NO: 51822 - protein, 507 aa, Prochlorococcus marinus str. MIT 9313
MSTTITNPLRVGLRQERVIAPQCLVIFGASGDLTHRKLVPALFELYKQRRLPSEFALLGCARRPWSNEIFRQKMAEALGETINENHLAWDQFAAGLFYEPVDLQKPEDLIKLSHRLEEIDRLRATRSNRTFYLSVSPKFYGSGCKALANAGLLSDPKRSRVVIEKPFGRDYASAQSLNQIVQSCGQENQIFRIDHYLGKETVQNILVLRFANTIFEPIWNRNYISSVQITAAETVGVEERANYYESSGALRDMVQNHLTQMLAITTMEPPGRFDPEAIRNEKAKVLLAARLADELEPWNCCIRGQYAPGGTKEAPIAGYRQEPGVDPSSTTETYVAMKLFIDNWRWQGVPFYVRTGKRLAKRLSEVVLTFREAPVHLFDAAGGSPTANQLILRIQPDEGAEWRFEVKSPGSGMRSRPVEMEFSYDESFGEPSDEGYVRLLADAMLSDPTLFTRSDEVEAAWRLYTPLLELIEDSPWQLPIHPYESRTWGPAAADTLLANDGLLWRRP

SEQ ID NO: 51823 - protein, 214 aa, Rhodospirillum rubrum ATCC 11170
MNQIFANPLSLPGTAQERVSRAVDSLRQGQGVIVVDDEDRENEGDLIFAAETLTAEQMSRMIRDGSGIVCLILTDPDLDRLALPPMVAHNTSRNGTGFTVSIEAREGVTTGVSAADRVTTIRAAIDPASTADDLARPGHVFPLRAHADGLSARRGHTEATIALMRLAGLRPAGVLCEVMNPDGTMARLPTLIGYGQAHGLPIVSIEDLVAVGAR

SEQ ID NO: 51824 - protein, 194 aa, Saccharomyces cerevisiae
MVTSNVVLVSGEGERFTVDKKIAERSLLLKNYLNDMHDSNLQNNSDSDSDSDSETNHKSKDNNNGDDDDEDDDEIVMPVPNVRSSVLQKVIEWAEHHRDSNFPDEDDDDSRKSAPVDSWDREFLKVDQEMLYEIILAANYLNIKPLLDAGCKVVAEMIRGRSPEEIRRTFNIVNDFTPEEEAAIRRENEWAEDR

SEQ ID NO: 51825 - protein, 614 aa, Arabidopsis thaliana
MESTIVMMMMITRSFFCFLGFLCLLCSSVHGLLSPKGVNFEVQALMDIKASLHDPHGVLDNWDRDAVDPCSWTMVTCSSENFVIGLLLQNNNIKGKIPAEIGRLTRLETLDLSDNFFHGEIPFSVGYLQSLQYLRLNNNSLSGVFPLSLSNMTQLAFLDLSYNNLSGPVPRFAAKTFSIVGNPLICPTGTEPDCNGTTLIPMSMNLNQTGVPLYAGGSRNHKMAIAVGSSVGTVSLIFIAVGLFLWWRQRHNQNTFFDVKDGNHHEEVSLGNLRRFGFRELQIATNNFSSKNLLGKGGYGNVYKGILGDSTVVAVKRLKDGGALGGEIQFQTEVEMISLAVHRNLLRLYGFCITQTEKLLVYPYMSNGSVASRMKAKPVLDWSIRKRIAIGAARGLVYLHEQCDPKIIHRDVKAANILLDDYCEAVVGDFGLAKLLDHQDSHVTTAVRGTVGHIAPEYLSTGQSSEKTDVFGFGILLLELVTGQRAFEFGKAANQKGVMLDWVKKIHQEKKLELLVDKELLKKKSYDEIELDEMVRVALLCTQYLPGHRPKMSEVVRMLEGDGLAEKWEASQRSDSVSKCSNRINELMSSSDRYSDLTDDSSLLVQAMELSGPR

SEQ ID NO: 51826 - protein, 432 aa, Bacillus cereus G9241
MLSLNNSTYLEKLAVGGKFLIKKYTCKNGVRIVMENIPTVRSVAIGIWIHAGSRNENEKNNGISHFLEHMFFKGTETRSAREIAESFDSIGGQVNAFTSKEYTCYYAKVLDEHAKYALDVLADMFFNSTFDEEELKKEKNVVCEEIKMYEDAPDDIVHDMLTKATYETHPLGYPILGTEETLNTFTGDTLRQYIKDHYTPENVVVSIAGNIDEAFLQTVEQYFGSYEGTTNREQVHSPIFHFNKVARKKETEQAHLCLGYKGLQMGHEDIYNLIVLNNVLGGSMSSRLFQEVREQRGLAYSVFSYHSSYEDTGMLTLYGGTGSQQLDTLYETMQETLETLKNTGITEKELMNSKEQLKGNLMLSLESTNSRMSRNGKNELLLRKHRSLDEIIESVNTVTKENVDELIRNMFTDEFSAALISPDGKLPKGIKL

SEQ ID NO: 51827 - protein, 161 aa, Triticum aestivum
MAVSELEVDGVVFPPLARPPGSEHAHFLAGAGVRGMEIGGNFIKFTAIGVYLQADAAVSALAAKWAGKPAADLASDAAFFRDVVTGEFEKFTRVTMILPLTGAQYSDKVTENCVAYWKATGVYTDAQAAAVHKFKEAFGAPKVSPPEASILLYPFPPAGLP

SEQ ID NO: 51828 - protein, 459 aa, Bradyrhizobium sp. BTAi1
MRTNSLQSKDIAHQIHPATNLRRHERVGPIVIDRGSGIYVYDDEGREYIEGLAGLWSVGVGFGEKRLVEAATRQMAKLPYYHIFAHKTHEPSTLLAEKLVSMAPANLKHVFFTSSGGEANDSAIKFVWYYNNALGRTDKKKFIARQGAYHGITIAAGSLTGLQANQRGFDLPLPFAKHLTCPHYYRFGLPGESEEAFTERLAKELEDLILSEGPDTVGAFIGEPLMGAGGVIVPPVNYWQRIQEVCRKYDVLVIADEVINGFGRLGTLFGCDTFGIRPDILVCSKQITSSYQPLAAVLISDEMYQAMADQSDRLGTFGHGYTASAHPVATAVALENLAIIEERNLVANAAEVGAHLHAGLSRFADHPLVGEVRGRGLIAAVELVADKATKARFDPVGKVGLKFFDRAHQHGLIIRNVGDSIAICPPMIITAAQVDELLKRFKATLDDITDWVNAGMPEA

SEQ ID NO: 51829 - protein, 425 aa, Thermococcus kodakarensis KOD1
MNPLEFHRDNFPGNGKIEVIPKVPVNRETLSLAYTPGVAEPSKAIANGADPDEYTVIPNTVAVVTDGSAILGLGDIGPVAGMPVMEGKAVLFKALAGVDAFPILINTKDVDEIVRTVELISPGFGGINLEDISAPRCFEIEERLRERLDIPVFHDDQHGTAVVTLAGLINALKLVGKKFSEIKVAISGAGAAGIAIAKILHSVGVKEIVTVDRKGIIHEGREDLNPYKREVAEYNVHGIEGGLKEAMEGADVFIGVSAGGIVTPDMVRAMADDAIVFAMANPIPEIMPEEAKRAGARIVATGRSDFPNQINNVLGFPGIFRGALDVKAEDITPSMKLAAAEAIASVVSDDELGEDYIIPSPLHPDVFPKEARAVAEVAMKEGVAGRKVSGEWVEEHTRRLREFYSAFIEPLNEKRKTFSGRGSSP

SEQ ID NO: 51830 - protein, 128 aa, Zea mays
MAEKEGAKVGAEEMEEREQEGEAEEVEVKFRLFDGSDIGPVRCNAAATTVAALKDRVVADWPKDKSIIPKTASDVKLISGGKILENDKNVAQCRAPFGDLPSSAITMHVVVQPSSAKSKPGELQVFAL

SEQ ID NO: 51831 - protein, 457 aa, Escherichia coli
MMEGQQHGEQLKRGLKNRHIQLIALGGAIGTGLFLGSASVIQSAGPGIILGYAIAGFIAFLIMRQLGEMVVEEPVAGSFSHFAYKYWGSFAGFASGWNYWVLYVLVAMAELTAVGKYIQFWYPEIPTWVSAAVFFVVINAINLTNVKVFGEMEFWFAIIKVIAVVAMIIFGGWLLFSGNGGPQATVSNLWDQGGFLPHAFTGLVMMMAIIMFSFGGLELVGITAAEADNPEQSIPKATNQVIYRILIFYIGSLAVLLSLMPWTRVTADTSPFVLIFHELGDTFVANALNIVVLTAALSVYNSCVYCNSRMLFGLAQQGNAPKALASVDKRGVPVNTILVSALVTALCVLINYLAPESAFGLLMALVVSALVINWAMISLAHMKFRRAKQEQGVVTRFPALLYPLGNWICLLFMAAVLVIMLMTRGMAISVYLIPVWLIVLGIGYLFKEKTAKAVKAH

SEQ ID NO: 51832 - protein, 228 aa, Plantago major
VQLYELLMGVEEIVGDDNHHTPLLSSSSTSAPYAHTLEQQPHKKGTIWTALAHIITAVIGSGVLSLAWSMSRLGWVAGPLTMLTFAAVSLTSAILLCNCYKSSDLNNGLRNNGSYLDAIQNILGKKSAWAGGIIVRLYFIKLGIVYTITSGISIRAIHRSNCYHFEGHTASCNYGTTFYMLIFGIVQVVASQIPDFTNTKWLSVIAAIMSFMYSGIGSVLGVAKVIEN

SEQ ID NO: 51833 - protein, 85 aa, Zea mays
MESTVNPKAYPLADVQLTMGILDIIQHSTNYKQLKKGANEAMNTLNRGISEFVVMAADTEPLEILLHLPLLGEDKTKSSHTRGDD

SEQ ID NO: 51834 - protein, 138 aa, Haemophilus ducreyi 35000HP
MLQQTLCLIKPDATQRNLIGKIISYLENAGLKIKAIKKLQLTQAQAEKFYLEHQDKPFFASLVGFMISAPIVAIVLEGENAIAHYRELMGATNPEQREAGTIRALYAISNQENSVHGSDSETSAKREIDYFFSKEEIC

SEQ ID NO: 51835 - protein, 234 aa, Triticum aestivum
KRVPLLAAHGRQGPDTGWTRGAPAGGPTAASAPSAKGGGSPPKGGAPPAPGGGHPPQGTLGGGPVGSGIPLSKGEEHPVVGLAIGGAEGVNPNFNLVKGRGGPLFPKEMVEPASGKFVLVVDETKLVTALGGSALPIPVEVVQFCWKHNQVRLQGLFNEEGCEANLRLNEDGNPYVTDNSKYIVDSHFKTPIRDALGAGKAPPPPEGVFEHGLFLNMATSVIIAGSDGVSVKTK

SEQ ID NO: 51836 - protein, 480 aa, Vitis vinifera
MHIRKVIHTTSASTSAVSLYSLSKLCLQLCMEDTADNHPLAIGTFQRRERRQKPKSVKGVIRRKRGHLKTEHKDDGGGGGGDEEDEEVELEVEKKIMELQRIVPGGEWVGIENLFEQTASYILALQCQVKAMNAVASFLEGLDMEKRKLGGLTMADEVFISGAINGDDQTNENFYDLDRENDIKIAELTRKVGVLEQEKADLIREYDGVKQRVEKLTAESEEMKSDKDEMEKKLEEMMREIERSESDKKALDVIGARAVELETEVSRLQHDLISASSEADEANAEVMQLKRILEEKELRVENLEKEKGLIEKEKGENESRLRDLEEKIRVMEVKESKTNEEKIKIEQETKEKIDEKEREISNLKSDIEELKASIEHLKMQQKQDEEMRSNELKEALRKCNEKAQYTESALDQALEEARELKVASKTLQDTQYEGVNGIASDSDTGDVEERPLGFKWQVAIFTGAITAAAAVCYLRYRRQR

SEQ ID NO: 51837 - protein, 503 aa, Glycine max
MAISIPSRQLFIDGEWKVPLLNNRFPIINPATEDIIGHIPAATKEDVDLAVDAAKRAFSHNKGKDWSSAPGSVRARYLRAIASKITEKKDELGKLEAIDCGKPLDEALADLDDVIGCFNYYAELAEGLDAKQNAPVSLPMETFKSYVLKEPIGVVALITPWNYPLLMATWKVAPALAAGCTAILKPSELASVTCLELAEICREVGLPPGVLNIVTGLGNEAGAPLSSHPDVDKISFTGSSATGSRIMTAAAQLTKPVSLELGGKSPIIVFEDVDLDKTAEWTIFGCFFTNGQICSATSRLIVHESIATEFVNRLVQWAKNIKISDPFEEGCRLGPIVSEGQYKKVLNCISTAKSEGATILIGGSRPEHLKKGYFVEPTIITDVTTSMQIWREEVFGPVLCVKTFSTEEEAIELANDTHYGLGSAVMSKDLERCERISKAIQAGIVWINCAQPSFIQAPWGGVKRSGFGRELGEWGLENYLSVKQVTKYISDEPWGWYQSPSKL

SEQ ID NO: 51838 - protein, 447 aa, unidentified eubacterium SCB49
MKQSIKDFIALVEKSNPNEPEFLQAVTEVAETVIPFIEANELYQGKMLLERMVEPERTIIFRVPWTDSKGNIQVNRGYRVEYNSAIGPYKGGLRFHPSVNLSILKFLGFEQTFKNSLTTLPMGGGKGGSDFDPKGKTDNEVMRFCQSFMSELSRHIGPNTDVPAGDIGVGGREIGYLFGQYKRLQNEFTGVLTGKGLSYGGSLIRPEATGYGNVYFAKNMLETKGESFKGKTVVISGSGNVAQFAAQKATEFGGKIVTMSDSGGYIFDSEGINAEKLAFIMNLKNVKRGRISEYVDKYPSAKYNAGQRPWGEKCDVALPCATQNELNETEAKTLVENGCICVSEGANMPSTPEAIEVFTEAKILFAPGKASNAGGVATSGLEMSQNSLRLSWTEKEVDEKLQTIMNDIHAACVKYGKDGDGYVDYVKGANIAGFVKVADAMMAQGVV

SEQ ID NO: 51839 - protein, 621 aa, Dunaliella salina
MSYHSIDGIGNSRHPLMQLRSVLVGGVKIASLDVWKTQLLLFSHTVSQPSHNTNPVLTDGPGAMGEPAKADEHRDSNGENGNGKPAPGQLFPDYRRTVALKYVSRGLQVAFSYISLTMLATPFVVFGSLELFNLYRQGELQKLVEVAKQTEMTFDMITVMGCIAMMVVGLLLYFFLRKNPVYLVDFSVFRANDSSWNATYKRFMNGSFMTRRFTEDSLNFQKKILERSGLGQDTMLPPAMQTMCSLDWKTLELSHDPAQTLASVAPRPGMKLAREEFEVVIFSTVQDLLNKTGVRAKDIGILVVNCSLFNPTPSLCAMVINHFKMRSNIISYNLSGMGCSASPIAIDLANQMLQLYSGTYALVISTENITQNWYFGNDRSMLLPNCLFRVGGAAMLLSNRRRDGLRAKYELQHVVRTHLGAKDQAYGCIFQTEDDEDNVGVRLTKELMAVAGEALKVNVTTLGPLVLPISEQALFIFNLIVRKTFNKKLKPYIPDFKLAFDKICIHTGGRAVIDEIEKQLRLTPEMVEPSRAVLFRYGNVSSSSIWYVLAYMESIEGVKRGDRIWQLGFGSGFKCNSAVWRSKRRIKNMHYAWEGFNLQEMRDHLASLAIHKARHLEQKPK

SEQ ID NO: 51840 - protein, 424 aa, Zea mays
MENLRSQNCHQGVAMEGVKFAPEKANTNRRALSDIKNIIGGPHQHLAVSKRALSEKPAAAAAANAKDQAGFVGHRPVTRKFAATLATQPTVALLDPIGSERLKRNADTAFHTPADMESTKMTDDSPLPMVSEMDEMMSPELKEIEMEDIEEAAPDIDSGDAGNSLAVADYVDEIYRFYRKTEGASCVPTNYMSSQTDINEKMRGILIDWLIEVHYKLELLEETLFLTVNIIDRFLARENVVRKKLQLAGVTAMLLACKYEEVSVPVVEDLILICDRAYTRADILEMERRIVNTLNFNMSVPTPYCFMRRFLKAAQSEKKLELLSFFMIELSLVEYEMLQFCPSMLAAAAIYTAQCTINGFKSWNKCCELHTRYSEEHLMVCSRMMVELHQRAAHGKLTGVHRKYNTSRYSYAAKSEPATFLLDA

SEQ ID NO: 51841 - protein, 82 aa, Oryza sativa
  misc_feature (11)..(11): Xaa can be any naturally occurring amino acid
  misc_feature (24)..(24): Xaa can be any naturally occurring amino acid
  misc_feature (34)..(35): Xaa can be any naturally occurring amino acid
  misc_feature (41)..(41): Xaa can be any naturally occurring amino acid
  misc_feature (45)..(46): Xaa can be any naturally occurring amino acid
  misc_feature (60)..(61): Xaa can be any naturally occurring amino acid
  misc_feature (77)..(77): Xaa can be any naturally occurring amino acid
  misc_feature (79)..(79): Xaa can be any naturally occurring amino acid
STPSQASHGEXGGERGGERGGFGXGFGRGGRGDXXGRRGGXAARXXEEEKWVPVTKLGRXXKEGRFSKIEEIYLHSXPXKEH

SEQ ID NO: 51842 - protein, 75 aa, Triticum aestivum
MKFFSAFDPWPVFFRREWGRTWPFLAGFAVTGALITKMTAGFTEEDLKELQFRPRRTRISPPAPAVPRQVNKGSS

SEQ ID NO: 51843 - protein, 260 aa, Aspergillus oryzae
MPAPTALKGLDQTTTAGVPVTQAAIVQDDEVLIDAQTSAEESVPVLAPLGENAQDTDMRIDEEGRPVFTPAKDTNTVYRVETRKVPVPPHRFSPLKASWSRIYPPLVEHLKLQVRMNIKSRAVELRTSKFTTDTGALQKGEDFVKAFTLGFDVDDAIALLRLDDLYIRSFEIRDVKASLHGEHLSRAIGRIAGKDGKLKHSIENATRTRIVLADQKIHLLGGYRNILVAQEAVVSLILGSPPGKVYGNLRKVASRMKERF

SEQ ID NO: 51844 - protein, 226 aa, Triticum aestivum
  misc_feature (137)..(137): Xaa can be any naturally occurring amino acid
MDGGGGVRPSLQPAAAGGGASGSPDEPRDARVVRELLRSMGLGEGEYEPRVVHQFLDLAYRYAGDVLGDAQVYADHAGKPQLDADDVRLAIQAKVNFSFSQPPPREVLLELARSRNKIPLPKSIAPPGSIPLPPEQXTALLSQNYQLLPALKPPTQTEEAEDEEEGANADAASPNPNSSQDQRGNEQQQQQPQSQSQGQRVSFQLNAVAAAAAKRPRMTIDQLNMG

SEQ ID NO: 51845 - protein, 275 aa, Triticum aestivum
MLMLHETVPFVRPSSCRDLKLSEKSASAFHCKLGCSAVCSSAEGHHVQKPHIVHSHKVNFTRTSHLLCKSLNKRTTRHWLHRFHVNASPDDEFRSSRNIAISLFKRYKKIIDRGGGGENLKEFVSAGVTAYALGCTDEGLRKELMDLEDSGLEIEGLGSLGGTSSKFKVHSFEIRECIMWLSIVFITILCTPQLTVTRWSTNPPVSADVLHQWKGFCAIIANAYYVKGMAWLPVKTLQLEQMAVTGNSEEPSVVASRMQLVFSTLEVVSPQWPRV

SEQ ID NO: 51846 - protein, 496 aa, Pseudoalteromonas tunicata D2
MTIEIKVPVLPESVADATIATWHVSVGDKVSRDQNLVDIETDKVVLEVVAPQDGVVTSISQQEGATVLGQQVIALIGASDATAVAQEQTAAPVAQAPVSEGNAVDILVPVLPESVADATIATWHVKPGEAVSRDQNLVDIETDKVVLEVVAPADGVMGEQLHGEGETVLGQQLIGKLLAGATASATPAAAPAPSAAPAAAASDDSASDVLTPSVRRLIAEKGLDASKIKGTGKGGRVTKEDVDAFLKAPAATSAPVATPAALAGRTQKRVPMTRLRKTIANRLLEAKNSTAMLTTFNEVNMKPIMDLRKQYQDVFEKRHGIRLGFMSFYVKAVTEALKRFPDVNASIDGDDIVYHNYFDISIAVSTPRGLVTPVLRDCDKLSVAEIEQGIRDLAIKGRDGKLTMDDMTGGNFTITNGGVFGSLLSTPIINLPQSSILGMHKIQDRPMAVNGKVEILPMMYLALSYDHRQIDGKESVGFLVTIKELLEDPTRLLLDV

SEQ ID NO: 51847 - protein, 388 aa, Pseudoalteromonas tunicata D2
MNLHEYQAKQLFAEYGLPVSEGFACDTPQEAAEAADKIGGNMWVVKTQVHAGGRGKAGGVKLVKTKEEIKEFAQHWLGKNLVTYQTDANGQPVSKILVESCTDIANELYLGAVVDRGSRKVVFMASTEGGVEIEKVAEETPELIHKAIIDPLVGPQAYQARELGFKLGLNPDQMKQFTKIFMGLAKMFNDFDFALLEINPLVITEQGNLHCLDGKIGVDGNALYRQPKIRAMRDPSQEDEREAQAAQWELNYVALDGNVGCMVNGAGLAMGTMDIVNLHGGKPANFLDVGGGATKERVAEAFKIILSDSNVKAVLVNIFGGIVRCDMIAEGIIGAVKEVGVTIPVVVRLEGTNAELGRQVLANSGLDIIAAESLTDAAEKVVAAAESK

SEQ ID NO: 51848 - protein, 133 aa, Microcystis aeruginosa PCC 7806
MIAAQDVAPFQLISSVESAATEFRPWGSFTTLEEGPGYKIKRIEVNPGHRLSLQMHYHRSEHWIVVSGTAKVTCGDNEEILGANQSTYVPQCTAHRLENPGVIKLVLIEVQNGEYLGEDDIVRFQDDYARHQS

SEQ ID NO: 51849 - protein, 166 aa, Picea sitchensis
MANATISTSTSTARKGLSKIACNRLQKELVEWQVNPPVGFKHKVTDNLQRWIIEVNGAPGTLYFNESYQLQVDFPEHYPMEAPQVIFLSPAPLHPHIYSNGHICLDILYDSWSPAMTVSSICISILSMLSSSTIKQRPADNDQYVKNCRNGRSPKETRWWFHDDTV

SEQ ID NO: 51850 - protein, 306 aa, Prochlorococcus marinus str. MIT 9313
MNETRFMAAAVSTFFDFPAYLAAAKASVEEALDDSLGPERPEQLREAMRYSLLAGGKRLRPILCLAACELAGGEPAEALPTAVALEMIHTMSLIHDDLPAMDNDDLRRGRPTNHKVYGDAVAILAGDALLTRSFEMVALRSPGVPPERLLKVVGELSLVAGAPGLVGGQVVDLECEGKEVDLETLEFIHLHKTGALLSACVICGALIGGAEDDLIDALRIYARGIGLAFQIIDDILDVTASSDVLGKTAGKDLLADKTTYPKLLGLDESRRRAELLVSEAKAALEPWQASAAPLLALADYITSRDR

SEQ ID NO: 51851 - protein, 284 aa, Microcystis aeruginosa PCC 7806
MTVKIAYLGPVGTYSETAALAFANSLPPQPHQLIPYPSIALSLRSVVQNQADLAVVPVENSTEGSVVMTLDALWQLPGLQIQQELVLPISHALLSPRQSLTEIKTVYSHPQALAQCQKWLENNLPTVPIIPTNSTTEAIQILDREANSAAIASPRAAKLYHVPILTKPINDYPDNCTRFWVMALTSHPQGERMSLAFQVLDQPGALVKPLEVFAKRQLNLSRIESRPTKRSLGEYIFFIDLEINLDQQHLIAETLEELTNYTDAIEVFGFYQVVNLPVESLEEL

SEQ ID NO: 51852 - protein, 423 aa, Corynebacterium diphtheriae NCTC 13129
MNNKKETPQAAPAQRKRTRRIFDQSDKLKNVLYEIRGPVTAEAEAMELDGHRILKLNTGNPAIFGFEAPDVIMRDMIASLPTSQGYSTSKGIIPARRAIVTRYEVIPGFPAFDVDDVYIGNGVSELITMTTQALLNNGDEVLIPMPDYPLWTAATSLAGGKPVHYLCDEEDDWNPSIEDIKSKITERTKAIVVINPNNPTGAVYSKEVLQKIVDVAREHDLLILADEIYDRILYDGAVHTNIAALAPDLLCITFNGLSKAYRVAGYRAGWMIVTGPKNNARGFIEGLDLLSGTRLCANVPGQHAIQVALGGRQSIYDLTGQGGRLLEQRNVTWEKLNAIPGVSCVKPMGALYAFPKLDLEYYDIKDDAQLMLDLLRQEKILMVQGTGFNWDKPDHFRVVTLPWASQLSEAMDRLGNFLASYKQ

SEQ ID NO: 51853 - protein, 406 aa, Ehrlichia ruminantium str. Welgevonden
MFIEVLMPALSPTMTSGIIRKWYKSEGEEIKSGDIIADIETDKAVMEFEYTDEDGIMGKIIVAEGTKNVLVNQLIALIVTDKLDLKEVDAYVSSSTASKTEKASVVLQGEEEIKNDVVTISEPKRIKISPLAKKIASDFAIDINSIQGTGPYGRIVKADVLDAASKKENNVEIIPTSNGENTFIEVSSMRKVIAERLVYSKQMIPHFYVSVDCKVDDLLKVRLEINAENFGTKITINDFIIKAVSMSIKKFPEINVSWDDNDKIIAFANVDISVAVSIDDGLITPIIRNADKKSLLEISNEVKMLASKAKTGKLKPEEFQGGGFTISNLGMFGIKEFNAIINPPQSCIMAVGCSDKRAIIVDDQICISNVMTVTLSVDHRVIDGVLAAKFLNCFKSYIEKPYLMLI

SEQ ID NO: 51854 - protein, 447 aa, Oryza sativa
  misc_feature (137)..(137): Xaa can be any naturally occurring amino acid
MRKKPARAVPEWLNSPLWSAPPPSSSSPSPPVPPDPYGADLSPPPPPPPKPPPTVPPPSYDQAVGSSRRARSEAGWEEEEEEDGEVGGGAALRAHLLADFKLALSKKVVNMGELRRLACLGVPDGGAAVRPLVWKCXLLLGYLPTERAFWPHELEKKRSQYSAYKDEFLLNPSEKIRRFEESKLLRKKELNSDKIGLLPRAKVTNEEHPLSFGKSSLWNQYFQESEILEQIDRDVKRTHPEMPFFSAKANQESLRRVLIIFSKLNPTIRYVQGMNEVLAPLFYVFKNDPDTSNSASAEADTFFCFVELLSGFKDNYCKHLDNSQVGIRSTLSKLSQLLKRHDEELWRHMEITTKVYPQYYAFRWITLLLTMEFSFNVCIHIWDAILGDPEGPPDTLLRICCAMLILVRRRLLAGDFTANIQLLQHYPPTNIDHLLHIANRLRGSVAS

SEQ ID NO: 51855 - protein, 258 aa, Thiobacillus denitrificans ATCC 25259
MLFLTLTWRKRMLLRLSAALLSSLSFAAAAAPGSHWTYEGEHGPTHWAQLDKGFAECALGHAQSPIDIRDATPRADAPDLDFRYQATPLRLINNGHTVQVDESDAGTLTIGGHRYALAQFHFHTPSEERVRGKAYDMVAHLVHKDASGKLAAVAVLFKAGRENAALKTVFDNMPLGAGPEHKVEGVQFNPADLLPKQHAYYHFQGSLTTPPCSEGVAWYVLKTPVEASRAQIGQLRTLYPHNARPVQALHGRQVIDHP

SEQ ID NO: 51856 - protein, 248 aa, Thiobacillus denitrificans ATCC 25259
MTGFKDHFSSGSEGYAAYRPDYPATLFAWLSSLCAERRLAWDCATGSGQAARGLAAHFPRVVASDASAEQVRHATPHPGVDYRVATAEASGLAERSVDLVTVAQAAHWFDLPRFYAEVARVLKPAGVAALWGYGRIVLPGAMDAPLRYFYAETVGPYWPAERALIDDAYRGLDFPFVEIPPPAFAIEVAWTLPRLIDYLSTWSAVKRFQTARGRDPLPALNAELAPLWGDANAAMTLRWPLFLRVGRV

SEQ ID NO: 51857 - protein, 171 aa, unidentified eubacterium SCB49
MIDISEYIRDVADFPKPGVMFKDITPLLLNEKATRECLEQLVSLVNDQKIDKVIGIESRGFFFGMMIAQALEVGFVPIRKSGKLPYDTYKEPYSLEYGMDVLEMHEDAIQKGDRVLVHDDVLATGGTAKAACNMVERAGGIVVQCNFIMQIDFLKGVDKLKKYDVASLLSY

SEQ ID NO: 51858 - protein, 226 aa, Plantago major
KMAPENKIVDQVSGWLTLYEDGSVDRSWTGPPEVKFMTDHVPPHNHFIDEVATEDITTSDGLKLRIYTPEKQENDDEKLPIILHFHGGGFCISEADWYMYYVIYARLARAAKAVVVSPYLRRAPEHRLPAACDDGFAALLWLQSIAKGESNHPWLHDHADFSRVFLIGDSSGGNVVHQVAARAGDTPLNPLKVAGAIPIHPGFCRAERSKSELEKPETPFLTLDMA

SEQ ID NO: 51859 - protein, 505 aa, Desulfitobacterium hafniense DCB-2
MGKATGFLEYQRIDPKKRAPEERIQDWREIKLPRDPEVIKTQGARCMNCGVPFCNGGVVLNGMVSGCPLHNLIPDWNELIYKGQWEEAYRRLSRTSPFSEFTSRVCPAPCEGACTEGYIMEPVTINCIEYEIIEKAFAEGWVKPKKGKVTGKRVAVVGSGPAGLSAANYLNAVGHEVTVYERADRPGGLLMYGIPNMKLEKNVVERRINLMKESGIHFVLNTEVGRDVPAQDLVNQYDAVVLCIGATKARGLNVEGRDLKGVHYAVDFLKANTKSLLDSNFEGLETMAEKDGQEGGWISAQGKNVIIIGGGDTGTDCVATSIRHGCKSVHQFEIMPEPPAKRIEATNPWPEWPKKLKVDYGQEEAISLYGKDPRHYLINTKKIVGNEQGEVKEVHTVEVHWIKDSSGRMVPQEVPGSEKVWEADLVLLAMGFLGPEDAIPNELNLERDERSNLKAVYEEFETNVEKVFAAGDARRGQSLVVSALQEGKLAAREVDKYLMGRSGIR

SEQ ID NO: 51860 - protein, 825 aa, Ashbya gossypii ATCC 10895
MEYMDIEASLYPCVVNMLPRGVPEVQARRLVQELARAITSGNNEQASRVVSMYRAEMVRTPEQTQQWGKFEMFVKVLESFGSKEQVLKYLTVLNSVPQESTPFRHRRTASGYLTNATLQRHNSLMTPSRAVSVYAESFENVERLSERRSAVTSAYGGPVPKRPQQHDTPLAYLSNPYYSNMVPEADVLKYISYTLLATTSSLFPISNQVIEIPPNVPNGESGVFHSIFEAALLYQYLSNQVEKFKVASSLSPLKVNFLTVVSERLREYSRVVNQLSSSIASESVKSIYIQIYTQILVFRFYHGYLERFEQLRGDQLISEFDSLRQHGDPLVKNLAEEIFSTLIDLYMEYLLYWLVRGQLKSTHDEFFVSVNKSADPKLGMNFAILKESIPGFIPPAVAQQIYTVGKSYIYLETYLKEIEWASNFSNKYMNKFADLPKSAIGQPFYDLVNEQHAEITAFINDILKSKYYYDETVTVLKDILLMGRGDFIENIIINASDFLMEPVHQLQSYQLTKCLQESVQRSSLRNYLNKHDNNVIINKLDARLLESGHGSVGWDVFTLDYLVDLPLSIVLNVNRPGRKKEYLRIFNFLWRIKKNAFFFQEEWLRNLSLMRDFRKTRRNKPLVRDIVRKMALVNALKNQLELFNRKMESYCFTNIIESKYRDFQKKLTMKENNSNESFNVITLKSGIKFIDGILKPRLEYLHQLRPDAATVGSSGLKQYNIDELDNLHNDYLDSILDNKLLDAHNGKQPGKFTNQYFPVSLIMLMNQMLEFVLSYAELNGILHEILIQLNLQRQDGLNDILARFNLVMKNIVSLLQNLSRSTRSL

SEQ ID NO: 51861 - protein, 223 aa, Campylobacter jejuni subsp. jejuni NCTC 11168
MIFAANLKCNHTRASFKIYAKILNKTMGVKCDDIIVFPPSIAFLENENNFIQGAQNFYPCVNGAFTGELGKEHLDEFGIKCVLIGHSERRALGDEEFIKAKFDFAKEHGYKIVFCIGENLDTKNSGKTLEFLKKQLEIIDLNYEKLIIAYEPIYSIGTGVSAQSTDIAKVLEFLASLTKVPLLYGGSVNENNIKEILSVNHCGGVLIGSAALKVENFIKLIKG

SEQ ID NO: 51862 - protein, 458 aa, Listeria innocua Clip11262
MAQTSTIQNDTKAAEEYAARVFETIKQRNPGETEFHQAVEEFLNSVIPALAKEPKYEAHGILEQLTEPERLISFRVPWVDDAGTVQVNRGYRVQFNSAIGPYKGGLRFHPSVTGSIVKFLGFEQIFKNSLTGLPIGGGKGGSDFNPKGKSDAEVMRFCQSFMTELQKHIGPDTDVPAGDIGVGGREIGYLFGQYKRLRGAYDAGTLTGKGLSYGGSLARTEATGYGLVYFTVEMLEAAGESIRGKKIVVSGSGNVAIYAIEKAHELGAKVVACSDSAGFVYDKEGIKVETVKQLKEVERKRISEYVTLHPSAEYYAGGDVWSVPCDIALPCATQNEINADQARALVKNGVIAVAEGANMPSTLEAVDIYHENKVLFGPAKAANAGGVAVSALEMAQNSTRMSWTFQTVDEHLQNIMKDIYKNSSNAASEYGAPGNLVVGSNIAGFLKVADTMIAHGII

SEQ ID NO: 51863 - protein, 445 aa, Ashbya gossypii ATCC 10895
MSLPKLTPENIIRSIYTSPVNRHKNNLGLVLDLTYITDNIIVCSYPVMKYPRMFYRNSLKDLVTYLNVHHGSGKWKIFNLKVEICDSDYTDEDILSMVGAGLRSPIESLRSPRSAVSSQSYALLTKHSKSIGIELPERSSLSTPINPKTILNDLVARRGWIDHFPPPFILLEEITDEIHEYLGGDSGRVAVVHCKMGKGRSGTVAIAYLMKYRQIPMLESCQLFLTTRFKPGISRGVTIYSQLRYLRYHETFICYDTLYRPQIMEELRRCRFRIDSIEFVNPLGTITRDIIGSACMLGVKIQKYKPRNDGLVDLYSVECDEDKEEFSLVDGKYIILPRTTIDTSDIRLCFGLRSKTTEFINSVTKLTSSAYCWLNLYWETVSCSRSLSPTNFLITELDEEIRSNIGQPTFTIKWEDLEGTKGTLNKGLKLFDSLTLYWSLETDPR

SEQ ID NO: 51864 - protein, 710 aa, Desulfotalea psychrophila LSv54
MTQNLYITATEERSGKSVIVLGVMQMLMKEVRNVAFFRPIISDTEPGDDDPDINLVLDYFDLDIPYEDTYGCTLSKAYELINSGKEDQLHDLILKKYKKLEADHDFILCEGTDFRGSDTSFEAEINADIAANLGAPLLLVLSGRKKIEKEIMQATQLSIDTMLEKGSSFAACIINRAAETITPETFHKLQAKNRALSRIPFYVMPENSNLASPSVMDVKKWLDASVMHGSEKLAGLVENYVVAAMQIGNFLDHIKPGSCVITPGDRSDIILASLASKASSTYPDISGIVLTGDMKPAESVQKLIEGWQGTPTPILSVATNTYQTIMRLNELYSHIQASDSQRIATALGTFSKHVDTKELTEHLISSIPTTITPKMFEYALMEKASQDKQRIVLPEGTCERILRAADILLRRGVANLTLLGPADEVKSRAAACGMDTRWVEIIDPQNTNLLAPFVDEYMKARAHKGMIEDIARDRMTDPTYFGTMMVHTGYADGMVSGAENTTAHTIRPAFEFIKTKPGISTVSSVFLMCLSDRVLVYGDCAVNPNPTAKQLAEIALSSAETARLFGIEPRVAMLSYSTGSSGKGEDVERVIEATKIAQALIIERKLDINLEGPIQYDAAIDPDVARTKLPNSLVAGKATVFTFPDLNTGNNTYKAVQRAAGAVAIGPILQGLNKPVNDLSRGCTVDDIVNTVAITAIQAQEEKRLFALKK

SEQ ID NO: 51865 - protein, 235 aa, Ashbya gossypii ATCC 10895
MSSVLYTHPPRPEKIPASATSQKMSEFINEDPKILDEAQLPQRAEDAQDWSGLALSKPAQERQKQLLQLTVRDTQLVRDVALLDTLLTQAAPPLSYSSDSDSDEADPVDPQEIYDLIAHISDPEHPLTLGQLAVVNLPDIEVRDSGDPHEIAEVVVRITPTITHCSLATLIGLGIRVRLERSLTPRFRITVLLKKGSHQSENQVNKQLNDKERVAAACENEQLVEVVSKMLSTCK

SEQ ID NO: 51866 - protein, 372 aa, Opitutaceae bacterium TAV2
MSQPYIVIIAGGKGERFWPQSRAACPKHLLPVVGDKPLLVQTLDRVKPLAPAKNIYVITSAVQAKAVRAVCKGIPAANIVVEPVGRDTAAAVGLAAALVGARDPQGVFAVLPADHVIHDDKAYQTDLAAAFAAAAADDVMVTIGITPTEPATGFGYIQKGDAWKNFGTGRARRPVSRVKRFVEKPKLEVAQQYLASGDYLWNAGMFVWSVPVVNAAFAAHASELDAGLQKIRAALAKKSPLDATLKRIYPKLPRISVDYALLEKSTNVVVLPSSFDWDDVGAWPAVSKHFTPDAAGNVTRGLAIVEQGRNNLVFADQDGGAKSKHLVAVLGADDLIVVHTPDATLVVPKAKAQEIKALLKRVETLKNGAKWL

SEQ ID NO: 51867 - protein, 382 aa, Cryptococcus neoformans var. neoformans B-3501A
MTNPLLAHFQDSFFPPCRVGINGFGRIGRAAFRASLERDDLIVVAINHTAPSIDYLLHAIKYDSTHGTSRHANDLSIKDGALYYKDRRIELFSQRDPLLLDWKSAGVEYVVESTGKMTTVATASAHIKSGARKVVISAPSKDAKTIVVGVNRKDYDSSMSVVSNASCTTNCLAPLAKVLNRAFGIEFGMMTTVHASTSSQPILDGYSKKNRRLGRGVGSNIIPTTTGAATAVQLVLPELAGKFTGVSVRVPVDNVSMVDLTVRLNKPVASKEELFRPIREASTGLSSLGPLANVLCVNDDELVSRDFLGWQHSCIVDSAASVMLNDRVFKIIAWYDNEYGYACRLLDLVRFIHEYDNGKVPTPTPSGVQTPSGVHTPILRSI

SEQ ID NO: 51868 - protein, 376 aa, Dunaliella viridis
MATSMAKSAFTGNMAGLKNFQRVQPARGAVKMEVVAQKKVRVAINGFGRIGRNFLRCWEGRKDSLLDVVCVNDSGGVKQASHLLKYDTTLGKFDADVKAVDDKTISVNGKNIAVVSSRDPTQLPWKAMDIDLVIEGTGVFVDTPGAGKHIQAGAKKVLITAPAKGNDIPTFVVGVNCDGYNHSYPIISNASCTTNCLAPFVKVLHEKFRIVKGTMTTTHSYTGDQRLLDASHRDLRRARAAALNIVPTTTGAAKAVALVLPDLKGKLNGVALRVPTPNVSIVDLVVQVEKKTFAEEVNNAFREAAAGPMSNVLAVADEPLVSADFKGMDQSTAIDSALTMVMGDDMVKVVAWYDNEWGYSQRVVDLAELTAQRWAA

SEQ ID NO: 51869 - protein, 54 aa, Brassica napus
DDVGDIEYCGFDPESGIVKLRLQGAYSGCPSSSVTLKSGIESMLMHYVPEDSTS

SEQ ID NO: 51870 - protein, 362 aa, Eustoma grandiflorum
MGIPVVPRVESLARSGTQEIPKEYVRTKEELTSIADVFAEEKNDEGPQVPMIDIKDIESEDISVRERCRDVLNKAAMEWGVMHLVNHGISSDLIRRVKSAGQAFFDLPVEEKEKYANDQASGNVQGYGSKLANNASGQLEWEDYFFHCIFPEEKRDMTIWPKTPEDYIPSTNEYAKQLRALASKILAVLSLGLGLEPGRLEKEVGGLEELILQRKINYYPKCPQPELALGVEAHTDISALTFILHNMVPGLQLFYEGKWITAKCVPNSIIMHVGDTIEILSNGKYKSILHRGLVNKEKVRISWAVFCEPPKEKIVLKPLPETVSESEPARFPPRTFAEHIKHKLFRKSEETNEDNNLPKGSS

SEQ ID NO: 51871 - protein, 523 aa, Roseovarius nubinhibens ISM
MIQDTHDRLLIIDFGSQVTQLIARRLRELNVYCEIHPYQNVTDAFLAEFAPKAVIFSGGPDSVMRDGSPRPPKSVYDLGVPILGICYGQQVMMHDLGGRVEAGEHATAEFGRAFVTPSEDRIDLLTGWFMDGSGREQVWMSHGDHVAEIAPGFSVYGTSPGAPFAITADEDRKFYAVQFHPEVHHTPNGKTIYENFVRAAGFSGDWTMGAYREEAIRKIREQVGDKQVICGLSGGVDSSVAAVLIHEAIGDQLTCVFVDHGLLRLNEADEVVKMFRDHYNIPLIHADESELFLGELDGVSDPETKRKIIGRLFIDVFQKHANSIDGAEFLAQGTLYPDVIESVSFSGGPSVTIKSHHNVGGLPEKMGLKLVEPLRELFKDEVRALGRELGLPDSFIGRHPFPGPGLAIRCPGEITREKLEILRKADAVYIDQIRKHGLYDDIWQAFVAILPVRTVGVMGDGRTYDFACALRAVTSVDGMTADYYPFSHDFLGETATRIINEVRGINRVTYDVTSKPPGTIEWE

SEQ ID NO: 51872 - protein, 153 aa, Nicotiana benthamiana
MKMIVLRSSDGETFEVEESVALESQTIKHMIEDDCADTSIPLPNVTSKILAKVIEYCKRHVDAASKTEDKAVEDDLKAFDADFVKVDQSTLFDLILAANYLNIKRLLDLTCQTVADMIKGKTPEEIRKTFNIKNDFTPEEEEEVRRENAWAFE

SEQ ID NO: 51873 - protein, 335 aa, Eustoma grandiflorum
MKVQRVQEIASLSKVIDTIPAEYIRSENEQSVISTVHGVVLEVPVVDLSDSDEKKIVGLVSEASKEWGIFQVVNHGIPNEVIRKLQEVGKHFFELPQEEKELIAKPEGSQSIEGYGTRLQKEVDGKKGWVDHLFHKIWPPSSINYQFWPKNPPAYREANEEYAKRLQLVVDNLFKYLSLGLDLEPNSFKDGAGGDDLVYLMKINYYPPCPRPDLALGVVAHTDMSAITVLVPNEVQGLQVYKDGHWYDCKYIPNALIVHIGDQVEIMSNGKYKSVYHRTTVNKEKTRMSWPVFLEPPPDHEVGPIPKLVNEENPAKFKTKKYKDYAYCKLFKLPQ

SEQ ID NO: 51874 - protein, 342 aa, Debaryomyces hansenii CBS767
MMLMPIKNMIGRRSFSSSAFLKSKPRHLVNTIELSNEELASLVGKAEAFKKQVRSGNSVPIEQHQKLLGKLVALLFSKRSTRTRISTEGAAAYFGAQPMFLGKEDIQLGVNESTYDTTKVISSMTSCIFARVNSHQEILDLCEHSSVPIINSLCDMYHPLQAITDILTIKEAFGKTEGLKLAWIGDSNNVINDLAIASLRSGISVAISIPKDIEFDPEVGKAASEIASDKGLSFDIFHEPSKAIDNANVIVTDTWISMGQESEKQAKMLQFDGYQITQNMISQGNASSDWKFMHCLPRHAEEVADDVFYSKNSLVFEEAENRLYAAMAVIEAFVVNKGDLLK

SEQ ID NO: 51875 - protein, 224 aa, Pseudomonas syringae pv. phaseolicola 1448A
MQPFVIAPSILSADFARLGEEVDNVLSSGADFVHFDVMDNHYVPNLTIGPMVCSALRKYGVTAPIDVHLMVSPVDRIIGDFIEAGAIYITFHPEATQHIDRSLQLIREGGCKAGLVFNPATPLNLLEYVMDKVDMILLMSVNPGFGGQKFIPGTLNKLREARALIDASGRDIRLEIDGGVNVNNIREIAAAGADTFVAGSAIFNAPDYREVIEKMRAELAASRA

SEQ ID NO: 51876 - protein, 175 aa, Nicotiana benthamiana
SSDITQLHNFLKQSEELLHSDFGRLLSSLAELDPNTHSLGFLYILEACMSFPAAKEQVNELLVSVVRFINSCAAEQIRLAPDKFISVCKRFKDQIILLEAPIRGVASMLTAVRKLQSSSEQLTTLHPDFLLLCVLAKCYKTGITVLEDDIYEIDQPRDFFLYCYYGGMVCIGQKQ

SEQ ID NO: 51877 - protein, 404 aa, Coprinopsis cinerea okayama7#130
MISAFFIFNQKGEVVSNSDVRSPIITLGSTSFFHVRINNLYVVAVTKTNANAALIFEFCYRFINICKAYFGKIDEESVKNNFTLVYEIIDEICDFGFPQNSEIDALKAYLTTESVVSQGATPDESSKITVQATGAISWRRPDVKYKKNEAFVDVIETVNLSMSAKGTILRADVDGHILMRAYLSGTPECKFGLNDKLVIDKGGGGGGGGDAVELDDCRFHQCVRLNEFDASRTISFIPPDGEFELMKYRSTSNVKLPIKVIPTVTELGTMQVSYNVVVKANFNSKLAATNVVLRIPTPLNTASVDCKVGTGKAKYVPAENVVVWKIPRMQGGQECAFIATATLASVTNRQVWARPPIDVDFQVLMFTSSGLIVRFLKVFEKSNYQSVKWVRYLTKASGTYQIRF

SEQ ID NO: 51878 - protein, 401 aa, Corynebacterium diphtheriae NCTC 13129
MRIGVFGAGYLGITHAACMSHLGHEVVAVDTDAARVAELLAGRLPISEPGLADLLAANSVEWTDDPQRARDCDLYFVCVGTPSTDGPSAQARLDVSAVVAAVGTIATLAPHPVVVGKSTVPVGTSIRLLQQFPQIRLLWNPEFLREGHAVADTLHPDRIVIGGADPQPLLRVYEGINAPVITTDLATAELAKSAANAFLATKLSFINGLSELASATGADIGTITRAMGLDPRIGSQYLSAGLGYGGGCLPKDVRGLAASARDYQASHFAELLSIIDATNLRQRERTCELVANLCTPGARIDVWGATFKEGSDDVRDSPGLAVAHALKTAGFRVRVVDPLVGHWPPELQEPEAIVVATAWSEFSRVVPEPRLAHGCGGVVVDARGVLNRSAWVAAGWTYRNL

SEQ ID NO: 51879 - protein, 181 aa, Arabidopsis thaliana
  misc_feature (10)..(10): Xaa can be any naturally occurring amino acid
  misc_feature (144)..(144): Xaa can be any naturally occurring amino acid
MAASMLSSFXFVTSPAQATMAGPFTDMKSFAFFPDTRKANNDITFITNNGGRINFLKAWPPFEKKTVGTLYYLPDLTDVELAKEVDYLLRNKRIPCVEFHLEHGFVYREHRNTTGYYDGRYWTMRKLTLIGCTDYAQVLKEVEXCKKDYPGALIMIIGINNTRHVQSITIIAYKRSSFTDA

SEQ ID NO: 51880 - protein, 434 aa, unidentified eubacterium SCB49
MATITVEKSKKVKKVPLKGMMDNVLEQFNSAADQIDIHPSIRKILSITNNEIIVNFPVKMDNGDVEIFTGYRVQHNNALGPYKGGLRYHPTVDIDAARALAMWMTWKTSLAGLPYGGGKGGIKLDPSKYSQAELERITRRFTFALADNIGPEHDIPAPDVNTNSQTMAWIADTYMSTRPPAERSANQHVVTGKPDGSGGLEGRDRATGYGVYLNIKFWAERKNVNLKDKKFIVQGFGNVGYWAAHFLEKDGAKMVAVQDAYGSIENPEGIVIEDLFNYSKSNTGSIVDYPQAKKINKEDFFSTECDICIPAALGNQITKENAGKIKATLIAEGANGPTNVEGENILLERGITIIPDILCNSGGVVASYFEWLQNRNGELWQLDEVIARLDKKMKETFNKVYEYSESEAMDFRTAAFCIAIKRVERAYVQRGIFP

SEQ ID NO: 51881 - protein, 400 aa, Campylobacter jejuni subsp. jejuni NCTC 11168
MSDIISIKDIDLAKKKVFIRCDFNVPQDDFLNITDDRRIRSAIPTIRYCLDNGCSVILASHLGRPKEISSKYSLEPVAKRLARLLDKEIVMAKDVIGEDAKTKAMNLKAGEILLLENLRFEKGETKNDENLAKELASMVQVYINDAFGVCHRAHSSVEAITKFFDEKHKGAGFLLQKEIDFASNLIKHPARPFVAVVGGSKVSGKLQALTNLLPKVDKLIIGGGMAFTFLKALGYDIGNSLLEEELLEEANKILTKGKNLGVKIYLPVDVVAAPACSQDVPMKFVPAQEIPNGWMGLDIGPASVRLFKEVISDAQTIWWNGPMGVFEIDKFSKGSIKMSHYISEGHATSVVGGGDTADVVARAGDADEMTFISTGGGASLELIEGKELPGVKALRSKENE

SEQ ID NO: 51882 - protein, 165 aa, Nitrosomonas europaea ATCC 19718
  misc_feature (3)..(3): Xaa can be any naturally occurring amino acid
  misc_feature (11)..(11): Xaa can be any naturally occurring amino acid
  misc_feature (48)..(48): Xaa can be any naturally occurring amino acid
  misc_feature (89)..(89): Xaa can be any naturally occurring amino acid
  misc_feature (103)..(103): Xaa can be any naturally occurring amino acid
GHXRHIISLLXENEAGALSRVAGLFSARGYNIESLSVAPTEDPTLSRXTLVTNGPDEIVEQITKQLNKLIEVVKLIDLSSEGYVERELXLVKVRAVGKDREEXKRLADIFRGNIIDVTNELYTIELTGTRSKLDGFLQAVDCNLILEIARTGVSGLSRGERVLKL

SEQ ID NO: 51883 - protein, 423 aa, Kluyveromyces lactis NRRL Y-1140
MRVIRQLHTSKRLLQSLVDKQKYQATTYARPNHLVLTRGKNAILYDDVNNKEYIDFTAGIAVTALGHANPEVAEIMYKQSKKLIHSSNLYYNEECLKLSENLVEATKSFGGQYDASRVFLCNSGTEANEAALKFAKRYGILKSPSKQGIIAFQNSFHGRTMGALSVTSNPKYREPFGSLIPGVEFLNINDELTKLDQQVSSLKEKTAGLIVEPIQGEGGVFPIPLDTLVGLKKICEDHDIIVIYDEIQCGLGRSGKLWAHSYLPKEAHPDIFTTAKALGNGFPIAATVTNDKVNDILKVGDHGTTYGGNPLGSAVGNYVVNVIAEQKFLDEVNKKGEIITNRLRKLQERFPEHIKDIRGKGLMIGCDFDEAPAKIVDAARDSGLLIITAGKTTVRFVPALTIEDNLLEKGLNIFEKAVEKVYS

SEQ ID NO: 51884 - protein, 332 aa, Campylobacter jejuni subsp. jejuni NCTC 11168
MAVKVAINGFGRIGRCVARIILERNDIELVAINDTTDIELTKYLFKYDTVHGEFKGSVDSEGDDLVVNGKKIKVFKSRNVKDLDFAKHGAQIVLECTGAHLTMAKCQEFIDMGVQKVIMSAPAKDDTPTYVLGVNSELYKGESIISNASCTTNCLGPVCRVLQDNFGIEKGLMTTIHAYTNGQSIIDAKAKDKRRSRAAAQNIIPTSTGAAKAMKLVMPELNGKLHGQSMRVPVIDVSSVDLTAQLSRKVSKDEINEAFRKAAATNLKGILMVDDDERVSSDFITCSYGAIVASDLTQVIADDFIKVIAWYDNEWGYSSRLVDMAVYIANKA

SEQ ID NO: 51885 - protein, 447 aa, Oryza sativa Japonica Group
MPPRQWRPMLASATKCCAAEDAVVAVDGSGGGGGLARCRPARSEFSRRLASFRKLSSMTNSPASSVAGAAEGGKDDGEEGGGGGGGVSGPLQLYSFSFSELRSITHDFSSSYLLGEGGFGAVHKGFVDAGMRPGLLPQPVAVKQLDIAGLQGHREWLAEVIFLGQFRHPHLVKLLGYCCEDEERLLVYEFMPRGSLENHLFKRISATVPWGTRLKIAIGAAKGLAFLHGASTPVIYRDFKASNILLDSEFTAKLSDFGLAKMGPEGSETHVTTRVMGTHGYAAPEYVMTGHLNIKSDVYSYGVVLLELLTGRRAMEHVRGRSLHADQVVKIVDWTRPYLGSSRRLRCIMDPRLAGHYSVKAARAVAHLAVQCTSPQPRDRPRMAAVVDALERLQGFKDMAVTVGLWPTNAPVAGRNAISAKIRAEVRGAGSGGGAASRRRSASAKLP

SEQ ID NO: 51886 - protein, 383 aa, Lactobacillus reuteri
MAEQDYYDILGVSKDASEKDIKRAYRRLAAKYHPDVNHEPGAEEKFKKINEAYETLSDSQKRAQYDQFGSAGPQGAGGQGFGGFGGGQAYSNFGGGFDDIFSQFFGGGGRTRRDPTAPRQGRDLQYAMTLDFMDAVFGKTTTIKYNRDAECKTCHGTGAKPGKSPITCPRCHGAGVITSVRQTPLGNMQTQTTCPECNGTGKIIKPEDRCDACHGAGHVHERHELEVKVPAGVDDGQQMRLQHQGDAGENGGPAGDLYIVFRVTPSREFRRDGSTIYVDRDISFAQAALGDEVKIKTVHGDVNLKIPAGTQSETNFRLRGKGVPHLNGNGNGDEHVTVHVKTPKSLNKRQREAMLAFAAASGEDVKGVKKTVLDKLRDAFEDK

SEQ ID NO: 51887 - protein, 107 aa, Prochlorococcus marinus str. MIT 9313
MSNAAAVTDASFEQDVLQSDVPVLVDFWAPWCGPCRMVAPIVDEIAKEFESKIKVFKLNTDENPNVASQYGIRSIPTLMVFKGGQKVDTVVGAVPKATLSGTISKYL

SEQ ID NO: 51888 - protein, 131 aa, Glycine max
  misc_feature (86)..(86): Xaa can be any naturally occurring amino acid
MSPSRAVKWWEEWQLRILVLASIFIQYILFFSDDVRRVPGLRRFRVLVWIAYGNSDAVAIFGLATLFNRHRHTCAEEGSNLEVLWXVPVLLIRLGGPADNICPTASKNNQPIENRHYGKPLNVLKSPVFAL

SEQ ID NO: 51889 - protein, 197 aa, Rhodospirillum rubrum ATCC 11170
MLTLPNILTLLRILIIPLVVVLFYVDGEGYRWANCALFAVAAITDFFDGWLARRSNQVSRLGRFLDPIADKLLVAAVLMLLVGFGRMSPWSYPAAVVILMREILVSGLREFLAEIRVGMPVTKLAKWKTTVQLIALPVLIVGDTPLIPLPITLIGEGLLWVAAVMTIITGYDYLRVGLRHMGPEHDAPPSQAHNTPR

SEQ ID NO: 51890 - protein, 453 aa, Campylobacter jejuni subsp. jejuni NCTC 11168
MSECPFFPKPYKNKASTLLTFLLKRRSWLDGLYERSYKMQTGYVKMPNFDLYVINDTKEVKRMMVDEVREFPKSAFLHELLSPLLGESIFTTNGEVWKKQRELLRPSFEMTRINKVFNLMSEAVADMMDRFSKYPNHAVIEVDEAMTFITADVIFRTIMSSKLDEEKGKKILNAFVTFQEQSVHTAMRRMFRFPKWLSYVLGDCKRAKAGDVIRQVLSDIIKPRYDMADNAEFEDILGSLLLVVDADTNKRFSFEEILDQVAMLFLAGHETTASSLTWTLYLLSLYPKEQEKAYEEITQVLQGGVIEISHLRQFKYLTNIFKESLRLYPPVGFFAREAKKDTQVRDKLIKKGSGVVIAPWLIHRHEEFWTNPHGFNPSRFEGEYKKDAYLPFGVGERICIGQGFAMQEAILILANILKTYKLELEEGFVPDVVGRLTVRSANGMRIKFSKRKL

SEQ ID NO: 51891 - protein, 287 aa, Arabidopsis thaliana
MEGKEEDVRVGANKFPERQPIGTSVQSTDKDYKEPPPASLFEPGELSSWSFYRAGIAEFIATFLFLYITVLTVMGVKRAPNMCASVGIQGIAWAFGGMIFALVYCTAGISGGHINPAVTFGLFLARKLSLTRAVFYMIMQCLGAICGAGVVKGFQPTPYQTLGGGANTGAHGYTKGSGLGAEIIGTFVLVYTVFSATDDKRSVRDSHVPILAPLPIGFAVFLVHLATIPITGTGINPARSLGAAIIYNKDHSWDDHWIFWVGPFIGAALAALYHQIVIRAIPFKSKS

SEQ ID NO: 51892 - protein, 193 aa, Arabidopsis thaliana
VYCTAGISGGHINPAVTFGLFLARKVSLVRALGYMIAQCLGAICGVGFVKAFMKTPYNTLGGGANTVADGYSKGTALGAEIIGTFVLVYTVFSATDPKRSARDSHIPVVAPLPIGFAVFMVHLATIPITGTGINPARSFGAAVIYNNEKAWDDQWIFWVGPFLGALAAAAYHQYILRASAIKALGSFRSNATN

SEQ ID NO: 51893 - protein, 356 aa, Oryza sativa Japonica Group
MENMRSENFNQGVSMEGVKHAPEMANTNRRALRDIKNIIGAPHQHMAVSKRVSLMGLNFLTCFSKPAAKNQAGHRPMTRKFAATLANQPSSAPLIYMQKLEMAPIGSERQKRTADSAFHGPADMECTKITSDDLPLPMMSEMDEVMGSELKEIEMEDIEEAAPDIDSCDANNSLAVVEYVDEIYSFYRRSEVHYKLELLDETLFLTVNIIDRFLARENVVRKKLQLVGVTAMLLACKYEEVSVPVVEDLILICDRAYTRTDILEMERMIVNTLQFDMSVPTPYCFMRRFLKAAQSDKKVGQKHTGASIFVLIYSSFAMECSKMMVELHQKAGHGKLTGVHRKYSTFRLLPIKSVGT

SEQ ID NO: 51894 - protein, 211 aa, Triticum aestivum
PFVKAFGMTARECNGKDMRLNRVFNEAMTHHSGIITGKFLELYTGFDGIGTLVDVGGSVGTLMHAIVSKYPSIRGINFDLPFVIAHAPDYPGVQHVAGDMFESVPSGDAIVIKWVLNGLSDQQCATLLKNCYDALPAHGKVVNLQCILPVHPDATHSAQEVISVDVSMLAYSVGGKERYLRDFEKLAKGAGFAGVEATYIYANFWAIEYTK

SEQ ID NO: 51895 - protein, 638 aa, Triticum aestivum
ARSRDGLRHAIFSDTIEYSSYASNALGALPYGRPAGGRASDFDGRPGRSPATPSAPSPSPPATPSPPSDTPSPPSPEGRAPPSPGGGGRSPFTPGHRGPSPKSPPHSSGGGGGGSGVSTSVVVGVAVGGFVLLLLATFVCLCCLRKKRRRQPPPLHYGYPPPPPPQYKEDHYGATYQNWQNNAPPPPPDHVVKMHPSPPPAYANRPPQAPPPPPPPMINSSGGSVSNYSGGEILPPPSPGTALGFSNSKSTFTYDELVRATDGFSDANLLGQGGFGYVHKGVLPNGKEIAVKQLKLGSGQGEREFQAEVEIISRVHHKHLVSLVGYCISGGKRLLVYEFVTNNTLEFHLHGKGRPTLEWPIRLRIALGAAKGLAYIHEDCHPKIIHRDIKSSNILLDFKFEAKVADFGLAKFTSDNNTHVSTRVMGTFGYLAPEYASSGKLTEKSDVFSFGVMLLELITGRRPVDSTQTYMDDSLVDWARPLLMRALEDGNYDELVDARLGKDFNPNEIARMIACAAACVRHSARRRPRMSQVVRALEGDVSLEDLNEGVRPGHSRFFGSYSSSDYDSGQYNEDMKKFKKMAFTTNDYTSSQYSAPTSEYGQIPSASSSEGQQTQEIETGTMKKGGHSGYSSGYSGPS

SEQ ID NO: 51896 - protein, 132 aa, Schizosaccharomyces pombe
YLIALTVSLLGVQLTWSVELGYGTPYLFSLGLRKEWTSIIWIAGPLTGILIQPIAGILSDRVNSRIGRRRPFMLCASLLGTFSLFLMGWAPDICLFIFSNEVLMKRVTIVLATISIYLLDVAVNVVMASTRS

SEQ ID NO: 51897 - protein, 657 aa, Arabidopsis thaliana
MEETRGISDPENGSSSYGGKPPNPLSFSSSSAAAAVYRQTFDGERSLAPCNKRSLVRHSSLVKTMVSDISVENEFTIEKNKSEFVPATRSGAWSDIGSRSSMEDAYLCVDNFMDSFGLLNSEAGPSAFYGVFDGHGGKHAAEFACHHIPRYIVEDQEFPSEINKVLSSAFLQTDTAFLEACSLDGSLASGTTALAAILFGRSLVVANAGDCRAVLSRQGKAIEMSRDHKPMSSKERRRIEASGGHVFDGYLNGQLNVARALGDFHMEGMKKKKDGSDCGPLIAEPELMTTKLTEEDEFLIIGCDGVWDVFMSQNAVDFARRRLQEHNDPVMCSKELVEEALKRKSADNVTAVVVCLQPQPPPNLVAPRMTYVRYAVNSRVGFDHIATYRFADAGKVSLVMRLNCPGYSNEEQGPIVRSKWAIRIAYEAYTMVIEFTRIHQRVIWSCSISDRTGSVNHLLLRKTEKETNQIHSYQRDREKMSGVAIHASSWGAALVRISPYTFSAIGIAISIGVSVLGAAWGIYITGSSLIGAAIEAPRITSKNLISVIFCEAVAIYGVIVAIILQTKLESVPSSKMYDAESLRAGYAIFASGIIVGFANLVCGLCVGIIGSSCALSDAQNSTLFVKILVIEIFGSALGLFGVIVGIIMSAQATWPTK

SEQ ID NO: 51898 - protein, 464 aa, Triticum aestivum
FKISADRYMKEKSSIAVIGLSVHTAPVDMREKLAVAEELWPRAISELTSLNHIEEAAVLSTCNRMEIYVVALSWNRGIREVVDWMSKKSGIPASELREHLFMLRDSDATRHLFEVSAGLDSLVLGEGQILAQVKQVVRNGQNSGGLGKNIDRMFKDAITAGKRVRCETNISAGAVSVSSAAVELAMMKLPKSECLSARMLLIGAGKMGKLVVKHLIAKGCKKVVVVNRSVERVDAIRQEMKDIEIVYRPLTEMYEAAAEADVVFTSTASESLLFTKEHAEALPPISLAVGGVRLFVDISVPRNVGACVSEVEHARVYNVDDLKEVVEANKEDRVRKAMEAQTIITQELKRFEAWRDSLETVPTIKKLRSYADRIRASELEKCLQKIGEDNLNKKMRRSIEELSTGIVNKLLHGPLQHLRCDGSDSRTLDETLENMHALNRMFNLDTEKAVLEQKIKAKVEKTQS

SEQ ID NO: 51899 - protein, 154 aa, Haloarcula sinaiiensis
MSEHERTFVMVKPDGVQRGLIGDIVSRFEDCGLKMVGGKFMQIDQELAEEHYGEHEDKPFFDGLVDFITSGPVFAMVWEGQDATRQVRTMMGETDPAESAPGTIRGDYGLDLGRNVIHGSDHEDEGANEREIELFFDEDELVDWDQIDSSWLYE

SEQ ID NO: 51900 - protein, 154 aa, Haloarcula quadrata
MSEHERTFVMVKPDGVQRGLIGDIVSRFEDRGLKMVGGKFMQIDQELAEEHYGEHEDKPFFDGLVDFITSGPVFAMVWEGQDATRQVRTMMGETDPAESAPGTIRGDYGLDLGRNVIHGSDHEDEGANEREIELFFDEDELVDWDQIDSSWLYE

SEQ ID NO: 51901 - protein, 804 aa, Oryza sativa Japonica Group
MALLVSFVVFVLAAAHGAVGFLSIDCGLDGNYSSGYKDPDEGITYVPDGTYVDAGENHRVAADRESGRLRSDLTVRSFPSGVRNCYALPTVAGAKYLVRVIAFYGNYDGKNSSSLQFDLYLGVNYWNTVSADGDEVYEAMFVAWASWAPVCLVNTGGGTPFVSSVNLRTLGSGVYHPVLAANQSMCLFDRRNMGSNVSILRYPDDPYDRYWWKMRSDPTWKNLSTASTIEQNDNFVVPLPVMQTAIEASNNDTIIKVTRKDKTAHKCMIFAYLADFQNSQLRQFNITLSDTKPLLYSPPYLSAGIVDISDWDMPNNGMYTITLEPTSASKLPPMLNAFEIYTLIPSDNPMTFPRDSWDGVKCSNPSDNTSRIISLDLSNSNLHGPISNNFTLFTALEHLNLAGNQLNGPIPDSLCRKNNTGTFLLSFDSDRDTCNKSIPGINPSPPKSKLVFVGIVSADVPHSEPELEIAPASRKYHEDGLQRVENRRFTYKELEKITNKFSQCIGQGGFGLVYYGCLEDGTEVAVKMRSELSSHGLDEFLAEVQSLTKVHHRNLVSLIGYCWEMDHLALVYEYMSQGTLYDHLRGNNGARETLSWRTRVRVVVEAAQGLDYLHKGCSLPIIHRDVKTQNILLGQNLQAKIADFGLCKTYLSDTQTHISVAPAGSAGYMDPEYYHTGRLTESSDVYSFGVVLLEIVTGESPMLPGLGHVVQRVKKKIDAGNISLVADARLIGAYDVSSMWKVVDIALLCTADIGAHRPTMAAVVVQLKESLALEEARADSGFKGSIGTLSDTTISTSTFGPSAR

SEQ ID NO: 51902 - protein, 497 aa, Bordetella bronchiseptica RB50
MKTIPHFINGQPYEGRNGRYTQGFNPATGEVSSSIPLASAQDVDTAVAAAAAAFPAWSETPPLKRARILFKFKALLDEHQDELAALITAEHGKVFSDAKGEVTRGIEVVEFACGIPHLLKGQYTDQIGGGIDNWSMRQPLGVVAGITPFNFPMMVPCWMFPVALACGNTFVLKPSERDPSAALRLAELLKEAGLPDGVFNVVQGDKQAVDALIAHPQVEALSFVGSTPIAEYIYAEGTRRGKRVQALGGAKNHMVVMPDADLDQVTDALMGAAYGSAGERCMAISVAVAVGEVADEVVARLAPRVRALVVKDGMQADAEMGPLVTAQHRAKVTGYIEDGQACGATLVVDGRGLQVPGNEGGFFLGGTLFDHVTPAMNIYREEIFGPVLCIVRVPDFAAAVELINAHEFGNGVSCFTSDGGIARAFARQIKVGMVGINVPIPVPMAWHSFGGWKRSLFGDHHAYGEEGVRFYSRYKSVMQRWPDSIGKGAEFTMPVAK

SEQ ID NO: 51903 - protein, 427 aa, Bordetella bronchiseptica RB50
MPFTANRQFKSQPRLLARAEGMYYTSTDGRQILDGTAGLWCVNAGHCRPEIVQAIASQAGEMDYAPGFQLGHPLAFEAATAVASFMPAGIDRVFFTNSGSESVDTALKIALAYHRARGDAQRTRLVGRERGYHGVGFGGISVGGISANRKTFSGALLPAVDHLPHTHSLEHNAFSKGQPAWGEHLADELERIVALHDASTIAAVIVEPMAGSTGVLVPPKGYLQRLREITARHGILLIFDEVITAYGRLGSPTAAEHFGVTPDIITMAKGVSNAAVPAGAVAVKREVHDAIVNGVQGGIEFFHGYTYSAHPLAAAAILATLGIYRRDDLFGRARDLSPAFEKAAHALQGAPHVIDVRNIGLVAGIELASRPDAPGARAAEAFRKCFDSGLMVRYTGDILAVSPPLIIDEAQIGELFEGIGKVLKEIA

SEQ ID NO: 51904 - protein, 523 aa, Microcystis aeruginosa PCC 7806
MSLESATDEVIKQNLEQFLIVLSVSLSVATVSRIFSWFRQIPYTLLLVIVGLGLAFIDIRLVNLSPELILEIFLPPLLFEAAWNTRWRDLKDNWIPVSLFAIVGVIISIFGVGFTLDELTNLPLFTALLVGASLSSTDPVAVVALFRELGASKKLTVLLEGESLFNDGVAVVAFALLVEIPLGASGLSLETTISRIAAFIGIGVAVGCLVGFGISYLTQRLDLPLVEQSLTLVSAYGAYLLTEEFGGSGVIGVVTTGIILGNFGSRISMSPRTRLLVTEFWEFLAFFVNSIVFLLIGDQIRLSSLADNLNLIFITIAAVVAARFLATFALGTVSNALMETKINWREKTVLWWGGLRGSVSIALALSVPVIFPNRQDIIDIVFGVVLFTLLVQGLTIQTFLSRLDLIGDQPIRENYAELLARRVALKRVLDYLSKLDKSPDVAPEFFSYEQHLVKEKLKTVESEIQSLNDSYPQLQLLTMEQLRETLLDIEADTYAEFIRAGRLTSNLSPVLQEILAESKISEQ

SEQ ID NO: 51905 - protein, 355 aa, Arthrospira platensis
MTQNYRITLLSGDGIGPEIMAVAVDVLKAVGKQLDLNFEFKEALMGGVAIDATGEPLPEESLQACRDSDAVLLAAIGGYKWDNLPRPERPETGLLALRAGLGLFANRARLLFCPHVLDASSLKREVVEGVDIMVVRELTGGIYFGQPKGIFETETGKNEGSNTMAYGESEIDRIGRVGFETAKKRQGRLCSVDKANVLDVSQLWRDRIMALAADYPEVELSHLYVDNAAMQLVRWPKQFDTIVTGNLFGDILSDAAAMLTGSIGMLPSASLGASGPGVFEPVHGSAPDIAGQDKANPLAQVLSAAMMLRYGLDEPAASDPVEKAVLKVLDWGYPTGDIMSEGMKAVGCRKWGICY

SEQ ID NO: 51906 - protein, 344 aa, Thermus aquaticus
MRVAVLPGDGIGPEVTEAALRVLKALDEREGLGLTYETFPFGGAAIDGYGEPFPEVTRKGVEAAEAVLLGSVGGPKWDALPRKIRPESGLLALRKSQDLFANLRPAKVFPGLERLSPLKEEIARGVDVLIVRELTGGIYFGEPRGMSEAEAWNTERYSKPEVERVAKVAFEAARKRRRHLTSVDKANVLEVGEFWRKTVEEVHKGYPDVALDHQYVDAMAMHLVKNPARFDVVVTGNIFGDILSDLASVLPGSLGLLPSASLGRGTPVFEPVHGSAPDIAGKGIANPTAAILSAAMMLEHAFGLVELARRVEAAVAKALRETPPPDLGGSAGTQAFTEEVLRHL

SEQ ID NO: 51907 - protein, 348 aa, Coccidioides immitis RS
MASQLPKTMKALQYSKPEEYAIVNIPLPQLRENDVLIKVKACGVCGTDLHIHEGEFLAKFPLVPGHETVGIVAAMGPKVKGFTVGDRVVADNSELCGECFYCRRGEELLCEHFEAHGVTMNGGFAEYCAYPAGRVFKIQNLSDVDATLLEPASCAAHGLDKISPKMGSTVLMFGAGPTGLVLAQMLRLNGGCKVVIAAPEGLKMNLAKSLDAADEYIPLSRQDPSAQFEALKAANPYGFDIVVEATGSVKILEDAINYVRRGGKLVVYGVYANKDRVTWPPSKIFGDEITILGSFSETYKFPAAIDYLDSGKVRVGGIVNKVFKIEQWAECLESMRNKSAIKAAITFD

SEQ ID NO: 51908 - protein, 388 aa, Ashbya gossypii ATCC 10895
MPNADLEIKTINPDLEASQFIIQPPAVQSGDGENVATDESQRGDVSSSVSSQKSTSLPRIKIIGTGGTIASKGSSSSQTAGYHVDLTIQELLEAIPDISNICEIEYEQLCNVDSKDINEEILLKLYSCISESLQRFNGIVITHGTDTMAETAFFIESTIDSGSVPIVFVGSMRPSTSVSADGPMNLYQAICIASNAKSRQRGVLVSLNDQISSGYYIIKTNANTLDSFNVRQGYLGNFVNNEILYYYPPAKPLGCHKFKLPLQPGQTSLNLPKVVIIYSHQSISPILVELAGKRCKGVVIATMGAGTLPEAVNSACMQLTIPVVYSKRSMEGMVPVANLPLPPSDPRSKIIASGYLNPEKSRILLQLCLNQDYSIDLIRQVFRGVYGG

SEQ ID NO: 51909 - protein, 863 aa, Oryza sativa Japonica Group
MALLVLVAVLVFEAAVRADGQTGFLSIDCGLEADDSYPDDLTGITYVPDGHYTDAGENHKVTTVYRNAWWGPDRTLYTVRSFPSAEGQRNCYSLPNDVRSKYLVRLKFLYGNYDGLDSSSLKFNLTLGVKHWDTVSIDTTDGNDGYNVHEAVFVAWASWAPVCLINIGQGTPFMSMVELRPLGILPYPAVMGNVSLSLYVRSNVGSSPDDDKLVRYPDDQYDRFWSTDEAHPLSTNISTQTTIQASTEFAVPSPVLQKAIVPSGNSMKLVFFSDQVDVLLHNHFVILHFADFQNNKSREFTVSIDNGVQSSPYSTPYLKGLSVTGGWSSNSEGKYNFTIAATATSALPPILNAYEVYGRIIHDNPTTFSQDFDAIMAIKYEYGIKKNWMGDPCFPPEFVWDGVKCSDAGDKIMRIISLDLSNSKLNGSISNFFTLFTALKYLNLSCNQLNGTIPDSLLKNNGSIDFSYESDGNMCKTHATPSLSRNTLAVSVVAPVLVLAILVLAYLIWRAKRKLNTSSTDLAMVPELMGAPGHITNHWDHLQKPENRRFTYQELEKFTENFKHLIGHGGFGHVYYGCLEDSTEVAVKMRSKLSSHGLNEFLAEVQSLTKVHHRNLVCLVGYCWEKEHLALVYEYMSRGNLCDYLRGKTGMGEILNWKTRVRVALEAAQGLDYLHKGCNLPIIHGDVKTNNILLGQNFKAKIADFGLSKTYHSDSQTHISAAAAGSMGYIDPEYYTTGRLTESSDVYSFGVVLLEITTGEPPIIPENGHIVQRVKQKIVSGNISSVADAHLGGAYNVSSMWKVVNIAMMCTTDIATQRPKMGDVVVQLKESLDLVEVHGDRGDMENLASDTMSSMSTFGPSAR

SEQ ID NO: 51910 - protein, 261 aa, Herminiimonas arsenicoxydans
MLNTAIKAARRGAAIINRASFDLDRVKVTEKNPNDFVTEVDQAAEQAIIEVLKTAYPDHAILAEESGASANLHDDNENVWIIDPLDGTTNFIHGFPQYCVSIALQQRGQITQAVVYDPTRNDLFTATKGAGAYLNEKRIRVTKRDKIADALIGTGFPCRATDNIDEYQKMFKIMTQNCAGLRSPGSAALDLAYVACGRFDGFFQKGLLPWDMAAGSLLITESGGIMGTFEGESDYLYKGDVLAGTPKVFAQMVSLLSPFAK

SEQ ID NO: 51911 - protein, 449 aa, Herminiimonas arsenicoxydans
MSFTDLGLADGIVRAVTEHGYSIPTPIQAQAIPAVLAGGDLLAGAQTGTGKTAGFTLPILHRLATSGTPHASASAQRPIRALVLTPTRELAAQVEESVRTYSKYLNLNSAVIFGGVGINPQIKLLKHGVDILVATPGRLLDHMQQGTVNLSKVEILVLDEADRMLDMGFIKDIRRVLAVLPKNRQNLLFSATFSNEIKALADGLLNSPAMIEVARRNSTVEVIEQKIHPVDRDKKHPMLAHLIKTNNWSQVLVFTRTKHGANKLVEQLEKDGISGMAIHGNKSQSARTRALSEFKDGSLQVLVATDIAARGIDIDQLPHVVNYDLPNVPEDYVHRIGRTGRAGATGEAVSLVCVDELDMLKDIEKLIKRKLPSEVIVGFEPDLNAKPQPIQRRSNDAPGRRPQGRGNAPAKSAKAPGAKPSGPNGQVRSFGGNANARPAAPHRSGGRGR

SEQ ID NO: 51912 - protein, 372 aa, Chlamydomonas reinhardtii [sequence omitted]

SEQ ID NO: 51913 - protein, 395 aa, Listeria innocua Clip11262
MMKNSIKLKLFPKFTKGYKEGYPLILKERFEKWPKDLQEGDLVELIDTNGQFIARGYHGKQNKGDGWLFTWDKQQQLDEHFLTTVITAAIEKRQFLFADDSTTAFRIFNGEGDGFGGFTADFYDGYLVIQWYSLGVYSFQKMILEIFLSFPEVKGIYEKRRFQEDTKDDFVAGQKATFPLIIKENGINYATYLDDGWMTGIFLDQRDVRRRISEDYAVSKNVLNTFSYTGAFSVAALFGGASKTTSVDVAGRSLSKTKEQLEVNGLDPNSQDIIVEDVFHYFKYALRKKLTFDLVVVDPPSFARTKKVTFRAAKDYPAMLREIIDITAPNGTIIASTNYAGFGMKAFKKLIAEAFQTSDRTYKIVETHSLPADFTVNKNFPEGNYLKVLFLTLDK

SEQ ID NO: 51914 - protein, 234 aa, Brassica napus
MEALTFKGSVMEAILEAKTQKKLFVVYISGEDEEESDKLNKLTWTDASVAESLSKYCVLLHLEAASVDATNFSAIYPYSSVPCIAAIGFSGTQVWKNEGFIAAEDLASSLEKAWLGLHIQETTASIFSAALASQNSEQPTSSPSNVVLPSEEGSTSDTMAASQSTGTSVQPSERKSTVTSGSTKEKNDGTAAIKVKQSAETSNQPASSVQAEKEPRSSCSTKTNDSSTSKIFYR

SEQ ID NO: 51915 - protein, 372 aa, unidentified eubacterium SCB49
MRINIGVLPGDGIGPEVTAQAIKALKAIAGEYNHTFNFKSAAVGAIAIDETGSPLPKATLDLCKASDAILFGAIGHPKYDNDPSAKIRPEQGLLALRKALGLYANIRPVKAYEALVHKSPLKEEIITGADMLIFRELTGGIYFGEKQLSEDGNMASDLCIYTRSEIERITHLAFKAAEGRRKKVTLVDKANVLESSRLWRKIVTEIAAEYKNVTLDFLFVDNAAMQMILNPNQFDIILTENMFGDIISDEASVIGGSIGLLSSASIGGKTGLFEPIHGSFPQATGEGIANPLASILSAAMLLSHFGLTEEAKRIEQAVDKSLELDITTSDINSNGSPVSTEQVGNFIEDFIYFSEDTNLNFKNIHLGQSTII

SEQ ID NO: 51916 - protein, 967 aa, Aspergillus nidulans FGSC A4
MSPPNRKSFATNVAAFVAEHELDGVDFDWEYPGAIDIPGTPPGLETDGPNYYKFLIVMRGQLAKEKSLLIAAPASYWYLKAFPIAQMAKQLDYIVFMAYDLHGEVGSTRFSPVANIRKANGMPVTSMQQRAVRRETAYEVTATGSTLQQQKGVCTDTGGYISNAEIDEIAILGDNVQTWHDGASNSDIMVYNDTQWVADMSRTTKETRRLHWKNYNFAGTIDWAVVLQSYADDEYYDYETGEGGEELLPPLPDDPDCSGSYHDLESIEKDFGTIDELCLGQYILEVLQKNFTSSLAAYDDLMKDGYDGKFKTYAKSVVSASKKVVENFMYENGKSYFSCSSQRPSSVDCRYCEEYDCIPEGNCDNPEVHCETPEYRYRNMTQPCPPDYSLRGQCQTIDARYSQSVYWTLEYPDAFWADLYTETGVAQEDIERKNVRHFPCYLTEKHCENTYWDYNFPVPSEYDEEDVVNPKDVVSEAYNKLKALLPQLSDVVERVKNEKFFGDINELIDAVSMPVLMVSDAIEHMQSIIEIAKEIEEAKAKAILFAFMGAIIFFVPVIGEVMGAVSSLASIGRIVSLLGATGNVGLDVYTILDDPENAPLAIFSLILSPLALMDVVKVGQAARAHIILYDSLNPKIFSRIMFRSSNTFNPNTDIPDLSGKVYVVTGGSAGIGFGICAHLLQHNPAALYLLGKKEEHIQEATEGLKKYGDTSKVHSVQIELEDLKQTDQVAKELASKLDRLDGLICNAGLGSGVFNLTNDGIDSHMQVNHISQFHLSRILLPLLQKTSNSRLVLQSSDLHRAISDVKFESLEELNTDIGPTKLYNRTKLAMVLYIRALAERKGKGQLGFDPKTDTGPWMNATHPGAVSTDQQKQAEDAYGVLGKVGVAIVRPFLKDPVDQGCRPALFAATGEDIVKDAIQGQYIVPDRSPTSPSSEAQNHQLQENLWKLTEKILVDKLGSVPYETQYV

SEQ ID NO: 51917 - protein, 201 aa, Brassica napus
  misc_feature (32)..(32): Xaa can be any naturally occurring amino acid
  misc_feature (53)..(53): Xaa can be any naturally occurring amino acid
MVIATAASSFSLGPSHCHHSYTDDFTSSMPYXRHRSARNRVFDPCASANLSVXLSSRCKVPLFGSAFHVSTGGHDLGLTKGSVAADYSDSVPDSSLYGYHPLEELKPCKRVRQTKLSPAEVARTTVEAYTSAVLVFPGAIHCEPHGQNSWSEFKYVIDDYGDIFFEIPYDGNILEDPGASNPVKAFIGMDVPRYENAWLHE

SEQ ID NO: 51918 - protein, 269 aa, Prunus persica
DWRDFLPYLRWVPNKSLEMKIQRLYTRRSAVMNALIDDRKKGIASGEELNCYTDYLLSEAKTLTSEQIAMLLWETIIETADTTLVTTEWAMYEIAKDSNRQGRLYQEIQNVCGSNKITEEHLSQLPYLSAVFHETLRKHSPAPIVPLRYAHEDTQLGGYYVPAGSEIAINIYGCSMDKNQWESPGEWKPERFLEPKYDPMDLYKTMAFGAGKRVCAGSLQAMLIACTTIGRLVQEFEWKLRDGEEENVDTVGLTTHKLHPMHAILKPRN

SEQ ID NO: 51919 - protein, 310 aa, Mycobacterium leprae TN [sequence omitted]

SEQ ID NO: 51920 - protein, 269 aa, Fragaria grandiflora
DWRDFLPYLRWIPNKTMETKIQRLYTRRKAVMTALINEQKKRIASGEEINCYIDFLLSEGKTLTMDQITMLLWETVIETADTTMVTTEWAMYEIAKNPKQQDRLYQEIQKVCGSEMVAEEHLSKLPYLNAVFHETLRKHSPAALVPLRYAHEDTQLGGYYLPAGTEIAINIYGCNMDKHQWESPEEWKPERFLDPKYDPMDLYKTMSFGAGKGACAGSLQAMLIACPTIGRLVQEFEWKLRAGEEENVDTVGLTTHKRDPMHAILKPRS

SEQ ID NO: 51921 - protein, 176 aa, Xylella fastidiosa Temecula1
MSGLFRGRVMTGLNVRIGQGYDVHAFGPSDHVMLGGVRVPHRCGVLAHSDGDVILHALCDAMLGALGLGDIGQHFPPSDVRWKGADSGVFVRHCNLLLRERDWCVGNVDATAICESPKIAPYVNAMREGIARLLEVQPECVSVKATTSEGLGFIGRGEGLAAQVVVLLYRLNGVVV

SEQ ID NO: 51922 - protein, 279 aa, Bacillus anthracis str. Ames
MKNLQSKAVLNNGVEMPWFGLGVFKVEEGPELVEAVKSAIKAGYRSIDTAAIYGNEKAVGEGIRAGIEATGISREDLFITSKVWNADQGYEETIAAYEESLKKLELDYLDLYLVHWPVEGKYKDTWRALETLYKEKRVRAIGVSNFQVHHLQDVMKDAEIKPMINQVEYHPRLTQKEVQAFCKEQGIQMEAWSPLMQGQLLDNETLQEIAEKHGKTTAQVILRWDLQNGVITIPKSTKEHRIIANADVFNFELTKEDMEKIDALNQNHRVGPDPDNFDF

SEQ ID NO: 51923 - protein, 313 aa, Zea mays
MGEASPSIAKDVTEVTDGCVGRVAAKLESMEPCSSVKDRIGYSMITDAEEKGLITPGVSVLIEPTSGNTGIGLAFMAAAKGYKLTLTMPASMSMERRIILKAFGAELVLTDPLLGMKGAVKKAEEIQAKTPNSYILQQFENPANPKIHYETTGPEIWKATAGKIAGLVSGIGTGGTITGTGRYLREQNPNVKLYGVEPVESAVLNGGKPGPHKIQGIGAGFIPGVLDVDLLDETLQVSSDEAIETAKALALKEGLLVGISSGAAAAAAVRLAKRPENAGKLFVVVFPSFGERYLSSVLFQSIKKEAESMVVEP

SEQ ID NO: 51924 - protein, 411 aa, Zea mays
MEVSSRLQSLLRPFLLCRSRAAGMTLQTLALCSPPPPPRIPSSFLLRTRRLPPPFPHGGPSRLLFHSTFASVSPAPAPAPGRDHLNSKEQGPPPAPLPPPPPEELASEDESYYHEHLLEVAQENQSRVVPVKAFFLCTSIDLRSLQSQNSFNVIPPTSRATNYVVLRYYDVKGDPEGFKSGVIDESHCHYMVVFQYGSIVLFNVSDHEADGYLKIVEKHASGLLPEMRKDDYAVVEKPTLETWMQGGLDYIVLRDLSIDGIRTIGSVLGQSIALDYYIRQVDGMVAEFTDINRGMEKTGTFTMERKKLFQLVGKANSNLADVILKLGLFERSDIAWKNANYAQIWEYLRDEYELTQRFGNLDFKLKFVEHNIRFLQEILQNRKSDFLEWLIIILISVEILISVYNIIQEQM

SEQ ID NO: 51925 - protein, 457 aa, Bordetella bronchiseptica RB50
MAPVPARGVLQRYKHVQTTYNSVAVTRLIGRFILRIDDVKLAVVGLGYVGLPLAVEFGKKRPVIGFDINERRIAALKAGHDHTLEVEDDELAQAAQLSYTAERADLAQANVFIVTVPTPIDEYKQPDLTPLVKASETIGAVLKRGDIVIYESTVYPGATEEDCVPVLERVSGLKFNQDFYAGYSPERINPGDKAHRVNTIKKVTSGSTPEVAELVDQLYNEIITAGTHKASSIRVAEAAKVIENTQRDVNIALINELALIFNKMGIDTEAVLQAAGTKWNFLPFRPGLVGGHCIGVDPYYLTHKAQSIGYHPEIILAGRRLNDSMGGYVVSQLVKAMAKRRIHVEGARVLLMGLTFKENCPDLRNTRVVDIVRELGEYHVDVDVYDPWVDPAEAEHEYGITPVAKPAAGAYDAVILAVSHHQFVEMGAEAIRKFGKAEHILYDLKYVLAPDQADLRL

SEQ ID NO: 51926 - protein, 453 aa, Synechococcus sp. WH 7803
MDQAFDLVVIGAGSGGLAAAKRASAHGARVALVEGDKVGGTCVIRGCVPKKLLVYGSQVSEHLADAPSYGVDVPAATINTAVLLQAVRAEVDRLNALHISLLEKAGVTLVRGWGRFDDDHRIAVSSKPGGDVEHFLKADRVLIAVGGRPHRPSIPGAELGWVSDDMFLLERFPEHVVVVGAGFIACEFACILRGLGIAVTQLVRRDGVLRGFDRELAAAVQEGMVEKGVDLRCSTSPAAIEGSPGDLVVVTDQGERIPAGGVLLATGRQPFLQGLNLEAAGLSSEDRKLAVDADQRTTVPHIFAVGDVTDRICLTPVAVDEGRAFADTEFGGRPRQVNHDLVASAVFSQPELATVGLSEEAAISRLGADAVVIHRARFRSMAQALPKRGPRTLLKLVVEARTDKVLGCHMVGEHAAEVVQMAAIAVGMGATKADFDRTMALHPTVSEEFVTMA

SEQ ID NO: 51927 - protein, 117 aa, Picea sitchensis
METSPKSVTVQVAFELVQAGHRYLDVRTLEEFNAGHVEDAINVPYMFKVGEGMVKNPNFIEEVLSHFTKDDKIVIGCQSGRRSLMAAKDLIVVDFTGVTDVGGGYSTWVQSGLPVKT

SEQ ID NO: 51928 - protein, 351 aa, Oceanicola granulosus HTCC2516
MLDFHRTRCTLAAVAALLPLAAAAQEPQMAEPTQEMQAVLDKLAELGAEPLSTLSVEAARSQPTPADAVAALIEERGIETDPALDAIATTDVMIPGAAGEVPARVFTPDGEGPFPVIVYWHGGGWVIAGIDTYAASARQLAAGTDAVVVSVSYRQAPEHPFPAAHEDAVAAYEWIVENAGQWNGDVDRLAVAGESAGGNLAANVAIAARDNGWIEPDHQLLVYPVAGDDMTTESYIENAEAQPLSKAGMEWFVDKVFTDPAMASDPRLDLVSREDLGGLPPATIINAEIDPLRTEGETYAEHLSEAGVEVTQETYEGVVHEFFGMAAVVPAAEEAMSLAVSELNDAFADAD

SEQ ID NO: 51929 - protein, 137 aa, Catharanthus roseus
MASADVEFRCFVGGLAWATTDQSLSEAFSQYGEVLESKIINDRETGRSRGFGFVTFGDEKSMKDAIEGMNGQTLDGRNVTVNEAQSRGSGGGGGGGGFRGPRREGGGCYGGGGRRNGGYGGNGGGYGGGRRDGGRRW

SEQ ID NO: 51930 - protein, 164 aa, Catharanthus roseus
MASADVEYRCFVGGLAWATTDQSLSEAFSQYGEILESKIINDRETGRSRGFGFVTFKDEQSMRDAIEGMNGQTLDGRNITVNEAQSRGSGGNGGGGFRGPRRDGGGGGGYGGGRRDGGYGGNGGYGGGRREGGYGGGDRGYGGGGGGGSRYSRGGGASDGNWRN

SEQ ID NO: 51931 - protein, 160 aa, Catharanthus roseus
MASADVEFRCFVGGLAWATTDQSLSEAFSQYGEVLESKVINDRETGRSRGFGFVTFGDEKSMKDAIVGMNGQTLDGRNITVNEAQSRGSGGGGGGGGFRGPRREGGGGYGGGGRRDGGYGGNGGGYGGGRRDGGYGGGDRGYGGGDRYSRGGGSDGNWRN

SEQ ID NO: 51932 - protein, 496 aa, Oryza sativa Japonica Group
MARKMLKDEEVEVAVTDGGSYDYDLFVIGAVSGGVRGSRTSASFGAKFAICELPFHPISSDWQGGHGGTCVIRGCVPKKILVYGSSFRGEFEDAKNLGWEINGDINFNWKRLLENKTQEIVRLNGVYQRILGNSGVTMIEGAGSLVDAHTVEVTKPDGSKQRYTAKHILIATGSRAQRVNIPGKELAITSDEALSLEELPKRAVILGGGYIAVEFASIWKGMGAHVDLFYRKELPLRGFDDEMRTVVASNLEGRGIRLHPGTNLSELSKTADGIKVVTDKGEEIIADVVLFATGRTPNSQRLNLEAAGVEVDNIGAIKVDDYSRTSVPNIWAVGDVTNRINLTPVALMEATCFSKTVFGGQPTKPDYRDVPCAVFSIPPLSVVGLSEQQALEEAKSDVLVYTSSFNPMKNSISKRQEKTVMKLVVDSETDKVLGASMCGPDAPEIIQGMAVALKCGATKATFDSTVGIHPSAAEEFVTMRTLTRRVSPSSKPKTNL

SEQ ID NO: 51933 - protein, 318 aa, Ashbya gossypii ATCC 10895
MSSNSIKLLAGNSHPDLAEKVSVRLGVPLSKIGVYHYSNKETSVTIGESIRDEDVYIIQTGTGEQEINDFLMELLIMIHACRSASARKITAVIPNFPYARQDKKDKSRAPITAKLVAKMLETAGCNHVITMDLHASQIQGFFHIPVDNLYAEPNILHYIQHNVDFQNSMLVAPDAGSAKRTSTLSDKLNLNFALIHKERQKANEVSRMVLVGDVADKSCIIVDDMADTCGTLVKATDTLIENGAKEVIAIVTHGIFSGGAREKLRNSKLARIVSTNTVPVDLNLDIYHQIDISAILAEAIRRLHNGESVSYLFNNAVM

SEQ ID NO: 51934 - protein, 486 aa, Bradyrhizobium sp. BTAi1
MNANVKLPAAKGVFIDNKWQPAQSGRTIAMLAPATGQVIASIAAGDAADIDLAVAAARRALEGSWGRLAAVERGRLLSKLGRLVEDHAEELAKLEAADTGKPMKQARADVVAVARYFEYYGGAADKVHGDTIPFLDGFFVTTVYEPLGVTGHIIPWNYPGQMFGRTVAPALAMGNATVIKPAEEACLVPLRLAELAAEAGFPAGAINVVPGLGEEAGAALSAHDGIDFISFTGSPEVGTLVQTAAAKNHIGCTLELGGKSPQIVFADADLEAALTSVAAAIVQNAGQTCSAGSRVLVERTIWDRFLADLTLRFEKITAGTPEMDLDLGPVISAVQKTRIESMLARAESGGARRVASGRIAEGVPSEGFYVAPALYQHVARDSELAREEVFGPVLAAMPFDDEADAIRLANATDFGLVAGVWSGDGSRAMRVARKVRVGQMFVNGYGAGGGIELPFGGMKRSGHGREKGFEALYELAAMKTLIVKHG

SEQ ID NO: 51935 - protein, 252 aa, Glycine max
MPISRIAIGNPSEFGQADALKAALAEFISMLIFVFAGEGSGMAYNKLTDNGSATPAGVVAASLSHAFALFVAVSVGANISGGHVNPAVTFGAFIGGHISLLRGILYWIAQLLGSVVACLLLKFATGGLETSAFSLSPGVGAANALVFEIVMTFGLVYTVYATAVDPKKGNLGIIAPIAIGFIVGANILAGGAFDGASMNPAVSFGPAVVSGTWANHWVYWVGPLIGSAIAAIIYETFFITPNSYEHLPVTDY

SEQ ID NO: 51936 - protein, 324 aa, Streptococcus agalactiae A909
MAEQYADKQIKLFSLTANREIAEKISQASGIPLGKVSSRQFSDGEIMINIEETVRGDDIYIIQSTSFPVNDNLWELLIMIDACKRASANTVNIVVPYFGYSRQDRIAASREPITAKLVANMLVKAGVDRVLTLDLHAVQVQGFFDIPVDNLFTVPLFAEHYNQLGLSGEDVVVVSPKNSGIKRARSLAEYLDSPIAIIDYAQDDSEREEGYIIGEVEGKKAIIIDDILNTGKTFAEAAKILERGGATEIYAVASHGLFAGGAADILESAPIREIIVTDSVLSKERIPSNIKYLTASHLIADAIIRIHERKPLSPLFSYRSDKKD

SEQ ID NO: 51937 - protein, 423 aa, Desulfotalea psychrophila LSv54
MNRKIEIAVIGLGYVGLPLAVEFGKIYPVIGFDHNPVRISELQAGNDITMELTAEELALGQQLSFSADAQDLGRCNVYIITVPTPIDKNKKPDLGPLLNASQEVGKVLQEGDVVIYESTVYPGATEEDCVPVLESVSDLTFNRDFFVGYSPERVNPGDKKHRVTTIQKVTSGSTSETADFVDSLYKKIIIAGTHRASSIKVAEAAKVIENTQRDVNIALVNELALIFNRMEIDTEEVLEAAGTKWNFLPFRPGLVGGHCIGVDPYYLTHKAQELGYHPEIILAGRRINDGVGSYVAAELVKAMLKKKCPMGSARVLIMGLSFKENCPDIRNSKVIDIIKELQSFGIEVDAYDPWVQRSQAERAYGISPIEAPAPKSYDGIVLAVGHRDFAQMGAEAIHALGKTPHVLYDIKCLLPSDQVDLRL

SEQ ID NO: 51938 - protein, 427 aa, Mycobacterium leprae TN
MSAEPSRNPRTPPVSAVDIDGAAKRIAPVVTPTPLQLSDRLSAITGAAVYLKREDLQTVRSYKLRGAYNLLVQLTDEEIAAGVVCSSAGNHAQGVAYACRSLGVHGRVYVPAKTPKQKWDRIRYHGGAFIELIVGRSTYDLAAAAAVDDIERTGATLVPPYDDVRVIAGQGTIAVELLEQLNTEPDLVVVPVGGGGCIAGMTTYLAERTANTAVLGVEPAGAAAMMAALAAGEPVTLDYVDQFVDGAAVNRVGTLPYAALTAAGDMVSITTVDEGAVCTAMLDLYQNEGIIAEPAGALSVAGLLETDIEPGSTVVCLISGGNNDVLRYGEVLERSLIHLGLKHYFLVDFPQKPGALRRFLDEVLGPNDDITLFEYVKRNNRETGEALVGIQLGSAVDLDVLLARMQGTEMHVETLQPGSPAYRYLLL

SEQ ID NO: 51939 - protein, 174 aa, Herminiimonas arsenicoxydans
MAIYQLGEHAPDIDASAYITDSATIIGRVTIKANSSVWFQVTVRGDNEDITIGENCNLQEGAVLHADPGFPLTLGDNVSVGHQAMVHGCTVGAGSLIGIQAIILNGAKIGRNCLVGAGALVTEGKEFPDNSLIIGAPAKAIRTLNENDVANLQRIADSYVARSRDFKNTLKKIG

SEQ ID NO: 51940 - protein, 124 aa, Triticum aestivum
  misc_feature (66)..(66): Xaa can be any naturally occurring amino acid
  misc_feature (91)..(91): Xaa can be any naturally occurring amino acid
PGALQYLSGVILFEETLYQSTKGGKPFVDILKAGNVLPGIKVDKGTIELAGTNGETTTQGFDDLGXRCAKYYEAGCRSAKWRASSKIRRTXHPQSPSDQNVKGLVPIHICQENGLGAIVGPESC

SEQ ID NO: 51941 - protein, 195 aa, Brassica napus
  misc_feature (77)..(77): Xaa can be any naturally occurring amino acid
MEDIQEEENGTDEEVLGSSLTMEKVAAAKQYIENHYKAQNKNIQERKERRWILERKLASSGVPKEEQINMIKDLERXETEFMRLKRNKISVDDFELLTIIGRGAFGEVRLCREKKSGNIYAMKKLKKSEMVMKGQVEHVRAERNLLAEVASHYIVKLYYSFQDAEYLYLIMEYLPGGDMMTLLMREDTLREDVAR

SEQ ID NO: 51942 - protein, 436 aa, Mycobacterium leprae TN
MSGATSGLTPEQIGAIDAAHLWHPYSTIGAATGVIPPVVAVAAHGAWLTLIRDGKPIEALDAMSSWWTAIHGHGHSVLDAALTTQLGAMNHVMFGGLTHEPAARLAQLLVDITPAGLETVFFSDSGSVSVQVAVKMALQYWRSRGQPAKRRLMTWRGGYHGDTLTPMSICDPDGGMHSLWTDILARQVFAPQVPRDYDPAYSKAFETQLAQHTPELAAVVVEPVVQGAGGMRFHDPRYLCDVRDICRRHDVLLIFDEIATGFGRTGELFAADHCGVSPDIMCVGKALTGGYLSLAATLCTTDIAHAISVGAAGALMHGPTFMANPLACAVSVASVEVLLGQDWRSRVAEISAGLTAGLEAAQGLPGVIDVRVCGAIGVIECDRSVDLAVATPAALDRRVWLRPFRNLVYAMPPYICPPAEIAQITSAMVEVAGLVG

SEQ ID NO: 51943 - protein, 207 aa, Glycine max
MGYWKSKVLPKIKKVFEKNSTKKAAAAEATKSFDESKEEYNKAFEEKKTELQTKVVEIYEASSTEIKSLVKEPKEAGLKKNSTEVQKFLEELVKIDFPGSKAASEASSKFGPALASGSVFFVFEKVSTFIVTEEKEVEAPPAVETKTEEETSSVVKERETVVEEEKKEEEKPQADETSDEKKVEEKQAETAAKEEEKPAEPAEPPKP

SEQ ID NO: 51944 - protein, 285 aa, Yarrowia lipolytica CLIB122
IITTRLITPSPPSLFISTTQHKMLRNAVRLMNRAQRPAVRLALTRQFTQPALRPQIAAGKLPSLHRTMFIQTASTPNEDALKFLPSVQILPEGHTVEFTSGREAHSSPLAKKLFGVDGVRSVMFGSDFITVEKAQDTHWNTLKPEVFSILTEHITAGAPIVMEGTTAAEDTAPCDDDSEVVSMIKELIETRIRPAIQEDGGDIAFRGFDEDTGVVHLKLLGACRSCDSSAVTLKNGIESMLMHYVEEVTGVEQFLDPEEKVSLEEFEKLEKRLAEEKGEEVPPSL

SEQ ID NO: 51945 - protein, 232 aa, Microcystis aeruginosa PCC 7806
MSNQSSPNSTEIQAIFDQIAPEYDRLNQELSLGLHHIWKLMTVKWCQPEKGDFALDVCCGSGDLTNLLSKQVGKTGKVIGLDFSPQQLKIARQRFSATNINWMEGDALNLPFADSSFDCATIGYGLRNVVDIAQCLGELYRVLKPGAKAAILDFHQPTQTIAKLFQNWYLDHIVVPAAERYGLTDQYAYISPSIDRFPQGPEQVKLGYQSGFSSAVHYPLLAGLMGVLVLKK

SEQ ID NO: 51946 - protein, 632 aa, Roseovarius nubinhibens ISM
MAVETAVAEGLSPVMAFALVGGIGVGAQWLAWRLRMPAIVLMLGAGLVIGPLLGLFDPGRDIGPLMQPMISIAVAIILFEGGLTLNFHHLRSAAEGVRRLVVVGAPLGWLLSTLALRYVAGLSWEASLVFGGIMIVTGPTVIAPLLRQARLPRRPAQLLHWEAIVNDPIGALAAVLAFEMILVMRATETMGDAVLDLVLGISLATALGIAGGWGVVRAFRRELVPQYMKVPLLFAMVLGVFALSDGMLHESGLLAVTVMGLWIANAELPSYDELRRFKEHATILLVSGVFVVLAASLKPETLMALDWRTGAFVVVVILVVRPATVLVSFLGTKLPMNERLLVGFTGPRGVVLVAVAGLFAQRLYADGVEDAARLTPIAFALVAATVILHGFTMSPMARALGLSAAQVPGVLIAGGSRFAASFGLALKRLEVPVLVADSNRTRLRSVREAGLPIFVGNILSEAAEHGVEFISYGRIVALSDNDALNTLITTDLAPEFGHENVYQLKPAKQEQRRHAMPVTLGGRSYCDGLSYLEIGRRMGEGWEVQVLEWGLDDGPDLESWRAANPDAVVLAEVKPGRDIRLIAEEMEPNGTAGWHLVYFAPMAEEASDAASEEASEAPAEPTPADAVKPSSD

SEQ ID NO: 51947 - protein, 264 aa, Streptococcus equi subsp. zooepidemicus
MTKVRKAIIPAAGLGTRFLPATKALAKEMLPIVDKPTIQFIVEEALKAGIEEILVVTGKAKRSIEDHFDSNFELEYNLQAKGKTELLKLVDETTAINLHFIRQSHPRGLGDAVLQAKAFVGNEPFVVMLGDDLMDITNPSAKPLTKQLIEDYDCTHASTIAVMRVPHEEVSNYGVIAPQGKAVKGLYSVETFVEKPSPDEAPSDLAIIGRYLLTPEIFAILENQAPGAGNEVQLTDAIDKLNKTQRVFAREFKGERYDVGDKFG

SEQ ID NO: 51948 - protein, 121 aa, Hyphomonas neptunium ATCC 15444
MKTEIIIRNLRIHGYHGLKEAEKALGQIFEVDITCDMHTDVPPRDVMEDTVCYGEICDLVVSVSENEVFNLIETLAERIASAIFASFPPIQKVRVEIRKPRAPIRHIVNHVGIAIERDRHG

SEQ ID NO: 51949 - protein, 228 aa, Pseudomonas syringae pv. phaseolicola 1448A
MSTIAANISTLEQRIRDAALAANREPASVGLLAVSKTKPAGDLREAYTAGLRNFGENYLQEALGKQLELSDLPLCWHFIGPIQSNKTRAIAENFAWVHSVDRLKIAQRLSEQRPEALEPLNICIQVNVSGEASKSGCTPQDLPTLAAAIIALPRLKLRGLMAIPEPTDDPAAQHASFAAVRTLQEQLNLALDTLSMGMSHDLEAAIAQGATWVRIGTALFGARDYGQP

SEQ ID NO: 51950 - protein, 802 aa, Arabidopsis thaliana
MMMDEDVEQATLVSYSDKPRTFPDMRSKTYSPLIIRILRNLNVRALSVLLLLSFGGIFYMGARTSPIIVFVFVVCIISFMLSVYLTKWVLAKDEGPPEMVQISDAIRDGAEGFLRTQYGTISKMAFLLAFVILCIYLFRNLTPQQEASGLGRTMSAYITVAAFLLGALCSGIAGYVGMWVSVRANVRVSSAARRSAREALQIAVRAGGFSALVVVGMAVIGIAILYSTFYVWLDVDSPGSMKVTDLPLLLVGYGFGASFVALFAQLGGGIYTKGADVGADLVGKVEHGIPEDDPRNPAVIADLVGDNVGDCAARGADLFESIAAEIISAMILGGTMAQKCKIEDPSGFILFPLVVHSFDLVISSIGILSIKGTRNASVKSPVEDPMVVLQKGYSLTIILAVLTFGASTRWLLYTEQAPSAWLNFFMCGLVGIITAYVFVWISRYYTDYKYEPVRTLALASSTGHGTNIIAGVSLGLESTALPVLVISVAIISAFWLGNTSGLIDEKGNPTGGLFGTAVATMGMLSTAAYVLTMDMFGPIADNAGGIVEMSQQPESVREITDVLDAVGNTTKATTKGFAIGSAALASFLLFSAYMDEVSAFANVSFKEVDIAIPEVFIGGLLGAMLIFLFSAWACAAVGRTAQEVVNEVRRQFIERPGIMDYKEKPDYGRCVAIVASSALREMIKPGALAIISPIAVGFVFRILGYYTGQPLLGAKVVAAMLMFATVCGILMALFLNTAGGAWDNAKKYIETGALGGKGSDSHKAAVTGDTVGDPFKDTAGPSIHVLIKMLATITLVMAPIFL

SEQ ID NO: 51951 - protein, 976 aa, Oryza sativa Japonica Group
MEKLVRCSWCGTVRFHKWVKSVEHDNFYRQLGMLVPFAELIACKMAIELAKEGSDVSRLILEIDNADVIDVQLFCAFVKKIMLVRMVQEIEDPWQINIWSCSTSRETKVGWVGRSNGFVSIDCGREANYSDYKDPKTGIVYVSDEPYIDAGAGENHRISATATATAADSYLLQTLRSFPSGPRNCYALPTVAGTKYLVRLGFLYGNYDGENSSSSSASSLRFDLHLGAQRWATVDDVVVQTGGISRMYEVVFMGWARWAPACLVNVGGGTPFVSSVELRPIDDELYPSVKTSESLSLFKRSDMGADTTTLTRYPADEHDRIWKGTGNPGSTDISTQEKIQSENSFEVPLPVLQTAITTPGGNDTTLTVAWQDTRSSSEYMVFLHFADFQKIQPRQFNVTLNDIPIGSNGRSLMFSPSPLDSSSVYSSDGYRADDGNYNLVLRRTAASALPPMLNAMEIYTVITHDSPRTFHKDFDAIMDIKYEYGIKKNWMGDPCFPSEFIWDGIKCSTAGDDNTSRIISLDLSQSNLQGVVSINFTFLTALNYLNLSGNQLNGPVPDSLCKNIAGLYIFSYTSDGDICNNRTSSSRSTNRSTTILAISIVTPVLAVAILLAFLLWRAKGKHNVSTFDPPRVPDPKKAPGSTTDHWSHLPINGSRQFTYEELKNFTLNFQRFIGQGGFGHVYYGCLEDGSEVAVKMRSESSLHGLDEFLAEVQSLTKVHHRNLVSLVGYCWEEHYLALVYEYMPSGSLCDHLRGKRDVGETLNWAKRVRIMLEAAQGLEYLHKGCNLPIIHGDVKTNNVLLGENLKAKLADFGLSKMYISDSQTHISVTAAGTVGYIDPEYYQTGRLTESSDVYSFGVVLLEVVTGELPILAGHGHIVQRVERKVTSGSIGLVADARLNDSYDISSMWKVVDTAMLCTTDVAIQRPTMSTVVLQLKECLALEEAREDRNRAGPTNDAVDVGELSQLKSGGLPHLLS

SEQ ID NO: 51952 - protein, 645 aa, Microcystis aeruginosa PCC 7806
MVTTPISPTAKVSKVEGIKERSNYLREPLASELLEDTTHFTDAAVQILKFHGSYQQDNRDNRAKGQEKDYQMMLRTRSPGGFIPAQLYLTLDSLSDRYGNGTLRVTTRQGFQLHGILKKNLKATLGEIIRSMGSTLAACGDVNRNVTAPPAPYKNRPEYGYAWEYANNIADLLTPQTGAYYEIWLDGEKVISAEEAPEVKASRQKDTNGINKKDPIEPIYGQHYMPRKFKIGVTVPGDNSIDIYTNDLGLVVITDANGQLQGFNILAGGGLGRTHNKEETFPRMADAIGYVSKEEVYDLVKAIVATQRDYGDRGDRRHARMKYILEEWGVEKFRSTVEGYFGQKIAPYQPLPDWKYQDFLGWNEQGDGKLFFGLSVENGRVKNEGSFQLKTALKVIVERFELPMRLTANHNIILYEIEPKDQQAIEAILKEHGIITNPAEIDPLTRYAMACPAWPTCGLAITESERILPSVIERIRTLLNRLGLSKEEFVIRMTGCPNGCARPYMAELGFVGSAPNSYQLWLGGTADQTRLARPYLDKMAIDDLEKVLEPIFVYFQQDQQNNETFGEFCHRVNFPALQAFSATYTPKMTETTTTESKPKRVRKNQNRVSVPDDMFVRLKEASETEKRPMNQIINEALEAYFSQKS

SEQ ID NO: 51953 - protein, 405 aa, Arabidopsis thaliana
MNSILSSVLPAPEDPVLSVIFACRDDPSPVKLNLSAGTYRTEEGKPLVLDVVRRAEQQLANDLSRDKEYLPLNGLPEFNKLSTKLILGDDSPALKENRVVTTQCLSGTGSLRVGAEFLATHNKESVIFVPNPTWGNHPRIFTLAGLSVQYFRYYDPKSRGLDFKGMLEDLGAAPPGAIVVLQACAHNPTGVDPTFEQWEKIRRLVRSKSLLPFFDSAYQGFASGSLDADAQAVRMFVADGGECLIAQSYAKNMGLYGERIGSLTIVCTSEDVAKKVENQVLLVVRPMYLTPPIHGASIVATILKNSDMYNDWTIELKGMADRIISMRQQLYAALEARGTPGDWSHIIKHIGMFTFTGLSEEQVRLMAKEYHIYMTYDGRISMASLSSTTVPQLADAIHAVVTRIA

SEQ ID NO: 51954 - protein, 423 aa, Rhodospirillum rubrum ATCC 11170
MDQITEFQLDINRALKETLALVLAGGRGSRLRDLTNRESKPAVPFGGKYRIIDFPLSNCMNSGIRRMCVITQYRAHTLIHHIQRGWGFLRAEIGEFVELWPAQQQTDKESWYLGTADAVHQNLDLIRMHDPRFVLILAGDHIYKQDYSKLLAHHIARGSDCTVACVDVPREEATGYGCVEVDNDDNIVHFLEKPANPPGIPGRPDRAFASMGIYIFNADFLYEILESDALNEASQHDFGRDIIPSQVGKARIVAHRFSQSCVYSVGRREPYWRDVGTVDAYWSANIDLVSVTPALDLYDADWPIWTYQMQRPPAKFVFDTDERRGMAKDSLVSAGCIVSGGAVTGSLLFNDVRVNSYSSVIDTVILPMGDIGRHARLTKCILDTGCRIPEGLVIGEDPILDAKRFHVTEQGITLVTPDRLALL

SEQ ID NO: 51955 - protein, 558 aa, Synechococcus sp. WH 7803
MAFYDVFLNHISTRNIRGDVFGGVTAAVVALPMALAFGVASGAGAAAGLWGAVIIGLMASLFGGTPTLISEPTGPMTVVFTAVILSFTSQIPDRGTALAMAFTVVVLAGVFQILFGFFRLGRYITMMPYTVISGFMSGIGVILVILQLAPFLGQDSPSGGVIGTLSNLPELAKGIQLHELGLAVITLLILWFTPEQLKRFCPPQLLALVIGTVLSLTVFGDVGLRPIGPFTAEFPTFQAPTFSLDQIRLMVVNGAVLGMLGCIDALLTSVVADSLTRTEHDSNKELIGQGLGNVMSGLFGGLPGAGATMGTVVNIQAGGRSALSGIVRALILMLVILLAAPLASRIPLAVLAGIALKVGFDIIDWSFLKRAHHLSIKAACITYGVIALTVLVDLIWAVFIGVFVANVLTIERMTALQSKGVKTISTTDDDVELPEQEQVLLDQASGRLLLFQLTGPMIFGVAKTISREHNAIDDCEAVLFDLSEVSHLGVTASLALENAIKEAIEVGRAVYLVVLSGSTRNRLEKLKLLDLLPDHHVSEDREEILRRAVGELPVLQEV

SEQ ID NO: 51956 - protein, 180 aa, Debaryomyces hansenii CBS767
MSIEEIPQGADVSILSKNEKKARELIKKLNLKQIKGITRVTFKQRGNLIYAIDQPDVFRSSAGTYVVFGEAKVDDMNKRIAEAQQQQAQQDALSKAAGETGEAGEEDKSQDAITADLEKASLNTNKIEEEEADDGEVDESGLDAKDIDIIVEQTQVSRAKAVKALRVHDGDMVNAIMELS

SEQ ID NO: 51957 - protein, 269 aa, Gossypioides kirkii
VVDGVDVISLSVGGAVVPYYLDAIAIGAYGAAEKGIFVSASAGNGGPGGLTVTNVAPWVATVGAGTIDRDFPADVKLGNGKVVTGAGVYNGRGLSPGRMYPLVYAGSGGGDGYSSSLCLEGSLDPDFVKGKIVLCDRGINSRAAKGEVVKKAGGVGMILANGVFDGEGLVVDCHVLPATAVGASNAGEIRQYIDSASKSKSSATATILFKGTRLGVRPAPVVASFSARGPNPETPEILKPDVIAPGLNILAAWPDKVGPAGIPSDNRRT

SEQ ID NO: 51958 - protein, 259 aa, Streptococcus pyogenes M1 GAS
  misc_feature (4)..(4): Xaa can be any naturally occurring amino acid
  misc_feature (14)..(14): Xaa can be any naturally occurring amino acid
  misc_feature (52)..(52): Xaa can be any naturally occurring amino acid
  misc_feature (89)..(89): Xaa can be any naturally occurring amino acid
  misc_feature (112)..(112): Xaa can be any naturally occurring amino acid
  misc_feature (115)..(115): Xaa can be any naturally occurring amino acid
  misc_feature (234)..(234): Xaa can be any naturally occurring amino acid
SNAXKIGIIGVGKXASAIIKGLKQTPHELIISGSSLERSKEIAEQLALPYAXSHQDLIDQVDLVILGIKPQLFETVLKPLHFKQPIISXAAGISLQRLATFVGQDLPLLRIXPNXNAQILQSSTALTGNALVSQELQARVRDLTDSFGSTFDISEKDFDTFTALAGSSPAYIYLFIEALAKAGVKNGIPKAKALEIVTQTVLASASNLKTSSQSPHDFIDAICSPGGTTIAGLXELERLGLTATVSSAIDKTIDKAKSL

SEQ ID NO: 51959 - protein, 756 aa, Erythrobacter sp. SD-21
MSAAASARQILTRLHEVMAGRHHAQHKLDRVVDIIADSLTSEVCSIYLLRDGELELYATHGLNPEAVHVTRMAVGEGLTGTIAKNIETLNLAEAKAHPDFLYRPETGEEKFHSFAGVPIVYRERSVGVLCVQHVEPRRYEDVEIEALQTTAMVLSELIAHKELVDDQEAIDLDEVSIECEVFEGLTLVKGLAEGQAVFHQPRIEIDQVVAEDIEAERQRVYRAFDKMRDQIDAMGREPEFGKGGEHVEVLETYKMFAYDEGWSRRINEAIDSGLTAEAAIERVQQRTRMRMREIDDPLLADRMHDLEDLSNRLLRIVSGQLGTAASQGLRRDTILFARNLGPAELLEYDRRRLKGVVLEEGSLTAHVVIVARAMGIPVLGRVPRVRSRVSEGDPVLVDADKGTVTLRPSQPLLEAFDARFAKSKERAATYAELRDVEPFTRDGTRITVMMNAGLRDDVSALQLTGADGIGLFRTEFQFLVSSTLPARERQQRLYRDVLDAADGKPVVFRTVDIGGDKAVPYLANDTAEKDENPAMGWRALRLSLERDGLLKAQARALLEAAAGRKLSVMFPMVSEPWEFDAAKAIFEEQADWLRDRRKLMPETIEYGCMLEVPSLAEVLDLLLPRVSFISIGTNDLTQFLFAADRANPKLAERYDWLSPAILRFLARISKQVVGSQVRVGVCGEMGGRRLEALALMALGYTRFSITPAAVGPIKELVRKVYLPDLKTQMQQWLMSPPLDMRLALTEWAVKNDIDLD

SEQ ID NO: 51960 - protein, 476 aa, unidentified eubacterium SCB49
MPNQKKTKIVATLGPATQDREILKQMILEGVNVFRVNFSHANYENVKEVVATIRDLGKELGTSTAILGDLQGPKLRVGIMKEEVVVSPGDTISFCTGEEFEGNAEKVYMNYDNFPRDVKKGERILLDDGKLMFEVLATDGKKEVKTKVIQGGPLRSRKGVNLPNTAISLPALTTKDKEDAVFAISLEVDWIALSFVRHAEDLKELQALIEAHSEYKIPIIAKIEKPEAVKNIDKIVAYCDGLMVARGDLGVEVPAAEVPLIQKQLVLTAKRARIPVIIATQMMETMITSLTPTRAEVNDVANSVMDGADAVMLSGETSVGKYPVQVIQTMANICKNVENSDLITVPHEPPHVRTNRYITKSICYHAAHMANEIDAKAICTLTNSGYTAFQISAWRPDAQILVFTSNHRILSRLNLLWGVKAFFYDKCVSTDETVEDVNAIAQERGFVKKGDYLINLAAMPIVDKGMVNTLRVSLGK

SEQ ID NO: 51961 - protein, 393 aa, Campylobacter jejuni subsp. jejuni NCTC 11168
MKIVIVGIGYVGLANAILFSKNNENEVVLLDIDENKIQSINNHKSPIKDKLIEKFFVQNISKLHATSNIKEAYFNADFAVIATPTDYDEQLNFFDTRSIENVLKDIKNINSKINVIIKSTVPIGYTKTIKQKFNMSNIVFSPEFLREGSALYDSLYPSRIIIGDKSVLGKTIGDLFLKNIEKKNVDIFYMDSDEAESVKLFSNTYLAMRVGFFNEVDSYARKHNLNSADIIKGISADDRIGKYYNNPSFGYGGYCLPKDTKQLLANFYNIPNSLIKAIVETNEIRKKFITQLILEKKPNILGIYRLIMKQNSDNFRNSVIIDIIKYLQEYNSNIELIIYEPLVKEKKFLNIKVENDFNVFGAKVDLIIANRFDDKLKEIKDKVFSADVFYTDI

SEQ ID NO: 51962 - protein, 508 aa, Bacillus anthracis
RKPTALIILDGFGLREETYGNAVAQAKKPNFDGYWNKFPHTTLTACGEAVGLPEGQMGNSEVGHLNIGAGRIVYQSLTRVNVAIREGEFDKNETFQSAIKSVKEKGTALHLFGLLSDGGVHSHMNHMFALLRLAAKEGVEKVYIHAFLDGRDVGPKTAQSYIDATNEVIKETGVGQFATISGRYYSMDRDKRWDRVEKCYRAMVNGEGPTYKSAEECVEDSYANGIYDEFVLPSVIVNEDNTPVATINDDDAVIFYNFRPDRAIQIARVFTNGDFREFDRGEKVPHIPEFVCMTHFSETVDGYVAFKPMNLDNTLGEVVAQAGLKQLRIAETEKYPHVTFFFSGGREAEFPGEERILINSPKVATYDLKPEMSIYEVTDALVNEIENDKHDVIILNFANCDMVGHSGMMEPTIKAVEATDECLGKVVEAILAKDGVALITADHGNADEELTSEGEPMTAHTTNPVPFIVTKNDVELREDGILGDIAPTMLTLLGVEQPKEMTGKTIIK

SEQ ID NO: 51963 - protein, 487 aa, Sinorhizobium meliloti 1021
MNPETTAVPYERLGILIDGRWIYEAERSTEVVDPATGQTIARLPFAADGEIAEAVASSQRAFESWKDRSPLERGRILRRFADLARKHADEIARNMTRDQGKPLSEAIGEIRFAADHADWHAEEARRIYGRVIPARDPRVQQMVLREPVGVCIAFTPWNFPFSQALRKVVAALASGCTIILKGPGESPSSTVAIGRLMQEAGLPDGCLNILWGDPAHLSETLLAAPEVRKISFTGSVEVGKHLASLAGRHMKRSTMELGGHAPVILFDDADIEAAADALAGQKVRNAGQVCISPTRFYVQAKGHDRFLARFAEKIASTRVGNGFQESVQMGPLCHGRRVAAMEGFIQDAREQGAEIVTGGERVGNAGFFYAPTVVAAGTDELRLMKEEPFGPIAVVTPFGDFDEVIRRANSLPFGLASYVFTGSSSRAQNAARALAAGMVSVNHFGLALPETPFGGINDSGYGSEGGSETFDGYLNTKFVTRFDQIPQ

SEQ ID NO: 51964 - protein, 461 aa, Sinorhizobium meliloti 1021
MNDRPNSLHALDKQSLVHPYTNLAVHQETGPHVITGGDGIYVVDDEGKRYIEGLAGLFCAGLGFSEQRLVEAATRQLKTMPFYHSFAHKSTEPGIRLAEKLLSIAPVPMSKVFFAGSGSEANDTAIKLIWYYNNALGRPEKKKIISRRKAYHGVTVATASLTGLPFNHRDFDLPIANILHTDCPHYWRFAETGETEEDFATRMANNLEAIILEEGPETIAAFFAEPVMVSGGVITPPKTYFEKVQAVLRKYDILLIADEVICGFGRTGNMFGSETYGLKPDMISCAKQLSAAYMPISALMINAKIADALVDQSRKIGTFSHGFTYGGHPVAAAVALEALTIYEEIDIVGHVRSVAPAFQDRVRKLGEHPLIGEARGVGLVAGLEFVKDKATRENFPPAWQVANQAGKFATARGVLTRGLGDMVSLCPAMIIDDEQIDDLMTRMGLALDDTLAWARAQGHVG

SEQ ID NO: 51965 - protein, 427 aa, Herminiimonas arsenicoxydans
MSAIVDIIGREIIDSRGNPTVECDVLLESGVMGRASVPSGASTGSREAIELRDGDKNRYFGKGVLKACENINTEISEAIMGLDANEQAFLDRTLIDLDGTDNKARLGANATLAVSMAVAKAAAEESGLPLYRYFGGSGAMQMPVPMMNVINGGAHANNNLDLQEFMIIPVGAPSFREAIRYGAEVFHTLKKIINDKGLPTSVGDEGGFAPSVENHEAAIKMILQAIEQAGYEPGTQIALGLDCAASEFYKDGKYHLAGEGMSLSSADFTNLLGTWCDKYPIISIEDGMAENDWDGWATLTNALGKKVQLVGDDLFVTNTKILREGIQKNVANSILIKINQIGTLTETFAAIEMAKRAGYTAVISHRSGETEDSTIADIAVGTNSLQIKTGSMSRSDRMAKYNQLLRIEEDLGDIASYPGRNAFYNLK

SEQ ID NO: 51966 - protein, 495 aa, Pyrus pyrifolia
MASSASENRLLLSKIATNEKHGENSPYFDGWNKYNQNPFHLTENPEGVIQMGLAENQLSFDLVEEWIRKNPKASICTAEGIEKFRNVANFQDYHGLPEFRQAIATFMSKARGGRVTFDPHRVVMSGGATGANELVMFCLADRGDAFLIPSPYYPAFYRDLGWRTGVQIVPVDCDSSNNFKITKEALEAAYEKAQNNNINVKGLIITNPSNPLGTTLDKDTLESLVTFINQKNIHLVCDEIYAATVFSSPKFTCITEVIQNMNCNPNLIHIVYSLSKDMGFPGLRVGIVYSYNDDVVNIGRKMSSFGLVSSQTQHMLASMLSDEDFVEKFLTTSAKRLAKRHGVFTDGLEEVGINCLKSNAGLFCWMDLRRLLKDQTFDGEMVLWRVIVNEVKLNVSPGSSFKCVEPGWFRVCFANMDDDTVEVALKRIRAFVGQGKKAQEQAQVKSPKKRWQSNLRLSFSSSSRRFEQEGVSVMSPRMMSPHSPMPHSPLLRATT

SEQ ID NO: 51967 - protein, 77 aa, unidentified eubacterium SCB49
MSDIASRVKAIIVDKLGVDENEVVNEASFTNDLGADSLDTVELIMEFEKEFDIQIPDDQAENIATVGQAVSYIEENK

SEQ ID NO: 51968 - protein, 355 aa, Cryptococcus neoformans var. neoformans JEC21
MSGPSSSPHVMQSGATSGVNIKLHPLAILNISDVYTRAQCTSTGSEVPKLIGALLGTESNREIAIVNSFELIYHPSVMSGEDVDMSDSGSSGGKYVLNTDFLETRKDQFKQVFPTLDVIGWYSVGKEPSSDDISLHAQFASSVETPIFLLFDPDPASGTQALPLKIYESATVTDTTGEISGEGKFVELEYGIETGEAERIAVDGVAKGGAGEEDTAVAHLTTQRNAIKMLYDRIEILLKYVTGVVNKSAKPDYSILRRISSLVATLPTMDAGEFREELITEYSDVQISSYLTTLTKQLNVLSEVCYALQHLILATKKNKQKTKNKKTDTCHSTLKNTPLFTVRRRMSSWEAQVWD

SEQ ID NO: 51969 - protein, 203 aa, Arabidopsis thaliana
MAKGRKPTTMNRSDRYLGSYTYGDSHGNSVTDELELGEEDIWSPAVIHDDTTENEESYGTWNLRATLGKNGRVGGLSLAFEGSLVAPPLSSPMIVQKIHGGGGEGEEDRRKLASSAPVNVPDWSKIYRVDSVESIHELDDEDDEDEESGMMPPHEYLAKSQARRSRKIGGGGASVFDGVGRTLKGRELRRVRDAIWSQTGFYG

SEQ ID NO: 51970 - protein, 127 aa, Zea mays
MESAVNPKAYPLADAQLTIGIIDIIQQAANYKQLKKGANEATKTLNRGISEFVVMAADTEPLEILLHLPLLAEDKNVPYVFVPSKQALGRACGVTRPVIACSVTSNEGSQLKQQIQGLKDSIEKLLI

SEQ ID NO: 51971 - protein, 424 aa, Roseovarius nubinhibens ISM
MSTIIDIHAREILDSRGNPTVEVDVILEDGTMGRAAVPSGASTGAYEAVERRDGDKSRYMGKGVLEAVAAVNGEIADTLLGFDAAEQVAIDEAMIELDGTDNKSRLGANAILGVSLATAKAAADFCAQPLFRYVGGTSARVLPVPMMNIINGGEHADNPIDIQEFMIMPTSAENIRDAVRMGAEVFHTLKKELSAAGLSTGIGDEGGFAPNIASTREALDFVLKSIEKAGYKPGDDIHLALDCAATEYFKDGKYVLSGEGKTLSSQENVDYLKALVADYPIISIEDGMAEDDWDGWIALTEALGDKVQLVGDDLFVTNPTRLAEGIERGAANSMLVKVNQIGSLTETLRAVEMAHRARMTNVMSHRSGETEDATIADLAVATNCGQIKTGSLARSDRLAKYNQLIRIEEMLGDTAIYAGRSILR

SEQ ID NO: 51972 - protein, 653 aa, Treponema denticola ATCC 35405
MTKNSLLSKIKGPEDIKLLSYNELKDLAVEIRKEILTVVGHNGGHLASNLGVIELTLAIHRVFSSPHDAVVWDVGHQSYTHKMITGRQSRFSTLRLWEGLSGFPKREESVHDAFNTGHASTSISAALGILEGKRLNKDSGKVIAVIGDGAMTGGMAFEALSNAGELKKDLIVIINDNKMSISKNTGAFSEYLSRLTVHEGYQRFKYLFDKAVGSIPLVGNKLNSIIWRLKRGMKGIFYKNNIFVDFGFEYVGPINGHNMRELEKVLKNVKKLNSPVVMLVETIKGKGYPLAEINPAAFHGIGPFNIADGKVEKNDAITFTQAFGKALVKAAEKNSKIAAITAAMESGTGLSLFHSKFPERFFDAGIAEGHAVTFAAGLASAGMKPVTAIYSTFLQRSIDQIIHDTSIQNLPVIFAIDRAGPVPADGETHQGLFDIALLRPVPNMTILCPASEKELELMLSWALMQDNPIAIRYPKADCPKEIPEFSQSIEKGRGVLIKNSDKSRILITCTGGMYNEVKEASAILAHRGLSTDIYNVRFAKPIDENYFLNITKDYSYILFVEDGMKIGSLSSYLESLILRYESNKTGSQSNKTGLQNKKTAVLAFEDMFFPHGTRSEIFKGAGVSAEHIVQAAELLFTETHTVSASTAIPVKEN

SEQ ID NO: 51973 - protein, 541 aa, Roseovarius nubinhibens ISM
MFKVQDELKARGEAARARGILPLFEEDAGRAEAFSIGFDGLLFDYAKTHLDREDRAALLGWAEAAGVAARRDAMFSGARINETEGRAVLHTALRNLEGGPVEVDGRDVMPEIRDTLERMKRFARRVRAQSYKGAGGEITDVVNIGIGGSHLGPEMAVRALETFRQGPRCHFLSNVDGADAADILDHLDPRQTLVIVASKSFTTQETMTNAATVRDWMATAVDNPAKQFVALSSSKEKTAEFGVPPEQVFDFGDYVGGRYSVWGPIGLSLMIAIGPEAFGMMLRGGAAMDRHFREAPLAENMPVMLGLVGLWHHQVMGFPTRAVLPYAQRLERLPAYLQQLEMESNGKRVRMDGRTLDLPSGPVVWGEPGTNGQHAFYQLIHQGTQVVPCEFIVAAEGHEPTLAHHHRLLLANCLAQSEALMRGRDMATAQALMAEAGYEGAERDRQAAHRVFEGNRPSVTLMIDQLTPYRLGQIIALYEHRVFVEGVMLGINSFDQWGVELGKELARALEPVLAGEESAEGKDGSTRALVAYAQRFWARER

SEQ ID NO: 51974 - protein, 335 aa, Treponema denticola ATCC 35405
MQKNQYQAELFKNRLQKRFKHLLKWAKREGVFAYRLYDKDIPEIPLAVDIYFAETEETEKRAFLLIYLYKRPYEKSQEEEREWLLVIEEAASSSLLIPKERIFIKLREKQKGKSQYEKAGSSKNLIRVKEGECFFYVNVEDYLDSGLFLDHRPARSMVFKEAKNKKVLNLFSYTGSFSVHAAKGGAASVDSVDLSNTYLNWAKENLKLNKLFDEEKTQLIKSDVIVFLKKAIEEQKKWDLIICDPPTFSNSKSADIFDVNRDWLKLCLLCLKVLSKNGKLYFSTNSQKIKFDEAELINFSEQKIRVKDITKASIPEDFRNQKIHKMWMIEAGYLP

SEQ ID NO: 51975 - protein, 362 aa, Coprinopsis cinerea okayama7#130
MAGPVKRAVPHLMTLADLTVPQIQGTLRYAHYLKQTSEPWLAPYGSLSKRESKRLKLPSQSLFNKTIALLFSKRSTRTRLAAETSATLLGGRALFLGKEDIQLGVNETARDTARVIGGMCQGIFARVGDHSEIEELAAHSPVPVLNALSSLWHPTQILADLLTLHEHAHLFDDPKSEPPASLKNLPNLRPLTVAYVGDANNILNDMLVTYPRLGHQLRVASPPQYRAEPEVWKRVEELGCDKGIWWGDDPKEAVKGADVVVTDTWISMGQEAEKAERLKAFEGYQVTEELCKEANPNWIFMHCLPRKPQEVNDEVFYGPRSLVFPEADNRKWTIMALFDNLFGKWSLDGKTLRETDLSKDED

SEQ ID NO: 51976 - protein, 407 aa, Hyphomonas neptunium ATCC 15444
MPRKLDLPAIRAEFPILSREVNGHPLVYLDNAASAQKSNAVIDALSGQMRTAYANVHRGLHTLANETTEAFEAARETVRAFLNAPSTDTIIFTKGSTEGINLVASALAARIQPGDEIVLSIMEHHSNIVPWHFLRERHGAVLRWVGLTEDGSLDMDAMAAAIGPKTKLVAITHMSNVLGTVVDVAAVAKLAHDAGAEILIDGSQAAVHLPVDVQAIGCDWYVITAHKIYGPTGIGALYGTAQALDRARPYQGGGEMIEIVEMDRITYNSAPHKFEAGTPPILEAIGFGAALRWLAEFDKAEVAAHEHGLYERAANALRSVNGIRIHGEAPGKGAVLAFSLEGAHPHDIAQIVDRYGVAIRAGHHCAQPLMQHLGVTATARASFALYNTEAEVDALAEALAKARKMLV

SEQ ID NO: 51977 - protein, 289 aa, Zea mays
MPAGQPHAHEAAAAACVGSGANHSNHRVPAHSPPPLPAEVVPAYPPPESEDDETWVWTQIKAEARRDADAEPALASFLYATVLSHPSLPRSLSFHLANKLCSSTLLSTLLYDLFLATLTAHPSLRAAVVADLLAAHSRDPACVGFSHCLLNYKGFLAIQAHRVAHVLWAQQRRPLALALQSRVADVFAVDIHPAAVVGKGILLDHATGVVIGETAVVGDNVSILHHVTLGGTGKAVGDRHPKIGDGVLIGAGATILGNVKIGAGAKIGAGSVVLIDVPARSTAVGTLPG

SEQ ID NO: 51978 - protein, 193 aa, Gossypioides kirkii
  misc_feature (93)..(93): Xaa can be any naturally occurring amino acid
  misc_feature (111)..(111): Xaa can be any naturally occurring amino acid
  misc_feature (127)..(127): Xaa can be any naturally occurring amino acid
  misc_feature (183)..(183): Xaa can be any naturally occurring amino acid
  misc_feature (191)..(191): Xaa can be any naturally occurring amino acid
EHVGLNVNGEPFVACHECNFPICKSCFEYDLKEGRKACLRCGTPYDENLLDDVEKATGDQSTMAAQLSKPQDVGIHARHISSVSTLDSEMTEXNGNPIWKNRVESWKEKKXKKKKPATTKVEREAEXPPEQQMEDKPVPDASQPLSTIIPIPKSRLAPYRTVIILRLIILGLFFHYRVTNPVXSAFGLWLXSV

SEQ ID NO: 51979 - protein, 886 aa, Oryza sativa Japonica Group
MPCSPPSYLFIIVTGVLLVLVHSQTSLDEDFISIDCGLPSGFSYVDEKTNITYISDDQYIDTGENHNISSQLQGAEQFRSGLNLRSFPTGGRNCYTLYPAIKGQKYLIRGMFMHGNYDNKGQDLVSSPVTFDIRIGLNFWNRLNIINATMTYTSEAIVVAIVNSVSVCLVDNGEGTPFISSLEMRPMKSSNYPAATPNHPLLLQDRRSMGASRIIRYPDDPYDRVWWLPQITSGLIKISTRSLISRYTDDVYEVPVAVLKTAATTSSTSTALNFLWAAPTGWDATPGYLIGLHFTDFQQGQLREFDIYYNNDLWNYDNKKTKPPYLLANYINGTTPYTSDNYLYNISLVATNASVLPPMLNAIEIYYQVQQDEKMTYSEDVEAMMTVKIDYQVKKNWMGDPCLPEKYTWSGLKCRSQGVTSRIISLDLSSSDLQGAISEQFSMLRSLEYLNLSNNDLTGSLPESLTNLPNIHVLDLSGNQLNGTFPEALCKNRALTLRYDTANGDPCSPRSSKKKHKAVLAVAVVVPVVIVVILISAMLMLLFWKKQAIVKSRGQEQYGDHIHIPENREFTYEELVKITNNFSVFIGEGGFGPVFHGQLKDGTQLAVKMRSPTSMSGKGMPEFLAEVESLTTVHHRYLVLLVGYCTDQDHLGLVYEYMPNGSLYDHLRGKNAIIQRLSWQHRAKIAHEAAQGLDYLHTGCVLPIVHRDVKSHNILLGCDLTAKISDFGLSKSYLNVAQSHITATAAGTLGYIDPEYCLSGRLTISSDVFSFGVVLLEIVTGEPPIIPTNGHIVQRIKEKVNMGNIEAIADPRLHGEFDISSIWKVVDIALLCTKEASSERPTMSMVVAQLKDALALEEARLSYSTSDISQGGANAELSINSMPTAR

SEQ ID NO: 51980 - protein, 419 aa, Thellungiella halophila
MPTSSGAAALDRSLNSGAFKPLEIPSTKPLHWKPPISDVAKFESNQQKEKTFSRPQMSPSLYATPKEIPLPFSPSSSPPSPYICCHKARWPILLKSSSELDLPCHPNTLIADAEGTTSLRSFPISQAIAEDHTNGVHDRPVWDCSPPHRKLWNDNSANNGLEWESYLLESVRMKANKSEDFCTTAQSVSEFTSDTGLEDDAGAENSHKLFSSGGEFYDARDELSTDSGTQSSVNHIESELRGMRLSLLMEIERRRQAEETLEKMQLHWRRLREQLAHVGLFVPLDPTSSQYSMNIADELRCQLEVARFVSDSVGSDLAKAEVEMEMESELEAKNFEITRLSDRLHYYETCFNTLDTRDGKARRAKEKEEAEMDLGINCCNHHAWWCSLGLAVPPFINGCSSVISNRLMRLPNQIMRTKL

SEQ ID NO: 51981 - protein, 481 aa, Hyphomonas neptunium ATCC 15444
MAERMLQFTKVSRAMPKKRSAKERAEDFREIYGEFSPDAAKAQASRCSQCGVPFCQQGCPLQNNIPDWLKLAAEDRLEEAWRVSSATNNMPEICGRICPQDRLCEGICTIEQSGHGTVTIGSVEKYITDTAWAEGWIQPIKPPRERTQSAGIIGAGPGGLAAAEQLRRKGYQVTVYDAYDRGGGLLMYGIPGFKLEKDVVERRIHHLEASGISFRFNTRIGADMSLADLREQHDTVLIATGVYAAKDLKCPGVGAEGVLPALDYLTASNRVDLGDTVEAYDAGVLNAEGKRVVVIGGGDTAMDCVRTAIRQGAKSVTCLYRRDRVNMPGSQREVQNAEEEGVVFEWLANPEAIIDSKGGKVKAVRASRMKLGEPDASGRQSPVKTGETFDVKADMVIKALGFDPEDLPALFNETSLTVNRWGAVRVDYATLETSLPGVYAAGDIVRGASLVVWAIKDGRDAAEAMHKAMRAAEAAAKVAAE

SEQ ID NO: 51982 - protein, 105 aa, Thellungiella halophila
MIRALSTRKDRGGYKKLGEEEAGGVGLLQGQLPSVPGEVNKPVEKTGGSVHPLLTFFDVRLQRKKKPKKKKSTTTAKPEFARYLEYVKEGGVWDATSNGPVIYYR

SEQ ID NO: 51983 - protein, 187 aa, Gossypioides kirkii
HVGLNGNGEPFAFCHDCNFPICKTCLDYELKEGRKACLRCGNPYDENLLDDAEKASGDRSTMAAHMAKSQDAGIHARHISSVSTLDSEMTEDNGNPIWKNRVESWKEKKNKKKKTSIKVEIEAQVPPEQLMEDKLAADAFQPLSTVIPIPKSRLAPYRTVIIMRLIILGLFFHYRVTNPVASAFALW

SEQ ID NO: 51984 - protein, 482 aa, Erythrobacter sp. SD-21
MPEVMFDADGLLLFGATGDLSQRMLLPSLCALHADGLLDPDLCIVATARSEMTTKEFRDFARQALEKYLPKNRRGPMADFLNRLSYVPVDATTPEGYDELARQVGEYKGLAIFLSTAPSLFEPTIAGLKSAGLTNGNARIALEKPLGTDLASSCEINDAVAKAFSEDRIFRIDHYLGKETVQNLLALRFANILLEPVWNSNYVDHVQITVAETVGLESRVAYYDDSGALRDMVQNHMLQLLALVAMEPPTSFDATAVRDEKVKVLRALRPAQSNEVVTGQYRAGAVDGKSVPGYDEELGKPSDTETYVALKAHVDNWRWRGVPFYLRHGKRMPRRVTEIVIQFKCIPHSIFEGRGAKTEPNRMVIEIQPEENIQLTMMAKVPGLGSDGLRLRPVPLDIAMPDAFSDVVRRIAYERLLLDLIHGDQTLFVRRDEVEAQWDFIDHIRALWAENETQPKTYAAGTWGPSAAVALAERDGVTWHDD

SEQ ID NO: 51985 - protein, 841 aa, Oryza sativa Japonica Group
MEFLAFFAVLVLATAVVPAVSQQGYLSIDCGLEANSSYQDDNRILYVPDGPYVDGGENHKVAAEYASSFQRPDQTLRSFPSGVRNCYTLPTAAGSKYLVRLVFVYGNYDGKNISSSSSSAAAAALRFDLYLGLSRWTTVQGGTGSGGEVHEAVFVAWASWAPVCLVNTGSGTPFVSTVELRPLVDSLYPAVMANQSLAMLRRRNMAANNFIRYPDDPYDRYWWPMNADPAWANLSTTSTIKTGSTFAVPSSVLQTAVTPSGNSTVLNVISWQDTTAKEYVVYLHFADFQSSKLREFDAYPDANQVVYNYTPHYLLSSSVYTPLFRAIAGEYNITLAATANSALPPMLNAFEIYFLITYDGTTTFSKDFDTIMAIKLEYGVKKNWMGDPCFPPEFAWDGIKCRNTSGNIMRIISIDLSNSNLFGVISNNFTLLTALEKLNLSGNQLNGPIPDSLCKNNAGQFVFRYVAKTNPELLVLYNYYSYGSDGNMCNKTIVPTYVPPQVPDIKTSPERKTNPFDPLQITESRQFTYEELKKFTNNFQQFIGRGGFGNVYYGCLENKTEVAVKMLSEFSENGLDQFLAEVQSLTKVHHKNLVSLVGYCWEKDHLALAYEYMARGNLCDHLRGKFGVGDTFNWVTRVRVVLDAAQGLEYLHKGCNLPIIHGDVKTNNVLLGENLKAKIADFGLSKTYISETQTHISTSNAAGTMGYIDPEYYHTGRLTESSDVYSFGVVLLEVATGEPPILPGSGHIIQRVKQKVASGNISLVADARLKDLYDISSMWKVVDTAMLCISEVATQRPTMSTVVLQLKESLALEEARDSRDITTSSVSDAMDVLSKFGPSAR

SEQ ID NO: 51986 - protein, 363 aa, Synechococcus sp. WH 5701
MLKAGIVGLPNVGKSTLFNALVANAQAQAANFPFCTIEPNVGVVAVPDPRLKMLSDVSSSREIVPTRVEFVDIAGLVKGASQGEGLGNKFLANIREVDAIVHVVRCFEDDDVIHVSGDVDPVRDAEVINLELGLADLGQIEKRRERLKKQARTSKEAQVEDAVLARIQAELEQGGAARNVELGEEEAPMLKPLGLLTAKPIIYATNVSEDDLAQGNPFSRAVEELARKEGAGAVRISAQVEAELIELGEAERADYLEGLGVSEGGLQSLIHATYGLLGLRTYFTTGEKETRAWTITAGMTAPQAAGVIHTDFERGFIRAQTVAYAQLLEAGSLPEARNRGWLRSEGKEYVVQEGDVMEFLFNV

SEQ ID NO: 51987 - protein, 258 aa, Thellungiella halophila
MGTMGRALYSVGFWIRETGQALDRLGCRLQGKNHFREQLSRHRTLMNVFDKAPSVDKQAFVAPSASITGDVHVGRGSSIWYGCVLRGDANSITVGAGTNIQDNSLVHVAKSNLSGKVLPTVIGDNVTIGHSAVLHGCTVEDEAYIGTSATVLDGAHVEKQAMVASGALVRQNTRIPSGEVWGGNPARFLRKVTEEERAFFSSSAVDYSNLAQVHAAENTKNLDETDFKKLLHKKNSRDAEYDSQLNDLALSENVPKAA

SEQ ID NO: 51988 - protein, 249 aa, Thermus thermophilus HB8
MSEALLVKVGGSLRGAEALLEELAAYPGPLVLVHGGGPEIGEWLKRLGYESRFVGGLRVTPPEQLEVVEMALYLTGKRLAWGLSRRGRKALALSGRDALCLRGRALPELGRVGEVVGVEVGLLLDLLEKGYTPLLAPIALDEEGPLNVNADTAAGAVAGALGWPAVFLTDVEGVYRNPKDPKTRFPRLTPKEVEALKEEGVIQGGMIPKVEAALAALRAGAPWAAVAKGERGVLRRLLSGEGGTLFSPS

SEQ ID NO: 51989 - protein, 255 aa, Oryza sativa
MAASRLALLLLVLAVAAARHALPAAGSDAHPGYDGAEDTCGVPAAAAAAGRMEEYGGGRILDITHAYRADLPAFAPGAVTGPVVRLRDSMANGTLYNLSELKMECHMGTHVDAPGHMNQGHFAAGLDVDKLDLDLLNGPTLLVDTPRNTNITAKAMESLNIPKGVRRVLFRTLNTDRKLMWKKGGDLSYVGFTEDGAQWLVDNTDIKLVGIDYLSVAAYDHLITAHVVFFKFPNIILVEGLKLDDVKGNYSGLVP

SEQ ID NO: 51990 - protein, 604 aa, Oryza sativa
MDDDDYSWVRRTKFSHSIVKSNSGREQFGAFLDPFDSSTAWRQKGFSGELMIHGHNLQPRAKGAVSKSPRPSIPLAKSPVSQAERKLKAKFSDGELKQRGKISDGSLREASKEKDRKVGHKGEGLSLDISCPILDRTVQDDSSDTLDFSFHSEEQSLRLLRVCSSPAPFYSKDTTTFGDSKIHSTSVKIVGEGSKPRRRAKSPMPTRVISEVFKEAKAATKRFSSPQRQRKSSSPHSPRSPDDSPRFGFPSMRTPGNLKARRASSWPRNCDNGVAKAVALDILERWTIDRSQLLIGQRFASGAYSRLFHGIYKEQPVAVKFIRQPDEEEDAELAAKLEKQFTAEVTILARLHHRNVIKLIGACNAPPVFCVITEFLCGGSLRAFLRKLQRQKLPLEKIICIALDIAHGLEYIHSQRVIHRDAKPENILFDGECCAKVVDFGVACEEVYCNSLEDDPGTYRWMAPEMYKRKPYGRKVDVYSFGLVLWELFSGSIPYEEMTPLQAAFAVVNKNLRPVVPSSCPAQLRLLIEQCWSCQPEKRPEFSQVVQILKNLKEALDRDGTLDKIPSTNCQEPPDQNKKRLSNWIQRLSYSQADFSGPPPPKLL

SEQ ID NO: 51991 - protein, 378 aa, Ashbya gossypii ATCC 10895
MSGEKADKTVESAAEEAVAATPVLATKGGRETSDRILYVGNLDKTINEATLKQYFQVGGPIANVKVLVDKNNEEANYAFVEYRQPRDANVAFQTLDGKQIENNVIKINWAFQSQQVSSDDTFNLFVGDLNVDVDDETLSSTFKEFPTFIQAHVMWDMQSGRSRGYGFVSFGEQEEAQKAMDAKQGFNLNGRAIRVNWAAKRESQHAARPRSNRGGFRGGSGHQPFRGMPQGPHLGGAAPAGPMQLQGPPVPSPVNPQAVEAMIRRAPQRVTTAYIGNIPHFAQEPDLIPLLQNFGFIIDFKHYAEKGCCFIKYDTHDQAALCIVALANFPFQGRTLRTGWGKEKPSFVPNGAVPHAAAPAPVQPASDAVPAQDQEHQQ

SEQ ID NO: 51992 - protein, 457 aa, Schizosaccharomyces pombe 972h-
MLRLQNLPKLVRRFATTALPKTETTTLKNGLTVATEHHPYAQTATVLVGVDAGSRAETAKNNGAAHFLEHLAFKGTKNRSQKALELEFENTGAHLNAYTSREQTVYYAHAFKNAVPNAVAVLADILTNSSISASAVERERQVILREQEEVDKMADEVVFDHLHATAYQGHPLGRTILGPKENIESLTREDLLQYIKDNYRSDRMIISSAGSISHEELVKLAEKYFGHLEPSAEQLSLGAPRGLKPRFVGSEIRARDDDSPTANIAIAVEGMSWKHPDYFTALVMQAIIGNWDRAMGASPHLSSRLSTIVQQHQLANSFMSFSTSYSDTGLWGIYLVTENLGRIDDLVHFTLQNWARLTVATRAEVERAKAQLRASLLLSLDSTTAIAEDIGRQLLTTGRRMSPQEVDLRIGQITEKDVARVASEMIWDKDIAVSAVGSIEGLLDYNRIRSSISMNRW

SEQ ID NO: 51993 - protein, 211 aa, Gibberella zeae PH-1
MSTGCTDLNSTAQLHTDKNRLMSDYEVTLVNDNTTSVCPSSPLVTSSDSLTDTLRQEFYVRFKGPAETPFEGGTWKVHVELPDTYPYKSPSIGFVNRIFHPNIDELSGSVCLDVINQTWSPMFDMINIFEVFLPQLLRYPNPTDPLNGEAAALLIREPKSYDAKVKEYVQKYASKEAADEAGAESEDDDELSSVASFGDDDDEPAGQMDDV

SEQ ID NO: 51994 - protein, 562 aa, marine gamma proteobacterium HTCC2143
MDSLNCDPDATASGADHTPRQVFSGHYVPVAPTPIKDPEYVIHSNDFFRELGFVDTLAHTDGFVRLFSGDISNVPAPMRKVGWACGYALSIFGTEYTQQCPFQTGNGYGDGRAMSVLETVIDGQRWEMQLKGGGRTPYCRGADGRAVLRSSIREFLAQEHMHALGVPTSRSLSLYVSTTEKVQRPWYSEGSHAMDPDRLVTEPVAISTRVAPSFIRVGQLELFGRRARNKAHPQAMEELEKIMLHLLDREYSGVVDNTLSTAEKVVALARAFRSRLTSLIANWIRVGYCQGNFNSDNCAAGGFTLDYGPFGFIDVYNPNYQSWTGGGHHFSFLNQPVAAERNFQMFCTALSPLLISNQDSLQQLDELQRDFATVMQAQMEKMWAAKLGLGSFDAALFNELETLMRQTPVDYTMFFRELSMVPDNIEPLKKSFYQGPQYATTSMYSDYNDDPTGMDRRWSAWLSKWHLLSAASVDSNTEQPRSREALAQQMKLVNPQYRWREWLVAPAYQQAATGDYTLIRALQQVMTQPYDRGSDAVNEKHYTLKPAEFFEVGGLSHYSCSS

SEQ ID NO: 51995 - protein, 86 aa, Glycine max
MDSFSNQSRGSSSQLSAQDLKNQLKNQLAIEYAQQFLETVGRKCFEKCVTKPGSSLGGSESSCISRCVDRYIEATGIISKALFSSQ

SEQ ID NO: 51996 - protein, 398 aa, Desulfotalea psychrophila LSv54
MWQNIEAAPADSILGLTEAFRNDPNPAKVNLGVGIYKDEQGATPILQCVKNAEARLIETEESKVYLPISGAPAYTENVQKLLFGEESEVISSKRAITAHAPGGTGALRMGAGLLKTFFPEAKVWVSTPTWANHTGIFSSTGFEIAHYPYYDETHRSVDFQAMLMSLRAVPEGDIVLLHACCHNPTGVDLTLEQWHQVVAIAQERNWIPFLDFAYQGFGVGTSEDRCAIELCAEAGIDFFVASSFSKNFGMYNERTGAITVVAANQASAAVALSHLKKTIRVVYSNPPAHGGLVAATILSDPELYDLWQQELQDMRERIIAMRVALVEGLSSRGVDQDFSFITEQSGMFSFSGLSDEIVAWLRKEKSIYVVGGGRINLAGLTASNIDYVCDAIAEALKS

SEQ ID NO: 51997 - protein, 484 aa, Roseovarius nubinhibens ISM
MVSRVIPVEAFDLVIIGGTGDLARRKILPALYQRFNAGQIGKKSQIIGAARGEMTSEAYRAFAEEAIREFLDKSDVKVRALKSFLKLLSYVTLDAKGETGWEELAGKMHSDRIRAIYFSVGPSLFGDLAKRLHKHGMAGEGTRLVVEKPFGRDLASAKELNQMLARHFDESQIYRIDHYLGKETVQNLMAVRFGNMLFEPLWNSQYVDHIQITVAESVGVGTRGGYYDRSGAMRDMVQNHLMQLLCLIAMEPPAKFDPDAVRDEKLKVIRALDPVEPDNIVRGQYEGDGERPGYRNQVESRDSTTETFVALKAHISNWRWAGTPFYLRTGKRLKDRASEIAIIFKDAPHSIFEEDGQRHNNILTIRLQPNEGIELGVTIKEPGPGGMRLVDVPLDMSFAEVLGPDEADFPDAYERLIMDVIRGNQTLFMRGDEVEAAWAWTDPIIAEWDGSGQAPEPYAPGSSGPESAMFLMHRDGRRWREIKP

SEQ ID NO: 51998 - protein, 384 aa, Roseovarius nubinhibens ISM
MSPRHIRHGFPWVYDNELVTDRRSRAIAPGTIGLLEDAERNPVALVAINPNSRIMARVLDRDTGAEIGRAWIEARLLRAFDLRSRLFEAPYYRLVHAEADGLPGVIIDRFGDVAVIQPNAAWAEAMIEVLSEALVAVTGVSTVIKNASGRARSLEGLDEESAVLRGAAPDGPLAVPMNGATYMADLMGGQKTGIFYDQRPNHAFAARFAPGARVLDVFSHVGGFSLAALAGGAESAVAVDGSEPALALAEAGAAAMGAEARFATRRGDAFAQLEALAAEGESFDVVICDPPAFAPTKKALDRGLRAYERVARLAAPLVREGGLLGLCSCSHAADLGAFRGASVRGIGRAGREARLIHTGFAGPDHPMHPQLAESGYLKALFFAL

SEQ ID NO: 51999 - protein, 316 aa, Bacillus anthracis str. Ames
MPKKVLIFCDPGIDDTMALLLAFFIDEIEIIGIVADYGNVPKKMAVQNAHFLKNETRNRNIKIFGGSERPLTGAPPAFFTEVHGKQGLGPIIPNGNVTNGEMENFFEVIPLIEQYKDELIIVSLGRLTSLAILFIMCKQLMKQIKSYYVMGGAFLHPGNVTPISEANFYGDPTAANIVLQSAANMYIYPLNVTQYSVITPEMAEYIEAKGKVPLVKPLFDHYYYGYYKNALPDLKGSPFHDTMPILALLDNSMFTYHKSPIVVMAESYAQGASIGEFRSLGKPKPFMDWPSHQIAIDFDYNRFFKHFMSLMTGEQF

SEQ ID NO: 52000 - protein, 736 aa, Oryza sativa Japonica Group
MSGGGPPKKRNFKIELFKHRVELDPKYAERTWKVLEHAIHEIYNHNASGLSFEELYRSAYNMVLHKYGEKLYDGLERTMTWRLKEISKSIEAAQGGLFLEELNAKWMDHNKALQMIRDILMYMDRTYVPQSRRTPVHELGLNLWRDHIIHSPMIHSRLLDTLLDLIHRERMGEMINRGLMRSITKMLMDLGAAVYQDDFEKPFLDVTASFYSGESQEFIECCDCGNYLKKSERRLNEEMERVSHYLDSGTEAKITSVVEKEMIANHMHRLVHMENSGLVNMLVDDKYDDLARMYNLFRRVFDGLSTIRDVMTSYLRETGKQLVTDPERLKDPVEFVQRLLNEKDKHDKIINVAFGNDKTFQNALNSSFEYFINLNNRSPEFISLYVDDKLRKGLKGATEEDVEVILDKVMMLFRYLQEKDVFEKYYKQHLAKRLLSGKTVSDDAERSMIVKLKTECGYQFTSKLEGMFTDMKTSQDTMIDFYAKKSEELGDGPTLDVHILTTGSWPTQPCPPCNLPTEILAICDKFRTYYLGTHSGRRLTWQTNMGTADIKATFGKGQKHELNVSTYQMCVLMLFNSTDGLTYKDIEQDTAIPASDLKRCLQSLACVKGKNVLRKEPMSKDISEDDTFYFNDKFTSKLVKVKIGTVVAQKESEPEKQETRQRVEEDRKPQIEAAIVRIMKSRRVLDHNSIVAEVTKQLQARFMPNPVVIKKRIESLIEREFLERDKADRKLYRYLA

SEQ ID NO: 52001 - protein, 591 aa, Microcystis aeruginosa PCC 7806
MHSPSFPRRTKIVATIGPASQNKETLRQMIKAGATTFRLNFSHGDHDYHRHSINLIRQLAFELNQPIGILQDLQGPKIRLGKFACGSITLKPGEPFILTSRDVECNQEISSISYPSLAQEVPEGSRILLDDGKVEMRVESVDRLKGDLSCRVVVGGVLSSNKGVNFPNVYLSVKALTDKDKKDLMFGLLWDVDWIALSFVRNPQDILEIKELIASAGKSIPVIAKIEKHEAIEEMEAILSLCDGVMVARGDLGVELPAEDVPILQKRLINTANQLGIPIITATQMLDSMASNPRPTRAEVSDVANAILDGTDAVMLSNETAVGHYPIEAVATMARIAERIEREQINSAARSNNKQSIPNAISSAVSQIAEQLGAAAIITLTKTGSTARNVSRFRPKTPILAVTPHREVAQQLQLVWGVKPMLLLDLPSTSQTFQVAMNLAQENNLLADGDLVVMTAGTLQGVAGSTDLIKVEVVKSLLGKGTGIGQGVASGRARVAHNAREVGSFSNGEILVVPTTSAEYVDMMRKAGGIITEDTAMNNHAATIGLKLGIPVIVGVKDATKIIREGVIISLDAQRGLIYSGIGKGAATMKN

SEQ ID NO: 52002 - protein, 147 aa, Candida albicans SC5314
MFKSSAFRTFVRNMSKSDSEWRAILSPEQFRVLRQGGTEAPYTGEYTNTPASDVGYYECAGCKYPLYKANTKFKAHCGWPAFYEALPGAVKIYRDESHGMIREEMRCSNCDGHLGHVFKGEGYKTPTDERHCVNSVSIKFNPQDQQS

SEQ ID NO: 52003 - protein, 589 aa, Yarrowia lipolytica CLIB122
MTEQCPLQTAMPQNTTTTMSIYVANLPGSVSEADLFELFKPHGPLKVIKIPRDPKLRTPLGHAYVTFYNPDHADAALGALKETELGGQQVTCALTEEVPSSASSMSTPPSSAHSPIDPARAVFVRDTRDGVDAATTKTALESLGAVSLQPKGPNAFVAVFPTAEEASKVLSDELANLEISPVRDPKTHFTNLFVRGLSRETTEEALRAEFERFGAVTSLLLPLDESHRAKGFGFVNFEEHRDAVTAVAALDGAELCGARISVSRAQSKVERQAELKRAYEANRIERLRNARGTNLYITNLNPAINNERLRAYFSKFGEITSVRIMLDAVGNSKGFGFVCFRDPDHASNAIAEMHNRPIEGNVLQVAIAHKKDPQSAPYSLGKRFPPSVGGAVPVVGMHGGIPGGMPMHSAPNMHHVPPHLVPPHLMQSHMVQSHMMPMGPMVPMHQMGPVMMRRDGGGNPVNPGGSTNIGNSTNSTNSSNPGKFKKRQPMLQPYGNIAASVAAAATPQAAKEIVGETLYPIVQRHPAIGKDADTTAHVTGIMLQHDNADILSWLEDEQLLNKRIQQASDAYREWLEEREGQDEAKQDEA

SEQ ID NO: 52004 - protein, 363 aa, Bordetella bronchiseptica RB50
MALQCGIVGLPNVGKSTLFNALTRAGIAAENYPFCTIEPNVGVVEVPDPRLDKLAEIVKPERILPATVEFVDIAGLVAGASQGEGLGNQFLSHIRETNAIINVVRCFEDPNVVHVAGKVDPIADIEVIETELALADLQTAEKALHRHSKTARSGDKDAQRLVTVLEKCIAQLNQAKPVRGLDLSDEEQALIAQLCFITAKPAMYVGNVSDDGFTDNPLLERLAEFAKSRNAPMVAICAAIESEIVDLPEEDRQAFLSDMGMEEPGLNRLIRGAFTLLGLQTYFTAGVKEVRAWTIPIGATAPQAAGVIHTDFERGFIRAQTIAYEDFIACKGEQGAKEAGKMRAEGKEYVVKDGDVMNFLFNV

SEQ ID NO: 52005 - protein, 205 aa, Frankia sp. EAN1pec
MPGYLLPVDVAAVRRPTGRGLAGGGLVEGLKAGFVGAAVDDALANRVCAQLLLLAQASRRQDISLYINSPGGSVDAGMAIYDTMQFIENDVATYALGLAASMGQFLLTAGTAGKRFALPNSRIMMHQPHGGVGGTASDIAIQAEQALHTRRRMQELIAEHSGHSVAEIAADSDRDRWFTAAAAKEYGLVDAVVEHVRRVPAGFTR

SEQ ID NO: 52006 - protein, 403 aa, Magnaporthe grisea 70-15
MSQSTLDIKQVRGSFPALSVDQVFFDNAGGSQTLDKVIDSIREYLSNTNVQLGASYSTGQKSTDLYDKGYEAAAKYINASVDNIVLGSSTTQLFRNLSQTLNFSHGDEIIVSKIDHEANIASWVDLAERQKLVLKWWLPSQASLDASSPKLEVADLKDLLSDKTRLVTLTHASNILGTIHDVKAVSDAVHAQKDEALVCVDGVAYAPHRPIDVKALGVDIYCFSWYKVYGPHISMLYASDRANSQMKSLGHYFNPSKTVEDKLGLAGSSYELVASIPEVVTYLDGKEAAIEKQETLLSETLLKYLRSRDDVTIWGEKSSDGQLRVPTISFTVKGWGSQELVETVEKGTNFGFRWGSFYSVRLVEEMLDLGHDGITRVSMVHYNTVDEVERLVEALDKTLASKE

SEQ ID NO: 52007 - protein, 529 aa, Thermus thermophilus HB8
MSALYRRFRPLTFQEVVGQEHVKEPLLKAIREGRLAQAYLFSGPRGVGKTTTARLLAMAVGCQGEDPPCGVCPHCQAVQRGAHPDVVEIDAASNNSVEDVRELRERIHLAPLSAPRKVFILDEAHMLSKSAFNALLKTLEEPPPHVLFVFATTEPERMPPTILSRTQHFRFRRLTEEEIAFKLRRILEAVGREAEEEALLLLARLADGALRDAESLLERFLLLEGPLTRKEVERALGLPPREALAEIAASLARGKTAEALGLARRLYGEGYAPRSLVSGLLEVFREGLYAAFGLAGTPLPAPPQALIAAMTALDEAMERLARRSDALSLEVALLEAGRALAAEALPQPTGAPSPEVGPKPESPPAPEPPRPEEAPDLRERWRAFLEALRPTLRAFVREARPEVREGQLCLAFPEDKAFHYRKASEQKARLLPLAQAHFGVEEVVLVLEGEKKSLSPRPRPAPPPEAPAPPGPPEEEVEAEEAAEEAPEEALRRVVRLLGGRVLWVRRPRTREAPEEEPLSQDEIGGTGI

SEQ ID NO: 52008 - protein, 854 aa, Oryza sativa Japonica Group
MALFLFLAAIVLAAASPAVGQLPAGFLSIDCGLEANYSGYKDTDTGIVYVSDDPYVDTGKNHRISADSTYQRFYQTIRSFPTGERNCYALPTVYGDKYIVRVMISRNSQMISLLWPTLPQFALHLGANYWDTVQDDSTEVYEALFMAWASWAPVCLVNTDQGTPYASAIELRPLGNELYPAVMANQSMRMSIRCRMGQTDSSITRFPDDQHDRYWWTTPTNPMWANLSTTSDIQEESSLFGVPSAILQKAVTVVGNGTMLNVTWEDRLFIEFMVFLHFADFQDSKIRQFNVYFNNDSPLLYTPLYLAADYVYSVVWYSSTNGKFNITLVATAKSLLPPMLNAYEIYTLIAHSTPTTFSKDFDVIMAIKFEYGIKKNWMGDPCSPSQFAWDGVICRNTSDNIPRIISLDLSNSNLHGVISNNFTLLTALENLNLTGNQLDGTIPDSLCKLNAGSFIFSYNSDQDVCNKTSPSSSRSRATILAISIAAPVMVVAILGTSYMIWRVKRKSNFFAYNPPRVLEHTNASRNEKYHWDHLQENENRQFTYEDLEKITDNFQLIIGEGGSGRVYHGRLEDNTEVAVKMLSGTSSSGLNGFLAEVQSLTKVHHKNLVSLVGYCSEKAHLALVYEYMSRGNLFDHLRGKSGVGENLNWAMRVRVLLDAAQGLDYLHKGCNKSIIHRDVKTSNILLGQNLRAKIADFGLSKTYISDSQSHMSATVAGSMGYIDPEYYHTGWITENSDVYSFGVVLLEVVTGELPILQGHGHIIQRVKQKVDSGDISSIADQRLGSDYDVSSMWKVVEIALLCTEPVAARRPSMAAVVAQLKDSLTLEEAREERGLKENPTDEVAMLPTSGPSAR

SEQ ID NO: 52009 - protein, 311 aa, Oryza sativa Japonica Group
MAKHFVLNTGAKIPSVGLGTWQSDPGVVGNAVYAAVKAGYRHIDCASAYNNEKEVGLALKKLFEEGVVKREDLFITSKLWCDHHAPEDVPEALDATLNDLQLEYLDLYLIHWPFRTKKGSSIGKPESYLPPDIPSTWAAMEKLYDSGKSRAIGVSNFSSKKLGDLLAAARVPPAVDQVECHPGWQQMKLHNFCQSTGIHLSAYSPLGSPGSTFMNGNVLKEPIIISIAEKLGKTPAQVALRWNIQMGHSVLPKSVSEERIKQNLDVYDWSIPEDLLAKFSEIKQVRLLRGNFIVNPQSVYKTHEELWDREI

SEQ ID NO: 52010 - protein, 245 aa, Zea mays
RGRPEKKKKKKKKKKKKKICSSFTASLASRPRPRRPTPPFRPRVSVAAPLSVRVTGGRRGQAVVAMASADARLAGIASSIRVIPDFPKPGIMFQDITTLLLDPKAFRDTIDLFVERYKDQGITVVAGVEARGFIFGPPIALAIGAKFVPLRKPKKLPGEVISEEYSLEYGTDKIEMHVGAVQANDRALVVDDLIATGGTLCAAVKLIERVGAKVVECACVIELPELKGRDKLGDRPVFVLVEADA

SEQ ID NO: 52011 - protein, 470 aa, Hyphomonas neptunium ATCC 15444
MSQTYTMTINGKAVSGAETFGVENPATGEVFAQAPNCTEAQLDEAVAAARAALPGWKATPIEKRRQALQAIAGVIAQNGEELARLLTREQGKPHPDAMGDVLGGAHWLVETAKLDIPEHVSEDSPERLAVTRYGPIGVVAAIVPWNFPIILMMFKVAPALLAGNTLVVKPAPTTPLTTLKIAELIRDILPPGVLNVISGADRLGPWLTAHKDIDKVSFTGSTETGKKVMASAAKDLKKVTLELGGNDAAIVMPDVDVKAVAEQLFWAAFRNAGQICIATKRMYIHKDVYEPLKAAIVDYAASVKVGDGAEQGTQIGPIQNKAQYERVLELIQDAKDKGYKFLIGGNSSNVPGYFVPVTILDNPPEDARIVQEEQFGPVLPLMSFDNIDEVVGRANASIYGLGASIWTKDLDRAQALAVQLQAGTVWINESQHLSPHAAFGGHKQSGVGVEGGQDGLLEFCQAQTVFMRRT

SEQ ID NO: 52012 - protein, 172 aa, Ashbya gossypii ATCC 10895
MIKGLGEVDQTYDASSVKVGIVHARWNKTVIDALVQGAIEKLLAMGVKEKNITVSTVPGAFELPFGTQRFAELTKASGKHLDVVIPIGVLIKSDSMHFEYISDSVTHALMNLQKKIRLPVIFGLLTCLTEEQALTRAGLGESEGKHNHGEDWGAAAVEMAVKFGPRAEQMKK

SEQ ID NO: 52013 - protein, 821 aa, Saccharomyces cerevisiae
MENITQPTQQSTQATQRFLIEKFSQEQIGENIVCRVICTTGQIPIRDLSADISQVLKEKRSIKKVWTFGRNPACDYHLGNISRLSNKHFQILLGEDGNLLLNDISTNGTWLNGQKVEKNSNQLLSQGDEITVGVGVESDILSLVIFINDKFKQCLEQNKVDRIRSNLKNTSKIASPGLTSSTASSMVANKTGIFKDFSIIDEVVGQGAFATVKKAIERTTGKTFAVKIISKRKVIGNMDGVTRELEVLQKLNHPRIVRLKGFYEDTESYYMVMEFVSGGDLMDFVAAHGAVGEDAGREISRQILTAIKYIHSMGISHRDLKPDNILIEQDDPVLVKITDFGLAKVQGNGSFMKTFCGTLAYVAPEVIRGKDTSVSPDEYEERNEYSSLVDMWSMGCLVYVILTGHLPFSGSTQDQLYKQIGRGSYHEGPLKDFRISEEARDFIDSLLQVDPNNRSTAAKALNHPWIKMSPLGSQSYGDFSQISLSQSLSQQKLLENMDDAQYEFVKAQRKLQMEQQLQEQDQEDQDGKIQGFKIPAHAPIRYTQPKSIEAETREQKLLHSNNTENVKSSKKKGNGRFLTLKPLPDSIIQESLEIQQGVNPFFIGRSEDCNCKIEDNRLSRVHCFIFKKRHAVGKSMYESPAQGLDDIWYCHTGTNVSYLNNNRMIQGTKFLLQDGDEIKIIWDKNNKFVIGFKVEINDTTGLFNEGLGMLQEQRVVLKQTAEEKDLVKKLTQMMAAQRANQPSASSSSMSAKKPPVSDTNNNGNNSVLNDLVESPINANTGNILKRIHSVSLSQSQIDPSKKVKRAKLDQTSKGPENLQFS

SEQ ID NO: 52014 - protein, 358 aa, Saccharomyces cerevisiae
MLPEKRLLTPDDMKLWEESPTRAHFTKFIIDLAESVKGHENSQYKEPISESINSMMNLLSQIKDITQKHPVIKDADSSRFGKVEFRDFYDEVSRNSRKILRSEFPSLTDEQLEQLSIYLDESWGNKRRIDYGSGHELNFMCLLYGLYSYGIFNLSNDSTNLVLKVFIEYLKIMRILETKYWLEPAGSHGVWGLDDYHFLPFLFGAFQLTTHKHLKPISIHNNELVEMFAHRYLYFGCIAFINKVKSSASLRWHSPMLDDISGVKTWSKVAEGMIKMYKAEVLSKLPIMQHFYFSEFLPCPDGVSPPRGHIHDGTDKDDECNFEGHVHTTWGDCCGIKLPSAIAATEMNKKHHKPIPFD

SEQ ID NO: 52015 - protein, 259 aa, Streptococcus pyogenes
SNAMKIGIIGVGKMASAIIKGLKQTPHELIISGSSLERSKEIAEQLALPYAMSHQDLIDQVDLVILGIKPQLFETVLKPLHFKQPIISMAAGISLQRLATFVGQDLPLLRIMPNMNAQILQSSTALTGNALVSQELQARVRDLTDSFGSTFDISEKDFDTFTALAGSSPAYIYLFIEALAKAGVKNGIPKAKALEIVTQTVLASASNLKTSSQSPHDFIDAICSPGGTTIAGLMELERLGLTATVSSAIDKTIDKAKSL

SEQ ID NO: 52016 - protein, 901 aa, Saccharomyces cerevisiae
MVNPVGSSKLEQNNIKSIIGSSYNRLYSQFTSDELTEVGNYKILKQIGEGSFGKVYLALHRPTHRKVCLKTSDKNDPNIVREVFYHRQFDFPYITKLYEVIVTESKVWMALEYCPGKELYDHLLSLRRISLLECGELFAQISGAVYYAHSMHCVHRDLKLENILLDKNGNAKLTDFGFTRECMTKTTLETVCGTTVYMAPELIERRTYDGFKIDIWSLGVILYTLITGYLPFDDDDEAKTKWKIVNEEPKYDAKVIPDDARDLISRLLAKNPGERPSLSQVLRHPFLQPYGSVVLDQTQKILCRQRSGGTQFKSKLERRLLKRLKQSGVDTQAIKQSILKKKCDSLSGLWLLLLAQGKKQENCKYPKRSRSVLSVKKVIESATHNDTNGISEDVLKPSLELSRAASLSKMLNKGSDFVTSMTPVSRKKSKDSAKVLNPTLSKISSQRAYSHSIAGSPRKSNNFLQKVSSFFKSKKSSNSNSNNSIHTNVSESLIASNRGAPSSGSFLKKNSGSIQKSRTDTVANPSRTESIGSLNENVAGAIVPRSANNTTLENKKTSGNEIGLKVAPELLLNEHIRIEEPRLKRFKSSISSEISQTSTGNYDSESAENSRSISFDGKVSPPPIRNRPLSEISQISNDTYISEYSTDGNNSSFKISDTIKPSYIRKGSETTSQYSASSEKMTNGYGRKFVRRDLSIVSTASSTSERSSRTDSFYDITTATPVVTTDNRRNKNNNLKESVLPRFGTQRPWTGKRTYTTSRHGKNARRSSKRGLFKITSSNTDSIIQEVSSSEEEDHNVIYSKGKGLPTPVLQTKGLIENGLNERDEEGDDEYAIHTDGEFSIKPQFSDDVIDKQNHLPSVKAVATKRSLSEGSNWSSSYLDSDNNRRRVSSLLVEDGGNPTA

SEQ ID NO: 52017 - protein, 527 aa, Zea mays
MQGASHMLLEEPFRLASVLSPAKPKVFPSLTKIVGTLGPNSHSVEIIQECLTAGMSVARFDFSWMDAAYHQETLDNLRKAAQNVKKLCPVMLDTLGPEIQVHNSTGEPIELKAGNHVIITPDISKALSAEILPIKFGDLAKAVKKGDTLFMGQYLFTGSETTSVWLEVVETSGENVNCLVKNAATLAGPIFTLHASQVHINLPTLSEYDKHVISTWGSCNSVDIISLSHTRSAEDVRELRAFLQAHALPDTQIYAKIENSEGLDHFDDILNAADGIIISRGDLGIDLPPENVFMFQKTAIHKCNLEGKPVIITRVVDSMIDNLRPTRAEATDVANAVLDGTDGILLGAETLRGLYPVDAVSTVGRICAEAETVYNQPLQFKKVMWHVGDPMPHEESVASAAVGSAIKVKAAAIVVFTFSGRAARLVAKYRPTMPILAVIFPREGSDPSKWRSYGTTQARQCFAVRGVYPLMGSTDEAETGGLTKEEYGIKLAMSYGRSVGIVKPFDRLIIFEKIGDSSVVKIIECEG

SEQ ID NO: 52018 - protein, 500 aa, Herminiimonas arsenicoxydans
MLMFKKTFLSVASAAALLGASAAPAFAASSFYLVVPVPTAAKAPVEDIRVSLAGAALPKATVSKAYSESLRPYLSVTGDAAFDPAAASWSLADGILPAGLVLDETTGAVAGTPSAKTTTPVSFTVLATYMGSDGQAVYTIEVAGAVLHVRNIAAGEQHTCAVTDAGGVKCWGLNDQGQLGDNSTTSRMIPVDVAGLGSGVSSINAGRAHTCAIAAGALKCWGENIYGQLGDNSATQRNAPVDVAGLGSGVASVSAGHSHNCAITTSGAVKCWGWNAAGQLGIPPSVERWTPVDVVQLGNDGASIAAGGLHTCATTKSGAVKCWGWNAHGQLGDNSTTQRDTPMNVVGLESGVSSIAAGLHHNCAVMTTGAAKCWGWNEYSQLGDNSATQRNAPVDVAGSGVASIAADLYHTCAVMTTGAAKCWGRNDYGQLGDNSLTDSPTPVNVSGLASGVSSIASGYSHTCAVLTTGQVKCWGRNDYGQVGDGSTTVLHLTPVDVQGN

SEQ ID NO: 52019 - protein, 371 aa, Streptococcus agalactiae A909
MALTAGIVGLPNVGKSTLFNAITKAGAEAANYPFATIDPNVGMVEVPDERLQKLTELITPKKTVPTTFEFTDIAGIVKGASKGEGLGNKFLANIREVDAIVHVVRAFDDENVMREQGREDAFVDPIADIDTINLELILADLESINKRYARVEKMARTQKDKESVAEFNVLQKIKPVLEDGKSARTIEFTEEEAKVVKGLFLLTTKPVLYVANVDEDKVADPDDIDYVNQIRAFAETESAEVVVISARAEEEISELDDEDKLEFLEAIGLTESGVDKLTRAAYHLLGLGTYFTAGEKEVRAWTFKRGIKAPQAAGIIHSDFERGFIRAVTMSYDDLIQYGSEKAVKEAGRLREEGKEYIVQDGDIMEFRFNV

SEQ ID NO: 52020 - protein, 998 aa, Cryptococcus neoformans var. neoformans JEC21
MDRLQRTRSQHFVSSPRKTASPLIARHTLYPRHPPKKRRLGVTTFVASHNEAGQNYSNELEDDLEKAIMKTGESSSAPARRTSRSRSQSRPVRRKSNDKVWADSLPNGQDGEDAASPKKRKRSRAGSLSTEDSWVETSGDEWEPDFIAESDRNMIHYAPSTALHRLRKAELVRLWRVAGMWDSEDIPDDMNEDETIGDMGKKELVDGLISARKHQTGRLISPLPSSPNRLIRRQSTLSPIPATPPPSSPLAESSSPDVTPKPRPRTRSRVRLETPVVRRQPRPSRPTRTLTKRHTKSEARSRRVRAQLTKKVNGKSENGDEIELTESSDSDDDVNGIESTPIVKRLRPRGVGERKSFMKEPSTDITDFEDDAEEADAEATEVEEEPQPKERKLRRKSISQASLSKYGGDIDMAPTSEQRSSKNLPTRGAKKKAIQRMQGGESGTEDEDMEVDEERDIGMKEGTPTPQPAIPPRRGRASRSSTPKLDEDSAMVGSPTPSVATETEASTPRPVHTTRSGKTFGAIQNRRRQLLQEARNDPDMDEEDESDEEDGEPELDIDLSEATVASLIRLLRDELVQMCETRGIEVGGTKPQLAKALLEWRDEQKGSYPSSASTARPSPPRTAMPRRKSKSKSKTKSKFKSNKHVPAIGTAAHAPGKPTPVLLRSHIHANDPETPPLSKGEEGDVEEEKKGTEAELNLDLQELGLEDSVIKPSQLIKLEKIGSGGFKDVYVGKFRGRKVAISEFRSHLSEMDIRELKLLAEFSHPNIVRFVSPFLSSERIIAYIEQRGICIPEDSTHVPCMLVSELCENGDLFDYIRNVPCPTLKRLLSLMLDIARGLEYLHTRKPSIIHRDCKSSNILINRSGVAKVGDFGLARVKNSTRSMIRSLVGTVNWQAPELWHPTPRYDYKVDVFSAGMVYWEMMSGWIGEKKYPWEGHNEHYIYDAVGTKHRRPPVTGMRKHWGSEPVNLMERMWHQDPAERPTMTDVVHDLESILAELK

SEQ ID NO: 52021 - protein, 223 aa, Arabidopsis thaliana
MLVAYPAGTINKFQIPISCYAALRRFKTSPFGPLISCSVSPRSIVPCSNVECYHSSFSTKYQIQPRRRWMFCNSRNNSISSDDEYRSSPNIAISLLRRYRTVIGRGEGETLKEFISAGVNAYALGCTDEDLRKELMAMKDSGLEIERMENYGGSTQTKSKITLSEVDECILWLRIVFITILCTPQPTVIRWSSTPSVSDEILSKWRGFCAVIANAYYIRGMAW

SEQ ID NO: 52022 - protein, 529 aa, Fragaria x ananassa
MGNCCVTPPQTGSPLKNKKNKPNPFAIDYVVANGGKLSVLKNPTGTEIEQTYELGRELGRGEFGITYLCTDKATNENYACKSISKQKLRTAVDIEDVRREVEIMKHLPKHPNIVSLKDTYEDDNAVHLVMELCEGGELFDRIVSRGHYTERAAAAVTKTIVEVVQMCHKHGVMHRDLKPENFLFANKKETAPLKAIDFGLSVFFKPGERFSEIVGSPYYMAPEVLRRNYGPEVDVWSAGVILYILLCGVPPFWAETEQGVAQAIIRSVVDFKRDPWPKVSDNAKDLVKKMLDPDPKRRLTAQQVLDHTWLQNAKRAPNVSLGETVRARLKQFSVMNKLKKSALKVIAEHLSQEEVAGIQEGFKIMDTSNKGKINIDELRVGLHKLGHQIPDADVHILMEAGDVDNDGYLDYGEFVAISVHLRRMGNDDEHLRKAFDFFDQNKSGFIEVEELRTALATEVDDHVEDVISAIISDVDTDKDGKISYEEFATMMKAGTDWRKASRQYSRERFNSLSLKLMRDGSLEGKTESK

SEQ ID NO: 52023 - protein, 759 aa, Glycine max
MGPFRKPFLAFLSVVLFLGLYEAAAEQTQTHKSTYIVHVAKSEMPESFEHHAVWYESSLKTVSDSAEMIYTYDNAIHGYATRLTAEEARLLQRQTGILAVLPETRYELFTTRTPLFLGLDKSADLFPESSSGSDVIVGVLDTGVWPESKSFDDTGLGPVPSTWKGACETGTNFTASNCNRKLIGARFFAKGVEAMLGPINETEESRSARDDDGHGTHTSSTAAGSVVSGASLLGYASGTARGMATRARVAAYKVCWKGGCFSSDILAAIERAILDNVNVLSLSLGGGMSDYYRDSVAIGAFSAMENGILVSCSAGNAGPSPYSLSNVAPWITTVGAGTLDRDFPAYVALGNGLNFSGVSLYRGNAVPDSPLPFVYAGNVSNGAMNGNLCITGTLSPEKVAGKIVLCDRGLTARVQKGSVVKSAGALGMVLSNTAANGEELVADAHLLPATAVGQKAGDAIKKYLFSDAKPTVKILFEGTKLGIQPSPVVAAFSSRGPNSITPQILKPDLIAPGVNILAGWSKAVGPTGLPVDNRRVDFNIISGTSMSCPHVSGLAALIKSAHPDWSPAAVRSALMTTAYTVYKTGEKLQDSATGKPSTPFDHGSGHVDPVAALNPGLVYDLTVDDYLGFLCALNYSASEINTLAKRKFQCDAGKQYSVTDLNYPSFAVLFESGGVVKHTRTLTNVGPAGTYKASVTSDMASVKISVEPQVLSFKENEKKSFTVTFSSSGSPQQRVNAFGRVEWSDGKHVVGTPISINWG

SEQ ID NO: 52024 - protein, 169 aa, Triticum aestivum
MAASAAAKKLTLKSSDGEDFEVEVAVAMASQTIHPSVEDGCADNIIPLPNVTAKILSKVIEYCTQHAPKADDAAAADSTGTATAVKPDEEKLKAFDTEFVKVEQATLFDLILAANYLDIKGLLDLTCQTVADMIKGKTPEEIRKTFNITNDFTPEEEEEVRKENQWAFE

SEQ ID NO: 52025 - protein, 128 aa, Brassica napus
MSNTPAAAPTSSSKSKAAGSSQAPEKRKPLFQKELQHMMYGFGDEQNPLPETVALVEDIVVEYVTDLTHKAQEIGTKRGRLLVDDFLYLIRKDLPKLNRCRELLAMQEELKQARKAFDVDEEKITSLD

SEQ ID NO: 52026 - protein, 619 aa, Pneumocystis carinii
DPTYSAVIKGIKEGRNGLGSIYVFGSGNGGLLDDCNYDGYANSPYTVTIGAIDSEDKNFYFSESCPCILASTYSGGENESIYTTDIGKTNCTTEHSGTSASTAIAAGIIALVLSVNPNLTWHDIQALIVETAVPFNLKYPGWGELPSKRYYNNYFGYGKLDAYRMVERARTFKTLNAQTMFSTQLIRINMQFPGTTKHITSSFYIHSGYPEYYNFKNLEYVGVSFHYQHQRKGRLEFSITSPANVTSKLARVRIRDKEGGTFSWVFTTVKHWGESIVGNWTIDVEDKNMWNEQSSIFSWQLHFFGESINSSKAQPPPYPFAHKQPTTAPPPDPGATPPPDLDANPQPQPDPGSPPSSDPESPPSSEPGYQPPSKPGPQPPSEPQPPSKPDLNPPSDPSSQQDPDTSLSSNPTSTSSSEPSPPSPPPAPAPAPPAPPPPPAPAPAPPAPPPPPAPAPAPPAPPPPPAPAPAPPAPPPPPAPAPAPAPPPPPPPPPPRPELEPEPEPEPEPEPEPQPPQPQPEPPVPPPKPQPPPPPPEQKPTSITSSTSTTSSSKTKISTTRKASSTKTSSTTKTSARPSPTEGTFTGSSASHLSFFEKRHLLLQMILLLFFFLFLGYSF

SEQ ID NO: 52027 - protein, 477 aa, Aristolochia gigantea
GRIAQIIGPVLDVAFPPGKMPNIYNALVVKGRDTVGQQVNVTCEVQQLLGNNRVRAVAMSATDGLMRGTEVVDTGAPLSVPVGGATLGRIFNVLGEPVDNLGPVDTRTTFPIHRSAPAFIQLDTKLSIFETGIKVVDLLAPYRRGGKIGLFGGAGVGKTVLIMELINNIAKAHGGVSVFGGVGERTREGNDLYMEMKESGVINEQNLAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTSQRYKELQDIIAILGLDELSEEDRLTVARARKIERFLSQPFFVAEVFTGSPGKYVGLAETIRGFQLILSGELDGLPEQAFYLVGNIDEATAKAMNLDLESKWK

SEQ ID NO: 52028 - protein, 494 aa, Microcystis aeruginosa PCC 7806
MGKPTGFIEFLRELPSELTPLDRLHNWDEFHLPMPEDKLRNQAARCMDCGTPFCHTGTLISGMASGCPINNLIPEWNDLIYRGLWREALDRLHKTNNFPEFTGRVCPAPCEGSCVLGIHNPPVTIKNIECSIIDKGWESGWITANPPAIRTGKKVAVIGSGPAGLAAADQLNKAGHWVTVYERADRPGGLLMYGIPNMKLDKEEVVLRRLQMLEQEGVKMVCNTEVGKDISSQDLLNEYDAVVICTGATKPRDLNIEGRQLKGIHFAMEFLTANTKALLDGQPGEDFISAAGKDVVIIGGGDTGTDCVGTSLRHNCRSVTQLEIMPQPPRERAADNPWPEWPKIYRLDYGQEEAAARFGDDPRVYTTTATKFEGDSEGNVTGIHTVQVEWQRNEKGQFIPQPVAGTEKVIPTQLVLLAMGFLGPEQPLLDDLGLEKDARSNIKAEHGQFTTSLPKVFAAGDCRRGQSLVVWAINEGRGAARECDRFLMGATDLP

SEQ ID NO: 52029 - protein, 299 aa, Rhodococcus erythropolis
MTILAPVTKSESSTDPRDPLARLENLFDPGTTVPLHARDKSGVLAASGNIDGVRTIAYCSDATVMGGAMGVDGCKHLVKAIDTAIEEESPIVGLWHSGGARLAEGVEALHAVGLVFEAMVRASGLIPQISVVLGFAAGGAAYGPALTDVVIMAPEGRVFVTGPDVVRSVTGEQVDMVSLGGPDTHTKKSGVAHIAAHDEADALHRARRLVSMMCEQGEFDQRAAELGDSDLRAMMPASAKRAYDVRPIVHEMLDNVEGESSFEELQGNYARSIVTGFGRMAGRTVGVIANNPLRLGGCL

SEQ ID NO: 52030 - protein, 902 aa, Pneumocystis carinii
MTLKILFTLTLYWIYLVRVRCERKPVDFENNDYYHFHFSEDVDIEDFSRALGFKHYMKLEYLDNQHIFSIEKSVLEDEIKEKIENYFGLEKGRNAIDGFNSDKLFHYEKQKLVKREKRNVIKDDIYFDNQDLYNDEVVNNVVKDPMGDQAENQKGDQAEKPTVNPPVNLTEKLEEIKKQLNISDPFQYEKPWYRYKCYRCMVTRFDICVVDCLLMILGITGKNVTVAIVDNGLDYTNKDLAPNYNANASYDFASNDPDPKPDDPDESHGTKCAGEVAAARNTLCGLGVAYESNISGIRFLTSVFALFLEAEALSYKPNVNHIYSCSWGPPEYGSLAMPMMPTTYSAIIKGVKEGRNGLGSIYVFGTGNGGLLDDCNYDGYANSPYTITIGAINSEDERPYFSESCPCILASTYSGGGNGSIYTTDIGKTNCTTQHSGSSASTAIAAGIIALVLSANPNLTWRDVQALIVETAVPFRLDYHEWEQLPSKRYYHNNFGYGKLDAYRMVERAKTFKTLNPQTTFSTQLVIVNRKIPNPSRHIRSSFYIHSGYPEYYNFKNLEYVGVSFYYKHKKRGFLEFSITSPANVTSKLTRVRFRDTESGAFFWTFTTVKHWGESIVGYWTIDVKDRNSWDEESHIFLWQLHFFGESINSSKPQPHPQYPFKHILPTTAPPPDPTTAPPPNPITTPPPSSDPGSQPPSKPGPQPPSDPQPPSDLKPPSKPDARPRPPSDPSSQQDPDTSLSSNPTSTSSSEPPPPSPPPPPPPPPAPAPAPAPPRPELEPEPEPGPEPVPQPPQPQPPQPQPEPPAPPPKPQPPPPSPPEQKPTSITSSTSTTSSSKTKISTTRKASSTKASSTTKTSTRPSPTEGTFTGSSASHLSFFEKRHLLLQMILLLFFFLFLGYSF

SEQ ID NO: 52031 - protein, 422 aa, Synechococcus sp. WH 7805
MTTLSRDIGVTLAERTRADFPILAQVSAQGDPLVYLDHAATSQKPQVVLDALRSYYSCDNANVHRGAHQLSARATDAFEGARAAVARFLGAAGPEEVVFTRNATEAINLVARTWGDDNLQAGDEVLLSVMEHHSNLVPWQQLAQRTGCVLRHVGITGSGELDLDDLRRQLNKRTRLVSLVHISNTLGCRNPVEEIAALAHGVGALMLVDACQSLAHQSTDVQRLGADFLVGSSHKLCGPTGMGFLWARKELLEAMPPFLGGGEMIQDVYLDHSTWASLPHKFEAGTPAIGEAVGMGAAIAYLEELGLEQIAAWEAQLTCHLFHKLESIEGLFILGPTPEQQPGRGALATFLVDGVHANDIASMLDLAGICIRSGHHCCQPLHRHFNVTGSARASLSFTTTFEEIDRFAAELQGVLAFFREHG

SEQ ID NO: 52032 - protein, 204 aa, Gibberella zeae PH-1
MATLDNANPTILSASQLPTRQKKAEPRRGPESKYDDIIFAKPSYLSGPFAGPTSAAWPQLNDQHDEFSSEAIDEQEIYDLISTISDPEHPVSLGQLSVINLSDIHITPSPAFGVPDPNTIVQVVVEITPTITHCSLATVIGLGVRVRLEQALPPNYRVDVTCKENSHNQDDQVNKQLGDKERVAAALENDTLKGVLDKMLETCA

SEQ ID NO: 52033 - protein, 865 aa, Saccharomyces cerevisiae
MSYTNKRHTYYGGFTNDLSDTFQYPQRTDEQRRKHVTFGPYILGSTLGEGEFGKVKLGWPKNFSNSSNSTFDFPKQVAIKLIKRDSISNDYRKEVKIYREINALKHLSHPNIVKLEEVLQNSRYIGIVLEYACGGEFYKYIQKKRRLKEMNACRLFSQLISGVHYIHSKGLVHRDLKLENLLLDKNENLVITDFGFVNEFCSRNELMKTSCGSPCYAAPELVISAEPYEARKADIWSCGVILYAILAGYLPWDDDPNNPEGSDIGRLYNYINSTPLKFPDYILPIPRDLLRRMLVSDPKKRINLKQIKKHEWLKPHSSFLSITPDEWDKLNNTQSVFRLAKPRRRYGSRPQSSCSTSSLGSRSDKRDSLVIDSTLITFPAPPQESQNHIITRPASIASDQRLSPIRRSNRHNRSNSAASVALQAVVNADREYVLSHEQSLSPVQNIRQTTGNMTASLSPPPAISPGDIIIETTPIKRNTISGSSIVPSLEEESSTTMQTSKIQPNNMASSQNHQYNKNKTQNSLQSAKNFYRTSSSSHTKPRPTSYHPGSYTTPPYNSNTLSIYEINEKAKSSASSQTLNQRDTSPFDSTPYLALDTCITSSSSIESSPKLITHGQFSVAKPSVDLQSVSGDLIKYKRDADVVTRIYDEKYKQKRKSLRYSGIFSDISCDTVTEESDELRPPESPLQQHEGQESIDKAKTEDTSEKGSKSSNIAKATAQKHVNNHLERSLNEAESTKKRFSFLSLYSYDTSKSSLYSSMDSKRKPSPPSQRRPKKDDSYQTNSKNHYITASNMQTSHQVSKDLPAPTMVQNKCTLETKKAVRSNRSSIMVSEVNKASVDNKAAQSPEHSTAKRVLGFFKRRSMKI

SEQ ID NO: 52034 - protein, 506 aa, Saccharomyces cerevisiae [sequence omitted]

SEQ ID NO: 52035 - protein, 166 aa, Schizosaccharomyces pombe 972h-
MSAQIENSIPLDFDLGNMAAFDISPLDETKLSGSEKESFLFSLSRDNVQQLVNKMISLPKERTSDGVLLQLPETVTPLPRAKPLPKPKPETKWQRFARIKGIAPKKREGRLVFDEASGEWVPKWGYKGKNKELETQWLVEEGEKEKKLTSKQVRNTSKKIKRSRRH

SEQ ID NO: 52036 - protein, 210 aa, Triticum aestivum
  misc_feature (165)..(165): Xaa can be any naturally occurring amino acid
MAGEADGKTYQVSRMPPAALNERILSSMSQKHVAAHPWHDLEIGPGAPAVFNCVVEIPRGSKVKYELDKATGLIKVDRVLYSSVVYPHNYGFIPRTLCEDNDPMDVLVLMQEQVVPGCFLRARAIGLMPMIDQGEKDDKIIAVCADDPEYRHHFRDISELPPHRXLQEIRRSFEDYKKNENKELQVNDSSPARRSINHQYPWLYVRTQGG

SEQ ID NO: 52037 - protein, 358 aa, Arabidopsis thaliana
MIPFPLLPTPIETNYRACTIPYRFPSDNLKKATPTEISWINVFANSIPSFKKRAESDTSVPDAPARAKIFEQRYAGFLEGWKKDPESNGGPPDGVILGRVREHLLRELGFRDIFKKVKDEENAKAISLFPEVVSLSDAIEDDGERLENLVRGIFAGNIFDLGSAQLSLFGAPTGKACPNYALFSFRILKLAEVFSRDGISFLATSQNLVPRPWVIDDLNKFQAKWVKKPWKKVTCLHNFGYFAFRKRVAPSRNSDLIYQLKDGNGQLIGVDTSKLLIANSGNDLAVIDLSRVSHELAYLSSDADLVILEGMGRGIETNLYAQFKCDSLKIGMVKHVEVAQFLGGRLYDCVFKFNEVQS

SEQ ID NO: 52038 - protein, 64 aa, Oryza sativa
MGDRERRTVFVTVGTTCFDALVKAVDSPQVKEALLEKGYTDLIIQMGRGTYVPSKVNEFLFHSF

SEQ ID NO: 52039 - protein, 176 aa, Zea mays
  misc_feature (44)..(44): Xaa can be any naturally occurring amino acid
  misc_feature (71)..(71): Xaa can be any naturally occurring amino acid
  misc_feature (85)..(85): Xaa can be any naturally occurring amino acid
  misc_feature (95)..(95): Xaa can be any naturally occurring amino acid
SRSVDSRFDPTDEMDVSLIVQSYTRTAVPRGASAEIYEDSHLMXGRSDYLVEIVLIAGIKVCNIIVPPIVXRSPVSIWTYDNFLXQQLDATSNVXCCRLQKIAANAILGGTLAVCMAGTMENKIPHYQLLPNLVENKTLLLPVPAYTVINGGSHAVNHLALQELMMLPTADSSLNE

SEQ ID NO: 52040 - protein, 107 aa, Synechococcus sp. WH 5701
MSSATAVTDASFELDVLKSDVPVLVDFWAPWCGPCRMVAPIVDEIAKEFEGKLKVYKLNTDENPNVASQYGIRSIPTLMIFKGGQKVDTVVGAVPKNTLSGTIAKYL

SEQ ID NO: 52041 - protein, 254 aa, Rhodobacter sphaeroides 2.4.1
MSDFLQGLFSLTGRRAMVTGASRGLGQAIALGLAEAGADLVLTARAAGALEETAARIRALGREALCLALDQSDPASVAAPMEAAGRIDILVNNAGTEEVCPSEAVTPELWDRILDTNLRGAFFVTQAAARGMLARGQGSIVNLCSLTSFVGVPTAVPYGSSKSGLLGMTRALAAEWAPRGVRVNAIAPGYFRTALTEVFYQNEDWAQAMQARIPQGRFGEGRDLVGAAVFLASDASAYVTGQCLGVDGGYLGSI

SEQ ID NO: 52042 - protein, 481 aa, Streptococcus pneumoniae TIGR4
MKQEECQMTKANFGVVGMAVMGRNLALNIESRGYTVAIYNRSKEKTEDVIACHPEKNFVPSYDVESFVNSIEKPRRIMLMVQAGPGTDATIQALLPHLDKGDILIDGGNTFYKDTIRRNEELANSGINFIGTGVSGGEKGALEGPSIMPGGQKEAYELVADVLEEISAKAPEDGKPCVTYIGPDGAGHYVKMVHNGIEYGDMQLIAESYDLMQHLLGLSAEDMAEIFTEWNKGELDSYLIEITADILSRKDDEGQDGPIVDYILDAAGNKGTGKWTSQSSLDLGVPLSLITESVFARYISTYKEERVHASKVLPKPAAFNFEGDKAELIEKIRQALYFSKIISYAQGFAQLRVASKENNWNLPFADIASIWRDGCIIRSRFLQKITDAYNRDADLANLLLDEYFLDVTAKYQQAVRDIVALAVQAGVPVPTFSAAITYFDSYRSADLPANLIQAQRDYFGAHTYQRKDKEGTFHYSWYDEK

SEQ ID NO: 52043 - protein, 741 aa, Desulfotalea psychrophila LSv54
MFEIVENSIIAPNVHRLIIKAPRVAKSRKPGQFVIVHEEGGERIPLTIADENIENGTITLIIQAVGEGTKQIVSKQAGEFIRDIAGPLGKASEIEKVGKVVCIGGGVGTAVLFPLAKALAAAGNDLTTIIGGRSESFVILKDELAVFSTQLKITTEDGSLGDKGFVTGPLAEILEDETRRPEIIYAIGPVPMMAAICEQTRPYGVKTIVSLNPIMVDGTGMCGGCRVTVANKVKFACVDGPEFDGHEVDFKELAARQRQYVGHDHDRHKCRMDAVKIETISIKERMAIPRAHMPEQDAKIRATNFTEVNLGISEEVAIREAQRCLNCKTRPCVSGCPVGVRIPEYLQEVAKGDFAAAAKILREDNALPATTGRVCPQESQCEQKCVRGKKGDAVALGWLERFVADWAAQNLKPEVPCIEKTGKKVAIIGSGPGGLTAAGELARRGHDVTVFEALHTAGGVLRYGIPEFRLPKNIVDHEVENLVALGVKFEFNVIIGQTLTIKEIMAEFDSCFIANGAGLPIFLNLPGENLNGVYSSNEYLTRVNLMNAYKKGSATPIVTGPTTVVFGGGNTAMDSARTAKRMGSERVILAYRRGRDEMPARLEEVIHAEQEGIEFMFLVAPLSIGGTEDGWVENVHLQKMELGEPDASGRRRPVAIEGSEFKVEADIVIMSIGTTSNPLLTSTCPELELNKWGNIVVDEKQMSSMQGVFAGGDIVRGGATVILAMGDGKNAAQSIHDYLQK

SEQ ID NO: 52044 - protein, 118 aa, Rhodobacter sphaeroides 2.4.1
MKGTCHCGAVEIEVELLNGFADARRCDCSFCRRRGAIAATARLSDLRVVRGAENLTLYQFGTRTAKHWFCRTCGIYTHHQRRSNPEEYGVNVAILEGVNPRDLGEVPWTDGVNHPSDR

SEQ ID NO: 52045 - protein, 423 aa, Arabidopsis thaliana
MTSLHTLLFSSLLFFIVFPTFTFSSTLLFQSFNWESWKKEGGFYNSLHNSIDDIANAGITHLWLPPPSQSVAPEGYLPGKLYDLNSSKYGSEAELKSLIKALNQKGIKALADIVINHRTAERKDDKCGYCYFEGGTSDDRLDWDPSFVCRNDPKFPGTGNLDTGGDFDGAPDIDHLNPRVQKELSEWMNWLKTEIGFHGWRFDYVRGYASSITKLYVQNTSPDFAVGEKWDDMKYGGDGKLDYDQNEHRSGLKQWIEEAGGGVLTAFDFTTKGILQSAVKGELWRLKDSQGKPPGMIGIMPGNAVTFIDNHDTFRTWVFPSDKVLLGYVYILTHPGTPCIFYNHYIEWGLKESISKLVAIRNKNGIGSTSSVTIKAAEADLYLAMIDDKVIMKIGPKQDVGTLVPSNFALAYSGLDFAIWEKK

SEQ ID NO: 52046 - protein, 261 aa, Rhodobacter sphaeroides 2.4.1
MQGSANLNLMIKAARKAGRSLVKDFREVENLQVSSKGPGDFVSKADREAERIIREELMGARPTYGWLGEETGEAAGQDPTRRWIVDPLDGTTNYLHGLPHWAVSIALEHKGEIVAGVIFDAAKDELYWAEKGAGAWMNESRLRVSGRRHMIEAIFATGVPFGGRSTLPATLQDLARLMPTCAGVRRWGSAALDLAYVAAGRYDGYWERGVSAWDVAAGVVLVREAGGLISGIREDQNPIDGSLICGNQNLFEPFRKVIRGE

SEQ ID NO: 52047 - protein, 472 aa, Mycobacterium leprae TN
MTRRGKIVCTLGPATQSDELIRALVEAGMDVARMNFSHGDYSDHKAVYDRVRVASDATGRAVGVLADLQGPKIRLGRFATGSTYWADGETVRITVADCHGSHDRVSTTYKNLARDAVVGDRVLVDDGKVGLVVSAIDGDDVVCTVTEGGPVSNNKGMSLPGMHVSAPALSDKDIEDLTFALNLGADLVALSFVRSPSDVELVHKAMDRVGRRVPVIAKLEKPEAVDNLEAIVLAFDAIMVARGDLGVELPLEEVPLVQKRAIQMARENAKPVIVATQMLDSMIENSRPTRAEASDVANAVLDGADALMLSEETSVGKYPLAAVKTMSRIVCAVEENSTAAPPLTHVPRTKRGVISYAARDIGERLDAKALVAFTQSGDTVRRLARLHTPLPLLAFTAWPEVRSQLAMTWGTETFLVPKMLSTDGMIRQVDKSLLELGRYKRGDLVVIVAGTPPGTVGSTNLIHVHRIGEDDV

SEQ ID NO: 52048 - protein, 370 aa, Yarrowia lipolytica CLIB122
MRSATIFSGSSHPKLVERICANLAIEPSNVDLAKFKNGETSVTIRDSVREKDVYVVQSGCGHVNDNFIELLIMISACKTASAKKVTAVMPLFPYSRQPDVPYTKAIVPPGGKTGGKDSDSTTDLANASGKPRQSGFFKDYNTGYKQWVAQSGTLIASLLTCAGADHIITMDLHDPQFQGFFDIPVDNLYGKPLLQHYISTQIPNYQDAVIVSPDAGGAKRATAIADGLCMDFALIHKERRPTKISGDHIAGKHNATTMLVGDVSGRVAILIDDLLDTSNTITRAAKLLKDQGAVKVYALITHGVFSGDAVEKIKKSEIDKIVTTNSTPQDQHAVELGEKLDVIDISRVFAEAIRRIHNGESVSMLFDHVS

SEQ ID NO: 52049 - protein, 226 aa, Oryza sativa Japonica Group
ARWTSRSSLSTRSATATVRCFSCWWGATSRRRYQRPASEAVPYFEQIGPLFSQVMPMMEASPVYSAARNASGDAWKALFDLAGGLIQVYDQEAMLSLSKFVDQLPSVMNQVTEGVSEFKPTPPENREFCKNSYNVPNTLLVKFSIDAIDDTEIVEDVLKPRVESIGGQIKKVILSGTHLTPCIQDVKWQVGSEYTPADALAQGLKSLALNETRVLSRTIADWFRSL

SEQ ID NO: 52050 - protein, 190 aa, Bacillus cereus ATCC 14579
MTEICLVRHGQTDWNFQEIIQGREDIPLNEVGKKQASQSAAALQEETWDIIISSPLIRAQETANEIAKTVGLQSILLDERFVERNFGEASGKPVAAVRELIAEGKVEGMERDEEIVARCFAALEDVATTHFGKRIIIVAHSHAIKAILHAIEPDEITFKTPLKNACISYVKQNSGKWDVLKYNIAEHINV

SEQ ID NO: 52051 - protein, 450 aa, Silicibacter pomeroyi DSS-3
MTTSKRVAIIGAGPSGLAQLRAFQSAAAKGEEIPEIVCFEKQDNWGGLWNYTWRTGLDENGEPVHCSMYRYLWSNGPKEGLEFADYSFEEHFGKQIASYPPRAVLFDYIEGRVLKANVRDWIRFSTAVRWIDYNDETGLFKVTVHDHTNDRVYSEEFDHVICASGHFSTPNVPHYEGFETFNGRLVHAHDFRDAREFAGKDILVVGSSYSAEDIGSQCWKYGAKSITSCYRSAPMGFKWPDNWEEKPALVKVDKNTVFFSDGTSREVDAIILCTGYKHFFNFLPDDLRLKTANRLATADLYKGVVYVHNPKMFYLGMQDQWFTFNMFDAQAWWVRDAIMGKIDLSNVTKEQMLADVTERETREEASDDVKYAIRYQADYVKELVAETDYPSFDIDGACEAFFQWKKHKGEDIMAFRNNSYTSVITGTLAPVHHTPWKDALDDSMEAYLRN

SEQ ID NO: 52052 - protein, 351 aa, Microcystis aeruginosa PCC 7806
MGYLDYKKSFSIPEHSLDRDCTTLSRHVLQQLQSFSPDAQDLSAIMSRIALAGKLIARRLSKAGLMADVLGFTGETNVQGESVKKMDVFANEVFISVFKQSGLVCRLASEEMDKPYYIPENCPIGRYTLLYDPIDGSSNVDINLNVGSIFAIRQQEDNDLDGEARDLLQNGRKQIAAGYILYGPSTILVYSIGRGVHAFVLDPSLGEFILAQENIIIPDHGPIYSTNEGNFWQWDEAIRDYTRYVHRHDGYTARYSGALVGDIHRILMQGGVFLYPGTVKNPQGKLRLIYETAPLAFLIEQAGGKASDGVTNLLDIVPDKLHYRTPLVIGSVEDVKLVESFIADRRHRDRV

SEQ ID NO: 52053 - protein, 776 aa, Oceanicola granulosus HTCC2516
MTVKEIFDTMEYGPAPESAAEALAWLVDMGGRFGCFIDGAFTDPGETFASTNPATGNDLAHVTQATQADVDAAVRAARRAQPAWAKDGHARARVLYAIARLLQKHSRLFAVLESLDNGKPIRESRDIDVPLAIRHFYHHAGYAQLMDAEQPDREAHGVCGQIVPWNFPLLMLAWKIAPALAAGNTVVLKPAEYTSLTALLFADICRQAGVPKGAVNILTGDGRVGEMIVAAEVDKVAFTGSTGVGRRIREATAGSGKSLTLELGGKSPYIVFDDADIDSAIEGLVDAIWFNGGQVCCAGSRLLVQESIAENFHTRLKARMDKLRVGDPLDKAIDVGAIVDQVQLDTITRMVDANAEGETYRANTAMPASGCFYPPTLITGLSPAATLMQEEIFGPVLVATTFRTPAEAVEIANNTRYGLAATLWSENVNLALDIAPRLKAGVVWVNGTNMFDAAAPFGGIRESGFGREGGWEGLAAYTRARGKPARLKPVQPHSGEGAPRDPLDRTAKLYIGGKQARPDGGYSTPIHGPKGALLGHAPKANRKDVRNAVEAMNAAKGWSGTTGHLRAQILFYLAENLSARADEFAERVDTMTGKGGAREVDAAIRRLFTYAAWADKYDGVAKGVPLRGLALALKEPVGKIAALCPDEAPLLGAVSLLAPALAMGNRITLVASEPFPLALTDLYQVLETSDVPGGAVNILTGSHAELAPTLADHLDIDAVWSFSSSDLSGEIERRAAANLKRTWVNNGRARDWATAEGTEFLDAATEIKTVWVPYGE

SEQ ID NO: 52054 - protein, 165 aa, Saccharomyces cerevisiae [sequence omitted]

SEQ ID NO: 52055 - protein, 470 aa, Saccharophagus degradans 2-40
MSSGRIVQIIGAVIDVEFPRDSVPKVYDALTVADKGLTLEVQQQLGDGVVRAIAMGGSEGVSRGLAVENTGAPINVPVGTATLGRIMDVLGNPIDEKGPINETERASIHRKAPKYDELAASEELLATGIKVIDLVCPFAKGGKVGLFGGAGVGKTVNMMELINNIATEHSGLSVFAGVGERTREGNDFYFEMQEAGVVNVDKFDESKVAMVYGQMNEPPGNRLRVALTGLTMAEKFRDEGKDVLLFVDNIYRYTLAGTEVSALLGRMPSAVGYQPTLAEEMGVLQERITSTKTGSITSIQAVYVPADDLTDPSPATTFAHLDSTVVLSRDIAAKGIYPAIDPLDSSSRQLDPLIIGQEHYDTARGVQSVLQRYKELKDIIAILGMDELSEEDKLTVSRARKIERFLSQPFNVAKVFTGQDGKIVSLKDTISGFQGLLSGQYDDLPEQAFYMVGSIDEAIEKAKKMKEKAA

SEQ ID NO: 52056 - protein, 389 aa, Glycine max
MPDFLATNPLTFSAAESPRFPFLNSRPTLTPRTQLNPNSRVLFSPKPSKTSCNNKSVSLALSSRSNEGPSRGYGFYNELEFEDRNEETLGLEINPVVAEDSQSETESLPFDGVEGDDNYKGEDDLVRVQGDADGDGDGLKKDYDDDDDQGENEKFGGKLRVRRGKQVIRRSNLLAKQVISIRSALSLGFVSQLWVDTSSWMVLFVEVRPNLLSGDSEKFLLEDISQIGDVVLVQDESVIDNEFKMVGLETLVGYKVVTPSRRNIGKVRGYTFSINSGAVEELELDSFGLSIIPSSLVSTYALLVEDVLEVVFDAVVVHEAAALRIQRLSKGFLGNQNVRISVDDFEDLDSEQSDTYGPISMRRKSTGGKKPNQRDWDDEDNWELPMDYP

SEQ ID NO: 52057 - protein, 180 aa, Tolypocladium inflatum
MGNKVFFDIEWEGPVMQGCKPTSTVKEQSGRINFKLYDDVVPKTAENFRALCTGEKGFGYEGSSFHRIIPEFMLQGGDFTRGNGTGGKSIYGEKFADENFQLKHDRPGLLSMANAGPNTNGSQFFVTTVVTSWLNGHHVVFGEVADQESLDVVKALEATGSGSGAVKYNKRATIVKSGEL

SEQ ID NO: 52058 - protein, 557 aa, Erythrobacter sp. SD-21
MAAQYAFVMKDMTKTFPGANKPVLSNINLQFYQGAKIGIVGPNGAGKSTLIKIMAGIDTDFTGEAWPGENITVGYLEQEPELDESKTVLENVKDGARETADMVERFNAIGMEMAEEDADFDALSTEMAELQDKIDAVDGWTLDNQLEVAMEALRCPPGDWPVTDLSGGEKRRVALTRLLIQKPSILLLDEPTNHLDAESVQWLENHLKEYAGAVLMITHDRYFLDNVVEWILELDRGSYYPYEGNYSTYLEKKAKRLEQESREESGRSKALSRELEWIRQTPSARQTKSKARIRKFEELQEGQKDRKPGKAQIVIQVPERLGGKVIEAKNISKAYGDKLLFENLSFMLPPGGIVGVIGPNGAGKSTLFKILTGKEEPDSGTVEIGSTVHLGYVDQSRDHLNPKNNVWEEISDGLDYMKVNGHDTSTRAYVGAFNFKGADQQKNVGKLSGGERNRVHMAKMLKEGGNVLLLDEPTNDLDVETLGALEEAIENFAGCAVVISHDRFFLDRLATHILAFEGDSYVEWFEGNFEAYEEDKRRRLGDAADRPTRLAYKKLTR

SEQ ID NO: 52059 - protein, 97 aa, Synechococcus sp. PCC 7002
MATYKVTLITPDGEVSYDAPDDEYILDSAGDAGYDLPASCRAGACSTCAGKIVSGTVDQSEQSFLDDDQIEAGYVLTCIAYPQSDVTIETNKEEELY

SEQ ID NO: 52060 - protein, 458 aa, Sinorhizobium meliloti 1021
MLERSNELTAWDRDHFFHPSTHMGMHARGETPTRVIGGGEGVYITDISGKRSLDAFAGLYCVNVGYGRQKIADAIAEQAKNLAYYHAYVGHGTEASIRLSKMIIDRAPEGMSRVYFGLSGSDANETNIKLIWYYNNILGRPEKKKIISRWRGYHGSGVMTGSLTGLHLFHNAFDLPRAPILHTEAPYYFRRPDRSMSEEQFSQYCADKLEEMILAEGPDTVAAFIGEPILGTGGIVPPPKGYWEKIQAVLQKYDILLVADEVVTGFGRLGTMFGSDHYGIKPDLITIAKGLTSAYAPLSGTIVSDKLWQVLVKGSDELGAIGHGWTYSAHPICAAAGIANLELIDELGIVENAGSTGAYFRAELQKAVGDHRHVGEVRGDGLMAAIEFVEDRDDRAFFDPGRKVGPQVAAALLERGVIGRAMPQGDILGFAPPLCLTRDEADIVVKAAADTIQSVLGR

SEQ ID NO: 52061 - protein, 498 aa, Sinorhizobium meliloti 1021
MTAVFARTAFHDALKNLSDRQLLRELAYVGGRWVAGRDGTCLEVSDPASGAALAFVASLDAAQTSEAIDAAQKAFRSWHNMLPQARAAILRKWHDLMLEAREDLALLMTLEQGKPLAESRGEIDYAASFIEWYAEEGKRLNAESVTSHLAGAEMIVRREALGVVGIVTPWNFPSAMITRKAAAALAAGCTVVAHPSSETPLSALALAELGERAGLPAGVFNVVTGKAATIVGRMCEDARVRAMSFTGSTEIGRLIASQCAPTMKRLVMELGGHAPLIVFADANVEKAADIAIAAKFATSGQDCLAANRIYVERPALKAFQEAFAARIAGLKVGSGMEPDTDIGPLMHERAVAKVEEQVADALKLGARLAVGGKRHAAGPLFFQPTLLTDVPDDALIMREETFGPVAAVTAFDSEEEVVARANDTEYGLVAYVVTENGARQMRLARALEYGMVAVNRVKITGGPIPFGGWKQSGLGREGSRHGMEAFTELKYLCIDTAA

SEQ ID NO: 52062 - protein, 404 aa, Magnetospirillum magnetotacticum MS-1
MPAMTQIHPDQPAARPVIRLAKGRSKRLRAGHPWVFSNEIEMGAEAKALPPGSLVTLMDAGDERLGVATFNPHSLIAARVLSRRAADTVDSLFLAERLSAALALRQSLFETPHYRLVHSEADRLPGLIIDRYGDVLAVQTNTAGMESLLPALLDALKTVLAPRAVVLVNDSPVRKLEGLEQHHEVVLGQVDGPVELMENGCRFVADLTGGQKTGWFFDQRDNRAFVARLAKGRRVLDVYTYAGGFAVQAAMAGAAETVAVDRSEHSLALADQAARLNGVEVRTVRAEAFAEMERMALAGERFGVVVADPPAFVKSRKDLGAGAKGYRKMARLAAALVEPGGFLLCASCSHHMPADTFAEEIGHGLHLAGRSGRILRSAGAAPDHPVHPWLPESAYLKAQLFQLD

SEQ ID NO: 52063 - protein, 191 aa, Rhodobacter sphaeroides 2.4.1
MIADEVQTGFARTGTLFAMHGYDVAPDLVTMAKGLGGGLPIAAVTGRAEIMDAAHPGGLGGTYGGNPLGIAAAHAVLDVIEEENLCARATELGSRLKQKLAEIRATAPEIADIRGPGFMVGAEFADPGSKAPDAGFTNRVREEALKRGLILLTCGVHGNVIRFLAPITIPEPHFAEALEILEASVAAARQG

SEQ ID NO: 52064 - protein, 234 aa, Rhodobacter sphaeroides 2.4.1
MLNADVSRRRTEAVSRGVGMQTQIYADRAVNAEIWDIEGRRYIDFAAGIAVVNTGHCHPKVMAAVAEQMGRFTHTCHQVLPYENYIRLAERLNAAAPGDFPKKTVFVTTGAESVENAIKIARIHTGRSAVVAFGGGFHGRTFMTMSLTGKVEPYKKGFGTMMPEVYHVPFPQALHGISTEGPWRPSPGSSRPTSTRAAWPRSSSSRCRARAASIPRRRIWCGRSGSSAMRTGSS

SEQ ID NO: 52065 - protein, 228 aa, Magnetospirillum magnetotacticum MS-1
MGDHEARRGEIALSDALISDDNEKASLIEAGRLLFARECTFMQGASGLDHLPAATLTEVAFAGRSNVGKSSLINALTGRNTLARTSNTPGRTQELNFFNLGGRLVLVDMPGYGFAQAPKGLVEKWTRLVNGFLKGRSVLRRAVVLVDSRHGLKDSDRDMMKMLDKAAVVYQVVLTKADKLKASELDAVQARTLEEIKSRVAAHPSLIVTSSEKGTGIPELRAELASLA

SEQ ID NO: 52066 - protein, 431 aa, Bacillus anthracis str. Ames
MSTIIDVYAREVLDSRGNPTVEVEVYTESGAFGRAIVPSGASTGEHEAVELRDGDKSRYLGKGVMNAVNNVNEAIAPEIVGFDVTDQAGIDRAMIELDGTPNKGKLGANAILGVSMAVAHAAADFVGLPLYRYLGGFNAKQLPTPMMNIINGGSHADNNVDFQEFMILPVGAPTFKESIRMGAEVFHALKAVLHDKGLNTAVGDEGGFAPNLGSNREALEVIIEAIEKAGYKAGENVFLGMDVASSEFYNKETGKYDLAGEGRTGLTSAEMVDFYEELCKDFPIISIEDGLDENDWDGHKLLTERIGDKVQLVGDDLFVTNTQKLAEGIEKGISNSILIKVNQIGTLTETFEAIEMAKRAGYTAVVSHRSGETEDATIADIAVATNAGQIKTGSMSRTDRIAKYNQLLRIEDELGEIAVYDGIKSFYNIKR

SEQ ID NO: 52067 - protein, 509 aa, Bacillus anthracis str. Ames
MRKPTALIILDGFGLREETYGNAVAQAKKPNFDGYWNKFPHTTLTACGEAVGLPEGQMGNSEVGHLNIGAGRIVYQSLTRVNVAIREGEFDKNETFQSAIKSVKEKGTALHLFGLLSDGGVHSHMNHMFALLRLAAKEGVEKVYIHAFLDGRDVGPKTAQSYIDATNEVIKETGVGQFATISGRYYSMDRDKRWDRVEKCYRAMVNGEGPTYKSAEECVEDSYANGIYDEFVLPSVIVNEDNTPVATINDDDAVIFYNFRPDRAIQIARVFTNGDFREFDRGEKVPHIPEFVCMTHFSETVDGYVAFKPMNLDNTLGEVVAQAGLKQLRIAETEKYPHVTFFFSGGREAEFPGEERILINSPKVATYDLKPEMSIYEVTDALVNEIENDKHDVIILNFANCDMVGHSGMMEPTIKAVEATDECLGKVVEAILAKDGVALITADHGNADEELTSEGEPMTAHTTNPVPFIVTKNDVELREDGILGDIAPTMLTLLGVEQPKEMTGKTIIK

SEQ ID NO: 52068 - protein, 251 aa, Bacillus anthracis str. Ames
MRKPIIAGNWKMNKTLSEAVSFVEEVKGQIPAASAVDAVVCSPALFLERLVAATEGTDLQVGAQNMHFEKNGAFTGEISPVALSDLKVGYVVLGHSERREMFAETDESVNKKTIAAFEHGLTPIVCCGETLEERESGKTFDLVAGQVTKALAGLTEEQVKATVIAYEPIWAIGTGKSSSSADANEVCAHIRKVVAEVVSPAAAEAVRIQYGGSVKPENIKEYMAQSDIDGALVGGASLEPASFLGLLGAVK

SEQ ID NO: 52069 - protein, 394 aa, Bacillus anthracis str. Ames
MNKKSIRDVDLKGKRVFCRVDFNVPMKEGKITDETRIRAALPTIQYLVEQGAKVILASHLGRPKGQAVEELRLTPVAARLGELLGKDVKKADEAFGPVAQEMVAAMNEGDVLVLENVRFYAGEEKNDAELAKEFAALADIFVNDAFGAAHRAHASTAGIADYLPAVSGLLMEKELEVLGKALSNPERPFTAIIGGAKVKDKIGLIRHLLDKVDNLIIGGGLAYTFVKALGHEIGLSLCEDDKIELAKEFMQLAKEKGVNFYMPVDVVITEEFSETATTKIVGIDSIPSNWEGVDIGPKTREIYADVIKNSKLVVWNGPMGVFEMTPFAEGTKAVGQALADAEGTYSVIGGGDSAAAVEKFGMADKMSHISTGGGASLEFMEGKELPGVVCLNDK

SEQ ID NO: 52070 - protein, 322 aa, Glycine max
MVLSDLEICKPTSSSHNKVGISRSGRDLPPAHYLFKIESYSELMNTGVEKYETNVFQAGGYKWRLILYPSGNIKSNGNGYVSLYLAIADTEKLSSGWEVDVNFKLFVFNQKNNNYLTIQDADGTVRKFQEMKTEWGFEQLISLETLLDSSNGYHVEDSCLFGAEVFVISRSGKWESLSMVKEPPHGTFTWKIGKFSTLEETYYHSKSFTVGERDWNLRVYPRGIESERGKGLSVYLQLTDCERFPAKRTVYAKFKLGILDQLNNKYHERTDSHWFRASGNIWGFKKLVALSELYEAAKGYIKDDTVIVEVQILVMSIAKIST

SEQ ID NO: 52071 - protein, 334 aa, Bacillus anthracis str. Ames
MTKIGINGFGRIGRNVFRAALNNSEVEVVAINDLTDAKTLAHLLKYDTVHGTLNAEVSANENSIVVNGKEIKVIAERDPAQLPWSDYGVEVVVESTGRFTKKSDAEKHLGGSVKKVIISAPASDEDITVVMGVNHEQYDAANHNVVSNASCTTNCLAPFAKVLNEKFGVKRGMMTTIHSYTNDQQILDLPHKDLRRARAAAENMIPTSTGAAKAVALVLPELKGKLNGGAVRVPTANVSLVDLVVELDKEVTVEEVNAAFKAAAEGELKGILGYSEEPLVSIDYNGCTASSTIDALSTMVMEGNMVKVLSWYDNETGYSNRVVDLAAYMTSKGL

SEQ ID NO: 52072 - protein, 506 aa, Oryza sativa Japonica Group
METLVCVAVWAVAMAMVVASVMWAYRWSHPRANGRLPPGSLGLPLLGETLQFFAPNTTCDISPFVKERLNRYGSIFKTSVVGRPVVVTADPEMNYYVFQQEGKLFESWYPDTFTEIFGRDNVGSLHGFMYKYLKSLVLRLYGQENLRAVLLDETDRACRTSLASWAAQPSVELKDSISAMIFDLTAKKLISYEPSKSSENLRKNFVAFIRGLISFPVDIPGTAYHECMKGRRNAMKVLKKMMRERMEEPGRQCEDFFDVLIEELGREKPVLTEGIALDLMFVLLFASFETTSLALTLGVRLLAENPTVLDALTEEHEAIVRGRKEGCDAAGLTWADYKSMTFTSQVTLEMVRLANIVPGIFRKALQDIEFKGYTIPAGWGVMVCPPAVHLNPEIYEDPLAFNPWRWQMQLTLVVLMLSGLSVGLIPKIYRVQQDKVEITGGSKHFMAFGGGLRFCVGTDLSKVLIATFIHHLVTKYRWKTVKGGNIVRTPGLSFPDGFHVQFFPKN

SEQ ID NO: 52073 - protein, 385 aa, Methanococcoides burtonii DSM 6242
MYADRINSLPPYLFATIDEAKAVVKAKGVDVIDLGVGDPDMPTPEHIVESMCEAVRDPATHRYPSYTGMIEFREAVANWCKDTRGLELDAATETLTLIGSKEGVAHIPLAFVNPGDVALIPDPGYPVYKIGTQFAGGEPHVMPLLEENGFLPDFDAIPADKLAKAKLMFLNYPNNPTSATADVKFFKEVVEFAKNNDITVVHDNAYSEMVYDDYTAPSFLSVDGAMDVGMELYSMSKTYNMTGWRLAFAVGNKDLIAGFGKVKSNIDSGAFDAVQRAGITAVSSSQQCVTDMNSIYQKRRDALLKGLRGIGLDAKAPKATFYMWVPTPDGYDSMGFSKLLLEESGIVATPGVGFGEYGEGYIRFALTQSVERIEEAVARMDKLTI

SEQ ID NO: 52074 - protein, 262 aa, Triticum aestivum
AYLGDTIEQVCTKKQAGTGPEFPGYRRPTRPNHTGASSLGAPGPGSSRGAGAGTRGGGGGRWMAEAALEGSEPVDLTKHPSGIIPTLQNIVSTVNLDCKLDLKAIALQARNAEYNPKRFAAVIMRIREPKTTALIFASGKMVCTGAKSEQQSKLAARKYARIIQKLGFPAKFKDFKIQNIVASCDVKFPIRLEGLAYSHGAFSSYEPELFPGLIYRMRQPKIVLLIFVSGKIVLTGAKVREETYTAFENIYPVLTEFRKVQQ

SEQ ID NO: 52075 - protein, 323 aa, Neurospora crassa
MDHLTTTKHTTDTEATHTQKIAGQKRDASAITTVSSQGSSASSGEGLEIRNESKREGEVKRPKLGEEQTSSNRSDNNMALIEETSMEGRQCFVTVGATAGFRPLLSEVITPEFLNCLADNHFDLLKVQCGEDFEWFDEQVKSLPSSPVTIERFAFTENMAKHYIRSRGEMSVRMPGVVVAHAGSGTILEVLRLQVPLVVVPNPTLMDNHQAELAQELESTGDAVYGRLGKLTEAIARSLELVAQGPLKLKDLPPYSPPPFPVPDSERVTLFDWMTLTCYPDELRKQQHLQDLRNVEKSFQRELEQAKVPQTETVQDRRQRDLD

SEQ ID NO: 52076 - protein, 210 aa, Sinorhizobium meliloti
AGGIAEMSHLPPEVRKSTDALDAVGNTTKAVTKGYAIGSAGLGALVLFAAYSNDLAYFAANGDKHPYFADVGTISFDLSNPYVVAGLIFGGLIPYLFGGIAMTAVGRAGSAVVEEVRRQFKEKPGIMEGKDRPDYGRAVDMLTKAAIREMIIPSLLPVLAPIVVYFGVLLISGSKASAFAALGASLLGVIVNGLFVAISMTSGGGAWDNA

SEQ ID NO: 52077 - protein, 254 aa, Zea mays
MPVSRIAVGAPGELSHPDTAKAAVAEFISTLIFVFAGSGSGMAFSKLTDGGAATPAGLIAASLAHALALFVAVSVGANISGGHVNPAVTFGAFVGGNISLLKALVYWVAQLLGSVVACLLLKIATGGAALGAFSLSAGVGAMNAVVLEMVMTFGLVYTVYATAVDPKKGDLGVIAPIAIGFIVGANILAGGAFDGASMNPAVSFGPAVVTGVWENHWVYWVGPLAGAAIAALVYDIIFIGQRPHQQLPTTAADY

SEQ ID NO: 52078 - protein, 644 aa, Photorhabdus luminescens subsp. laumondii TTO1
MRHHYMTTETEISFADLGLSAPILSALEDLGYEKPSPIQQQCIPHLLNGRDVLGMAQTGSGKTAAFSLPLLHNINAELKAPQILVLAPTRELAVQVAEACADFSKHMRNVNVVALYGGQRYDVQLRALRQGPQIVVGTPGRLLDHLKRGTLDLSNLSGLVLDEADEMLRMGFIEDVENIMSQIPAEHQTALFSATMPEAIRRITRRFMNDPQEVRIQASVTTRPDISQSYWSVYGMRKNEALVRFLEAEDFDAAIIFVRTKNATLEVAEALERNGYNSAALNGDMNQALREQTLERLKDGRLDILIATDVAARGLDVERISLVVNYDIPMDAESYVHRIGRTGRAGRAGRALLFVENRERRLLRNVERTMKLTIPEVELPNAELLSQRRLERFAANVQQQLESSDLDQYRTLLSKLQPAEDLDIETLAAALLKMAQGERPLILPPDPVRRPRREFNERDDRRRNGFDDRGERSDRPRRERRDVGEMELYRIEVGRDDGVEVRHIVGAIANEGDISSRYIGNIKLFATHSTIELPKGMPGDLLSHFTRTRILNKPMNMQLMGDAQPFERRERRGGGRNGNGNGNSSGSGPRRDRENFNGGGRRFNGERRGGEGRGEGQSRSNFRGRGDDHGSSAPRRRYNNSNAQ

SEQ ID NO: 52079 - protein, 492 aa, Oceanicola granulosus HTCC2516
MLDDTTDFTALLSDPSLVCSQAFVGGKWVDAASGETFDVTNPARGDVIARIPDLSREEVAEAIAVADRARHAWAAKTGKERAAVLRKWFDLMMANQEDLAIIMTAEQGKPLAESRAEIAYGAGFIEWFGEEAKRIYGETIPGHQPDKRITVLRQPIGVAAGITPWNFPNAMITRKVAPALAAGCSFVIRPASQTPLSALAMAKIAEEAGVPAGVFSVVTSTSASEIGREFCENPKVRKLTFTGSTEVGRILLRQAADQVMKCSMELGGNAPFIVFDDAEIDAAVQGAIMCKFRNNGQTCVCANRIYVQDAVYDTFAEKLKAEVEKLSVGDGLDDGTQLGPLIEPAAIKKVREHLQDALDKGAKILTGGEAHPLGEQFFQPTVVTEANQQMKVATEETFGPFAPLFRFKDEDEVIELANDTIFGLASYFYAKDLSRVVKVQEALEYGIVGVNTGIISTEVAPFGGVKQSGLGREGSRHGIEDYLELKYICTSV

SEQ ID NO: 52080 - protein, 338 aa, Synechococcus sp. WH 7805
MPSDRLWLRSELMGTQVITRDTGRRLGVVGEVIVDIDGREVVALGLRDNPLTRFLPGLPRWMPLDRIRQVGDVILVDSADSLSEAFSPERYSRVINCQVITESGQQLGRVLGFSFDIETGELTTLVMGAVGVPLLGEGVLSTWEIPVDEIVSSGADRIIVYEGAEEKLKQLNSGFLEKLGVGGPSWEEQERDRYRVNVVPVENQLSSGQSAEDTPRQLGASSSQRFDVDQDELEYVELEQPRQDEVRRRRYLDELPLEEDPERYQPQESYQPRESYQSRDFDSEPPRYDEVPPQPRSDQRPRPASRRPIERPGEPLDVEPLDDEPQSSAPREPMDDPW

SEQ ID NO: 52081 - protein, 494 aa, Schizosaccharomyces pombe 972h-
MLSEYQCLKNIGFSHKTVLKRRLFRKECTPALKSFYSTQDPALNEVRTEKLKNGVTYVCDPRPGHFSGLGVYVKAGSRYETKKFSGVSHFMDRLAFQATERTPVGEMKAKLENLGGNYMCSTSRESMIYQAAVFNDDVKSMSKLLAETVLAPKIQEDDLVHYRDSIIYENSELWTKPDALLGEFAHVTAFQNNTLGNCLLCTPDKVNGITATSIREYLKYFYRPEHLTLAYAGIPQEIAKEITKELYGHLPSSSLPPLEAIPSHYTGGFMGIKKSEAPPVPYQQEFTHVVIAMEGLPVTDPDIYALACLQFLLGGGGSFSAGGPGKGMYSRLYLNVLNQYPWVETCMAFNHSYTDSGLFGMFVTILDDAAHLAAPLIIRELCNTVLSVTSEETERAKNQLKSSLLMNLESRMISLEDLGRQIQTQNGLYITPKEMIEKIDALTPSDLSRVARRVLTGNVSNPGNGTGKPTVLIHGNVDEVGDVFALCKKAGIGH

SEQ ID NO: 52082 - protein, 332 aa, Pseudomonas syringae pv. syringae B728a
MIKHQLARFNRLDLISAPTALEKLERLSIWADRDIYIKRDDTTTLALGGNKVRKLEYLAADALAQGADTLITAGAIQSNHVRQTAALAARLGLGCVALLENPIGTEDPSYLKNGNRLLLELFDAKVELVENLDNADEQLHALAARLRSSGKKPYLVPIGGSSPVGALGYVRAGLELAEQIKQTGIEFAAVVLASGSAGTHSGLALALAHELPQLPVIGVTVSRSEEAQLPKVQGLAERTAELLGVALPEHFKVELWDEYFAPRYGEPNAGTLSAIKLVASHEGLLLDPVYTGKAMSGLLDGIGRQRFNDGPLIFLHTGGAPALFAYPDAFDQ

SEQ ID NO: 52083 - protein, 317 aa, Pseudomonas syringae pv. syringae B728a
MSDIPEASADGRSSHWQLQRIVSQLRGAREDWRARNRRVSGEHGGRELPSRAAMGEILEALSGALFPMRLGPVDLREESEDFYVGHTLDVALNALLAQARLELRYVAHQQGGDLKSIDARALELIQGFAMALPGIRLLLDTDVLAAYHGDPAARSVDEVLLCYPGILAVIHHRLAHYLYRAGLPLLARISSEIAHSATGIDIHPGAQIGPSFFIDHGTGVVIGETAIIGERVRIYQAVTLGAKRFPSDEDGQLQKGHARHPIVEDDVVIYAGATILGRITIGKGSTIGGNVWLTRSVPADCNLTQANLLQQDDCSRK

SEQ ID NO: 52084 - protein, 287 aa, Pseudomonas aeruginosa PAO1
MTDVARLLALRSFTELGARQRARALLDAGSFRELLDPFAGVQSPWLERQGIVPQADDGVVVARGLLDGQPAVLAAIEGAFQGGSLGEVSGAKIAGALELAAEDNRNGVPTRALLLLETGGVRLQEANLGLAAIAEIQAAIVDLQRYQPVVAVIAGPVGCFGGMSIAAGLCSYVLVTREARLGLNGPQVIEQEAGIAEYDSRDRPFIWSLTGGEQRFASGLADAYLADDLDEVRTSVLAYFAKGLPARPRCRRAEDYLRRLGDLDTAEQPDAAGVRRLYQGLGQGDAT

SEQ ID NO: 52085 - protein, 134 aa, Brassica napus
  misc_feature (17)..(17): Xaa can be any naturally occurring amino acid
TDAWELKSGSRCMLSRXQITDEDHPLSLGKASVWNTYFQDIETIEQIDKDVKRTHPDIPFFSAESSFARSNQESMKNILLVFAKLNQGIRYVQGMNEILAPIFYVFRNDPDDDSSSHAEADAFFCFVELLSGFR

SEQ ID NO: 52086 - protein, 434 aa, Arabidopsis thaliana
METPTMKPDTVLILDYGSQYTHLITRRIRSLNVFSLVISGTSSLKSITSYNPRVVILSGGPHSVHALDAPSFPEGFIEWAESNGVSVLGICYGLQLIVQKLGGVVVEGESKEYGKMEIEVKGKSEIFGSESGGEKQMVWMSHGDEAVKLPEGFEVVAQSAQGAVAALESRKKKIYGLQYHPEVTHSPKGMETLRHFLFDVCGVSADWKMEDLMEEEIKVINKTVASDEHVICALSGGVDSTVAATLVHKAIGDRLHCIFVDNGLLRYKEQERVMDTFERDLHLPVTCVDASERFLSELKGVVDPETKRKIIGREFINIFDQFAQELEKKHGKKPAFLVQGTLYPDVIESCPPPGTDRTHSHTIKSHHNVGGLPKDMKLKLIEPLKLLFKDEVRELGRILNVPVGFLKRHPFPGPGLAVRVLGDVTQGNALEVLR

SEQ ID NO: 52087 - protein, 585 aa, Bacillus licheniformis
MRRLAFLVVAFCLAVGCFFSPVSKAEGVMSGGDGDKVAVGKDGMVATAHPLASKIGAEVLKKGGNAIDAAIAIQYALNVTEPMMSGIGGGGFMMVYDGETKETSIINSRERAPEGAKPDMFLDEDGKVIPFSERSRHGNAVGVPGTLKGLEAAHKKWGTKKMEDLISPSIKLTEEGFPIDSVLADAIKDHQDKLSKTAAKDIFLPDGEPLKEGDILVQKDMAKTFKLIRKEGSKAFYDGEIGRAIADVVQDFGGSMTPDDLSRYEVTTDKPIWGEYHGYDIASMPPPSSGGVFMLQMLKLIDDFHLSQYDPKSFEKYHLLAETMHLSYADRAAYAGDPEFVDVPLRGLLDPDYIKERQKLISLDSMNRDVKEGDPWKYEEGEPNYEIVPQPEDKTIGETTHFTVTDQWGNVVSYTTTIEQLFGTGILVPGYGLFLNNELTDFDAIPGGANEVQPNKRPLSSMTPTIVFKDEKPVLTVGSPGGTTIIASVFQTILNYFEYGMSLQDAIEEPRIYTNSLTSYRYESGMPEDVRRKLNDFGHKFGSNPVDIGNVQSIFIDRENKTFMGVADSSGNGTAVGVNNKTSAE

SEQ ID NO: 52088 - protein, 122 aa, Oryza sativa Indica Group
MKKKKKKMSTVTRAYLDQKLALAKRCSREATLAGAKAAAVATVASAVPTLASVRMLPWAKANINPTGQALIICTAAGMAYFVAADKKILSLARKHSFEGAPEHLKNTSFQGTGRPHPAFFRP

SEQ ID NO: 52089 - protein, 173 aa, Crocosphaera watsonii WH 8501
MKHTLSVLVEDEAGVLTRIAGLFARRGFNIESLAVGPAEQPGISRITMVVPGDDNSIEQLTKQLYKLINVLKVNDITQTPCVERELMLLKVNVSAANRAEVLEVAQVFRARIVDISDDTVTIEVVGDPGKMVAIMKMLSKFGIREVARTGKIALTRESGVNTEYLKSLQAKVS

SEQ ID NO: 52090 - protein, 483 aa, Rhodobacter sphaeroides 2.4.1
MRAQPAASHFVDGRPLEDETGAPIPVIYPATGEEIARLHEATPAVIEAALASGARAQAAWAAMRPVERARILRRASDLIRAHNEELSLLETLDTGKPLQETLVADWASGADALEFFAGLAPVVTGETVPLGQDFVYTIREPLGLCVGIGAWNYPSQIACWKAAPALALGNAMVFKPSEVTPLGALKLAEILIEAGLPPGLFNVVQGRGAVGASLVTDSRVAKVSLTGSVPTGRRVYAAAAEGVRHVTMELGGKSPLIVFDDADLESAIGAAMLGNFYSAGQICSNGTRVFVQKGIKEAFLARLAERADAIRMGDPLDPEVQMGPLVSQAQLEKVLAYIEKARAEGGRLVCGGEASVSPGCYVQPTVFADVTDAMTLAREEVFGPVMAVLDFETEEEAIARANATDFGLAAGVFTADLTRAHRVVAQLQAGTCWINAYNLTPVEAPFGGVKLSGVGRENGRAAVQHYTQVKSVYVGMGPVDAPY

SEQ ID NO: 52091 - protein, 141 aa, Pediococcus pentosaceus ATCC 25745
MEQERILILIKPDGVSLGHIGEVITRLELKGYSIDALKVTQATEAQLQQHYEKLVNKPFFKEIETYMLEGKIVAMIASGTHVIDVFHRMAGATDPSEAAFGTIRGDLGREWPDGLLRNVVHSSDSIENAEKEIKIWFPELN

SEQ ID NO: 52092 - protein, 498 aa, Mycobacterium leprae TN
MATLAESPEPKSGASRAGVLGEEAGYHKGLKPRQLQMIGIGGAIGTGLFLGAGGRLAKAGPGLFLVYAVCGVFVFLILRALGELVLHRPSSGSFVSYAREFFGEKAAYVVGWLYFLDWAMTAIVDTTAIATYLHRWTIFTALPQWTLALLALAVVLVMNLISVEWFGELEFWAALIKVCALMAFLVVGTIFLGGRYPVDGHNTGLSLWTSHGGLFPTGVAQLIVVSSGVMFAYAAVELVGTAAGETVEPKKIMPRAINSVIARIAIFYVGSVILLALLLPYSAFKASESPFVTFFSKVGFYGAGDLMNIVVLTAALSSLNAGLYATGRVMHSIAINGSGPKFTARMSKNGVPYGGILLAAVICLCGVALNAFNPGQAFEIVLSVAALGIIAGWGTIVLCQLRLHKMAKAGIMRRPRFRMPLAPYSGYLTLAFLFAVLVVMAFDKPIGTWTVASLIVIVPALIAGWYSIRKRVMTIARERMGYTGPFPAIANPPVKSSD

SEQ ID NO: 52093 - protein, 501 aa, Pediococcus pentosaceus ATCC 25745
MEAASVAGPAAIFSWIIGFVVIGVIAYNYIELGTMFPESGGMSKFAQYSHGSLVGFIASWANWISLITLIPIEAVAAVQYMSSWPWAWANWTHSFFKNGNITTSGLLVVFCFILIFTLLNYWSVTLLTRFTSLISIFKIAVPLITIIFLTLSGFHPENYGKSLSEFMPYGSASIFAATSASGIIFSFNAFQTVINMGNEVENPKKNIGLGVGLSLSISAVLYLVLQSTFITSVPTALITQSGWHGINFESPFADLAILLGIHWLSVLLYLDAFISPFGTGVSFAASTGRALAAMSSNNHFPKILGRINAKYGIPRVAMAFNAVLSMVMVSIFRSWGTLASVISTSTLIAYLTGPITVVSLRKMASRFNRPVRLKAIKFMAPLAFILASLAIYWAMWPTTVEVILVILLGLPIFIYYEWRLHWKETMKQLRSSLWLIVYLIFLSVMSYIGSDNFNGRNLIHYPLDFIVIIIVAFIFYIWGMRSRIITVSFGNAQEVNKHVKK

SEQ ID NO: 52094 - protein, 505 aa, Mycobacterium leprae TN
MATLAESPEPKSGASRAGVLGEEAGYHKGLKPRQLQMIGIGGAIGTGLFLGAGGRLAKAGPGLFLVYAVCGVFVFLILRALGELVLHRPSSGSFVSYAREFFGEKAAYVVGWLYFLDWAMTAIVDTTAIATYLHRWTIFTALPQWTLALLALAVVLVMNLISVEWFGELEFWAALIKVCALMAFLVVGTIFLGGRYPVDGHNTGLSLWTSHGGLFPTGVAPLIVVSSGVMFAYAAVELVGTAAGETVEPKKIMPRAINSVIARIAIFYVGSVILLALLLPYSAFKASESPFVTFFSKVGFYGAGDLMNIVVLTAALSSLNAGLYATGRVMHSIAINGSGPKFTARMSKNGVPYGGILLAAVICLCGVALNAFNPGQAFEIVLSVAALGIIAGWGTIVLCQLRLHKMAKAGIMRRPRFRMPLAPYSGYLTLAFLFAVLVVMAFDKPIGTWTVASLIVIVPALIAGWYSIRKRVMTIARERMGYTGPFPAIANPPVQPSERSHSQNP

SEQ ID NO: 52095 - protein, 299 aa, Triticum aestivum
QFSISYPTNGTTKSFDIDDDNRCRIFFEKRMGQEVEADTLGEEFKGYVFRINGGFDKDGFAMKQGVFCNNRIKLLLAPGTSGYRAKRKGERKRRSVRGCIVGPDIKTLSLTLIKKGEKDIPGLTDETKNRRLGPKRASGLRKLYGIEKLEGEKTTQSSTALIKKHAIQRTFKSAKNPNAPQRRKAPKIQRLVTESRLRRKRIQKQEKVNRWKRTRALTEEYKKVYDAFAHKRRAENKERKASKVSAQGESQPAETQPAVAATKVAAPKVSTTATKTVVTKTVVTKTVATKPAEKPKAGQ

SEQ ID NO: 52096 - protein, 180 aa, Neurospora crassa
MSKVFFDLEWEGPVLGPNNKPTSEIKAQSGRINFTLYDDVVPKTARNFKELCTGQNGFGYKGSSFHRIIPEFMLQGGDFTRGNGTGGKSIYGEKFADENFAKKHVRPGLLSMANAGPNTNGSQFFVTTVPTSWLDGRHVVFGEVADDESMKVVKALEATGSSSGAIRYSKKPTIVDCGAL

SEQ ID NO: 52097 - protein, 510 aa, Rhodobacter sphaeroides 2.4.1
MKDILQELENRRAIARAGGGQRRVEAQHKRGKLTARERIELLLDEGSFEEFDMFVRHRCTDFGMQDDRPAGDGVVTGWGTINGRMVYVFSQDFTVFGGSLSETHAQKICKIMDMAMQNGAPVIGLNDSGGARIQEGVASLAGYADVFQRNIMASGVIPQISVIMGPCAGGAVYSPAMTDFIFMVRDTSYMFVTGPDVVKTVTNEVVTAEELGGASTHTKKSSVADGAFENDVEALYEIRRLVDFLPLSNRTPAPVRPFFDDVARIEDSLDTLIPDNPNQPYDMKELILKIADEADFYEIQKDFAANIITGFIRLEGQTVGVVANQPMVLAGCLDIDSSRKAARFVRFCDAFNIPILTLVDVPGFLPGTGQEYGGVIKHGAKLLFAYGEATVPKVTVITRKAYGGAYDVMASKHLRGDFNYAWPTAEIAVMGAKGATEILYRSELGDKEKIAARAKEYEDRFANPFVAAERGFIDEVIMPHSTRRRVSKAFASLRNKKLANPWKKHDNIPL

SEQ ID NO: 52098 - protein, 778 aa, Vitis vinifera
MAFHVACPITCKRICYCTLGYPHQLQSLRARAQFEEEVARVEALLKDPWLIRVPERSTVQVAVPKVVAPPAPAVVAVVGDGVGGEGEEMLLSAQTKRAAMQRKAAAVSMVAEDYARRFESGDLVDTSKDIVGEEQSQSNVNVMCRICFFGEMEGSERARKMLPCNSCGKKYHRLCLKSWSQNRDLFHWSSWTCPSCRICEVCRRSGDPNKFMFCRRCDDAYHCYCQQPPHKNVSSGPYLCPKHTRCHSCGSNVPGNGLSVRWFLGYTCCDACGRLFVKGNYCPVCLKVYRDSESTPMVCCDVCQRWVHCQCDGISDEKYLQFQVDGNLQYKCATCRGECYQVKDLEDAVQELWRRRDKADRDLIASLRAKARLPTQDEIFSISPYSDDEENGPVSLKSEFGRSLKLSLKGSVDKSPKKTKEYGKQSSNKKNVKKKGHQTPLISKKESHQSFEGHDDAQPFEYSLGDDKNEQPNRSDGREGICSINQPGVLKHKFVDEIAVNNEDRTSRVIQIKSNKPHGSDVGEDTGKQASKSKTMKGTKLVIHLGARNRNVTNSPRSDASSCQREQDLTTSNGDKIDYSGQAKGSTNVAGAVTEVSRGEKVFSRKHPESRLNMYGEGNDDNSSTPSVSHSLPKDSKPLLKLKFKNPSFENQSSWGLPGEDEKSAVKGQRSKRKRPSPFMEKTSFKEDEDGSQFHQDDSMDQIMDANWILKKLGKDAIGKRVEVHQSSDNSWHKGMVIDFIEGTSTLIVKFDDGRAKTLELGKQAIRLISQKQKRSKT

SEQ ID NO: 52099 - protein, 381 aa, Ostreococcus tauri
MTHDDAACARAPAFRFGLLADIQYCDQDDRKNITGTQMRRYRNTLRVAERAVRYFNAQSGALDFCVHNGDITDHQCAFDFANDDFRPVEHGREDLGAVMKILSESSCDEWVFTVGNHELYNFTREELRDGVATPGAKLEFKCANERGDFYYSFAPGPGWRVMVLDPYEVSIYRKGRQQGLCEEAVELLRQYNPNVDVYVNENPDVIETERMSGTFPYFKDLEGLQGRWVPFNGGLGKKQLEWARETIRSAAASGEKVLILTHLLVHPDSTAKRSGKTLMWDYDELLEIIESDDAKGCVKCVISGHQHEGTRWRCEKTGTYYIGMESPMLAEDASPGPFAIVNVYDDEIVFEGYGRNEDSKMFPYDAKSPPTDPMQCTLTLK

SEQ ID NO: 52100 - protein, 316 aa, Thermoplasma acidophilum DSM 1728
MEELLNVEAKPPGRTPTIKAYALGNKLHLNNLFLKFEGANATGTQKDRISEAHVINAMRGGYNGIAVGTCGNYGASIAYFAHQYGVKSYIGIPRSYSHDRTDFMQSEQAEILYYDGKYEETVEFIRDFSKDNGLYDASPGSANSSIDKMMYATIAFEIYEALLTVPSYVIVPVGNGTTLAGIYHGFRRMYDEGVIDHLPRMVGVSTSGGNPIVDSWRHGYSRVVDLNPEEIRETSINEPLVSYRSFDGQDALSAIRETHGRAMYVSDEEMVYYSNLIYSAEGLNPLPASASAVAAIGHLKVKQDETVVSVITGRQI

SEQ ID NO: 52101 - protein, 377 aa, Vitis vinifera
MVAGQYLPPWFSVAPMMDWTNNHYRTLARLISKHAWLYTEMIAAETIVYQEKNLDRFLEFSPDQHPIVLQIGGNNLDNIAKATELANSYCYDEINLNCGCPSPKVAGHGCFGVRLMLDPKFVAEAMSVIAANSDVPVSVKCRIGVDDHDSYNELCDFIYKVSSQSPTRHFIIHSRKALLNGISPADNRKIPPLKYEYYFGLLRDFPDLRFTINGGINCVDEVNAALRQGAHGVMVGRAAYHNPWYTLGHVDSAVYGAPVSDLSRRQVLEQYQVYGDSVLEKYGPHRPSIREVVKPLLHFFYSEPGNGLWKRKADAAFFHCKTIKSFLEETLVAIPDSVLDAPVAKAPSGREDLFANLSDLLPLPYETSEQEQEVLYA

SEQ ID NO: 52102 - protein, 284 aa, Thermoplasma acidophilum DSM 1728
MNGMQTAEFDGTGRKVSVIGVGTWSLEGSRSENVRSIRYALDHGVNFIDTAEMYGTEDIVGEAIKGYRREDLFIATKVWPTHFAYHDVLKSCEESLKKLGTDYVDLYQLHWPNPSVSIKETMSAMEKLVDEGRIRYIGISNFSVKEMKEAMSALAKYRIVSNQLEYNVATREIEDEGIYDFCRKNGMAIIAYSPLSHGKIFGNEMILETLTDIGKKYGKRPAQVALNWIIRKGAFPIPKASKPIHMAENIESTDFTLSDEDMKTLDSLYQRHPIRSIASRYKGH

SEQ ID NO: 52103 - protein, 393 aa, Arabidopsis thaliana
MAETQGKVITCKAAVVWGPKVPLVIQEICVDPPQKMEVRVKILYSSICHTDLGCWNGTNEAERAFPRILGHEAVGIVESVGEGVKDVKEGDYVIPTFNGECGECKVCKREESNLCERYHVDPMKRVMVNDGGTRFSTTINKDGGSSQSQPIYHFLNTSFTEYTVLDSACVVKIDPNSPLKQMSLLSCGVSTGVGAAWNIANVKEGKSTAVFGLGSVGLAVAEGARARGASRIIGVDANASKFEKGKLMGVTDFINPKDLTKPVHQMIREITGGGVDYSFECTGNVDVLREAFLSTHVGWGSTVLVGIYPTPRTLPLHPMELFDGRRITGSVFGGFKPKSQLPNFAQQCMKGVVKLEPFITNELPFEKINDAFQLLRDGKSLRCILQISKLLKR

SEQ ID NO: 52104 - protein, 193 aa, Bacillus anthracis str. Ames
MNLIPTVIEQTNRGERAYDIYSRLLKDRIIMLGSAIDDNVANSIVSQLLFLESQDPEKDIHIYINSPGGSITAGMAIYDTMQFIKPQVSTICIGMAASMGAFLLAAGEKGKRYALPNSEAMIHQPLGGAQGQATEIEIAAKRILFLREKLNQILADRTGQPLEVLQRDTDRDNFMTAEKALEYGLIDKIFTNR

SEQ ID NO: 52105 - protein, 387 aa, Chlamydomonas reinhardtii
SRSGPSSGAQTGPEMSLTLSETLEAPLLRVPFESLKRAAKDRKALIDELSDHLAQPPADPSGDTEMEDAAAGEGVSGREASIERLRLLLSQLQGVKRKLGEVSRTEADDCARCKARLDYLAATAPTAAAAAAAAGGTPATAAARLDVILVDHLLRSGYHDSAAKLAAAAGIQLLTDGHIFEGARRVLAALLEDHDCGPALAWCADNRSRLAKSKSGLEFKLRLQQFIELVRAGPAQRAAAIAHARAHLAPWQQQHLLELQRAVATLAFPAAARERVPAYRALFQESAWHGLADLFMRDLYRLHSLTPESLLTVYLQAGLSALKTPASGAPGGSRDDPLRLPPFQRLAAHLPLAKHMHSKLVCAVTKELMSDANPPLLLPNGLVYSTR

SEQ ID NO: 52106 - protein, 2430 aa, Chlamydomonas reinhardtii
MKISSTVSFGQLTEEVSKPLSKARSALKSVHSRMDLIQEYHLREVAAAALKREKAMDWLPEYRPISVVPPSRGRLTHLERTTRVSQAAILNDVPVGRKTKIVCTLGPSCWSEEGLGGLLDAGMDVARFNFSHGTHQAHQEVLDRLRKVVEAKKRHTAFLLDTKGPEIRTAMLKDGKDIELVAGQEVTVVGVGEDYDKWEGYKDEKTGETKIGISYAKLCASIKVGGVILIADGAISIEVVKILNDRELLGSVINSHKLGQRKNCNLPGVHVDLPVLSPKDIDDVQNFAVKNQMDFIAASFVQCADDVKMIRRVLDDAGGYHIKIICKIENEAGLRNIDTILEVTDGIMVARGDLAMEVPAEKIALAQKMIIAKCNVLGKTVITATQMLESMTGSPLPTRAEMTDVANAVYDGTDAVMLSGETANGAYPHAAVRTMAHIVEYAELGVDYAFHHDWVKRHNAGLAPVSPLEATLACVAKSAITFSMDANGDGVLDASEGCVAVVFTRSGLAAQVIAKYRPPCPVIVLSDHDWVLRQASLTYGLYPLRVEVSGMEDRRKAVETAIEYGRQRKLVYDGKNILVVTGSGEPFADTVAEMYVDQIGSEGGAGWVRRAVSCKRSLSVGQPMHIEYKSPFAGNSVVCVQSLRITPELIIERQFNHRSTKIFASLGPASYDPKKVEAMLDNGVSVFRIFLHEAPTDFYQKLVDRLREQFEQRREKCSYTTMPGLMATIKTVVLVPTSDPLFEGFTGADGIHIVGVNFPTLTAKLRAGDVLVLAEGTISLTVKEVVPRLAAVAPGGGADGSVAYMHGKVITKVTTAAKLGEDRAIDLAGGCLLQDNFLGDRDCEAVLFCAKNMIDFVSIPNVRSRADVMAVRELLDANGGARCKIISHVSTAKAIANYDEILDATDAVLISRAYMGMRIPAAKVSLAQKWMTAKANLKGKPCIVSAQIMYSMVDSPRPTRAEMTDVANALYDGADALMLREETAVGSFVERVVSITADILRDAEVGVDTYAQLNQLRNFTPKPMPTLECLCSSAVKAAVDMRAALIAVITDTSAPVRALAKYRPGQAIVVVTTRTHVARQCNMNYGCVPLLLRSKDRDAPLDKIVSKIVDFARTQKLAAFQAGDDQGDQLIIVQGPSNRTFATEEDLAEMQFVTRIMGEEASEVCAKLGYTGADTIAYRSTKVGLDLICGPTDTRTRKTKVVCTLGPKCWSKEGLEMLVDTGINVARFNFSHGSHADHQEVLDRLRLVLDERGARHRVALLLDTKGPEVRTAMLKDGKDINLEAGQELTVVAVGDKYTTWEGFKDEATGETRIGLSYQHLCRDVKVGGMIKIGDGLITLEDGGGGIVHLQVLEILSPTELRVRALNSKALGQRKNVNLPGVHVDMPVLGPNDINDVQNFAAKNNMDFVAASFVQSADDVRFIRKVLDEAGGKNVRIISKIESTAGLINYDAILAESDGIMVARGDLAMEIPSEKVALAQKMMITKANIAGKFVITATQMLESMIKSPLPTRAEMTDVANAVFDGTDAVMLSGETANGDFPQLALATMCAISANAEVGTNYPQVYDFIRDFSARPMSTAEAVLGCAAKNVLDVDAALILVISSTGASARLVAKYRPRVPVLLITDSMAAARSVAPLFGVYVSIVDELPPSRFDLEFEVLLEEATLFAMEAGLCPPGKEVVVVHGCNTADAEDGLPMVEIQVAAGGVPSRQTSEAISETVTPKPSLPQPKAKRTGPSPFAPAVPPSPATTAFQHAFYLGGAGIHHVTSGVTPFGSLAALAPSEAPPSPKQQPHATNRLVADVVEEGASSGASAAAALRDNLPAIPAAAKPASNVASLTPSPAPTALPKALTAAVMAAKTLSLRTTAISLVDILDHSLPAGRKTKIVCTLGPSCWSEEGLNGIINAGMDVARFNFSHGTHQAHQEVLDRLRKVEKAGTKRIAYLLDTKGPEVRTAMLREGKDIKLDANQEVTVVAVGDDYDKWEGYKDEKTGETKIGISYAKLCQSVRVGSRILVADGSLTIEVLEITSATELRGRCLNTKVLGQRKNVNLPGVHVDIPVLTPKDIEDLQKFCVGNDMDFVAASFVQSADDVRLIRRVLDEAGGYNVQIISKIENEAGLKYFDGILAESDGIMVARGDLAMEIPSEKVALAQKMMITKANIAGKFVITATQMLESMTSAPLPTRAEMTDVANAVFDGTDAVMLSGETANGKFPRPAVETMAAIVANAENGTAYVSTQWFIRDHTPKPFGITEATGVSCVAASVDCNAQLIITLTSGGYTSRFVSKYRPAVPQIVVTDSVHVANQASVHFGQYALLVGDIDFSTWPADRSLTAMVDELVAQAALFAQDKGLWAGQGTAILLHGRDDLSADSQPVLRAVDLADLVGAAPAELTAASSKLSAGSGPGRAGSREVGLGRTSAGLAGTSVNRAFSLVV

SEQ ID NO: 52107 - protein, 274 aa, Brassica napus
  misc_feature (243)..(243): Xaa can be any naturally occurring amino acid
  misc_feature (265)..(265): Xaa can be any naturally occurring amino acid
GSWTVFHVTDQQGNKVTDSKTIDYIEKVLGPKGYASASQNTWPGKRVGVHSLGDHTSIEIIARDRPGLLSEVSAVLADLHFNVVGAEAWTHNRRIACVLYVNDNETSRAVDDPERLSNMEEQLNLVLRGCEQEDEKVARTCLSIGSTHLDRRLHQMLFADRDYEALTKVDGSVPKITIDNCIKKRYSVHHMSCEDLPKLMFDIVCTLTDMHYIVFHATITSSGPHASHEYFIRHKDCCTLDSXRDKERVIRCLEAAIHTKVNDGXTLELYAKDT

SEQ ID NO: 52108 - protein, 399 aa, Silicibacter pomeroyi DSS-3
MDIHEYQAKEILANFGVDIPPGALAYSPEQAAYRAREIGGDRWVVKAQVHAGGRGKAGGVKVCSSDAEIQETCENLFGRKLVTHQTGPEGKGIYRVYVEGAVPIEREIYLGFVLDRSSQRVMIVASAEGGMEIEEISAEKPDSIVRATVEPAVGLQDFQCRQIAFKLGIDPALTARMVRTLQGCYQAFSEYDATMVEINPLVITGDNRILALDAKMTFDDNALFRHPHISELRDKSQEDPRESRAADRGLSYVGLDGNIGCIVNGAGLAMATMDTIKLAGGEPANFLDIGGGATPERVAKAFRLVMSDSNVQAVLVNIFAGINRCDWVAEGVVQALKEVQVEVPVIVRLAGTNVEEGQKILAKSGLPIIRARTLMEAAERAVGAWQNDLSENTIVRAVQ

SEQ ID NO: 52109 - protein, 256 aa, Saccharophagus degradans 2-40
MAANQSFIKHNSQVNSNALLVEASGLALLSKTLLDNSILGSELCIPKVLAVNKNQLEIEYIQSQRPSDSHFKTLGVGLAKLHTIQQPHFGLEHDNYIGLNPQPNCISYNWGQFFYQYRLQYQVSLIADSHVKQRFQTLLNTHQAKLMEFLNNSCSSPSLVHGDLWSGNVLFDKQRVWLIDPAVYYADSEVDIAMTEMFGGFDAAFYQAYQTVRPFTAQYPIKKRIYNAYHYLNHYNLFGDSYLAGCEQGLGMIEAL

SEQ ID NO: 52110 - protein, 466 aa, Salmonella enterica subsp. enterica serovar Typhi str. CT18
MPHSWDYDAVVIGSGPGGEGAAMGLVKQGARVAVIERYHNVGGGCTHWGTIPSKALRHAVSRIIEFNQNPLYSDHSRLLRSSFADILNHADNVINQQTRMRQGFYERNHCEILQGNAHFIDEHTLALECHDGTVETLTAEKFVIACGSRPYHPNDVDFSHPRIYDSDSILSLHHEPRHVIIYGAGVIGCEYASIFRGMDVKVDLINTRDRLLAFLDQEMSDSLSYHFWNSGVVIRHNEEYEKIEGCDDGVIMHLKSGKKLKADCLLYANGRTGNTDSLALENIGLETDSRGQLKVNSMYQTALPHVYAVGDVIGYPSLASAAYDQGRIAAQALVKGEATAHLIEDIPTGIYTIPEISSVGKTEQQLTAMKVPYEVGRAQFKHLARAQIVGMNVGTLKILFHRETKEILGIHCFGERAAEIIHIGQAIMEQKGGGNTIEYFVNTTFNYPTMAEAYRVAALNGLNRLF

SEQ ID NO: 52111 - protein, 921 aa, Oryza sativa Japonica Group
MSVLNPPPKRRAISAIRKFPRDCGRAASTLAESGASMEELPLEATPISVATGGASMEDSLARTPISVQGASLVCGLDHSSEAIDGKTIEDDESSKVENRIQEFQVATNVALDDFEGAKNGSTHPNDSIAKPSPSHGFVERVNGKGSQQEKKLVARSAGDGKMVSKYEERLQKGTPETRMRDLVDVKAKKKILKSDKMNGALQNDARSSGDGKMKTKASSTQRGVVRSDMSLKQGDIARKVDATGKCKGGVNSLIKEATSGKHATTNGIEENDDRDLVSDRIIVQALMAPDKCPWTRRRKSIGGSSESRTPKLKKKFGRPRKELKDTTPREEVSPEVASCKAIKHEAIEDKEDSYFEDEGNSKASYSDVEGNSKELVRGGKALVVCGGKKELCVTLPPSAPFGTDPRSKIRNLLIKFHAACRKLVQVEEQHKGNIGRIDIEAGKALKQNGFIKPGPIVGNVAGVEVGDEFNFRIELSFVGLHRPYQGGIDSTKVNGILVAISIVASGGYHDELSSSDELIYTGSGGKAIGNKAAGDQKLERGNLALKNSIETKTPVRVIHGFKGHSKGEASHSKSKQISTYIYDGLYMVVDYWKEGPEGSMVYKYKLQRIPGQPELALHIIKATRKSKVREGVCVPDISQGRERIPIPAINTIDDTQPTAFKYTTEVIYPHSYAKEPLKGCDCTNGCSDSNRCACAVKNGGEIPFNSNGAIVEAKPLVYECGPSCRCPPTCHNRVSQHGIKIPLEIFKTGNKGWGVRSLSSISSGSFVCEYAGEVLQENGDEHVETDEYLFDIGHHYHDEVWEDPKFEGILGLESSTSKTTEDTEGSKTTEDTEGSTIDASKCSNVGRFINHSCSPNLYAQNVLWDHDDMKKPHIMFFATENIPPLQELTYDYNYGKVEDKNGKEKVKPCFCGSPDCSRRLY

SEQ ID NO: 52112 - protein, 261 aa, Bacillus cereus ATCC 14579
MQEVWKDIDAHAKRWIRDAGEHLMASMKKALIIETKSNAADLVTNMDREIEQFLIGKIKETFPNHNILGEEGYGDEITSSDGVVWLIDPIDGTMNFVHQKRNFAISIGIYENGIGKIGLIYDPVHDELYHAVKGSGAFCNDISIPPLEKGTVEQGIVALNAIWLTDNPLLNMESMMALVKKARGTRSYGCAALEMVYVATGRIDAYVTPRLSPWDFGGGQIIVEEVGGKVTTFSGAPLSIIEKSSVLVAKPGVYEEVLSFI

SEQ ID NO: 52113 - protein, 336 aa, Pseudomonas syringae pv. syringae B728a
MSRVTLSRYLIEQTRSNNTPADLRFLIEVVARACKEISHAVSKGALGGVLGSMGTENVQGEVQKKLDVISNEILLEANEWGGHLAGMASEEMDNAYQIPGKYPKGAYLLVFDPLDGSSNIDINAPVGTIFSVLRCPNEYLSQNEALNEKAFLQPGTEQVAAGYAIYGPQTMLVLTLGDGVKGFTLDREMGSFVLTHEDITIPESTQEFAVNMSNQRHWEAPVQRYVSELLAGEDGPLKKNYNMRWVAAMVADVHRILTRGGLFMYPRDSREPSKPGKLRLMYEANPMSFLVEQAGGASTDGHQRILDIQPEGLHQRVAVYLGSKEEVERATAYHKA

SEQ ID NO: 52114 - protein, 217 aa, Oryza sativa Japonica Group
MDSKDKEKEHEQTASGRNPDVNDVEEEEEDEEGNKRAVVLGPQVPLKEQLELDKDDESLRRWKEQLLGQVDTEQLGETAEPEVKVLNLTILSPDRPDLVLPIPFVPDEKGYAFALKDGSTYSFRFSFIVSNNIVSGLKYTNTVWKTGVRVENQKVMLGTFSPQLEPYTYEGEEETTPAGMFARGSYSAKLKFVDDDGKCYLEMSYYFEIRKEWPTIQ

SEQ ID NO: 52115 - protein, 1169 aa, Arabidopsis thaliana
MVDWSTLPKDLLDLISKSLESSFDLIQFRSVCSSWRSAAEPKSPLPTHHLPILPDNGGSLFPDSAVGFRLSQRSILLIKPHEPCIESDSFGWLIKVEEDLNVPRKVTLLDPLCDTRNSIPENFPRVLDMSKFKVRELGREFKLHYFNTVGDIVESLYLEKAVVKYLDCDGDYKFVLLTIHVSGKLAVFRSWDRAWTVINDMPSPYDDVMLFDGRFFAVDNNGRTVVVDYSSLKLTLVASPVFGGDKNVLKIILEKHHPNLEKHVYNPKLKKIGDAMTIHGGKPNLTLTLVYPSTFTSRHKALNQMTSSSNSGLRRFLFTPPQRLSQGICYWGAELSNNVSWTYKTKMVVRSKAGAVPLMKHGDRFLSSLSSPALAGDPSAINRHIKKFVAASPKSVALNVLSHLLSDQTSHPHLSFFALSLYSEITEASWFDWNPKLIAELIALLNKQERFDESETLLSTAVSRLKSNERDFTLFLCNLVESNSKQGSIQGFSEASFRLREIIQRSSSVYVKTQAYKSMVSGLCNMDQPHDAERVIEEMRMEKIKPGLFEYKSVLYGYGRLGLFDDMNRVVHRMGTEGHKIDTVCSNMVLSSYGAHDALPQMGSWLQKLKGFNVPFSIRTYNSVLNSCPTIISMLKDLDSCPVSLSELRTFLNEDEALLVHELTQSSVLDEAIEWNAVEGKLDLHGMHLSSSYLILLQWMDETRLRFSEEKCVIPAEIVVVSGSGKHSNVRGESPVKALVKKIMVRTGSPMRIDRKNVGSFIAKGKTFRSVCSSWRSAAGPKRLLWAHNLPFFPSDDKPFLSNVILRVAHQSILLIKPNEPQCEADLFGWIVKVWDNIYVSRKMTLLKPLSSSRNYFPQHLPRIFDMSKFTVRELCREVKLYHPDYYCVPGHTALELELGKTVVKYLNDDKFVLLTILEYGKLAVFRSWDREWTVINDYIPSRCQDLIMFDGRFFAIDYNGRTVVVDYSSFKLTLAANPLIGGGDKKFLIESCGEMFLVDIEFCLNEKPEFTGGFYSYFNETTVSYKFKFFKLVEREKRWVEVEDLGDKMFFLGDDSTFSASTADIIPRCVGTGSFVFFYTHEESLVVMDDRNLGVFDFRSGKTELVNKLPEYAKLFWPPPPWITTSHEVSGFQSLNHPNRVYLHLHLTTSFLPLVSLTYAQISFVSEC

SEQ ID NO: 52116 - protein, 496 aa, Pseudomonas aeruginosa PAO1
MFELSDWQRRAATQRFIDQALIGGRQRPAASGATFDAIDPASNRLLARVAACDAADVDAAVAAARRAFDEGPWARLAPVERKRVLLRLAELMLAHREELALLDSLNMGKPVMDAWNIDVPGAAHVFAWYAESLDKLYDQVAPTAQQTLATITRVPLGVIGAVVPWNFPLDMAAWKLAPALAAGNSVVLKPAEQSPFSALRLAELALEAGVPEGVLNVVPGLGEQAGKALGLHPEVDALVFTGSTEVGKYFMQYSAQSNLKQVWLECGGKSPNLVFADCRDLDLAAEKAAFGIFFNQGEVCSANSRLLVERSIHDEFVERLLAKARDWQPGDPLDPASRAGAIVDRRQTAGILAAIERAQGEGATLLGGGRQLTINGSDNFIEPTLFGDVRPDMQLAREEIFGPVLAISAFDSEDEAIRLANDSRYGLAASLWSDDLHRAHRVARRLNAGTVSVNTVDALDVAVPFGGGKQSGFGRDLSLHSFDKYTQLKTTWFQLR

SEQ ID NO: 52117 - protein, 388 aa, Synechococcus sp. WH 5701
MKLSARAEALHPSLTLAIAARAKQLRAQGQDICSLSAGEPDFDTPAFIRQAASEALEAGATRYGPAAGEPALREAIAVKLSEENGVPTKAEQVLVTNGGKQALFNLFQVLLGPGDEVLLPAPYWLSYPEMVQLAGASVRLLPSDAEHGFRLDPQQLEAAITPASRLLVLNSPSNPTGMVLSRQELEAIAAVLRRHPHVAVVCDEIYEFLLAPGHVHHSFAAVAPDLSDRVFIVNGFAKGWAMTGWRLGFLAGPSAVVSAAIALQSQSTSNVCSFAQFGALAAVSGPRDCVVEMARQFSERRALLHQGLASLPGLTLQPPEGAFYAFPDVSAYGLDSMTFCNRLLNEVGLALVPGVAFGDDRCVRLSCAASPATLRDGLARLGHFISSL

SEQ ID NO: 52118 - protein, 460 aa, Pseudomonas aeruginosa PAO1
MTAQLNPQRDTRDYQQLDAAHHIHAFLDQKALNREGPRVMVRGDGLQLWDNDGKRYLDGMSGLWCTNLGYGRQDLAAAASRQLEQLPYYNMFFHTTHPAVVELSEMLFSLLPDHYSHAIYTNSGSEANEVLIRTVRRYWQILGKPQKKIMIGRWNGYHGSTLGSTALGGMKFMHEMGGMLPDFAHIDEPYWYANGGELSPAEFGRRAALQLEEKILELGAENVAAFVAEPFQGAGGMIFPPQSYWPEIQRICRQYDVLLCADEVIGGFGRTGEWFAHEHFGFQPDTLSIAKGLTSGYIPMGGLVLGKRIAEVLVEQGGVFAHGLTYSGHPVAAAVAIANLKALRDEGVVTRVREETGPYLQRCLREVFGDHPLVGEVQGAGFVAALQFAEDKVTRKRFANENDLAWRCRTIGFEEGVIIRSTLGRMIMAPALVAGRAEIDELIDKTRIAVDRTAREIGVL

SEQ ID NO: 52119 - protein, 738 aa, Agrobacterium tumefaciens str. C58
MSTYTNFTIETDADGIALVTWDMPEKSMNVFTAEVLEELNAIVDATVADGAVKGVVFTSGKSSFSGGADLSMLKSMFALYNDEKAKSPDAAAAKLFELVGRMTGLFRKIETNGKPWVSAINGTCMGGAFELSLACHGRVASSAKSLKIALPEVKVGIFPGAGGTQRVSRLTDAQSALQMMTTGQSLTGARAKAMGLVHQVVEPDQLVATAKQMIKDGLKPVAPWDEKGFKAPGGGIWTPAAAQLWPAAPAILRRESAGNYPAALAILKCVYEGLQLPFDTALKVEQRYFTEILRSKEAFGMIRSLFISMQELNKGARRPAGQPKTEFKKVGVVGAGFMGAAVAYVTAAAGIPVTLVDRDQDAADKGKGHCEESVKAAIGKGRLTQEEGKALLDLVTPTSDYATLADADLVIEAVFEDRDVKKAVIEAVEAVLPEGAIFASNTSTLPITGLAKNSKRPADFIGIHFFSPVEKMMLTEVILGKETGDKALAVALDYVAKIRKTPIVVNDTRGFFVNRCVLRYMAESYDMLIEGVPAAMIENAAKFAGMPVGPLALNDEVAIDLSYKILKATVADLGEKAVDPRHMELVKKLVEGDGRFGRKNAKGFYDYPPKPAKKSLWPGLKDLYPQQKPEDVDMDVLKQRFLVTVALEAARTVEEGIVTDPREADVGSILGFGFAPYTGGALSYIDGMGVKNFVALAEKLSEAYGPRFQPTPLLKDMAAKGETFYGRFDPYASAAKAA

SEQ ID NO: 52120 - protein, 334 aa, Crocosphaera watsonii WH 8501
MRYDDTRGPGKGGVRYHPNVTMDEVQSLAFWMTFKCALLNLPFGGAKGGITLNPKELSKQELERLSRGYIEAIADFIGPDIDILAPDVYTNQMIMGWMMDQYNIIQRKISPGVVTGKPQTMGGSQGRDTATGTGAYYVIQTILPKFELIPEKTTVAVQGFGKAGAVVAELLGKVGYKVVAVSDSKGGIYAEQGLDIVSIRNYKEEHQGIAAIYCQDTVCNIGEHQSITNEELLGLDVDVLIPAALENQITEENADNVRAKFIFEVANGPINSAADTILDEKGIYVFPDILVNAGGVTVSYFEWVQNRSGLYWTKTEVNQRMRDKMMSEAQEVWV

SEQ ID NO: 52121 - protein, 574 aa, marine gamma proteobacterium HTCC2143
MLRKFFPGLGWLQGYNRGIFKSDLLSGITIAAMLIPQSMGYALVAGLPAEYGLYACIVPPVLYALLGTSNKISMGPVALDSILILTGLSVLAEPGSDNYLELAIALTLLVGVIQFAFGLIKFGFIANFLSYPVILGYTCAAAIIIMGSQFENMLGITVDSGNIFSQIFYFVQRIGSWHWLTAGIGLIGLVFMIYPKRFFPSMPSGLILLVIGMICSGVWNAQAYGIDVIANIPRGLPTPRMPGITSDQLMALIPTAMTVALMGYVGSMSICKAQEKPTDKFNVKPNQELVAMGVANFVGSFFKAFPVSASFSRSAAFIEAGALTQVSAVVSSVVIVIVMMFLTPVFISYPLPKVLLAAIIIVSVAGLFKYGQMKALFKQNRHEFLLMLVTFVVTLVLGVQQGLLAGVVLSIARVIYTSATPHMTELGSIQGGRLFRNVNRFDDVVIRDDILIFRFDAPLYFANKDYFVDNLYRWIKQRPDNLLTSIIFDAEAVNSVDTTAILMLQKIIDNLQQQGIKLYITNAIGPVRDALHNSPLSNYMNEESMFSTIQSAIDFIDYGTSDTDRVALQTDASP

SEQ ID NO: 52122 - protein, 305 aa, Saccharomyces cerevisiae
MSSSSQFKQLEKLGNGTYATVYKGLNKTTGVYVALKEVKLDSEEGTPSTAIREISLMKELKHENIVRLYDVIHTENKLTLVFEFMDNDLKKYMDSRTVANTPRGLELNLVKYFQWQLLQGLAFCHENKILHRDLKPQNLLINKRGQLKLGDFGLARAFGIPVNTFSSEVVTLWYRAPDVLMGSRTYSTSIDIWSCGCILAEMITGKPLFPGTNDEEQLKLIFDIMGTPNESLWPSVTKLPKYNPNIQQRPPRDLRQVLQPHTKEPLDGNLMDFLHGLLQLNPDMRLSAKQALHHPWFAEYYHHAS

SEQ ID NO: 52123 - protein, 762 aa, Triticum aestivum
MAILGELGTEILIPVCGVVGIVFAVAQWFIVSKVKVTPGAASAAGGGKNGYGDYLIEEEEGLNDHNVVVKCAEIQTAISEGATSFLFTMYQYVGMFMVVFAAVIFVFLGSIEGFSTKGQPCTYSTGTCKPALYTALFSTASFLLGAITSLVSGFLGMKIATYANARTTLEARKGVGKAFITAFRSGAVMGFLLSSSGLGVLYITINVFKMYYGDDWEGLFESITGYGLGGSSMALFGRVGGGIYTKAADVGADLVGKVERNIPEDGPRNPAVIADNVGDNVGDIAGMGSDLFGSYAESSCAALVVASISSFGINHDFTAMCYPLLVSSVGIIVCLLTTLFATDFFEIKAASEIEPALKKQLIIFTALMTIGVAVINWLALPAKFTIFNFGAQKDVSNWGLFFCVAVGLWAGLIIGFVTEYYTSNAYSPVQDVADSCRTGAATNVIFGLALGYKSVIIPIFAIAVSIYVSFSIAAMYGIAMAALGMLSTTATGLAIDAYGPISDNAGGIAEMAGMSHRIRERTDALDAAGNTTAAIGKGFAIGSAALVSLALFGAFVSRAGVKVVDVLSPKVFIGLIVGAMLPYWFSAMTRRVCESAALKMVEKVRRQFNTIPGLMKGTAKPDYATCVKISTDASIREMIPPGALVMLTPLIVGTLFGVETLSGVLAGALVSGVQIAISASNTGGAWDNAKKYIEAGNSEHARSLGPKGSDCHKAAVIGDTIGDPLKDTSGPSLNILIKLMAVESLVFAPFFATYGGVLFKYI

SEQ ID NO: 52124 - protein, 398 aa, Zea mays
VDPRVRSAIAPCLSYARGTGSAPSASCCLNRPTPFVGLAFKRKWQNKRKEQGKPCDRPNIVTGANVQVCWEKFARYFEVELKEVKLSEGYYVMDPVKAVEMVDENTICVAAILGSTLTGEFEDVKQLNDLLTDKNKETGWDVPIHVDAASGGFIAPFLYPELEWDFRLPLVKSINVSGHKYGLVYPGVGWVIWRSKEDLPEELIFHINYLGTDQPTFTLNFSKGSSQIIAQYYQLIRLGFEGYRNIMQNCQDNAAILREGIAATGRFGVLSKDAGVPLVAFSLRDSSRFSVFDVSENLRRFGWIVPAYTMPADAEHVAVLRVVVREDFSRSLAERLVSDVRKILRELDARATHAVRVATATAEQSGDGVVAKKSVLEIEREVAARWMNAVNKKKTGVC

SEQ ID NO: 52125 - protein, 146 aa, Glycine max
  misc_feature (37)..(37): Xaa can be any naturally occurring amino acid
  misc_feature (61)..(61): Xaa can be any naturally occurring amino acid
  misc_feature (72)..(72): Xaa can be any naturally occurring amino acid
MVLSTTDSEAYDYDNSPFDSKSVLASLSTFKMACASXPMEAESHIINNELMLDGTPRENLXASFVTTYMDPXSDKLIMHDINYIYVDMDEHPDTTELQTLSAIMILHFCNAPPKDTEATHAVRTGGSSEALMSTGLACQRLWQCTT

SEQ ID NO: 52126 - protein, 119 aa, Oryza sativa Japonica Group
MAGGKEPIEVKFRLFDGTDIGPSKYDPSTTVSALKEFILARWPQDKEITPKTVNDLKLINAGRILENNRTLAESRVPVGEVPGGVITMHVVVRPPQPDKNSEKQLANSPKQNRCGCTIL

SEQ ID NO: 52127 - protein, 484 aa, Francisella tularensis subsp. holarctica
MSQKLKRGLHTRHMSMIALGGCIGTGLFVALGGAIADAGPGGTVLAYVIIAIMVYFLMASLGEMAAHSPVSGTFCEYATRYVDSALGFSTGWSYWFNWAITVATEVIAAALIMQYWFPGSSILLWSGFFFVLVFALNIFSVKIYGEVEYWLSFIKVSTVIIFIIVGFLSILGLVGNHQSVGFQNWHIGDAPFHNGWWGFISVFMIAGFSFQGSELIGVTAGEAKDPNTSIPKAIKQTFWRLFIFYILAVVIISFLIPYNNPSLIKVGASNDVSVSPFTIVFENVGLNSAATIMNVIILTAIISACNASMYSATRVLWHLGNIKQAPQFFATTNSKGTPMIALLVTAVIGSSFFFVSFVGSGYIFTWLVNVSSLAGFIAWFTIALSHYRFRRAYIKQGKSLEDLPYVAKFFPWAPIIALTMVSIVIVGQGVTMLTMDGRTWFSVIIEFLSTYIGFFAFVILYFVYKFIKKTKLIRLEDCDLTRES

SEQ ID NO: 52128 - protein, 206 aa, Cryptococcus neoformans var. neoformans JEC21
MAAHSEQIKNNFLNNPYAQQVFNIANGQVSALDAELNKYPILRQLEQQTKVPKAYGVIALGFSSVLLIFFNMFGLAQPISNLIGWALPAYLSILAIESPQTNDDKQWLTYWVVFGSLNLVESMGLRAVLYWVPMYFVFKTLFTIWLMLPATRGAEILYFHFLRPMVGNVKSRSQSSFGTSDPLAKETGFNPAGTTAPSSFAHEKTL

SEQ ID NO: 52129 - protein, 2198 aa, Chondromyces crocatus
MTQRQDQLLERLREATLALRRTLDERDALEREKYEPIAIVGIGCRFPGGASSPSAFWDLLLEGRDAVGPLADRWALVGVSPEGDVPRWAGLLTEAVDAFDAAFFGISPREAVSLDPQHRLLLEVGWEALEDAGILAGTLEGSRTGVFVGALTTDYARLVEQRPRTEQDAYGMTGNLLSVAAGRLSYTLGLQGPCMTVDTACSSSLVSVHLACRSLRAGECDLALAGGVNLMLSADVMEGTSRTQALSPDGRCKTFDALANGFARGEGCGLLVLKRLSDAQRDGDPIRALIRGSAINQDGRSTGMTAPNVLAQEALLHEALENARVTSDQIGFVETHGTGTSLGDPIEVEALRAVLGAARPDGSRCLLGAVKTNVGHLEAAAGVAGLIKAALALQHEAIPGNLHLRQLNPRISLEGTPFVLPTETVTWPRQERRRLAGVSSFGISGTNAHVVLEEAPAQNTPDRTGSSPPDEPTAAALVVVSARNEQALADAAGRLGEHLQAHPELELPDVAFSLARTRTEMPHRLAIAATSREGLLEALATASRGETPAGGARGRVELRRRPEVIFVFPGQGSQWAGMGRQLLAEEPVFREALEASDRAVRAEAGWSLLQTLEGSPDALPLERIDVVQPVLFAIEVALSALWRSWGVEPDGVVGHSMGEVAAAHVAGVLSLADAVAVICCRSQLLRRLSGQGEMALVELSFEAAEAALAGYEDRLSVAVSNSPRATVLSGDPEALGQVMARLEGQGVFCRRVKVDVASHSPQVDPLEEELTRGLRDLRPQPARMRMQSTVTALPVEGPELGASYWVTNLRQPVRFAQTVEALLDGRHRLFVEMSPHPLLVTAIEEMRHAKGDPGGALASLWRERAERSALLESLGALWAQGQAVSWDRVLRDGGLRVTLPTYPWQRQRYWVDLSAHRKTGHRGHAGEHPLLGEGLSVSASAGMHLWETTLDHDRLPWLQDHRVQGLLVFPGAGYLEMALSAGRSLWGEHPLAVTDVALIEALTPADDEPTTVQMVTSTQGEALARFQIASQRPAATSAGWTVHARGMLRRLDHASAPDRVDLGALRARFDQVLAGEEIYRLLSARGLDYGPTFRGLLELRRGSHEALGRVSLPEPASVAAGYQLHPALLDACLQTVAGALDDPERRAWMPVALGAFEMAQPPTGEIWCHVRFTQDDPASLAPVTSRPDVRAPRRQRVDLSVLDASGTRIAELSGLVVQQLSQGARRHDPMADWFLEVGWIQSSVGPSRLTPGRYLLIGDGDGLERELASALEEAGHVVLCAAFGTSTEPGLGASSIDSASLETIRAQLSDAFGGQPPTAVVHLRTAAGRATPSTSAPLNTPGDSTTPLDGQALEADLCALYDSVLHTVQALATMAYRAPPRLWLVTRGAQPVAQRIVSLDQAPLLGLGRVIAMEHPELRCARVDLDPFSHTPQLQALLAELLADGDEHEVALRGTSRHVARFRHAPPRPLQPLTQLEPVEGRPFRLEIEPPGVLDGLELRPVARRAPGPGEVEIAVEAAGLNFVDVLKALGIYPGMKDGPVVLGGECAGQVVRVGPGVEGLVAGQPVLAMAPCSFGSHVTVGARSVAPRPSALTPAQAAAIPAVFMTAWYGLVHLARLQAGERVLVHSATGGTGQAALQIARHLGAEIFATAGSPEKRAWLREQGIAHVMDSRSLHFADEVLAATRGEGVDVVLNSLSGDAIEASLSALAPDGRFIELGKTDIHADRALGLAHFKKSLSYSAVDLAGLSERRPQRFSALLHEVVALFARGVFAPLPVETFPISRASEAFRKMAQAQHLGKLVLVTDDATARLRITATAGPRIRPDASYLVTGGLGGLGLSVARWLAEKGAGHLVLIGRSGAATAAQQAAVAELAATGTRLTLVKGDVAMRTQIEPAFDAIRSSGMPLAGILHAAGLLEDGLLLHQSPNAFRRVMAPKILGALNLDALAANAPLDFFVLYASGAGLLGSPGQGNYAAASTFLDAFAHHRRARGLPALSVDWGVFSEVGLAIAHDDRAARLASRGAQSLTPAQGIEALERLLDGGSPQTAVVPLDVAQWLASYPAAASSPMFSDLHVERPTLTAHASAETLAERLARATSEERGPLLQALVRGEVSRVLRLPESSLDIGAPLTSLGLDSLMGLELRHRLSRSTTVDIPVARLLSDMTIERLSSLLVHPTSGPTAAPVERQEAEAWVDTEL

SEQ ID NO: 52130 - protein, 423 aa, Trichoderma viride
MSLSNKLSITDVDVKGKRVLIRVSPDCPVDFNVPLDENKNITNPQRIAGAIPTIKHALDNGAKAVILMSHLGRPNGAVNAKYSLKPVVPKLEELLGKPVTFAPDCVGPEVEAIVNKADNGAVILLENLRFHIEEEGSSKDKEGNKTKADKAKVEEFRKGLTALGDVYVNDAFGTAHRAHSSMVGVDLPQKAAGFLMKKELDYFAKALESPQRPFLAILGGAKVSDKIQLIDNLLDKVNTLIICGGMAFTFKKVLDNLAIGDSLFDKAGAETVPKLVEKAKAKNVKIVLPTDFITADKFDKDANTGLATDKDGIPDGWMGLDCGDESIKLYKEAIDEAKTILWNGPAGVFEFEKFAGGTKATLDAVVEGCKNGKIVIIGGGDTATVAAKYGVEDKLSHVSTGGGASLELLEGKELPGVTALSSK

SEQ ID NO: 52131 - protein, 733 aa, Rhodobacter sphaeroides 2.4.1
MTDFTSRTDADGVCTITWDVPGKSMNVMSMAGFAELDGLIAAALGDPSVKGVILTSGKKDFAAGMDLNVIARMKEEGGDDPARAVFEGVMEMHAVLRRIERAGMDPKTLKGGKPIVAALPGTALGLGLELPLACHRIIAADNPKAKIGLPEIMVGIFPGGGGTTRLVRRLGAMMAAPLLLEGKLNDPKGAKAMGVVDEVVPADQLLPRAKEWVLGAKDADLVKPWDAKGYKMPGGAPYHPAGFMTFVGASAMVTGKTMGVYPAAKGLLAAVYEGALVPFDTALKIEARWFTHVLMNPSSSAMIRSLFINKEALEKGAVRPALPDQSVRKLGVIGAGMMGAGIAHVAANAGIEVVLIDATQEAADRGKSHSEGLLDKGMKRGKVSAEKKAEVLGRIAATTDYAALSGCDLIVEAVFEDPAVKAEVTQKVEAAVGPDCIFATNTSTLPISGLAKASRDPAQFIGIHFFSPVDKMMLVEIIRGKATGDRAVAKALDFVRQIRKTPIVVHDARFFYANRCIIPYLNEGIRMVAEGVAPALIENAAKLVGMPLGPLQLVDETSIDLGVKIAKATKAALGEAYPDAAVDAVIFPLADEGRLGRKAGAGFYAYDAAGKREGLWPGLADRWPQAEAQPELAEVQHRLLFAQVLEAVRALEEGVLTDIREGDVGAILGWGFAPWSGGPFSWLDMIGAPRAVEICEGLAERHGSRFAPPKLLVEMAGKGESFYARFAPQARAA

SEQ ID NO: 52132 - protein, 259 aa, Thermoplasma acidophilum DSM 1728
MIGALYVVGPAGTGKSTFSGSLNEWLKRMEFDSAIINLDPGADYLPYEPDFDIREYISLDSIMSDYNLGPNGSQIVAADMIVSYTDKITEFLEDLDDYYVVVDTPGQIELFTFRTSSTEIVEKVSGQRSMMAYIADAPLATYPSGFIAQKMLYASVFSRFFRPMMFVLNKIDLVSDEDIQEVKKWESSPDLLNDAFMEEKGQMEKDYFVGILQAFKESNIMTKIYPVSSRDSFGFEDIYSQMALYFTGGEDNDTYREEG

SEQ ID NO: 52133 - protein, 974 aa, Oryza sativa Japonica Group
MKKSLQKSLRDPMVKSFDQGLPRIVFFIVTIYTINREQKNVILNVSMSQWEAAFVVTLSLLFCIHGQLDNLGFISIDCGYITRPSYPDFKTNLTYVADVGFTNTGFIHTVDVGNLQRDLAQRYTTVRYFPNGTRNCYTLKQLTRGGKYLVRATFGYGNYDAFNSPPAFDLYLGANYWVKVNITNSSRAYVHETIAVSPSEFLQVCLVNTGSGTPFISGLDLRPMWHNVAQSLVLLSFFRETVSFGFNRFHFGTDEHHIRYPVDRYDRFWQRYEDIPGWEDVPDKINGTVKSPQNDTYGAPSDLMRSASTAVNASRMDLPWSSDASMDVGIGPEYIVVLYFAEVQAISDNLLRQFLVSVDNTPLAAAFSPRHMLADVFSGTVLGSDQHSISLITTIISDLPPLISAMEIFLGRTLNESSTGSSDAIAMMTIQTKYSVKRNWEGDPCAPEAFVWDGLSCIHTSIGDIQYNPRGLHRITALNLSFSELIGDIDASFGQLLLLRHLDLSYNNLSGSIPDFLGQMPLLTFLTGNNPNLCGNHTCDPISNKNKRNKFIGFVIAAAIVATVFALSLSALFIWYRRRKTNPDVLPEADPYKSRRFKYKELQVITNDWRNVIGEGGFGHVYAGQLEDVTDVAVKVESQTSLRGNHKQFLAEVQHLTRVHHKNLVSLIGYCNDKKHRCLVYEYMDGGTLEGRLRGREDPPEPPLTWLQRVNIALGSANGLNYLHTMCSPRLIHRDVKAGNILLTANLEAKISDFGLTRPSIHGTVETRTITQLAGTPGYMDPESLQASHPSESNDVYSFGVVLMVVITGRTAIVTINGTEKNLAQCVRDWLSSGRGIEAIADPMIRDDCNLSSVEMVAQLALDCTEPAGQDRPTMADVVTTLTESLQLEMSWSSPHSMRSSTTISSSAGFTGSGRADHDAAADSIAVLQVEQAVVETSTRGFTILDRAPRSQTLDELMNTGSEFSIHGQYVWLP

SEQ ID NO: 52134 - protein, 257 aa, Salmonella enterica subsp. enterica serovar Typhi str. CT18
MNPLIIKLGGVLLDSEEALERLFTALVNYRESHQRPLVIVHGGGCVVDELMKGLNLPVKKKDGLRVTPADQIGIITGALAGTANKTLLAWAKKHHIASVGLFLGDGDSVNVTQLDEALGHVGLAQPGSPKLINMLLENGFLPVVSSIGVTDDGQLMNVNADQAATALAATLGADLILLSDVSGILDGKGQRIAEMTASKAEQLIDQGIITDGMIVKVNAALDAARALGRPVDIASWRHAEQLPALFNGTPIGTRILA

SEQ ID NO: 52135 - protein, 73 aa, Brassica napus
NMSKTPTEKQELPLETSPYTKYEDIEDYKKNAYGTSGHQEVKPGQGGGATDAPTLSGSAPPSAIDSANQQAKK

SEQ ID NO: 52136 - protein, 720 aa, Neurospora crassa
MPPRTSSAVPKLRGREPCIKNMNLIYSVLENITGSDRNNKGLLKFDAAKAAQTANFSSGEVLRDKWYRFRRTFLLNSNLPVDPKRARCSSIEPELRGLKPTASDLNLIFSILENLKDKVLADWAKVAERAGLESADVAQQAWVNLCAEYQLWNDDIAVWRVSNSPCPQHPLVVVADKLQPAFISVADAISVPHTHQNPIPPFTPIRPSVLSVPSCDYLLPAPASAPTLAPVKTPTITGSHAPVHHQVFISGTQINKNNNKDSVNNKHAIDASRGTQTDAKCCPTKAIGFKVVARALLWHSILAEKSERRQHEKGPSLSAGCHTRARASYSWSWDTPINKNESVVNEESTMTVTSTNEGAKSKGRDAGTQTEDPCCRVTEFGFRVAFVYMFVVLNATDQQDSVSGWPLEHFGAGAEPVFNSKSYSSISNSVFFNDLRITTATTISPFPTPTTGLTGTPFSPTTKRAETLLAAARYIWSLSAKAEYEHDESLGEWPGWLLLDQGGGGGVSSTAYENALASAVAPLRLLWLRVAVMISEKNNKINNDNNNNNNNNNNNNNNNNNNNNNNNNNNNNNNNNNNNNNNNNNNNNNNNNNNNNNNNNNNNNNNNNNNNNNNNNKKKSNDDEEDAERDGGTEGERGRGRRLLISVQLFYRSQLSVCGFRGGMSTRTIWKFALVAVDTTLAGRGVLSTVNCEVMDSPSLFVLPPTLLNADKAGKRGNWP

SEQ ID NO: 52137 - protein, 593 aa, Oryza sativa Japonica Group
MESTMKGIRGDNAPCVLDLDDAATVGGGVGDTYGEDCATEEQLVTPWTVSVASGYNLLRDPRYNKGLAFNERERETHYLRGLLPPAIVSQELQERKIMHNIRQYQLPLQKYMAMMDLQEGNERLFYKLLIDNVEELLPVVYTPTVGEACQKYGSIFSRPQGLYISLKEKGKILEVLKNWPERSIQVIVVTDGERILGLGDLGCQGMGIPVGKLALYTALGGVRPSACLPITLDVGTNNEALPNDEFYIGLRQKRATAQEYADFLHEFMTAVKQNYGEKVLIQFEDFANHNAFELLAKYGTTHLVFNDDIQGTASVVLSGLVAALKLVGGSLSEHSYLFLGVGEAGTGIAELIALEISRQTKAPIEECRKKIWLVDSKGLIVSSRKETLQHFKKPWAHEHEPVGNLLDAVKTIKPTVLIGTSGKGQTFTQEVVEAISSFNERPVIFALSNPTSQSECTAEQAYTWSKGRAVFASGSPFDPVEYDGKIYVPGQANNAYIFPGFGLGVVMSGAIRVHDDMLLAASEALAQQVTQENFDKGLTYPPFSNIRKISAHIAANVAAKAYELGLASRRPRPKDLVKYAESCMYSPLYRNYR

SEQ ID NO: 52138 - protein, 144 aa, Triticum aestivum
EAKDVLVLYSVGIYTDDELGAMVDRMESAKLRTVNLTDNDLAKDHLRYFIGGRSEIKDELVYRFIFPERPGALMKFLDAFSPRWNISLFHYRAQGEAGANVLVGIQVPPAEFDEFKSHAENLGYEYMSEHNNEIYRLLLRDPKV

SEQ ID NO: 52139 - protein, 131 aa, Triticum aestivum
MTSKGAILLCLNVLFFTVVSSTYVPCNPPPKTPKHPPVPKPPSPKQVSCPKDTVKFGVCADVLGLINVQLGKPPKTPCCSLIQGLADLEAAVCLCTALKANVLGINLNVPVNLSLLLNYCGKGVPKGFVCY

SEQ ID NO: 52140 - protein, 470 aa, Bacillus cereus ATCC 14579
MVVGDFPIELDTVVVGAGPGGYVAAIRAAQLGQKVAIIEKANLGGVCLNVGCIPSKALINAGHRYENAMHSDDMGITAENVKVDFTKVQEWKNGVVKKLTGGVEGLLKGNKVEIIRGEAYFVDANTLRVMTEDAAQTYTFKNAVLATGSTPIEIPGFKYSKRVINSTGALSLPEIPKKLVVIGGGYIGMELGTAYANFGTEVTVVEAGDEILAGFEKAMSSVVKRALQKKGNVNIHTKAMAKGVEETETGVKVSFEVKGEIQTVEADYVLVTVGRRPNTQEIGLEQVGVKMTDRGIIEIDEQCRTNVPNIYAIGDIVPGPPLAHKASYEGKVAVEAISGHASAIDYIGIPAVCFTDPELASVGYTKKQAEEAGMTVTVSKFPFAANGRALSLNSTDGFLQLVTRKEDGLLVGAQVAGAGASDIISEIGLAIEAGMTAEDIAQTIHAHPTLGEITMEAAEVALGMPIHIVK

SEQ ID NO: 52141 - protein, 429 aa, Bacillus cereus ATCC 14579
MAFEFKLPDIGEGIHESEIVKWFIKPGDEVNEDDVLLEVQNDKAVVEIPSPVKGKVLEVLVEEGTVAIVGDTLIKFDAPGYENLKFKGDDHDEAPKAEEAAVEAPAAEATPAATAEVVNERVIAMPSVRKYAREKGVDIHKVAGTGKNGRIVKADIDAFANGGQTVAATEAPAAVEATPAAAKEEAPKAQPIPAGEYPETREKMSGIRKAIAKAMVNSKHTAPHVTLMDEVDVTELVAHRKKFKAVAADKGIKLTYLPYVVKALTSALREYPMLNTSLDDASQEVVHKHYFNIGIAADTDKGLLVPVVKDTDRKSIFTISNEINDLAGKAREGRLAPAEMKGASCTITNIGSAGGQWFTPVINHPEVAILGIGRIAEKPVVKNGEIVAAPVLALSLSFDHRLIDGATAQKALNQIKRLLNDPQLLVMEA

SEQ ID NO: 52142 - protein, 431 aa, Coccidioides immitis RS
MASAAAPKGYDYETTEAAGVKLACRDFPAPTTTLTVVAKAGSRYQPLPGYSDALANFAFKSTTKRSALRITRESELLGGQFSAYHSRENVVLTTKFLSADLPYYAELLAEVLSNAKYSAYELSEVVVDHVKLSQQELVANPSLQALDAVHNVAFHRGLGNPLIPSPSAPLNVDADGVAAFSKNVYTKATTAVISNGANASEVSKWVGQFFSGVPASPASGAVASEASKYFGGEQRIASQAGNAMVIAFPGSSSFGTNGYKPEFNVLAALLGGQSTIKWSTGSSLLSKAVEGVSGVSVSAKQATYSDAGLFHITISGQAESVAQASKSVVETIKKVASGNIASEDIKKAIALARFRALECGQNLTSGVELTGSALVHGSQPFQIAGVGQSIEKVTEQQVKEAAKSLLAGKASVASVGDLFRIPYASELGLTV

SEQ ID NO: 52143 - protein, 650 aa, Oryza sativa
  misc_feature (111)..(111): Xaa can be any naturally occurring amino acid
MPLGQRAGDKSESRYCGVEVLDFPAGEELPAVLSHSLSSSFDFLLAPLVDPDYRPTPGSVLPVAASDLVLGPAQWSSHIVGKISEWIDLDAEDEQLRLDSEITLKQEIAWXASHLSLQACVLPPPKRSSCANYARVVNHILQGLTNLQLWLRIPLEKSEPMDEDHDGAKDNSDMSDTVDSWEWWNSFRLLCEHSSQLCVALDVLSTLPSMNSLGRWFGEPVRAAILQTNAFLTNARGYPCLSKRHQKLLTGFFNHSVQVIISGRSNHNVSQGGVLSGDENHTEDTAVRHALSPYLDYIAYIYQRMDPLPEQERFEINYRDFLQSPLQPLMDNLEAQTYETFEKDTVKYTQYQRAIAKALVDRVSDDDVSTTKTVLMVVGAGRGPLVRASLQAAEETGRKLKVYAVEKNPNAVITLHSLIKLEGWESLVTIISSDMRCWEAPEKADILVSELLGSFGDNELSPECLDGAQRFLKPDGISIPSSYTSFIEPITASKLHNDIKAHKDIAHFETAYVVKLHRIARLAPTQSVFTFDHPNPSPNASNQRYTKLKFEIPQETGSCLVHGFAGYFDAVLYKDVHLGIEPNTATPNMFSWFPIFFPLRKPIYVPSKTPIEVHFWRCCGATKVWYEWAVTAPSPSPIHNSNGRSYWVGL

SEQ ID NO: 52144 - protein, 1191 aa, Oryza sativa Japonica Group
MSGLDLREMLSSAARRHTWRRSGWGAEWGGGDDARSAALPARCPPPPPPRRPAAAGGRGDEGSGGVRGRGEEGTSRGGSGARREDAAGTGRNAVAVVAGGSATSGAERVAARAEDGRRSMDGPTLELSEMMLHAAQPWRSRCTQRDVRPGAVPPRPVAADGRGEGTSTVRGRVLEGTTRGGGRGGGMEREREVVAPARNAVAVAGDLATHGGERVAGPLVAKEKRNGGGELGTKRGLEKRAPLPPPKRRVVSAKRQFPPDFGRDSAVPLGRGRGRGGGVRPSDGAPARAVLGEKVASAVGSPENGAEGAARGKGAHNGELLGKREVLAQAVNLLPMRRTVSATHRFTAGCGRDAAAPLARREEGKVGSGLEVMPVDVGGGERHEGVVPVTFAVTEVLTSHAYDEMMQIKALQEGGSDAAQETEHDLPMGGKCETILPDASPKCSFGGPSNEIVHGKRVLGSHGMKGEVPSLAIEDHGGIAQIDQELEDVEMTTGEYRVQDAQIATHVIPHESTTGRHEGGLCASAAAEDVKVMNKYKGTLPKGAAKSSMNIATGVFGDGIMRSKILSTARKVVKPPVRASHKPPLNTLHRPFSTNSASFGHKKLKVKRPDQSKDIPMKIASTSGLAGKDNLIDEKALSLEDDDILKALVVHDGKLEVYLNVPSCVQLHRQHGSGNADDRSKIRMLCRRFQFICRALLHAVEQGSLKIRRVDLAADKIIRKLPGFTKPGPTVGNVNGVEVGDEFMYRVELALVGLHRPYQGGIDTTDYNGVLVAISIVCSGGYPDELSSSGELIYTGSGGKPAGKKKDEDQKLERGNLALKNCIETKTPVRVIHGFKGQNREDNSHSRAKQILTFTYDGLYLVVDCWTEGLKGSRIFKYKLQRIPGQPELPLHIAKGLRRSLSRPGLCIADISQGKEMDPICVINDVSNVHPTSFQYISRIKYPSWLTKRHPQHHGCDCSDGCIDSTKCFCAVKNGGKIPFNSNGAIVHDKPLIFECGPSCRCHSSCHNRVSQKGMKIHLEVFRTANKGWGVRSLRSISSGSFICEYVGILLTDKEADKRTNDEYLFDISHNCDDEDCSKGRPSTISSLNSSGGCSQTMEDVCFTIDASEYGNIGRFINHSCSPNLYAQNVLWDHDDQRVPHIMFFAAENIPPLQELTYDYNYKIGEVRDLNGRVKVKDCHCGSPQCCGRLY

SEQ ID NO: 52145 - protein, 197 aa, Kluyveromyces lactis NRRL Y-1140
MNNTVLVTCGATVSFPRLVETVLDRSVTEKLKVLGYGRIVIQYGRGFSDTFLQLVEKHLGLFTEKKSCGIKVLDKIENLKVISVDGIEICGFEFSHDIEKLIANNIDLVISHAGTGSILDSLRVGKKLIVVVNDTLMDNHQQLIADKFEQQKLLWSVHANTEELLRALDRSENEELLKIDNTYNKQFEKLLYNVAID

SEQ ID NO: 52146 - protein, 129 aa, Arabidopsis thaliana
  misc_feature (27)..(27): Xaa can be any naturally occurring amino acid
  misc_feature (95)..(95): Xaa can be any naturally occurring amino acid
  misc_feature (112)..(112): Xaa can be any naturally occurring amino acid
RNIRGDPRVRAQATMVAPFTEHEVFLXFPATPKAGDDITFITSNGGRVSCMKVGTPVVKHKAETLSYLPDLRDVELANEADYLPRNNSPRWVRFXLEHGFVFREHGNTSGYXDGRYWTMWKLPLFGCTD

SEQ ID NO: 52147 - protein, 118 aa, Vitis vinifera
MGNSSAFVLICAIMAVHMVLTSSAVDFSGDHLQFQLGWIPARSACQGSIAECLAGEEFEMDSEINRRILASKRYISYGALSRNSVPCSRRGASYYNCRPGAQANPYTRGCSAITRCRR

SEQ ID NO: 52148 - protein, 263 aa, Pseudomonas aeruginosa PAO1
MPTVRLADGDLNYSLEGPAGAPVLLLSNSLGTDLGMWDTQIPALTAHFRVLRYDTRGHGASLVTPGPYAIGQLGADVLALLDALELPRVHFCGLSMGGLIGQWLGIHAGERLGRLVLCNTAAKIASDEVWNTRIDTVLKGGEQAMRDLRDASVARWFTAGFAEREPAQVERIVAMLAATSPQGYAANCAAVRDADFREQLGLVQAPTLIVAGSHDAVTTPDNARFMQARIADAQLVEFAAAHLSNVEAGDAFSRRLVDFLLSA

SEQ ID NO: 52149 - protein, 227 aa, Oryza sativa Japonica Group
MASSMAPAAAMAILLLALLMPATLCSRSGPPSSKHGHGGHAKRAPPPASPVVPVAPQAAALVRATCNSTAYYDVCVSALAADPSSTTADVRGLSAIAVSVAAANASGAAQAAAALANGTAPLAAAAAGDGTVQALLRACAGKYGDARDALAAAKESMGQQDYDLATVHVSAGAEYPQVCKALFRRQRPGAYPAELAAREEALNKLCSVALDIIALLTSSPASNNNNS

SEQ ID NO: 52150 - protein, 129 aa, Oryza sativa Indica Group
MAPSVMASSATSVAPFQGLKFTAGLPVNRRSSSSSFGNVSNGGRIRCMQVWPIEGIKKFETLSYLPPLTVEDLLKQIEYLLRSKWVPCLEFSKVGFVYRENHRSPGYYDGRYWTMWKLPMFGCTDATQV

SEQ ID NO: 52151 - protein, 108 aa, Salvia officinalis
ISLYLFVFFKEYKEVQREKTADPDIQLVCDDSNIFKWTALIKGPSETPYEGGVFQLAFSVPEQYPLQPPQVRFLTKIFHPNVHFKTGEICLDILKNAWSPAWTLQSVC

SEQ ID NO: 52152 - protein, 328 aa, Sinorhizobium meliloti 1021
MVAPRILVTGGAGYIGSHTAKLLRLEGIEPVVYDNLTTGNRSAVRWGPFVQGDILDGRRLIEVIEAHQPDAVIHFAASAYVGESVADPAKYYNNNVRGTLSLLDACRQTGVDKVIFSSSCATYGVPAVLPIDEATPQAPINPYGKTKLVAEHMLADYAAAFALNYVSLRYFNACGADPEGDLGEWHDPETHLIPRALMAAAGRIPHLEIFGEDYDTPDGTCVRDYIHVADLASAHVLAYRHLAKGGGNVALNLGTGRGFSIKEVLRTIGEITGHDVPVVFRRRRAGDPPALYADAGLACRTLGFLPRYSDLETIVRTAAPFFGLEVRS

SEQ ID NO: 52153 - protein, 321 aa, Kineococcus radiotolerans SRS30216
MRAVRIDRTGGPEVLTVTDLPAPEPGPGQVLVDVEAAGVNFIDTYRRGGVYPLDLPAVLGSEGAGRVARPGPGVEGFAAGQLVAWKEAPGSYAEQVLVPAAELVPVPEAVGATTAAAVLLQGLTAHYLATDTFPAAAGTWALVHAGAGGVGLLLTQVLKLRGANVLTTVSTPAKAELSRAAGADDVVVGYAGATPRARELTGGLGVDVVYDGVGRDTFDAGLDALRPRGLMVVFGGSSGQVPPFDVQRLNAKGSLFLTRPTLRSYTRDRAELLARTEEVFGWITAGRLDVRVGGTYPLTAARRAHEDLEGRRTTGKLLLVP

SEQ ID NO: 52154 - protein, 293 aa, Oryza sativa Indica Group
PRLSELLGVDVVMANDCIGEEVEKLAAALPEGGVLLLENVRFYKEEEKNDPEFAKKLAAVADLYVNDAFGTAHRAHASTEGVTKFLKPAVVGFLMQKELDYLVGAVANPKKPFAAIVGGSKVSTKIGVIESLLAKVDVLILGGGMIFTFYKAQGYAVGKSLVEEDKLELATSLIEKAKAKGVSLLLPTDVVVADKFAADAESKTVAASAIPDGWMGLDVGPDAIKTSSEALDTCNTIIWNGPMGVFEFEKFAAGTDAIAKKLADLTTTKGATTIIGGGDSVAAVEKAGLADKM

SEQ ID NO: 52155 - protein, 267 aa, Arabidopsis thaliana
MGSAFDPLVTATEDLAAVNSAPPLSNLTQEELKKIAAYKAVEFVESGMVIGLGTGSTAKHAVARISELLREGKLKDIIGIPTSTTTHEQAVSLGIPLSDLDSHPVVDLSIDGADEVDPALNLVKGRGGSLLREKMIEGASKKFVVIVDESKLVKYIGGSGLAVPVEVVPFCCDFTRGKLEELFRDSGCVAKLRMKIGSNGEEAAPAVTDNGNYVVDLYLERDIGDLEVASEAILRFPGVVEHGMFLGMATTLIVAGKFGVTVKDRFG

SEQ ID NO: 52156 - protein, 173 aa, Zea mays
MAAKRELVVSFGEMLIDFVPTVAGVSLAEAPAFVKAPGGAPANVAIAVARLGGGAAFVGKLGDDEFGRMLAKILRDNGVDAGGVVFDSGARTALAFVTLRADGEREFMFYRNPSADMLLTADELKVDVIKRAAVFHYGSISLIAEPCRTAHLHAMKVAKEAGALLSYDPNLRE

SEQ ID NO: 52157 - protein, 589 aa, Chlamydomonas reinhardtii
MVSCFSCGSGEHKDITDQALDEARRELKKNRGRKIGDVYHFGQVLGKGGFGKVYLATHKHTKHQYAVKQVEKRPERWIQEALLLEIAVQRRACAAIPHAVKLVEVYEDGADTYLVLELCPGGEVFDRIIEQGNFCERDAAEVMRALLGFIAALHGRLGVAHRDIKPMNLLLACEPDQPITAADVRLADFGLSAFCEDGQHFHETCGTIYFQAPEARELEERGRGPRGCCLTNPGRGSVVGDASGRVRYDKGADVWAAGVTMYVLLCGWVPFGGRYAFKRSEVELRKIIRAGKFCFTGLVWEVVSDSAKDLIRQLLTPDPAQRPSAAQLLSHPWFHEAASLQRPLGQRMITNLKQFAAACRLQKLAALVVAKRGGGLGNKLNPDVAKLREVFAELDANGDRRLTFDELKDEIQKVRVAMRGSTAGTAKALAKSGGAKSGATAAAGGGGGLDEQQLWKLFMAADCDGDGKLDVNEFVAAMMNAAGVQPDEKTAAEAIFDEVDVLEEALVVSKHHSKRAAGLPEGEEEADDGAGGADGDGEEAEQAGKNTNNQNHGDNRKTDNHKGTWNPPFKSMEPHEPLPVEDRKTNIDF

SEQ ID NO: 52158 - protein, 529 aa, Yarrowia lipolytica CLIB122
MTTTATETPTTNVTPTTSLPKETASPGGTASVNTSFDWESICGKTPLEEIESDISRLKKTFRSGKTLDLDYRLDQIRNLAYAIRDNENKIRDAIKADLKRPDFETMAAEFSVQMGEFNYVVKNLPKWVKDEKVKGTSMAYWNSSPKIRKRPLGSVLVITPWNYPLILAVSPVLGAIAAGNTVALKMSEMSPNASKVIGDIMTAALDPQLFQCFFGGVPETTEILKHRWDKIMYTGNGKVGRIICEAANKYLTPVELELGGKSPVFVTKHCSNLEMAARRIIWGKFVNGGQTCVAPDYVLVCPEVHDKFVAACQKVLDKFYPNNSAESEMAHIATPLHYERLTGLLNSTRGKVVAGGTFNSATRFIAPTIVDGVDANDSLMQGELFGPLLPIVKAMSTEAACNFVLEHHPTPLAEYIFSDNNSEIDYIRDRVSSGGLVINDTLIHVGCVQAPFGGVGDSGNGGYHGKHTFDLFSHSQTVLRQPGWVEMLQKKRYPPYNKSNEKFVRRMVVPSPGFPREGDVRGFWSRLFN

SEQ ID NO: 52159 - protein, 122 aa, Zea mays
MAKKGIQYVVVDAFTAQPFKGNPAAVCFLEDDAAAPAGDGRWMQSVAVEFNLSQTAFFSRDSSCAADAATPRFHLRWFTRVTEVALCGHATLATAHFLFTSVLAERHGVVEFVTKSGVLTAK

SEQ ID NO: 52160 - protein, 306 aa, Helicobacter pylori 26695
MMIITTMQDAIGRTPVFKFTNKDYPIPLNSAIYAKLEHLNPGGSVKDRLGQYLIGEGFKTGKITSKTTIIEPTAGNTGIALALVAIKHHLKTIFVVPEKFSTEKQQIMRALGALVINTPTSEGISGAIKKSKELAESIPDSYLPLQFENPDNPAAYYHTLAPEIVQELGTNLTSFVAGIGSGGTFAGTARYLKERIPAIRLIGVEPEGSILNGGEPGPHEIEGIGVEFIPPFFENLDIDGFETISDEEGFSYTRKLAKKNGLLVGSSSGAAFVAALKEAQRLPEGSQVLTIFPDVADRYLSKGIYL

SEQ ID NO: 52161 - protein, 467 aa, Hyphomonas neptunium ATCC 15444
MADDLLKLMKDQDVQYVDLRFTDTRGKLQHVSFHKDMVDKSFFEDGQMFDGSSIAGWKAINESDMLLKPDAKGAFIDPFFQQTTLVVFCDILDPISGQAYSRDPRTTAKKAEAYLAASGVGDTAFFGPEAEFFIFDDVRWSTDPHNTGYSFDSTELPANSGREYPMGNLGHRPGPKGGYFPVPPIDSEQDMRGEMLSIMGDIGLEPEKHHHEVAPAQHELGLKFSTLTVMADRMQLYKYVIHQVAASYGKTATFMPKPMFKDNGSGMHVHQSIWKGGKPLFAGDKYADLSEMCLYYIGGIIKHAKALNAITNPSTNSYKRLVPGYEAPVMLAYSARNRSASIRIPYGSNPKAKRIETRFPDPMANPYLAFAALLMAGLDGIENKIHPGDAMDKDLYDLPPAEAKQIPQVCGSLREALAALDADRAFLKKGGVFDDDQIDAYIELKMEENMRYELHPHPVEFDMYYKN

SEQ ID NO: 52162 - protein, 301 aa, Methanococcoides burtonii DSM 6242
MKHLISMTDLTQEEIIEILDMAEDLKEKRLRGKMTDLLKNKSLAMIFEKSSTRTRVSFEVAMSDLGGHSIYLNSRDIQIGRGETVSDTAQVLSRYVAGITARVNSHRTVEDLAKHSNVPVINALSDLEHPCQILADFLTIREYKNRLNGLKFAWIGDGNNVCNSLILGCALVGMQIAVACPEGYMPNPEIVAKGRELGGDILITTDPEEAAADADVLYADVWVSMGDEEEREKRLSDLENYQINSNLVELAKPDVIFMHCLPAHRGEEVSAEVMDGPHSVVFDQAENRLHAQKALLMKLMA

SEQ ID NO: 52163 - protein, 341 aa, Ostreococcus tauri
MTTADARALVESFARVSLAPTGASPIERAPRLSEALGGAEIFIKRDDVYGTITGGNKTRKLEYLLAEALDANAERVVTQGATQSNHARQTAAACARLGLKCHVLLEDRTKRVDQNYTANGNVLLNSLFGATMEYRPGDQGLNMNDEMLASCESFREKGESVYGIVGGGSCPTGALGYVRAAIEILEQADAMGLEFDYIVHATGSAGTQAGLVTGLHAVGSKTKLLGFGVRAPKDVQETNVHNLAVKTCEKLGISPVDRADVVADTNYVGDGYGFPADSTIEAIREFASLEGILLDPVYSGKGGAGLIDYCRKGLFAPGTKVLFLHTGGSTSLHGYLDSFAQ

SEQ ID NO: 52164 - protein, 376 aa, Streptomyces avermitilis MA-4680
MEPVSEESIAVTHPFLDLAPLSAAHFASIEDRVARLLATEQDVVIMQGEALLPLEGAIRAAAGPGTTALNVITGPYGQTFGNWLRDCGATVIDLAVPFHTAVTAARIREAFAAHPEIDFVSLVHAEAATGNTNPVAEIGAAVREHGALFYLDAVASIGAEPVLPDAWGVDLCVIGAQKAMGGPAGVSAVSVSERAWARMAANPAAPRRSYLSLLDWKERWVDGGRKALLHAPAQLEMLALEACVERIEAEGLEAVMARHASAAAATRAGAVALGGGLEPYVHEAADAAPVATTLRTPAGIDASELVAKALASDPVLPLVAGGGALAREMVRVNHYGPGATRGVVQSCLGALGAALAEFGVPVDLEGARRAVAEAWA

SEQ ID NO: 52165 - protein, 256 aa, Pseudomonas syringae pv. syringae B728a
MNDQRKGSDAEPTTHFGYKNVPESQKAEKVAEVFHSVAAKYDLMNDLLSGGMHRLWKRFAIELSGVRTGNRVLDIAGGTGDLTRKFSNLVGPTGQVVLADINASMLKVGRDRLLDLGVSGNVEFVQADAEKLPFPDNHFDCVTIAFGLRNVTHKEDALRSMLRVLKPGGRLLVLEFSKPTNKLMSKAYDAYSFAFMPLMGKLVTNDSESYRYLAESIRMHPNQETLKSMMVEAGFDRVTYHNMTAGVVALHRGIKP

SEQ ID NO: 52166 - protein, 249 aa, Oryza sativa
MIRRHVGRGVGRRVLFTGLVIPITLGLLPRSLTRKGLKGREAITAKLSANLLTEAGSDRVIVCDIHSTQALGYFDIPVDHIHGQPVILDYLASKTISKDLVVVSPDVGGVVRARAFAKKLSDAPLAIVDKRRQGHNMSEVMHLIGDVKGKVAIMVDDMIDTAGTITSAAALLKQEGAEAVYACSTHAVFSPPAIERLSGGIFEEVIVTNSILLPEHKCFPQLTVLSMANLVAETIWHVHRDGSVSSIFQ

SEQ ID NO: 52167 - protein, 448 aa, Pseudomonas aeruginosa PAO1
MNSPSLPAVERLDVQAFINAQPLSPYQWRIVLLCFLIVFLDGLDTAAMGFIAPALTQDWGIDRASLGPVMSAALIGMVFGALGSGPLADRYGRKLVLVAAVFLFGLFSLASAYSTNVEQLLALRFLTGLGLGAAMPNATTLLSEYTPERLKSLLVTSMFCGFNLGMACGGFVSAKLIPLFGWHSLLLLGGLLPLVLAVVLLFRLPESARYLVVRNRGSERVRQVLAPIAPAQVALARSFHVPEQQTVQARNVFAVIFSGTYSAGTLLLWLTYFMGLVIVYLLTSWLPTLMRDSGASLEQAAFIGALFQFGGVLSAVAVGWAMDRFNPHKVIGLFYLLAGVFAWCVGQSLGQVTLLATLVLLAGMCINGAQSAMPSLAARFYPTQGRATGVSWMLGIGRFGAILGAWIGATLLGLGWNFEQVLTALVLPAALATAAVLLKGLVSHADAG

SEQ ID NO: 52168 - protein, 483 aa, Saccharomyces cerevisiae
MLSATKQTFRSLQIRTMSTNTKHYDYLVIGGGSGGVASARRAASYGAKTLLVEAKALGGTCVNVGCVPKKVMWYASDLATRVSHANEYGLYQNLPLDKEHLTFNWPEFKQKRDAYVHRLNGIYQKNLEKEKVDVVFGWARFNKDGNVEVQKRDNTTEVYSANHILVATGGKAIFPENIPGFELGTDSDGFFRLEEQPKKVVVVGAGYIGIELAGVFHGLGSETHLVIRGETVLRKFDECIQNTITDHYVKEGINVHKLSKIVKVEKNVETDKLKIHMNDSKSIDDVDELIWTIGRKSHLGMGSENVGIKLNSHDQIIADEYQNTNVPNIYSLGDVVGKVELTPVAIAAGRKLSNRLFGPEKFRNDKLDYENVPSVIFSHPEAGSIGISEKEAIEKYGKENIKVYNSKFTAMYYAMLSEKSPTRYKIVCAGPNEKVVGLHIVGDSSAEILQGFGVAIKMGATKADFDNCVAIHPTSAEELVTMR

SEQ ID NO: 52169 - protein, 491 aa, Vitis vinifera
MLSPGMDSAREGGGVAGTVLIPMNFVWSYGGRSVYLSGSFTGWTNLYQMSPVEGCPTVFQVICSLTPGYHQYKFFVDGEWRHDENQPFISCTYGIVNTVLLARESDYIPPTISPAVPSLTNMDVDNEAFQQLVRISDGSRHEAVPRIQETDLEVSRHRVSLFLSTHTVYELLPESGKVITLDVDLPVKQAFHILYEQGISIAPLWDYFKGRFVGVLSALDFILILRELGNHGSNLTEEELETHTISAWKEGKGYLNRQIDGNGRAFSRGLIHAGPYDNLKDVALKILENEVATVPIIHSSSEDGSFPQLLHLASLSGILKCICRYFRHSSNSLPVLQLPIFAIPVGTWVSEIGEANQRPLAKLHPSASLSSALSLLVQAQVSSIPIVDDNDSLLDIYSRSDITALAKNRVYAHINLDDMTIHQALQLGQDPYSPYEFNSQRCQMCLRTDPLHEVMDRLANPGVRRLVIVEAGSRRVEGIVSLRDIFKFLLG

SEQ ID NO: 52170 - protein, 414 aa, Francisella tularensis subsp. holarctica
MALISLAIDYKKSPIEVRSEFALSGLDVSMLYRSILAIDNVVHAVILSTCNRTEVYLEISDLRVVDDILVWWQGYVRNPNYKIKDYFKLRQGTEVIMHLMKLACGLESMVLGEPQILGQVKDSYTLSKKNHAIGKELDRVFQKVFATAKRVRSETRIGYCPVSVAFSAITLAKRQLDNISSKNVLIIGAGQTGELLFRHVTALAPKQIMLANRTIEKAQKITSVFRNASAHYLSELPQLIKKADIIIAAVNVLEYIVTCKYVGDKPRVFIDISIPQALDPKLGELEQNVYYCVDDINAVIEDNKDKRKYESSKAQKIIVKSLEEYLEKEKAIISNSAIKELFQKADGLVDLSLEKSLAKIRNGKDAEEIIKRFAYEIKKKVLHYPVVGMKEASKQGRSDCLVCMKRMFGLNVEK

SEQ ID NO: 52171 - protein, 543 aa, Rubrobacter xylanophilus DSM 9941
MFRSEGAAAKTRVRRPDGGGRSTVYGTRGAVSCEHPLAAVEGLRVLDEGGTAADACVAMAACLAVVAPMTTGMGGDAFLLFYEAGSGRVIGANGSGRAPRGATIEGLRARGVKEMPERGGLSVTVPGAVRLWEDAARRLGKLPLGRLLEPARRYAEEGFPVTEVVSRYWEVAAELLGSREASARCFLPGGRAPRPGEVFRQPDLARTLALVAESGSEAFYGGEVARSIARAVQEDGGYLSEEDLAAHETTWVEPISTGYRGLEVHEIPPPGQGIAALEMLNILEGFDMGSLDPSGAERIHLEVEAKKLAFRDLFGKVGDPEFAAVPVEELLSKDYAARLREEISPERAAVPSVGPALGSDTTYLCAVDAGGNGCSFINSLYMGFGSGVVADGTGVCLQNRGRSFRLVEGHPNALAPGKRPMHTIIPGLVTRDGALWAVFGVMGGPMQPQGHAQLLSNLIDHRMEPQEAVDHPRHFHDHEGDVLLVEGRVAPAEVERLRRMGHRVEVGPAYAIPTGGAQLIRVLEDGVRACGSDPRKDGCALAQ

SEQ ID NO: 52172 - protein, 1081 aa, Vitis vinifera
MDSEGESGAKSLKGLGGQVCQICGDNVGKTVDGEPFIACDVCAFPVCRPCYEYERKDGNQSCPQCKTRYKRHKGRPAIRGDGEEDGDVDDVVADINYSSEDQNQKQKIAERMLSWQMTYGRGEDTNYDREVSHNHIPLLTNGMDVSGELSAASPERLSMASPGAGGGGKRIHPLPYTGDVNQSPNIRITDPVREFGSPGLGNVAWKERVDGWKMKQEKNVVPLSTGHAASEGRGAGDIDASTDVLVDDSLLNDEARQPLSRKVSIPSSRINPYRMVIILRLIILSIFLHYRITNPVNDAYPLWLLSVICEIWFAMSWILDQFPKWLPVNRETYLDRLALRYDREGEPSQLAAVDIFVSTVDPLKEPPLVTANTVLSILAVDYPVDKVSCYVSDDGAAMLTFEALSETSEFARKWVPFCKKYSIEPRAPEWYFALKIDYLKDKVQPSFVKDRRAMKREYEEFKVRVNGLVAKAQKIPEEGWIMQDGTPWPGNNTRDHPGMIQVFLGQSGGLDTEGNELPRLVYVSREKRPGFQHHKKAGAMNALVRVSAVLTNGPFLLNLDCDHYINNSKALREAMCFLMDPNLGKSVCYVQFPQRFDGIDRNDRYANRNTVFFDINLRGLDGIQGPVYVGTGCVFNRTALYGYEPPIKPKHKKPGVFSLCCGGSRKKGSKSSKKGSDKKKSSKHVDPTVPIFNLEDIEEGVEGAGFDDEKSLLMSQMSLEKRFGQSAVFVASTLMENGGVPQSAAPETLLKEAIHVISCGYEDKSEWGREIGWIYGSVTEDILTGFKMHARGWRSIYCMPKRPAFKGSAPINLSDRLNQVLRWALGSVEILFSRHCPIWYGYGGRLKWLERFAYVNTTIYPITAIPLLVYCTLPAVCLLTGKFIIPQISNIASIWFISLFLSIFATGILEMRWSGVGIDEWWRNEQFWVIGGVSAHLFAVFQGLLKVLAGIDTNFTVTSKASDEDGDFAELYMFKWTTLLIPPTTLLIINLVGVVAGISYAINSGYQSWGPLFGKLFFAFWVIVHLYPFLKGLMGRQNRTPTIVVVWSILLASIFSLLWVRIDPFTTRVTGPDVEQCGINC

SEQ ID NO: 52173 - protein, 427 aa, Rubrobacter xylanophilus DSM 9941
MADVTGVGREGAGEAPRSWGARLKYIGPGFVVAATGVGAGDMVSSLSAGTNFGTVLIWAIVIGALLKYVLTEGLGRWYMATGTTILEGWRSLGLWASLYFVIYLLIVTFVFGAAVVSASALAVTAMFPGVMPLWAWAVLHGIFGFVVIGIGRYRLFERIMEFFVALMFVTVVGLAIMLTPDLGELALGIVVPRIPEGSVLYALAVIGGVGGTFTLASYPYWVRERGWSRPSWIPMMRLDLSVGYLFTALFMVSMLVIGAEMLFARGEGISGEEGLVALSDPIRERFGTLASWFFLVGFWAAATSSILGAWNGAAYLFADSVRTILRVPDERAGEYLSETGLWFRLMLVWITFPPMLLLSFGQPVLLVVVYAALGAFFMPFMALTLLWLLNSSRVSREYRNGWLTNALLAAAILLFVVVGVQEVAGAL

SEQ ID NO: 52174 - protein, 186 aa, Rhodobacter sphaeroides 2.4.1
MFIQTESTPNPATLKFLPGQMVLEAGTADFATAEAAATSPLARRIFAAGGVSAVFFGTDFVAVTKADEVAWDHIKPAILGAIMEHYQSGAPVLEGEQAASGHASHDGPDEDVVRQIKELLDTRVRPAVAQDGGDITFHGFDRGIVYLHMQGACAGCPSSTLTLKMGIENLLRHYIPEVLEVRPVAA

SEQ ID NO: 52175 - protein, 200 aa, Brassica napus
MMPKANVIFSSTITIFLLLSISHFPGALSQFDKECTPEYDNTCTDKNKAFNLKLVAVFTILVTSLIGVCLPLFARSVSAFQPERSLFLIVKSFASGIILATGFIHVLPDSFEMLSSHCLNDNPWHKFPFTGFVALISAVFTLMVDSITTSLISKSGKRDPCADVASAGSPDEEMGHVSHYGHGLHHSNGKKLGSNLQLLR

SEQ ID NO: 52176 - protein, 325 aa, Cucurbita pepo
MALLFFLALLFGASYAQLTETFYDQTCPRLPNIVRQEVKRAIETDIRAGAKLIRFHFHDCFVQGCDGSVLLEDAPGIDSELNGLGNLGIQGLEIVDAIKAAVESECPGVVSCADVLALAAKQSVDVQGGPSWRVLFGRRDSRTANRTGADELPSPFETLEPLKQKFEALGLDSTDLVAPSGAHTFGRSRCMFFSGRFSNFNGTGQPDPALDPAYRQELERACTDGETRVNFDPTTPDTFDKNYYTNLQANRGLLTSDQVLFSTPGADTIEIVNRLGSREGTFFRQFRVSMIKMGNIRPLTPNQGEIRRNCRGVNELGGEAGHDVM

SEQ ID NO: 52177 - protein, 348 aa, Thermus caldophilus
MKGLILAAGRGTRLRPLTHTRPKPAIRVAGRPIIHYAVENLLEAGVREIGVVVSPETERDLKVALEGYPVRYVFQEEPQGLAHAVDVARGFLGESPFVLYLGDNLFQKGIRRFLEAFKPGVSAVIALVRVEDPRQFGVAVLEGNRVVRLLEKPKEPPSDLAVAGVYVFSPEVLEVVRGLKPSARGEYEITDAIQGLIDRGKTVVGVEVEGWWKDTGRHQDLLDANRLLLEELTPKVEGDVVESQLTGRVVVEKGAKVVRSTVIGPAHIGAGAVVEEAFVGPFTSVGPRARVARSEVEYSLLEEEAVVEEVRLRLQECILGVRAEVKSRDGLPRAHRLILGDLSQVELA

SEQ ID NO: 52178 - protein, 216 aa, Methanococcoides burtonii DSM 6242
MTVDENIKRIFNELGRTKLVCVTKTIDTERINESIRAGATIIGENRVQEFEDKCADILPCERHLIGNLQTNKVKKAVHLFDVIQSVDSLKLIQDIDKKAKAINKVQKVFLQVNIGNEPQKFGFGSDEIGQVITQIQSLKNVHVKGLMCIPPFVSPEQTRSYFKKMKALFDELKQVDQDNIDIQELSMGMSNDYRVAIEEGATMVRVGSAIFGNRKY

SEQ ID NO: 52179 - protein, 338 aa, Sclerotinia sclerotiorum
MAPTKVGINGFGRIGRIVFRNAIEHDDIDIVAVNDPFIETEYAAYMLKYDSTHGQFKGDIKVLSDGLEVNGKKVKFYTERDPANIPWAESEAYYVVESTGVFTTTEKAKAHLKGGAKKVVISAPSADAPMYVMGVNNETYNGEADVISNASCTTNCLAPLAKVINDEFTIIESLMTTIHSYTATQKTVDGPSAKDWRGGRTAAQNIIPSSTGAAKAVGKVIPELNGKLTGMSMRVPTATVSVVDLTVRIEKAASYDEIKEVIKKAANGPLKGILAYTEDDVVSTDMNGDNHSSIFDAKAGISLNKNFVKLVSWYDNEWGYSRRVLDLLHYISKVDNKQ

SEQ ID NO: 52180 - protein, 567 aa, Mesorhizobium loti MAFF303099
MSWRRWLPLQALSGWQFSDLNGDLIAGLTLAAIAIPEQMATARLGGFAPEIGFFAFVAGSVAFALFGANRHLSVGADSTITPLFAGSLALLATSGSPHYLALAAMLALLVGLIVTLSGIFRLGWIADLLSVPVTTGFLAGIAVHIIVSQMPGLLGLPAESGETLRRVGEIAGNLHLTNPWSLGLGLGVFAIVFCSERISARIPGALIGMVLATLAVVVFGLRDHGVEVLGALPNGLPGAYLPVASLGDVQALVPLALLIAIVVMVQTAATSRSFASQPDASPDVNRDFVGVGAGSILSSLFGAFAVNASPPRTAIVSQSGGRSQLSGLIAAAIVLALGAFGGALLANVPQAALAGVLMFVAQHILRWKVFAGVYRQAPVEFVLILVTTAAIVVLPIATGVAVGIGLSLLHGIWSATRTEPIELEQVPGTSVWWPPAKPSAGEQLPGVLVAAFQAPLSFVNADRFKRGVCDLVDARDETVKLVVLEASNIVEIDYTAAQALIDTITHCRKAGAIFAIARMESLRAQAALARFGIAEMVGTQHIFHSVDAAIKSLGPGKQQQQEQDGVP

SEQ ID NO: 52181 - protein, 412 aa, Burkholderia pseudomallei K96243
MKPIQKSNKLLNVCYDIRGPVLEHAKRLEDEGHRIIKLNIGNLAPFGFDAPDEIIQDMIRNLPASSGYSDSKGVFAARKAIMHYTQQKGVHGVGLDDIYIGNGASELIVMATQALLNDGDEVLLPAPDYPLWTAAVSLSGGTPVHYVCDESNRWMPDPDDIRRKITPNTKALVVINPNNPTGALYSDALLIELIAIAREHGLIIFADEVYDKIVYDGKSHTALASLAEDVITVTFNSLSKSYRSCGYRAGWMSVAGLTAENRRRAHDYLEGLGILSSMRLCANVPGQYAIQTALGGYQSINELIMPSGRLYKQRELAYDMLTSIPGVSCVKPEAALYMFPRLDPKLYPIENDQQFILELLLRERVLLVQGTGFNWPTPDHFRVVFLPNVDDLTDSIERIARFLDGYRKRNSV

SEQ ID NO: 52182 - protein, 173 aa, Methanococcoides burtonii DSM 6242
MILKFKNKEPSISETSFVADSADIIGDVKIGEGSSVWFNATIRGDKDEIIVGKKSSIQDNCVVHTDPPFKVTIGDNASIGHGAILHGCTIGNNVLVGMNSTILDGAEVGENSIIGANALVPSGKVIPPNSVVTGVPGKIRREATVEDIQMIAENAAEYVRLATEYKQHSAFHS

SEQ ID NO: 52183 - protein, 288 aa, Solanum demissum
MVGSVNIDQQGKGGYVSDEVLGTFLPIVVYWVYSGLYLMLGNMDNYRLHSKKDEDEKNLVSKKEVVKGVLLQQIVQAAVATVLFALGLLSLDSTNALLWFPFTLVTGDDGESGGDRHTSIFVLGRQLFIAMLMLDTWQYFMHRYMHQNKFLYKHIHAQHHRLIVPYAFGALYNHPLEGLILDTIGGALAFLVSGMSPRTSIFFFSFATIKTVDDHCGLWLPGNLFHIFFKNNSAYHDIHHQLYGTKYNYSQPFFVTWDMILGTYMPYELERRPEGGFEAKPVKDCKEH

SEQ ID NO: 52184 - protein, 434 aa, Colwellia psychrerythraea 34H
MKYYNLKENDEQVTFAQAVKQGLGKNQGLFFPTDMPKLDNIEELLALPLVERSVKILAPFVEGDLTKSELTDIVTDAFNFPALLQPISPDRAILELFHGPTLAFKDFGARFMAKCLQVFVAKDAKASGETKPLTILTATSGDTGAAVAHAFHGIDNIRVVIMYPKGKISLLQEKMFTTLGGNIETLAVDGDFDDCQTLVKQSFDDKELANTIGLNSANSINISRLLAQVCYYFEAVAQLSRAKSDLSSIVFSIPSGNFGNLTAGLFAKAMGLPIKRFIAATNANDTVPRYLETGEWTPNVTVATISNAMDVSNPNNWPRVEHMLKSGIVEQGCVSSVSIDEEQTQSTVIQLRKLGYISEPHAAVAYKALQYSAVEGEFGVFLGTAHPAKFKEVVESILGQPLGLPKELADCAGEPILSQDLAANFSDLRSYLLS

SEQ ID NO: 52185 - protein, 422 aa, Pseudomonas syringae pv. syringae B728a
MSDLKTAALEYHANPRPGKLSVELTKPTATARDLALAYSPGVAEPVREIARDPELAYKYTGKGNLVAVISDGTAILGLGDLGPLASKPVMEGKGVLFKRFAGIDVFDIEVDSESPQAFIDTVKRISITFGGINLEDIKAPECFEIEKALIEQCDIPVFHDDQHGTAIVTAAGMINALEIVGKTLESAKIVCLGAGAAAISCMKLLVSMGAKIENIFMVDRTGVIHSGRTDLNQYKAAFAHATEKRSLTDALDGADVFVGLSGPNLLSAENLKLMAKDPIVFACSNPDPEISPELAHATRSDVIMATGRSDYPNQVNNVLGFPFIFRGALDVRAKRINEEMKIAAANALRELAKLPVPQEVSDAYGGIKLEFGREYIIPKPMDTRLLGLIADAVAKAAIESGVATLPYPKHYPLTSVDDVFKG

SEQ ID NO: 52186 - protein, 256 aa, Bacillus cereus ATCC 14579
MYVKEKVVIITGGSSGMGKGMATRFAKEGARVVITGRTKEKLEETKLEIEQFPGQVLPVQMDVRNTDDIQKMIEQIDEKFGRIDVLINNAAGNFICPAEDLSVNGWNSVINIVLNGTFYCSHAVGKYWIEKGIKGNIINMVATYAWDAGPGVIHSAAAKAGVLAMTKTLAVEWGRKYGIRVNAIAPGPIERTGGADKLWISEEMAKRTIQSVPLGRLGTPEEIAGLAYYLCSDEAAYINGTCMTMDGGQHLHQYPF

SEQ ID NO: 52187 - protein, 439 aa, Schizosaccharomyces pombe 972h- [sequence omitted]

SEQ ID NO: 52188 - protein, 1065 aa, Arabidopsis thaliana
MESEGETAGKPMKNIVPQTCQICSDNVGKTVDGDRFVACDICSFPVCRPCYEYERKDGNQSCPQCKTRYKRLKGSPAIPGDKDEDGLADEGTVEFNYPQKEKISERMLGWHLTRGKGEEMGEPQYDKEVSHNHLPRLTSRQDTSGEFSAASPERLSVSSTIAGGKRLPYSSDVNQSPNRRIVDPVGLGNVAWKERVDGWKMKQEKNTGPVSTQAASERGGVDIDASTDILADEALLNDEARQPLSRKVSIPSSRINPYRMVIMLRLVILCLFLHYRITNPVPNAFALWLVSVICEIWFALSWILDQFPKWFPVNRETYLDRLALRYDREGEPSQLAAVDIFVSTVDPLKEPPLVTANTVLSILAVDYPVDKVSCYVFDDGAAMLSFESLAETSEFARKWVPFCKKYSIEPRAPEWYFAAKIDYLKDKVQTSFVKDRRAMKREYEEFKIRINALVSKALKCPEEGWVMQDGTPWPGNNTGDHPGMIQVFLGQNGGLDAEGNELPRLVYVSREKRPGFQHHKKAGAMNALVRVSAVLTNGPFILNLDCDHYINNSKALREAMCFLMDPNLGKQVCYVQFPQRFDGIDKNDRYANRNTVFFDINLRGLDGIQGPVYVGTGCVFNRTALYGYEPPIKVKHKKPSLLSKLCGGSRKKNSKAKKESDKKKSGRHTDSTVPVFNLDDIEEGVEGAGFDDEKALLMSQMSLEKRFGQSAVFVASTLMENGGVPPSATPENLLKEAIHVISCGYEDKSDWGMEIGWIYGSVTEDILTGFKMHARGWRSIYCMPKLPAFKGSAPINLSDRLNQVLRWALGSVEILFSRHCPIWYGYNGRLKFLERFAYVNTTIYPITSIPLLMYCTLLAVCLFTNQFIIPQISNIASIWFLSLFLSIFATGILEMRWSGVGIDEWWRNEQFWVIGGVSAHLFAVFQGILKVLAGIDTNFTVTSKASDEDGDFAELYLFKWTTLLIPPTTLLIVNLVGVVAGVSYAINSGYQSWGPLFGKLFFAFWVIVHLYPFLKGLMGRQNRTPTIVVVWSVLLASIFSLLWVRIDPFTSRVTGPDILECGINC

SEQ ID NO: 52189 - protein, 337 aa, Synechococcus sp. WH 5701
MNEQLNPEKILQTGLAFWASKTLLSAVEMGLFTELSSGPESLDKLSGRLGLHPRSARDFLDALVALGFLTRTGGEYSNTPETELFLDRNKPSYLGGILEMANHRLYPFWNNLTEALRTGQPQNEAKSGGPELFEILYADPARLKEFLAAMSGISHGANMKIAKTFPWKEYRTFVDVGTAQGDLAAQIILANPHLRGEGFDLPEVAPIFEEYIEGLGIKDRLTFVPGSFFTQDIPPADVILMGHILHDWDLPTKKMLIRKAFDAVPTGGALVVYEAIIDDDRSKNAFGLMMSLNMLIETPGGFDYTGADCVRWMLEAGFTSTWVEELVGPDSMVVGIK

SEQ ID NO: 52190 - protein, 144 aa, Pseudomonas aeruginosa PAO1
MKTVAQLLNAKQNQQVYTIGADEMVLDALRLMAEKNIGALLVVNHGEVVGVVSERDYARKMVLKGRSSIGTPISAIMSAPVVSVDSKQSVDTCMNLMTDRHLRHLPVVEDGQLLGLLSIGDLVKAAIAEQAELIQQLEQYIRGD

SEQ ID NO: 52191 - protein, 602 aa, Sulfitobacter sp. EE-36
MLAHHIVKYIGRTCTAIAIGGFVSGAAFAQQAADSVAPEGASQGSFTGMSPQITAAFEAKDAGKPVIAQNWMVAAANPHAVQAGADVLARGGTAADALVAVQAMLGLVEPQSSGLGGGAFLVWYDAASGWLTTLDGRETAPLAVTPQLFQDDEGVPLGFFDAVVGGRSVGTPGTPALMAAAHEKWGNQPWAELLAPSVALAEKGFAVSPRLAGLVADDAERLATSETTASYFMPNGTPVQAGDTLKNPDYARTVAAMAERGVEAFYTGDIARDIVGAVQGATNPGVLSEVDLSIYRVKERDALCAPYHGHEVCGMGPPSSGALAVGQILGLLENADLSAGPADADVLRLIGDASRLAFADRGRYVADTDYVPVPVTGMLDQSYLADRAKLLQGDDALPEVTAGAPAFDHALNFADDISIELPSTSHVSIVDSMGNVASMTTTIENGFGSRLMVRGFLLNNELTDFSFRSHTDGVPIANRVEPGKRPRSSMAPTIVMKDGAPVLAVGSPGGSRIIGYVAGAIIAHLDWGMDVQQAAALPHAINRFGPYDLEEGTDAAAMADALTGLGYEVNTRALTSGLHMISIGDDLRGGADPRREGIALGE

SEQ ID NO: 52192 - protein, 458 aa, Bacillus halodurans C-125
MTTLVREKQTYDVQYYVQHVYETVKRRNPNEHEFHQAVKEVFDSLLPVLVKHPQYVKQAILERIVEPERVISFRVPWVDDQGNVQVNRGFRVQFNSALGPYKGGLRFHPSVNASIIKFLGFEQIFKNALTGQPIGGGKGGSDFDPKGKSDGEIMRFSQSFMSELSNYIGPDIDVPAGDIGVGAKEIGYMFGQYKKMRGGFEAGVLTGKGIGYGGSLARKEATGYGTVYFVEEMIKDHGFSFAGSTVVVSGSGNVSIYAMEKAMQLGAKVVACSDSGGYVYDKNGIDLQTVKRLKEVERKRISEYVNEHPHAHYVQGCSGIWSVPCDIALPCATQNELDEAAATMLIANGVKAVGEGANMPSTLQAVHTFQEHGVLFAPAKAANAGGVSVSALEMAQNSTRLAWTFEEVDAKLYEIMKNIYRESIKAAELYEASGNLVVGANIAGFVKVADAMISHGVV

SEQ ID NO: 52193 - protein, 289 aa, Schizosaccharomyces pombe 972h-
MFARRCGRLANRFVRLKSTSATSPITYKALHANSPLPRCRIIEPPRATVPEAVSNIIMSTPFNRVQRPKRHVFNCLVQNEPGVLSRLSGILAARGFNIDSLVVCATEVENLSRMTIVLRGADEVVEQAKRQIEDIVSVWAVLDYTGTSMVERELLLAKVSLLGPDHFQEHFERSEKVAESTNAKAKSDGEGVMNANAALQLRASQLAAINQLTTLFHGRVADISTETIILELTATPDRVDNFLSLLRPYGVLEACRTGTSAMTRAPHSNEVTEEAEDDVEVEEVFLPPG

SEQ ID NO: 52194 - protein, 325 aa, Kineococcus radiotolerans SRS30216
MTGITTTGEKRMVLISGRAHPELAEEVSAALGAELVPTSAYDFANSEIYVRFEESVRGSDAFVIQSHTSNVNQWIMEHLIMVDALKRASAKRITVVAPFYGYARQDKKGRGREPISARLIADMFKTAGADRLMSVDLHTAQIQGFFDGPVDHLWALPLLADHVGKRVDRSNITIVSPDAGRVRVADLWSDRLGAPLAIIHKRRDPNVPNQVKVHEVVGDVEGRTCVLVDDLIDTAGTIVQAAEALKANGAADVIATATHAVLSGPAVDRLKNSPISELVVTNTLPISESQQFPQLKVLSIAPLLARAIREVFDDGSVTSLFDGHS

SEQ ID NO: 52195 - protein, 587 aa, Pediococcus pentosaceus ATCC 25745
MKKTKIVSTLGPASTSVDTIVKLIEAGANVFRFNFSHGDHEEHLGRYNMVKEAEKITGKSVGILLDTKGAEIRTTPQKDGNQEYHTNDKVRISMDDTLETTKEKIAVTYDGLFDDVHVGGHVLFDDGLLDFKIDEKDEENRELVAHATNNGVLGSRKGTNAPGVSINLPGITEKDADDIRFGLESMNINFIAASFVRKPQDVLEIRELLEEKNMEDVQIFPKIESQEGIDNTDEILKVSDGIMIARGDMGVEIPAENVPLVQKTLIKKCNAVGLPVITATQMLDSMIENPRPTRAEASDVANAVWDGTDATMLSGESANGDYPVEAVATMAKIDEKAENAMAEDGNLQINTFDQSDVTETISAAVARAAKNLGVKTIVAATQSGYTARMISKYRPDADILAITFDERVRRGLMVNWGVHPIIADRPSTTDEMFELAANKAVDLGLAKEGDLILVVAGVPVGESGTTNIMKLQLIGSKLASGQGVGDETVIGKAVVATSADEANKKAVEGGVLVTKTTDKDYLPAIEKSSALVVENGGLTSHAAVVGISMGIPVIVGVQNATSILSDDELITVDSRRGIIYHGASNSL

SEQ ID NO: 52196 - protein, 449 aa, Thermoplasma acidophilum DSM 1728
MMQEELNGIKIKVTPPGPEAKKIIDMNDRYLARSTQSLPVVGKIGRGVYVEDVDGNVYLDFSSGISVTNLGHVDPYVTAKVEDQLHKMWHFPGTDFYTEMQVLAAKSLIEVTPGKFEKRVFFTNSGTESVEAAIKVAKSYTGRGMFIGFIGAFHGRTQGSLSFTASKPIHHRGFFPSMPGVEHVPYPNPYRNPFGIDGYENPDELVNRVIDYIETYLLKTYVPPEDVAGILAEPVQGEGGYIVPPMNFFRELRKLADSYNIPLMMDEVQSGFGRTGKFFASEHFGVEPDVITLAKAIASGIPMGAVVMRKEMNFKESGLHSNTFGGNLIASAACVATIEEMKKLNVVENSAKQGAYLRKRLEELQSKYDAIGDVRGLGLMQAIDFVKDRRTKEPNSKLRNAVIDNAFRLGLILLSTGSSAIRIIPPLIITQDQIDEGIEVLDKAIKQSL

SEQ ID NO: 52197 - protein, 468 aa, Oryza sativa Japonica Group
MASCKKVCVIGAGVSGLAAARELRREGLDVTVLEQRGGVGGQWLYDTATDAGDPLGVAGVHSSMYASLRLITPREVMGFSDFPFRPGKDGDSGAGEVDARRFPGHAEFLRYIRELCDVFGLMDAVRLNTAVTRVAMAPPRRDGSLRWAVRSKHHGEAETEEVFDAVVVASGHFCQPRLPTIDGMDRWRRRQLHSHSYRVPDAFHGEVVVIVGCGISSKDIGLELRRVAKEVHLSAKSPEEAMTPAMSKILARYDNLHLHPQIEHLREDGTVVFVDGTCVVADAVVYCTGNTYSYPFLDTDGKVTVDDNRVGPLFDHVFPPALAPSLSFVGIPAMVVVPLFNEVQARWVAQVLSGRRALPSPEEMARAAEEYNRGREAAGVAKRRTHDILDLEYCDDYGERNCGFPRLEAWKKELMWSSYLTMCDNLETFRDDYHDSDLVADGLRLHGWISPATTLTQQGDDDKRPHLL

SEQ ID NO: 52198 - protein, 468 aa, Vitis vinifera
MKRLPAPAHAYPTRQKDHQVTIIPSLSIQNPNIESKKWREIKRSYRGHLGNEEKNYFLSFFPLSVKTLVFPSSSGKTKTKGGAEKSKRRRTVAGKTTSLHRFRRFELDSGVYQIMEERTWLKVVVILCLFAVSNGRELKLKHKDHSLAHYNHTLATILVEYASAVYMSDLTELFTWTCSRCDDMTEGFEIIELVVDIQHCLQAFVGVAQDLNAVIIAFRGTQEHSIQNWVEDLYWKQLDLNYPGMPDAMVHHGFYYAYHNTTIRPGVLNAVKRAREIYGNVPIMVTGHSMGGAMASFCGLDLIVNHEAENVQVMTFGQPRIGNAVFVSYYSELVPNTIRVTNEHDIVPHLPPYYSYFPQKTYHHFPREVWLYNIGLGSLVYTVEKECDGSGEDPTCSRSVAGNSIADHLEYYGVILHSESWNSCRIVMDPLVNEYIATDADGNFRLSKDPAVSVIKMNTRSGNGGNSV

SEQ ID NO: 52199 - protein, 133 aa, Zea mays
MAAASGRAPSACALLLLFLLLVVGAAAAAVIVVDASRGEQEQEQDWDWEQLSAASPSPWSPAPAPAPSPVSFIDCGSACGARCALSSRWNLCRRACGSCCARCNCVPPGTAGNHDVCPCYAAITTRGGRPKCP

SEQ ID NO: 52200 - protein, 659 aa, Schizosaccharomyces pombe 972h-
MEYYTSKEVAEWLKSIGLEKYIEQFSQNNIEGRHLNHLTLPLLKDLGIENTAKGKQFLKQRDYLREFPRPCILRFIACNGQTRAVQSRGDYQKTLAIALKKFSLEDASKFIVCVSQSSRIKLITEEEFKQICFNSSSPERDRLIIVPKEKPCPSFEDLRRSWEIELAQPAALSSQSSLSPKLSSVLPTSTQKRSVRSNNAKPFESYQRPPSELINSRISDFFPDHQPKLLEKTISNSLRRNLSIRTSQGHNLGNFGQEILPRSSRRARPSELVCPLSSLRISVAEDVNRLPRIDRGFDPPLTVSSTQRISRPPSLQKSITMVGVEPLYQSNGNEKSSKYNVFSESAHGNHQVLSFSPGSSPSFIEQPSPISPTSTTSEDTNTLEEDTDDQSIKWIRGALIGSGSFGQVYLGMNASSGELMAVKQVILDSVSESKDRHAKLLDALAGEIALLQELSHEHIVQYLGSNLNSDHLNIFLEYVPGGSVAGLLTMYGSFEETLVKNFIKQTLKGLEYLHSRGIVHRDIKGANILVDNKGKIKISDFGISKKLELNSTSTKTGGARPSFQGSSFWMAPEVVKQTMHTEKTDIWSLGCLVIEMLTSKHPYPNCDQMQAIFRIGENILPEFPSNISSSAIDFLEKTFAIDCNLRPTASELLSHPFVS

SEQ ID NO: 52201 - protein, 453 aa, Prochlorococcus marinus subsp. marinus str. CCMP1375
MNYSFDLIVLGAGSGGLAAAKRAASYGARVAIVEGDRVGGTCVIRGCVPKKLLVYGSQYGEYLKNAPSFGVKLTASKIEPSILLKNVRNEVDRLNKLHIDLLEKSNVVLIKGWGSIAGPNSVVVKSKDVQDQAIELFAEKILIAVGGRPSFPEIPGASLGWTSDDVFLQEGFPDKVVVVGAGFIACEFACILNGLGVKVKQLVRGRNLLKNFDNEVAFNLQQSMESSGIEFQFASEVNSIEGEIGDLNLVVNHDSNIKSGAVIFATGRKPFIEGLNLEKVDIRTSNNRINVDNKNSTNISNIFAIGDVTDKVNLTPVAIEEGRVFADNNYSDKNRYVNYEFIPKAVFSQPELAYVGKTEEESKRIYGESNIKIYRANFKPMSKMLVKSKEKCFLKLIIEKNSNKVVGCHMLGEHASEIIQMAAISMNMGATKLDFDQTMALHPTISEEFVTMK

SEQ ID NO: 52202 - protein, 104 aa, Triticum aestivum
  misc_feature (81)..(81): Xaa can be any naturally occurring amino acid
MGPTVVAWGATSVDPFQGLKSTEGLHVRRRYNGARLGSVRNGGRVRCMQVWPIEGMKKFETLFYLPPFSTGALLKQVDYLXIRSKWGPCLEVSKGGFIFREHNA

SEQ ID NO: 52203 - protein, 173 aa, Oryza sativa Indica Group
VRLFVDISVPRNVSACVSEVGHARVYNVDDLKEVVEANKEDRLRKAMEAQTIITQELKRFEAWRDSLETVPTIKKLRSYADRIRASELEKCLQKIGEDALTKKMRRSIEELSTGIVNKLLHGPLQHLRCDGSDSRTLDETLENMHALNRMFSLDTEKAIIEQKIKAKVEKSQN

SEQ ID NO: 52204 - protein, 289 aa, Physcomitrella patens subsp. patens
MVSAKENAPDSVLRDGASRFNVLITGSTKGVGLALAEEFLRNGDNVVVCSRSQERVQSVVQELRSQFGEQRVWGKECDVRDAKSIEALADYVKSNLGHIDCWINNAGTNAYKYNSLVDSDDADIMEIVETNTLGVMLCCRQAIKMMRDQRRGGHIFNMDGAGADGNPTPRFAAYGATKRSLAQFTKSLQAELKQANIQNVVVHNISPGMVTTDLLMSGSDTRQAKFFINVLAETPDTVAKYLVPRVRKIVEENKNSSTYPRFLTGFKAYTQILARLLFKARKDRYVSED

SEQ ID NO: 52205 - protein, 337 aa, Methanococcoides burtonii DSM 6242
MSKTAAVIEGDGVGPELVDAMVKVAEAVGTNVEFVKCEAGVQWWEKNGGATLIPDETWALLDEADACFKGPTTTPGGAGSPRSVAVSIRQKYNLYANVRPIKTFPNTNNPLGDVDFVCVREGTEGMYIGEEVKLTDDVYIAIRKITRPACKNIATYSFEEAKKRGYDTVVPIHKSNILKMTCGTFLEEVEKVAEGYPGIDVWEYHVDNIAQQLIKNPQLFNNKILLSTNLFMDVISEECSALIGSIGLIYSANIGDNFAMFEPAHGSAPKYAGLDKVNPVATILAGAWMLDYLGESDKFAQIFKATEDVISEGKHLTYDLGGKASLSEMTDAIISKL

SEQ ID NO: 52206 - protein, 201 aa, Mesorhizobium loti MAFF303099
MSGLASLVPMVIEQSSRGERAFDIFSRLLRERIIFINGEINDDVSALVCAQLLSLESDNPDKEISLYINSPGGVVTSGFAIYDTMQYVSCPVSTVCMGFAASMGSFLLMAGTPGRRIALPNATILLHQPLGGFQGQASDIQRHAERIGKTKQRMAELYAQHCGRSYEEVERTLDRDHFMTAREAQTWGIVDHVFDTRKKAA

SEQ ID NO: 52207 - protein, 255 aa, Salmonella enterica subsp. enterica serovar Typhi str. CT18
MRHPLVMGNWKLNGSRHMVNELVANLRKELTGVAGCDVAIAPPEMYIDLAKRAAAGSHIMLGAQNVDLNLSGAFTGETSAEMLKDIGAQYIIIGHSERRTYHKESDELIAKKFAVLKEQGLTPVLCIGETEAENEAGKTEEVCARQIDTVLKTQGAAAFEGAVIAYEPVWAIGTGKSATPAQAQAVHKFIRDHIAKADAKIAEQVIIQYGGSVNASNAAELFAQPDIDGALVGGASLKADAFAVIVKAAEAAKQA

SEQ ID NO: 52208 - protein, 254 aa, Salmonella enterica subsp. enterica serovar Typhi str. CT18
MNSQFAGLTREACVALLASYPLSVGILAGQWIALHRYLQQLEALNQPLLHLDLMDGQFCPQFTVGPWAVGQLPQTFIKDVHLMVADQWAAAQACVKAGAHCITLQAEGDIHLHHTLSWLGQQTVPVIDGEMPVIRGISLCPATPLDVIIPILSDVEVIQLLAVNPGYGSKMRSSDLYERVAQLLCLLGDKREGKIIVIDGSLTQDQLPSLIAQGIDRVVSGSALFRDDRLVENTRSWRAMFKVAGDTTFLPSTA

SEQ ID NO: 52209 - protein, 546 aa, Synechococcus sp. WH 7805
MNKRRHALIHGFSWTHWRGDLSGGLTAAVVALPLALAFGNAALGPGGAIYGLYGAIVTGFLAALFGGTPAQVSGPTGPMSVTVAGVVGSLATVGVSRELNGGELLPLVMAAVVIGGLIQILLGVLRLGRYITLVPYSVVSGFMSGIGMIILCLQIGPLLGINSRGGAIQSLQMVVADFRPEPSALLVSAATLLVVFGTPRLISKVVPSPLLALVVITPLSLWLFPDQLTRIGSIPEGGLTFMIPNWRDHLPVLMRAGVVLAVLGAIDSLLTSLVADNISYTRHRSDRELVGQGIANSVAGLLSGLPGAGATMRTVINIKSGGRTPLSGMTHSVVLLLLLLGAGPLAEGIPTALLAAILIKVGFDIIDWGFLRRAHRLSFKTALVMWGVLLMTVFWDLIGAVLVGMFVANLLTIESLTDHQLGTMNVDAAPLDEEEQTLLERCGDQLMLFRMQGPLSFGAAKGISERMMLVRQYTILLLDITDVPHLGVTASLAIERMVQEAAQHDRQVLVAGAAGKVKRRLEMFGIPSLVDTRLAALREADQRLNS

SEQ ID NO: 52210 - protein, 165 aa, Colwellia psychrerythraea 34H
MRRILAILMENEPGSLSRIVGLFSQRAFNIESLTVAPTDDNSLSRMTIATKGDDKVLEQIVKQVNKLIDVIKITDITDRKHIERELLLVKVAAMNDKSRTEVTRITDIFRGNIIDIGKQVYTVQLTGDAEKLNAFINALQNETEIIESARSGCVGMARGDQALRI

SEQ ID NO: 52211 - protein, 472 aa, Pseudomonas syringae pv. syringae B728a
MAERLSNDFQFIDVGRKDPKKKLLRQRKKEFVEIYEPFKPQQSADQAHRCLGCGNPYCEWKCPVHNFIPNWLKLVAEGNILAAAELSHQTNTLPEVCGRVCPQDRLCEGACTLNDGFGAVTIGSVEKYITDTAFAMGWRPDMSKVVPTGKRVAIIGAGPAGLGCADVLVRGGVTPVVFDKNPEIGGLLTFGIPEFKLEKSVLSHRREVFTGMGIEFRLNTEVGKDVTIDQLLAEYDAVFMGMGTYTYMKGGFPGEDLPGVHDALDFLIANVNRNLGFEKAPEDFVDMKGKRVVVLGGGDTAMDCNRTSIRQGAKSVTCAYRRDEENMPGSRKEVKNAKEEGVKFLYNRQPIAIIGEGKVEGVKVVETRLGEPDARGRRSPEPIPGSEEIIPAEAVVIAFGFRPSPAPWFEQFTISTDSQGRVVAPEQAQYKHQTSNPKIFAGGDMVRGSDLVVTAIFEGRNAAEGILDYLGV

SEQ ID NO: 52212 - protein, 72 aa, Triticum aestivum
MAATIQSVKARQIFDSRGNPTDEGDVCCSDGTFARAAVPSGASSGVYEALELRDRGSGYLGKGVSKAGDNVN

SEQ ID NO: 52213 - protein, 532 aa, Streptomyces avermitilis MA-4680
MISASGIELRAGARILIESATFRIAKGDRIGLVGRNGAGKTTLTKVLAGEGVPAGGNVTRSGEVGYLPQDPRTGDLDVLARDRILSARGLDTLIRKMRENEQRIANGSGATREKALRQYERQETEFLTKGGYSAEAEAATIAAALNLPDRVLGQPLHTLSGGQRRRVELARILFSDADTLLLDEPTNHLDADSIVWLRDYLKTYRGGFIVISHDVDLVETVVNKVFYLDANRSQIDVYNMGWKLYQQQREADEKRRKRERQNAEKKAAALHSQADKMRAKATKTVAAQNMARRADKLLAGLEAVRQQDKVAKLRFPEPSPCGKTPLTAEGLSKSYGSLEIFTDVDLAIDKGSRVVILGLNGAGKTTLLRLLGGVETPDTGEVVEGHGLKLGYYAQEHETLDPERTVLENMRSAAPDLDLVEVRKTLGSFLFSGDDVDKPAGVLSGGEKTRLALATLVVSSANVLLLDEPTNNLDPASREEILGALRTYKGAVVLVTHDEGAVEALQPERIILLPDGVEDLWGADYADLVALA

SEQ ID NO: 52214 - protein, 169 aa, Geobacillus stearothermophilus
MITMTVNNRPGVLNRITGLFTKRHYNIESITVGHTEIDGVSRMTFVVNVDDERTAEQIIKLLNKQIDVLKVNDITDQAIVARELALVKVSAAPAIRQEIYTLIEPFRASIVDVSKDSLVIQFTGEPEKVEALIELLRPYGIKKVARTGTTAFTRGAQKAAANQKTAFII

SEQ ID NO: 52215 - protein, 516 aa, Kluyveromyces lactis NRRL Y-1140
MPPKRRHHGAGRVQNKRGKVDTVKEEIKPKDEPVETEIDGGSAVDEDVTDDLEHKTSKEDQKEDQKEEDGPIDAQNGTSETKVAGESVKTVEDKIESVTTNEEVVESPVNDYNASSTTTKAEEKQLEEEANEKTDTSPIVENEVVDEEAGTTKFDFDGQEYSYKDRPSVIEEKEGKIEFRVVNNDNSKENMMVLTGLKNIFQKQLPKMPKEYIARLVYDRSHLSMAVVRKPLTVVGGITYRPFDKREFAEIVFCAISSTEQVRGYGAHLMNHLKDYVRATSPIKYFLTYADNYAIGYFKKQGFTKEITLDKNVWMGYIKDYEGGTLMQCSMLPRIRYLDAAKILLLQEAAIRRKIRSISQSHIVRPGLKQFLDLDNIKPIDPMTIPGLKEAGWTPEMDELAQRPKRGPHYAAMQNLLTELQNHAAAWPFLQPVNKEEVPDYYEFIKEPMDLSSMEMKLNGNRYEKMENFIYDARLIFNNCRAYNGENTSYFKYANRLEKFFNSKVKEIPEYSHLVD

SEQ ID NO: 52216 - protein, 148 aa, Vitis vinifera
MVTSVQTKLIAVAGVPVLVSNKAKFQNSPAFIYFVAALSVVGLYSIITTLASFIFISKPSCSTKTILHLAIWDVLMLGLAASATGTAGGVAYVGLKGNSHVGWNKVCNTYDKFCRHVGGSIAVALFASILLVLLVWLSLFTLYSRIRK

SEQ ID NO: 52217 - protein, 338 aa, Aspergillus oryzae
MATPKVGINGFGRIGRIVFRNAIASGDVDVVAVNDPFIETHYAAYMLKYDSTHGRFQGTIETYDEGLIVNGKKIRFFAERDPAAIPWGSAGAAYIVESTGVFTTTEKASAHLKGGAKKVIISAPSADAPMFVMGVNNKEYKTDINVLSNASCTTNCLAPLAKVINDNFGLVEGLMTTVHSYTATQKTVDAPSAKDWRGGRTAAQNIIPSSTGAAKAVGKVIPSLNGKLTGMSMRVPTANVSVVDLTCRTEKAVTYEDIKKTIKAASEEGELKGILGYTEDDIVSTDLIGDAHSSIFDAKAGIALNEHFIKLVSWYDNEWGYSRRVVDLIAYISKVDGQ

SEQ ID NO: 52218 - protein, 316 aa, Salmonella typhimurium LT2
MSMNKAVSSEQKPLDVICLGRVAVDLYGQQIGSRLEDMTTFAKYLGGSSGNVAYGTAIQGLRSAMLARVGDEHMGRFVREELNRVGVDTQCLLSDRDRLTALVILGIKDQDTFPLIFYRDNCADMALTPEDIREDYIASSRALAVTGTHLSHPNTRAAVLKALEYAQKHGLRRALDIDYRPVLWGLTSLGDGETRFIASSQVTEQLQQVLRHFDLIVGTEEEFHIAGGSTDTLTALRRVRQLTQAVLVCKRGALGCSVFEGNIADDWSQVKIHSGVRVDVLNVLGAGDAFMSGLLRGYLNDESWEQACRYATPAAR

SEQ ID NO: 52219 - protein, 409 aa, Rhodobacter sphaeroides 2.4.1
MRDAQRPDLSTTFTVLLAGGRGSRLHELTSRECKPALPFAGPRRIVDFTLANAARSGLTRMIVATQYRPETLAHHLESRWASRFAGGSLRLREGTAVTGSPQGYGGTAAAVAANLAELQSEGVRELVVLAADHVYEMDYADMVAAHRASGASATVAVDTVPTDRASEFGVVRTSEGGRIESFLEKPAVVPADPAIPGRAQVSMGIYVFDLDWLASVLRIIPGATQDFGHDILPLAVALGEAHAYRVPGDNFYWRDVGTLDAYRLAQLEFQTGEAPCALPPRIAASEHEMKAATGELIQFAFRMQTGGIALHSPRLGGDLPGRWTMLDESVLLPGARVAPGVRLTRTIVAPGTSVPAGLVIGEDPDEDARWFRRTEEGTVLVTTPMLARRAADRGRLVAPFADSRMGRSA

SEQ ID NO: 52220 - protein, 337 aa, Phaeosphaeria nodorum
MVVKVGINGFGRIGRIVFRNAIEHNDVEIVAVNDPFIEPHYAAYMLKYDSQHGQFKGDIKVEGNDLTINGKTIRFYTEKDPANIPWSETGAYYVVESTGVFTTTDKAKAHLKGGAKKVVISAPSADAPMFVMGVNNETYTKDIEVLSNASCTTNCLAPLAKVIHDKFTIIEGLMTTVHSYTATQKVVDGPSAKDWRGGRTAAQNIIPSSTGAAKAVGKVIPDLNGKLTGMSMRVPTSNVSVVDLTVRLEKGATYDEIKEAVKAAADGPLNGILGYTEDEIVSTDLNGDTRSSIFDAKAGISLNKNFVKLVSWYDNEWGYSRRVLDLLVYIAKVDGNA

SEQ ID NO: 52221 - protein, 334 aa, Pichia ciferrii
MAITVGINGFGRIGRLVLRIALSRKDIQIVAINDPFIAPEYASYMFKYDSTHGRYSGEVSHEGENIVIDGKKIRVYQERDPVNIPWGKDGVDYVIDSTGVFKELDSAQKHIDAGAKKVVITAPSSTAPMFVVGVNEDKYTPDLNIISNASCTTNCLAPLAKIINNKFGIEEGLMTTVHSITATQKTVDGPSHKDWRSGPTASGNIIPSSTGAAKAVGKVIPELAGKLTGMSLRVPTVDVSVVDLTVKLLKDATYDEIKAAVKEAAEGPLKGVVGYTEDQVVSSDFLTDNRSSIFDAEAGIWLSPRFVKLIAWYDNEYGYSTRVVDLLEYVASKN

SEQ ID NO: 52222 - protein, 335 aa, Lentinus sajor-caju
MVNVGINGFGRIGRIVFRNALEVGGVDVVAINDPFIDLDYMVYMFKYDSVHGRFKGSIEAKDGKLIVEGKPIHIFAEKDPANIPWGSVGADYVVESTGVFTTIDKASAHLKGGEKVVISAPSADAPMFVCGVNLETYDPKYKVISNASSTTNCLTPLAKVIHDKFGIVEGLISTIHATTATQKTVDGPSHKDWRGGRSVNNNIIPSSTGAANWVGKVIPSLNGKLTGLSFRVPTLDVSVVDLVVRLEKPADYKEIVAAIKEASETTHKGILGFTSDSVVSTDFVGSTDSSIFDSTAGIQLNPNFVKLIAWYDNEYGYSRRVVDLLKYVAEKDGAQ

SEQ ID NO: 52223 - protein, 337 aa, Cryptococcus curvatus
MATKVGINGFGRIGRIVLRNALEHGDIDVVAINDPFIDLDYMVYMFKYDSTHGRFKGKVETKDGKLVIEGKPISVFGERDPAAIPWGKAGADYVVESTGVFTTIEKASLHLKGGAKKVIISAPSADAPMFVCGVNLEAYKPEYEVISNASCTTNCLAPLAKVIHDNFGIVEGLMTTVHATTATQKTVDGPSHKDWRGGRGAAANIIPSSTGAAKAVGKVIPSLNGKLTGMSFRIPTSDVSVVDLVVRLEKGASYDQIKEVIKKASEGELKGILGYTEDEVVSTDFLGSTESSVFDAKAGIPLNDKFVKLISWYDNEYGYSRRVCDLIAYVAKKDKSA

SEQ ID NO: 52224 - protein, 467 aa, Xanthomonas campestris pv. campestris
MSDVLPIILSGGSGTRLWPLSRETYPKQFLPLVGEHSMLQATWLRSAPVAAHAPIVVANEEHRFMAAEQLQQLGVKPSAILLEPKGRNTAPAIAVAALEATRNGGDPLLLVLPSDHVIRDEAAFQAAVTVAAAAAEQGKLVTFGIKPTAPETGYGYIKAGAGTGATAVERFVEKPDLATAQGYLASGEYYWNSGMFLFRASRYLEELRKFQPAIADACQKAWEGGKRDADFTRLDKDAFASSPSDSIDYAVMEKTADAVVVPLDAGWNDVGSWSSLLDVSEQDGQGNAHHGDVIQLDCKNTYAYGSRLIAMVGLENVVVVETDDAVLVGHRDRIQEVKEVVSQIKSAGRSEATWHRKVYRPWGAYDSIDMGQRFQVKRITVKPGATLSLQMHHHRAEHWIVVSGTAEVTRGDEVLLLTENQSTYIPLGVTHRLKNPGKLPLELIEVQSGSYLGEDDIVRFEDTYGRT

SEQ ID NO: 52225 - protein, 504 aa, Mycobacterium austroafricanum
MTRTLSADADTRTATPPLMYVNGEWLPARSGATFPTIEPSTGRPITEIPRGDSSDVDAAVKAAADVAVEWQFTDAITRAALLRRLAELVAENAEELARIESLDSGHYLAKARELVTAIPLWLEYWAGAADKVGGRTIAVPGNKLSFTLLEPLGVTAHIIPWNYPLLILARSIAPALALGNTCVVKPAEDTSLSALKFAELVHAAGFPAGVFNVVTGYGSEAGAALAAHPEVRGITFTGSTETGREIARLGGQHIAQVNLELGGKSPLVVFPDAPLEDAVEVAVQGFCSRAGQVCVAGSRLFLHEDIADRFLEMLVSRLETVTVGDPFDGATQMGPLASKKHYDRVREYIEVGKQEATLLYGGGRPTDTPDDGFFVEPTVFVDVATDARIAREEIFGPVTAVMRWSSVDDLIATINDSEFGLFAVLWCRDITSALDTAKRLQVGSVMINDWFGELPMTPHGGHKQSGTGREEGLEAVHGYTQVKHIGINLEPSPAKSADWAGAPL

SEQ ID NO: 52226 - protein, 175 aa, Physcomitrella patens subsp. patens
MAFGMGRTLPALVLLINFFLHLISACLAGWALNRNLGATIGIEFFAGNVVTPTFLPLALIASMVGLASVFAGVNHLRVFRSDSLSSAASTSLIAWFLSLLAMGVACKEIHTGGSNRQKRLKTLEAFTIILAFFEVLYLLLLQAGFFRTSDDGYDQSRAANAKTGITYGTPAAAAV

SEQ ID NO: 52227 - protein, 451 aa, Magnetospirillum magnetotacticum MS-1
MPDYDYDLITLGAGSGGVRACRMAAAAGRKVAVVESSRVGGTCVMRGCVPKKLLVYGARFAEDLADSLGFGWSLEGADFDWARLVAAKNVELQRLEGVYMRLLKEPGVTVVEGKGHLLDAHTVQVGLQVLSAETILVATGGRPSLPDVPGIEHAVTSDQALDLMQLPERVVIVGGGYIAVEFAGIFNALGVGVTLVLRGDTLLRGFDADIRATLAEEMGKKGVELRTTTQVRAIERRGHGYCVLLSDGDSLEADLVMYATGRVPNTEGLGLEKAGVVLNSKGAVMVDALSRTSVRNIWAVGDVTDRVNLTPVAINEAMAFVRTAFLGQSTAMDYDNIPSAVFSLPPVGTVGLTEAEASKRYGAIDVYLSRFKLMRNILAGREERTMMKLVVDRASDRVLGVHMVGSDAPEIVQGFAVALKCGATKAQFDATVGIHPTAAEELVTMRDKRAD

SEQ ID NO: 52228 - protein, 242 aa, Haemophilus influenzae
  misc_feature (1)..(1): Xaa can be any naturally occurring amino acid
  misc_feature (22)..(22): Xaa can be any naturally occurring amino acid
  misc_feature (54)..(54): Xaa can be any naturally occurring amino acid
  misc_feature (151)..(151): Xaa can be any naturally occurring amino acid
  misc_feature (197)..(197): Xaa can be any naturally occurring amino acid
XTLDVWQHIRQEAKELAENEPXLASFFHSTILKHQNLGGALSYLLANKLANPIXPAISLREIIEEAYQSNPSIIDCAACDIQAVRHRDPAVELWSTPLLYLKGFHAIQSYRITHYLWNQNRKSLALYLQNQISVAFDVDIHPAAKIGHGIXFDHATGIVVGETSVIENDVSILQGVTLGGTGKESGDRHPKVREGVXIGAGAKILGNIEVGKYAKIGANSVVLNPVPEYATAAGVPARIVSQ

SEQ ID NO: 52229 - protein, 186 aa, Frankia sp. CcI3
MTGGPRWDEPVVDAAPISRQAPASSLVNTVILPRVGVGVDVHPFAAGRPCWVACLEWPGETGLAGHSDGDVAAHAACDALLTASCLGDLGRVFGTDRPEYAGASGAVLLAETARLLGAAGWAIGNVSVQVIGNRPRMAGRREDAQKAMSVALGASVSLSATTTDGLGLTGRGEGLAAIATALVIRA

SEQ ID NO: 52230 - protein, 501 aa, Rhodococcus sp. RHA1
MQQDSIAKPKLTEIVALNTLNADKLSSLDSQTRELVERRQRVMGPAYRLSYEEPFQPIRAQGTKIIDVYGHEYLDAYNNVASVGHNHPHVVDAVCRQLRLMNTNTRYLQRDIVDYAENLVSTHDSALDNVMFTCTGSEANDLAVRIARTVTGGTGVIVSEYAYHGCTRDVASWSPSSGKGTVLGSDVRLVPPPDTFRADRAEAETKFLSSLQAQIDDLNRRGVQLAAFVVDSMFSSDGIHPDPGVLKAAIELVHRAGGLLISDEVQSGFGRTGEAMWGYQRSNIVADLVTMGKPMGNGMPIGGVVAKSALLEKFSRETAYFNTFGGENAPVAAAQAVLEVIRDENLIANAQDKGGQLVAGIREILTRNNFAADVRGAGLYIGVEFVSDFDTAIPDTETTLAFVNGLRQHRVLTSTAGTYGNVIKVRPPLVLSQSDTDRLLTEFDNVARELRQSARPTPETTTDSPSDQDPSGVGLGDGAVREELRRLIVEELRGLIGQNHG

SEQ ID NO: 52231 - protein, 825 aa, Burkholderia pseudomallei K96243
MTYQVLARKWRPKDFASLVGQEHVVRALTHALDGGRLHHAYLFTGTRGVGKTTLSRIFAKALNCETGVTSQPCGVCRACREIDEGRFVDYVEMDAASNRGVDEMAALLERAVYAPVDARFKVYMIDEVHMLTNHAFNAMLKTLEEPPPHVKFILATTDPQKIPVTVLSRCLQFNLKQMPAGHIVSHLERILGEERIAFEPQALRLLARAAQGSMRDALSLTDQAIAYSANEVTETAVSGMLGTLDQTYMVRLLDALAAADGPQILAVADEMALRSLSFSAALQDLASLLHRIAWAQFAPASVLDEWPEAADLRRFAELLSPEQVQLYYQIATVGRGELGLAPDEYAGFTMTLLRMLAFEPATTGGGAPAGGVPARVAGAAPKSGARAAAAVGASAVPAVTGATGATGAALAPKAAAARAATRAEAPPAAPARPATAERGDDASDGDAPVPAKANARASADSRCDERDAQPPADSGSASGASSSAPPDTAFESAPRAAAPSAATPAAVPDARAPAAASAEDAVEAAAPAAPESRPPTPAAGAPVSRATGAAAALDVLRNAGMRVSSGRGAGAARPAAGPAASPTKPAPRVQVSVPTPRARAATGDAPPNGAARAEARAESRGAPPPWEDIPPDDYVPLSMDDGFIPPDDGFVPVFDGGPDDVRVAPKPAPAPPVDTRPLPEPIPLDAIGYDGEWPTLAASLPLKGVAYQLAFNSELTAADGGTLKLAVPVPQYADAAQVAKLKAALADALGKPVDVAVEVGPARRTAAALAAAERAKRQREAEQEMSADPFVQQLLREFGASIVEGSIRPVGAEAGAADGASPTLH

SEQ ID NO: 52232 - protein, 696 aa, Bordetella pertussis Tohama I
MTYLVLARKWRPRSFDTLIGQDHVVRALTHALDTQRLHHAWLFTGTRGVGKTTLSRILAKSLNCENGITSKPCGQCRACTEIDAGRFVDYLELDAASNRGVEEMTQLLEQAVYAPGAGRFKVYMIDEVHMLTGHAFNAMLKTLEEPPPHVKFILATTDPQKIPVTVLSRCLQFNLKQMPPDAIVGHLQAVLGEEQIGFEVPALRLIGQAAGGSMRDALSLTDQAIAYSAGNLSEEAVRGMLGTIDQRHLVRLLDALASGDAAGVLAVADELAVRGLSYAGALADLAVLLSRVAIEQRVRGALPQDDPLTEDITRLAAALHPDAVQLFYSVAVHSRGELTLSPDEYAGFVMACLRMLALNGEAGPATAVQAPRADTTPRAAAPAAAAPAETRPEPTPAPALAPQAAAAPRAVARSESKPQPAPEPEPEPEPAPRPAATPVAATPPAVAEPEPVAAPAAQARAAEPAPAPVPPWEDLPEAVAAPAPAQPAAAPAPVAADDDGPPAWVDEAIPDEAGGGFVPEHSFTADPDDEFETLAPAAAAMPAPRAPTPRRESGGRGRAARSRLADMSPTGWPELAARLPVTGLAAELARQSEWAGVQGDAVLLRVAVRTLAESESRVRLQTVLCEHFGQGLRLEIEVGVTGDGTAHAVAQIERAARQQAAEDAVAVDPFVQALVADFGGRVVPGSIRHVDNPPAA

SEQ ID NO: 52233 - protein, 306 aa, Vibrio campbellii AND4
MNKLVVLGSVNADHVLQVPSFPRPGETLHGRNYQVIPGGKGANQAVAAARLNADICFIACVGDDPFGINIRENFKLDGIDITGVKMQPNCPTGIAMIQVADSGENSICISAEANAKLTAEAIEPDLERIRQADYLLMQLETPMCGIEKAARIAKDAKTNVILNPAPARELSDELLSCIDVITPNETEAEVLTGVKVTDNDSAREAANLLHSKGIEIVMITLGAKGVWLSQNRHGQIIAGFRVEAIDTTAAGDTFNGALVTGLLEGLPLESAIKLAHAAAAISVTRFGAQTSIPTRKEVEEFLAQYQ

SEQ ID NO: 52234 - protein, 186 aa, Magnetospirillum magnetotacticum MS-1
MLTSLPNLLTLSRIVVIPLVVGLFYVDGAAARWAACTLFVAAAITDWFDGYLARSWNQVSKFGRFLDPIADKLLVASVLFMLAAFDRLSTVSFLPALVIVLREILVSGLREFLAEVRVGMPVSKLAKWKTAIQMTAIPVLLVGDAATFMPTRLVGEVGLWLAAILTIITGWDYLRSGMRHMGETPE

SEQ ID NO: 52235 - protein, 319 aa, Salmonella enterica subsp. enterica serovar Typhi str. CT18
MKAMNKVWVIGDASVDLVPEKQNSYLKCPGGASANVGVCVARLGGECGFIGCLGDDDAGRFLRQVFQDNGVDVSSLRLDAALTSAVLIVNLTADGERSFTYLVHPGADTYVSPQDLPPFRQHEWFYFSSIGLTDSPAREACLEGARRMREAGGYVLFDVNLRSKMWRNTDEIPELIARSAALASICKVSADELCQLSGASHWQDARYYLRDLGCDTTIISLGADGALLITAEGEFHFPAPRVDVVDTTGAGDAFVGGLLFTLSRANCWDHALLAEAISNANACGAMAVTAKGAMTALPFPDQLNTFLSSHSLAQAMTVK

SEQ ID NO: 52236 - protein, 175 aa, Zea mays
  misc_feature (97)..(97): Xaa can be any naturally occurring amino acid
  misc_feature (103)..(103): Xaa can be any naturally occurring amino acid
  misc_feature (128)..(128): Xaa can be any naturally occurring amino acid
  misc_feature (142)..(142): Xaa can be any naturally occurring amino acid
  misc_feature (149)..(149): Xaa can be any naturally occurring amino acid
  misc_feature (167)..(167): Xaa can be any naturally occurring amino acid
NGPAFGCVMMKEFLSELAKRVNKNTTAYENYKRIFVPEGQPLESEPNEPLRVNVLFKHVQKMLTGDSAVIAETGDSWFNCQKLKLPEGCGYEFQMQXGSIGWXSGCMLGYAQGANHKRVIAFIGDGSXQVTAQDVSTMLRCXRNSIIFXLSNNGGYTIEVGIHDGPXTSSRNWNY

SEQ ID NO: 52237 - protein, 91 aa, Fragaria x ananassa
MMMISLLVFNPVEADGVVVNYGQHASLLAKIDCGGACKARCRLSSRPHLCKRACGTCCQRCSCVPPGTAGNYDVCPCYATLTTHGGKRKCP

SEQ ID NO: 52238 - protein, 636 aa, Synechococcus sp. WH 7805
MSLISLVDASKDFGIRTLFEDLTLHVREGDRLGLIGPNGAGKSTLLRVLAGLEPLGSGERRCSARLRVELVGQESRVDPGLTVLEQVLAGCGKKRDLLLRFSEVSEAVAKTPDDTALMGELGALSERMDEEEAWALEQQCQEVLQRLGISDLHRPVEDLSGGYRKRVGLASALVACPDVLLLDEPTNHLDAAAVEWLQSWLDRYPGAVVLVTHDRYVLDQVTRRIVEVERGVASSIDGNYSAYLQRKADQEVADAAEAARFKSVMRRELAWLRQGPKARSTKQRARIERIEALKASPTKQAKQELAMSSVSRRIGKVVIEAEELTVTTDGQPGGPSLLRDFTYSFSPEDRVGIIGPNGSGKSTLLDLIAGRRQVTSGSLRLGDTVHLGYLDQHTDALSEGRGLERKVIEFVEEAASRIELAGEQLSASQLLERFLFPPAQQHSPLNKLSGGERRRLSLCRMLIQAPNVLLLDEPTNDLDVQTLSVLEDLLEDFRGCVVVVSHDRYFLDRTIDRLFCFEDGRLKRFEGNYSAFLDHKRALEKNSSEPSSVPKETASSKKKPKKSSDSGPRRRSFKESRELETLEQTLPDLEKRKADLEEAIGSGQGDLTNLSQDLATLLERIQESEERWLELSELAP

SEQ ID NO: 52239 - protein, 329 aa, Synechococcus sp. WH 7805
MALPPLVVATAREGWRWQWRQLMQGLGPADTEGRYQRPASDRIDVLIPDKSGLQFRADAQRPRLVIGRSCPWAHRTWLMHRLRQLDDTLTLLMATADHRAGRWSLVPAWLGCDSLLALYRHCGTPPHHRATVPALIDPGEEAEPTPQLLGNDSAALTETLNQWPGGEGAMDLAPAALEPNIQRWLQLLQPAVNDGVYRCGFARTQKAYDEASAALFSALDEVEAALQHQGPWLCGAQPTIADVCLFPTLIRWELVYAPLFGCNAQPLWMFPALWSWRQSFYALPGVAETCDGEAWRADYFGALFPLNPGGIIPAGPDLCTLIKSSPALP

SEQ ID NO: 52240 - protein, 406 aa, Physcomitrella patens subsp. patens
MAATAFTAVSVPSNASLKVAGSKGLSEFSGMKSTNAVTFGKRSDDLASIVAAQSAVSASSGATRAVTEAKIKVAINGFGRIGRNFIRCWQGRKDSPLDVVVINDTGGVKQASHLLKYDSMLGTFNADVKVEGNNAISVDGKVIKVVSDRNPLNLPWGDMDIDLVIEGTGVFVDEAGAGKHIQAGAKKVLITAPGKGAIPTFVVGVNEQDYKHSDAIISNASCTTNCLAPFVKVLDEKFGIIKGTMTTTHSYTGDQRLLDASHRDLRRARAAALNIVPTSTGAAKAVALVLPNLKGKINGIALRVPTPNVSVVDLVVQVEKKTFAEEVNQAFRDACQTEQLKGVLAVCDEPLVSVDFRCTDVSSTVDSSLTMVMGDDMVKVVAWYDNEWGYSQRVVDLANLVAEKWE

SEQ ID NO: 52241 - protein, 387 aa, Bacillus cereus ATCC 14579
MEQFINPRVKDIQISGIRQFSNMIQNYDNLISLTIGQPDFPTPSLVKEAAKRAITENYTSYTHNAGLLELRKAACNFVKDNYDLHYSPENETIVTIGASEAIDVAFRTILEPGTEVILPAPIYPGYEPIIRLCGATPVFVDVRETGFRLTAEALKNAITEKTRCIVLPYPSNPTGVTLSTEELKDIVDVLKDKNIFVLSDEIYSELVYEQKHTSIAHFPEMREKTIVINGLSKSHSMTGWRVGLLFAPSYLAGHILKVHQYNVTCATSIAQYAAIEALTAAKDAPKMMRHQYKKRRDYVYNRLTQMGLTVEKPTGAFYLFPYVGHLTSSSFDFALDLVKEAGLAVVPGTAFSEYGEGYLRLSYAYSIETLKEGCDRLEAFLMKKAKS

SEQ ID NO: 52242 - protein, 387 aa, Streptococcus pyogenes M1 GAS
MNKLYIDSFVEKKLTAGVQLLDEKDFSNIKEKNQLVQLVTKSNRPIGTAYISKQNKGIGWYLGPEKIDLSISYFVSLFSVAKAKRQDFAQSDETNAYRLFNQEGDGFGGVTIDLYKDFAVFSWYNAFVYDKKEMIMEAFQQVFPEVKGAYEKCRFKGPDTETAHLYGELAQETFSILENGIAYQVFLNEGLMTGIFLDQHDVRRALVDGLAMGKSLLNLFSYTAAFSVAAAMGGAIETTSVDLAKRSRELSLAHFEHNQLNLASHHFVVMDVFEYFKYAKRKKLIFDVIVIDPPSFARNKKQTFSVSRDYHKLITEALDILSPKGTIIASTNAANMTVSQFKKQIIKGFGSRRPESMTLQQLPSDFTINKADERSNYLKVFTIKVRE

SEQ ID NO: 52243 - protein, 483 aa, Pseudomonas aeruginosa PAO1
MQLKDAKLFRQQAYVDGAWVDADNGQTIKVNNPATGEIIGSVPKMGAAETRRAIEAADKALPAWRALTAKERANKLRRWFDLMIENQDDLARLMTIEQGKPLAEAKGEIAYAASFLEWFGEEAKRIYGDTIPGHQPDKRIIVIKQPIGVTAAITPWNFPSAMITRKAGPALAAGCTMVLKPASQTPYSALALAELAERAGIPKGVFSVVTGSAGEVGGELTSNPIVRKLTFTGSTEIGRQLMAECAQDIKKVSLELGGNAPFIVFDDADLDAAVEGALISKYRNNGQTCVCANRLYVQDGVYDAFVDKLKAAVAKLNIGNGLEAGVTTGPLIDAKAVAKVEEHIADAVSKGAKVVSGGKPHALGGTFFEPTILVDVPKNALVSKDETFGPLAPVFRFKDEAEVIAMSNDTEFGLASYFYARDLARVFRVAEQLEYGMVGINTGLISNEVAPFGGIKASGLGREGSKYGIEDYLEIKYLCLGGI

SEQ ID NO: 52244 - protein, 426 aa, Pseudomonas aeruginosa PAO1
MSKTNESLLKRRQAAVPRGVGQIHPVVAERAENSTVWDVEGREYIDFAGGIAVLNTGHLHPKVIAAVQEQLGKLSHTCFQVLAYEPYIELAEEIAKRVPGDFPKKTLLVTSGSEAVENAVKIARAATGRAGVIAFTGAYHGRTMMTLGLTGKVVPYSAGMGLMPGGIFRALAPCELHGVSEDDSIASIERIFKNDAQPQDIAAIIIEPVQGEGGFYVNSKSFMQRLRALCDQHGILLIADEVQTGAGRTGTFFATEQLGIVPDLTTFAKSVGGGFPISGVAGKAEIMDAIAPGGLGGTYAGSPIACAAALAVLKVFEEEKLLERSQAVGERLKAGLREIQAKHKVIGDVRGLGSMVAIELFEGGDTHKPAAELVSKIVVRAREKGLILLSCGTYYNVIRFLMPVTIPDAQLEKGLAILAECFDELA

SEQ ID NO: 52245 - protein, 495 aa, Eustrephus latifolius
MRINPTTSGPAVSILEEKNLGRIVQIIGPVLDVVFPPGKMPNIYNALVVKGRDTVGQQINVTCEVQQLLGNNRVRAVAMSATDGLTRGMEVIDTGAPLSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYKEMKESGVINEKNIAESKVALVYGQMNEPPGARMRVGLTALTMAEYFRDVNEQDVLLFIDNIFRFVQAGSEVSALLGRMPSAVGYQPTLSTEMGSLQERITSTKKGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDSLPEQAFYLVGNIDEATAKAMNLEEEKK

SEQ ID NO: 52246 - protein, 500 aa, Saccharomyces cerevisiae
MTKLHFDTAEPVKITLPNGLTYEQPTGLFINNKFMKAQDGKTYPVEDPSTENTVCEVSSATTEDVEYAIECADRAFHDTEWATQDPRERGRLLSKLADELESQIDLVSSIEALDNGKTLALARGDVTIAINCLRDAAAYADKVNGRTINTGDGYMNFTTLEPIGVCGQIIPWNFPIMMLAWKIAPALAMGNVCILKPAAVTPLNALYFASLCKKVGIPAGVVNIVPGPGRTVGAALTNDPRIRKLAFTGSTEVGKSVAVDSSESNLKKITLELGGKSAHLVFDDANIKKTLPNLVNGIFKNAGQICSSGSRIYVQEGIYDELLAAFKAYLETEIKVGNPFDKANFQGAITNRQQFDTIMNYIDIGKKEGAKILTGGEKVGDKGYFIRPTVFYDVNEDMRIVKEEIFGPVVTVAKFKTLEEGVEMANSSEFGLGSGIETESLSTGLKVAKMLKAGTVWINTYNDFDSRVPFGGVKQSGYGREMGEEVYHAYTEVKAVRIKL

SEQ ID NO: 52247 - protein, 454 aa, Vitis vinifera
MVSERNQSKHVCVIGAGPSGLVAARELRKEGHSVVVIEQNHDIGGQWLYEPKVEGEEALGKSTFLKVHSSIYDSLRLFSPREIMGFSDFPFVVKKGRDMRRFPGHRELLLYLQDFCEWFGLREMIRFKTRVEYVGMLDSDQVGRDLKWVVKSRDMESEKVVEEVFDAVVVATGHYSKPRLPSIKGMDVWKRNQMHSHIYRDPEPFRKEVVVVVGNSLSGQDISMELVDVAKEIHLSAKSLEISEGLAKVISKHDSLHLHLEIESLHEDGRVVFVDGSWVMADTIIYCTGYSYAFPFLDTKGIVGVDDDRVGPLYEHTFPPSLAPSLSFVGIPRKLIGFPFFESQAIWIAQLLSGKRTLPSFHDMMQSIKDFYHSREIAGVPKHNTHDLANFEYCDKYGDNVGFPHLEEWRKELCISAIVKAEVDLEGYRDAWDDVELLQVALQSPHFTQFPRST

SEQ ID NO: 52248 - protein, 450 aa, Streptococcus pyogenes M1 GAS
MVIPYDYIVIGGGSAGIASANRAAMHGAKVLLAEGKEIGGTCVNLGCVPKKVMWYGAQVADILGTYAKDYGFDFKEKAFDFKQLKANRQAYIDRIHASYERGFEQNGVDRIYDYAVFKDAHTVEIAGQLYTAPHILIATGGHPVFPDIEGAQYGISSDGFFALDEVPKRTAVVGAGYIAVELAGVLHALGSKTDLFIRHDRPLRSFDKTIVDVLVDEMAVNGPRLHTHAEVAKVVKNTDESLTLYLKDGQEVEVDQLIWAIGRKPNLEGFSLDKTGVTLNDKGYIETDAYENTSVKGIYAVGDVNGKLALTPVAVAAGRRLSERLFNGKTDEKLDYQNVATVIFSHPVIGSVGLSEEAAVKQYGQEAVKTYQSRFTSMFTAITNHRQPCLMKLVTVGDTEKIVGLHGIGYGVDEMIQGFAVAIKMGATKADFDNTVAIHPTGSEEFVTMR

SEQ ID NO: 52249 - protein, 1511 aa, Saccharomyces cerevisiae
MSSTDEHIEKDISSRSNHDDDYANSVQSYAASEGQVDNEDLAATSQLSRHLSNILSNEEGIERLESMARVISHKTKKEMDSFEINDLDFDLRSLLHYLRSRQLEQGIEPGDSGIAFKNLTAVGVDASAAYGPSVEEMFRNIASIPAHLISKFTKKSDVPLRNIIQNCTGVVESGEMLFVVGRPGAGCSTFLKCLSGETSELVDVQGEFSYDGLDQSEMMSKYKGYVIYCPELDFHFPKITVKETIDFALKCKTPRVRIDKMTRKQYVDNIRDMWCTVFGLRHTYATKVGNDFVRGVSGGERKRVSLVEAQAMNASIYSWDNATRGLDASTALEFAQAIRTATNMVNNSAIVAIYQAGENIYELFDKTTVLYNGRQIYFGPADKAVGYFQRMGWVKPNRMTSAEFLTSVTVDFENRTLDIKPGYEDKVPKSSSEFEEYWLNSEDYQELLRTYDDYQSRHPVNETRDRLDVAKKQRLQQGQRENSQYVVNYWTQVYYCMIRGFQRVKGDSTYTKVYLSSFLIKALIIGSMFHKIDDKSQSTTAGAYSRGGMLFYVLLFASVTSLAEIGNSFSSRPVIVKHKSYSMYHLSAESLQEIITEFPTKFVAIVILCLITYWIPFMKYEAGAFFQYILYLLTVQQCTSFIFKFVATMSKSGVDAHAVGGLWVLMLCVYAGFVLPIGEMHHWIRWLHFINPLTYAFESLVSTEFHHREMLCSALVPSGPGYEGISIANQVCDAAGAVKGNLYVSGDSYILHQYHFAYKHAWRNWGVNIVWTFGYIVFNVILSEYLKPVEGGGDLLLYKRGHMPELGTENADARTASREEMMEALNGPNVDLEKVIAEKDVFTWNHLDYTIPYDGATRKLLSDVFGYVKPGKMTALMGESGAGKTTLLNVLAQRINMGVITGDMLVNAKPLPASFNRSCGYVAQADNHMAELSVRESLRFAAELRQQSSVPLEEKYEYVEKIITLLGMQNYAEALVGKTGRGLNVEQRKKLSIGVELVAKPSLLLFLDEPTSGLDSQSAWSIVQFMRALADSGQSILCTIHQPSATLFEQFDRLLLLKKGGKMVYFGDIGPNSETLLKYFERQSGMKCGVSENPAEYILNCIGAGATASVNSDWHDLWLASPECAAARAEVEELHRTLPGRAVNDDPELATRFAASYMTQIKCVLRRTALQFWRSPVYIRAKFFECVACALFVGLSYVGVNHSVGGAIEAFSSIFMLLLIALAMINQLHVFAYDSRELYEVREAASNTFHWSVLLLCHAAVENFWSTLCQFMCFICYYWPAQFSGRASHAGFFFFFYVLIFPLYFVTYGLWILYMSPDVPSASMINSNLFAAMLLFCGILQPREKMPAFWRRLMYNVSPFTYVVQALVTPLVHNKKVVCNPHEYNIMDPPSGKTCGEFLSTYMDNNTGYLVNPTATENCQYCPYTVQDQVVAKYNVKWDHRWRNFGFMWAYICFNIAAMLICYYVVRVKVWSLKSVLNFKKWFNGPRKERHEKDTNIFQTVPGDENKITKK

SEQ ID NO: 52250 - protein, 181 aa, Cryptomeria japonica
MASADVEFRCFVGGLSWSTDDRSLKDAFTAFGEVMDSKVVSDRETGRSRGFGFVTFMDEQSMRDAIEGMNGRDLDGRNITVNRAQARGGGGGGGGGGGGYRGGGGGSGGYGGGGSGGYESRRSGGGGSGGGGYSGGGRERSERGYGGGSRNGGGYGGYSGGGGGGSRYGGGGVSDDGGWRS

SEQ ID NO: 52251 - protein, 431 aa, Kineococcus radiotolerans SRS30216
MATIEAVGAREILDSRGNPTVEVEVLLDDGTFARAAVPSGASTGAYEANERRDGDKGRYGGKGVEQAVEAVIEEVGPALVGHDAHEQRIIDRVMLDLDGTPTKSRLGANAILGVSLAVAKAAASAADLPLFRYLGGPNAHVLPVPMMNIVNGGAHADTGVAIQEFMIAPVGAASFREALRWGAETYHALKSVLKQRGLATGLGDEGGFAPDLPSNKDALDLIVEAIGKTGFAVGSDIALALDVAATEFHGADGYDFEGSKRSAEWMTGYYEGLVSEYPLVSIEDPLSEDDWDGWQHITNALGGKLQLVGDDLFVTNPERLQKGIDLSAGNSMLVKVNQIGSLTETLDAVDLAHRNGFSTMMSHRSGETEDTTIADLAVAVGSGQIKTGAPARSERVAKYNQLLRIEEELDDAAVYAGAKAFPRSAGFTGRA

SEQ ID NO: 52252 - protein, 371 aa, Schizosaccharomyces pombe 972h-
MCAKKIVVLPGDHIGPEIVASALEVLKVVEKKRPELKLEFEEHKIGGASIDAYGTPLTDETVKACLEADGVLLGAVGGPEWTNPNCRPEQGLLKLRKSMGVWANLRPCNFASKSLVKYSPLKPEIVEGVDFCVVRELTGGCYFGERTEDNGSGYAMDTWPYSLEEVSRIARLAAWLAETSNPPAPVTLLDKANVLATSRLWRKTVAKIFKEEYPHLTLKNQLIDSAAMLLVKSPRTLNGVVLTDNLFGDIISDEASVIPGSLGLLPSASLSGVVGKSEEKVHCLVEPIHGSAPDIAGKGIVNPVGTILSASLLLRYGLNAPKEAEAIEAAVRKVLDDTSIGGRGLYTRDLGGEASTADITKAVVEELEKIL

SEQ ID NO: 52253 - protein, 224 aa, Cryptomeria japonica
MSSAKADEEQLATGYPLLPQNPDSHAHLQYVQPPPPQNSDAHLQFVTPPPPPPPPPPPAYPSPPPQQGNPLRPTQWSSGLCFCTDDPSLCLLTFFCPCITFGRIAEIVGEGSPKCGVSGVIYGLLCVTWYACFGVYGVICVSGFASCYSCTYRTKMRAKFNLAEIPVRDCLLHFFCEPCALCQEYKELKHRGYDPALGWMKNLQKQEREMGIAMAPPVIPPMEK

SEQ ID NO: 52254 - protein, 442 aa, Sulfitobacter sp. EE-36
MKSHIFGRSTKGALPVATRGDGCYLIDADGRRYLDGSGGAAVSCLGHSNQAVRAALHAQIDQLAFAHTGFFTSDPAERLADRLIENAPAGIDRVYLVSGGSEAVEASIKLARQYFLEIGQPKRHRVIARRQSYHGNTLGALAAGGNAWRRTQFAPLLADTTHISPCYEYRDRQDGETQEAYGLRVANELETEILRLGPDTVMAFLAEPVVGATSGAVPAVPGYLKRIREICDQYGVLLILDEVMCGMGRTGKLFACTEDGVAPDMITIAKGLGAGYQPIGALLTSAAIYDAIAAGTGFFQHGHTYMGHAMAATAANAVLSEILDRDLLSHVTTQGDKLDAALKAQFGDHDNIGDIRGRGLFRGIELVADRSTKAPFDPSRGLAARIKKEAFAAGLICYPMSGTIDGQYGDHVLLAPPFIIEDAQIDELVGKLSTAIDKALAA

SEQ ID NO: 52255 - protein, 523 aa, Arabidopsis thaliana
MDSSYSFALGTSSSILPKLSFRNVENRFYGEKNNNNGLCKRFGSDLGSKKFRNQKFKHGVVYAVATSDNPKKAMTVKTSMFERRKVDPQNVAAIILGGGNGAKLFPLTMRAATPAVPVGGCYRLIDIPMSNCINSCINKIFVLTQFNSASLNRHLARTYFGNGINFGGGFVEVLAATQTPGEAGKKWFQGTADAVRKFLWVFEDAKNRNIENILILSGDHLYRMNYMDFVQSHVDSNADITLSCAPVSESRASNFGLVKIDRGGRVIHFSEKPTGVDLKSMQTDTTMLGLSHQEATDSPYIASMGVYCFKTEALLNLLTRQYPSSNDFGSEVIPAAIRDHDVQGYIFRDYWEDIGTIKTFYEANLALVEERPKFEFYDPETPFYTSPRFLPPTKAEKCRMVDSIISHGCFLRECSVQRSIIGERSRLDYGVELQDTLMLGADYYQTESEIASLLAEGKVPIGIGKDTKIRKCIIDKNAKIGKNVIIMNKGDVQEADRPEEGFYIRSGITVIVEKATIQDGTVI

SEQ ID NO: 52256 - protein, 271 aa, Rubrobacter xylanophilus DSM 9941
MEAGNTKTALVTGSTDGLGRGVARELARRGYAVILHGRSEARCEEAAAELPGGAAGYLVADLSSLGEVRKMAREVLAGRERLDLLVNNAGVISRERRESREGFELTFAVNYLSHFLLTLLLLPLLRRSAPARVVNVASAAQSPIDFEDPMMERSYSPMEAYARSKLAQVMFSFALAGRLSGTGVCVNALHPASLMDTKMVRESFGRPMSSVEEGVRAVVRLAASSELEGVSGRYFEGTREARAHPQAYDPAARERLWELSEGLCGALDAGR

SEQ ID NO: 52257 - protein, 394 aa, Crocosphaera watsonii WH 8501
MQDEITIIGAGIGGLTLAAALEKKHIPFQLYEQANSFEALGYGIQVSPNIVRVLWALGLEKELENISHRCLGFELRSFNSDNILAKWQIDNKIPYYQCRRADLHQLLFDSIEDKNRIHFSQRLESFQQKDHKISLHWQNSQPTTTTALVAADGVRSQVRRSLFPGNKAQYAGYAAYRAILPFKDKYRPLWGKATVWMGENHHVVVYPNGNQENSTPWLNLVLVVKDANWNEQGWSIPADKQAVAQDFVNQSEELKEILEDMIASPEPCFKWGLFIHQPLPYWSQGKVTLLGDAAHPMLPFQAQGAAMAIEDAYVLAEYLGKEKEIEKAFIKYQQTRLKRATKVQQVSRNNADIFHASGVKALIRNFGLGLVSATVPNLLNQKTAWIYDYDILSN

SEQ ID NO: 52258 - protein, 267 aa, Haemophilus influenzae
MNLDVWQHIRQEAKELAENEPMLASFFHSTILKHQNLGGALSYLLANKLANPIMPAISLREIIEEAYQSNPSIIDCAACDIQAVRHRDPAVELWSTPLLYLKGFHAIQSYRITHYLWNQNRKSLALYLQNQISVAFDVDIHPAAKIGHGIMFDHATGIVVGETSVIENDVSILQGVTLGGTGKESGDRHPKVREGVMIGAGAKILGNIEVGKYAKIGANSVVLNPVPEYATAAGVPARIVSQDKAAKPAFDMNQYFIGIDDGMNLNI

SEQ ID NO: 52259 - protein, 538 aa, Vitis vinifera
MTIPRISSLLSRSFTSSASSALLSSIGRNSSRRGGIFRYSTAAVVEEPINPSVNVNYTQLLINGQFVDAATGKTFETLDPRTGNVIASVAEGDAEDVNRAVSAARKAFDEGPWPRMSPYERSKILLRFADLLEKHNDEIAALETWDNGKPFEQAAKAEVPLVIRLMRYYAGWADKIHGLTVPADGLHQVQTLHEPIGVAGQIIPWNFPLLMYAWKIGPALACGNTIVLKTAEQTPLSALYASKLLHEAGLPPGVLNVVSGYGPTAGAALASHMDVDKLAFTGSTATGKIVLQLAARSNLKPVTLELGGKSPFIVCEDANVDEAVELAHFALFFNQGQCCCAGSRTFVHESIYDEFVEKAKARALRRTVGDPFKAGIEQGPQIDSDQFEKILRYIRSGVENGATLETGGERFGKEGFFIKPTVFSNVQDGMLIAQDEIFGPVQSILKFKDLGEVIRRANATSYGLAAGVFTQNLDTANTLTRALKVGTVWINCFDVFDAAIPFGGYKMSGHGREKGIYSLQNYLQVKAVITPLKNPAWL

SEQ ID NO: 52260 - protein, 141 aa, Burkholderia pseudomallei K96243
MALERTLSIIKPDAVAKNVIGQIYSRFENAGLKIVAARMAHLSRADAEKFYAVHAERPFFKDLVDFMISGPVMIQVLEGEDAILKNRDLMGATDPKKAEKGTIRADFADSIDANAVHGSDAPETARAEVAFFFPEMNVYSR

SEQ ID NO: 52261 - protein, 611 aa, Mesorhizobium loti MAFF303099
MAAETSGSDLIQVVALLAAGVVAVPIFKRMGLGSILGYLAAGVVIGPFGLRIFSESGAILHVAELGVVMFLFIIGLEMQPSRLWGLRREIFGLGALQVGVCAVLLTGVGMAGGFPVSQSFVAGAGFVLTSTAIVMQLLEERGEIASPKGQRIVSILLLEDLAIVPLLALIAFLAPGGADTSMSERLTEVGIGLAAIVGLVLAGRYLLNPFFRILADARAREVMTAAALLVVLGSALAMQLSGLSMAMGAFLAGVLLSESTFRHQLEADIEPFRGILLGLFFLAVGMSLDLHVVAANWRLIAVYVVAYMVMKALGIYIVARILKTGHREALERAVFMAQGGEFAFVLYSAAAAVGIIDNQANATLTAIVIISMVLTPLAIIALRYVTPRDEQSLDGVDVADGLTGSVLIIGFGRFGQIASQPLLLRGIDVSIIDNDVEMIQAAADFGFKVYYGDGTRLDILHAAGAGRARAVLICVDKADAAVRIVQLIKAEFPLLTVLARAFDRGTALQLIRAGVDYQLRETFESALVFGGSALESLGVDPEDVAETIEDVRRRDTERFETQLAEGIRAGQRFLRGNIGTPIPTPLSTPRRPGQALNEETAGVLHKSETAD

SEQ ID NO: 52262 - protein, 806 aa, Ustilago maydis 521
MSGSGFTSSGPSATAAGGSRLPAVHDANATWAFLEPGIDLMMTRLKEGMTYPRYMELYTVAYNHFTSSSLASSSTALGRSSGPFGSKGGTALVGAELYNHLTVYFRTHLEQVRTDSDGLSEEALLRYYATEWDRYTTGANFVHRLFAYLNRYWVKREKDEGHKYVYTVYILALVQWKEHMFRYIQQKGRLVQALLKQIEKQRNGEIIEASLVKKVVDSLVSLGLDESDTNRQNLDVYRQEFEKPFIEATEIYYITESDAFVSQNAATDYMKKAETRLKEEEDRVELYLHASTRTKLVPTCDNVLVRRHSAMLWDEFQELLDSDQADDLYRIYTLLSRIPEGLEPLRRKFEEHVKRVGHSAVEKVMGGGDVGSADTGAATNGAAGSSAATAAAPAASDSLDPGAYVSALLKTHQSNLNTVNVAFRGEAGFLAALDKACRDFANRNKATGASTSKSPELLAKHADALLKKSNKATAENSLEEALADVMVVFKYIEDKDVFQKFYSKMLAKRLVNFASASDDAEASMISRLKEVCGVEYTKKLQTMFTDMGLSKELNDHFKDTMANHYDKTELDVDFYSLVLGRSSWPLQAPTTEFSIPTELLPTYERFQRYYSVKHQGRKLIWLWQLSKNEVKTNYLSQKLQFQTSTFQTAVLLQFNTNDSLTKTQLQQATGLNDATIKPVLGMLSKAKVLVTSSSDPEAYELNANFKSKKLRVNLNLPVKAEQKAESNDVLKTIDEDRRLLLQATIVRVMKSRKQLKHQALIQETVAQVSGRFNPRVSDIKKAIDQLIDKEYLERLEGSKDTYSYLA

SEQ ID NO: 52263 - protein, 119 aa, Mesorhizobium loti MAFF303099
MYVIRLKNCAFFARHGVLDEEEALGQRFYVDAVLSVEPGRALVDDAIEETVNYGIAFTVIEKIITGERRFLIEALAMEVAKALTERFPQIRRAEITVRKPNAPVPGVLDYVEVTVVWPE

SEQ ID NO: 52264 - protein, 114 aa, Glycine max
  misc_feature (60)..(60): Xaa can be any naturally occurring amino acid
VVRKVGYDAIVECSGCWRITMHMLFASSGEMRQSATSILYDLTLSARGALVCVAGAPRHXSFEMFGAGLVIENSYALPLVRDQPICKRQRVQVLEDLLNCHKHGVHTTGPDWGD

SEQ ID NO: 52265 - protein, 389 aa, Ustilago maydis 521
MVAQRYTLSALRSTLSAASSAPRQSVATSSRTFASTPYNRSDRPPTGSFSPHQNDASSASTSSTNAFSSSRPAATFGMDGSASDHKQTHFGFKTVAEEEKESMVASVFSSVASKYDVMNDAMSLGIHRLWKDHFVSKLDPRGGIKVLDVAGGTGDIALRILDHARTKHFDRETHVTVLDINPSMLKEGQKRFKQTMYWGGPQVSFQLGNAEQLDSSMSVPAEPVRGPNSKHPYLPPLESKPIPDESIDLYTIAFGIRNCTHIDEVLRQAYRVLKPGGVFSCLEFGKVNIPFLAEAYKQYSFNVLPPLGQMLAGDRASYQYLVESIERFPTQPQFARMMKDAGFHLPGSPTATNLGFPAESGSAAGSEDVAGAWEDLTFGVATIWTGIKL

SEQ ID NO: 52266 - protein, 339 aa, Colwellia psychrerythraea 34H
MTIRIAINGFGRIGRSVVRALYESGKTDLFTLVSINELAPASGIAHLLKYDSTHGRFPFSVSEKENQLIINGDEIALTHIGNLNSLPWQQQNIDIVLDCTGKYGNKADGLSHINRGAKKVLFSHPGSQDIDATIIYGINHQTLTSSDRVVSNGSCTTNCIVPVIKVIDEAFGVESGSITTIHSSMHDQQVIDAYHKDLRLSRAASQSIIPVDTKLAAGIERILPKFKGRFEAIAVRVPTINVTAMDLSLTVNNDVCICDINQAIQAATSNHDLYGVLSYTEEPLVSVDFNHDPHSCIVDGNQTRVSHKRLIKMLVWCDNEWGFANRMLDTAMAMHQAEN

SEQ ID NO: 52267 - protein, 415 aa, Colwellia psychrerythraea 34H
MSDFKQAALDYHALPTAGKIAIAITTPAETSADLSLAYSPGVAEPCREIAKNPDDVYKYTGKGNTVAVISNGTAVLGLGNLGPMASKPVMEGKALLFKRFADINSFDIEVTHRTPEEFINTVAAIADSFGGINLEDIKAPECFIIEKALNERCKIPVFHDDQHGTAIVTAAAMINALEIQNKKIEQADIVCLGAGAAAIACMELLIQCGAIREKIYMLDTKGVIHTRRDDLSEYKTRFANNTDKRTLDDVIEGADVFLGVSGPNLLNTEQLKKMADNPVVFACSNPDPEIKPELAHSVRSDLIMATGRSDYPNQVNNVLCFPFIFRGALDVRARKINNEMKIAAVHAIRELAKQDVPKSVLKASNEKELSFGKGYIIPRPMDPRLCKNVALAVAKAAVDSGVAALPLPDNYMNDT

SEQ ID NO: 52268 - protein, 131 aa, Oryza sativa Japonica Group
MAASPASTAAAVVNAPAATGGLLLPRGRSSWSWSCCNNNNSSMGRRWRAAAVGEVAAEGNTYLIAGAVAVALVGTAFPILFSRKDTCPECDGAGFVRKGGATLRANAARKDLPQIVCPNCNGLGKLGQIDK

SEQ ID NO: 52269 - protein, 338 aa, Triticum aestivum
PFSRAGRGDGISLRPECAGDDDGEAQIPIIDHRRLLLELDRRGEESSRLHRACQDWGFFQLINHNVPDDVVEGMKASLQEFFQLPAETKRRFAQQQGRLEGYGQLFVVSEDQKLDWADMLFLYAQPPEIRKTKLWPDQPATFRAALDRYSCAVKEVADSLLATMSENLGLKREVIADRCIGGLQSIRMNLYPPCAQADKVVGLSPHSDADLLTLVLQVNHVQGLQIKRNGSWFAVKPVEGAFVVNVGDIFEILTNGRYRSIEHRVVVDPKEERLSVAAFHSPNTRATIGPLKELVARADGEDVAYATVEHERLRELFFATKLEGKSFLERMKLPSTTS

SEQ ID NO: 52270 - protein, 748 aa, Bacteroides fragilis NCTC 9343 [sequence omitted]

SEQ ID NO: 52271 - protein, 482 aa, Escherichia coli K12
MKLNDSNLFRQQALINGEWLDANNGEAIDVTNPANGDKLGSVPKMGADETRAAIDAANRALPAWRALTAKERATILRNWFNLMMEHQDDLARLMTLEQGKPLAEAKGEISYAASFIEWFAEEGKRIYGDTIPGHQADKRLIVIKQPIGVTAAITPWNFPAAMITRKAGPALAAGCTMVLKPASQTPFSALALAELAIRAGVPAGVFNVVTGSAGAVGNELTSNPLVRKLSFTGSTEIGRQLMEQCAKDIKKVSLELGGNAPFIVFDDADLDKAVEGALASKFRNAGQTCVCANRLYVQDGVYDRFAEKLQQAVSKLHIGDGLDNGVTIGPLIDEKAVAKVEEHIADALEKGARVVCGGKAHERGGNFFQPTILVDVPANAKVSKEETFGPLAPLFRFKDEADVIAQANDTEFGLAAYFYARDLSRVFRVGEALEYGIVGINTGIISNEVAPFGGIKASGLGREGSKYGIEDYLEIKYMCIGL

SEQ ID NO: 52272 - protein, 426 aa, Escherichia coli K12
MNSNKELMQRRSQAIPRGVGQIHPIFADRAENCRVWDVEGREYLDFAGGIAVLNTGHLHPKVVAAVEAQLKKLSHTCFQVLAYEPYLELCEIMNQKVPGDFAKKTLLVTTGSEAVENAVKIARAATKRSGTIAFSGAYHGRTHYTLALTGKVNPYSAGMGLMPGHVYRALYPCPLHGISEDDAIASIHRIFKNDAAPEDIAAIVIEPVQGEGGFYASSPAFMQRLRALCDEHGIMLIADEVQSGAGRTGTLFAMEQMGVAPDLTTFAKSIAGGFPLAGVTGRAEVMDAVAPGGLGGTYAGNPIACVAALEVLKVFEQENLLQKANDLGQKLKDGLLAIAEKHPEIGDVRGLGAMIAIELFEDGDHNKPDAKLTAEIVARARDKGLILLSCGPYYNVLRILVPLTIEDAQIRQGLEIISQCFDEAKQ

SEQ ID NO: 52273 - protein, 466 aa, Escherichia coli K12
MGQSSQPHELGGGLKSRHVTMLSIAGVIGASLFVGSSVAIAEAGPAVLLAYLFAGLLVVMIMRMLAEMAVATPDTGSFSTYADKAIGRWAGYTIGWLYWWFWVLVIPLEANIAAMILHSWVPGIPIWLFSLVITLALTGSNLLSVKNYGEFEFWLALCKVIAILAFIFLGAVAISGFYPYAEVSGISRLWDSGGFMPNGFGAVLSAMLITMFSFMGAEIVTIAAAESDTPEKHIVRATNSVIWRISIFYLCSIFVVVALIPWNMPGLKAVGSYRSVLELLNIPHAKLIMDCVILLSVTSCLNSALYTASRMLYSLSRRGDAPAVMGKINRSKTPYVAVLLSTGAAFLTVVVNYYAPAKVFKFLIDSSGAIALLVYLVIAVSQLRMRKILRAEGSEIRLRMWLYPWLTWLVIGFITFVLVVMLFRPAQQLEVISTGLLAIGIICTVPIMARWKKLVLWQKTPVHNTR

SEQ ID NO: 52274 - protein, 407 aa, Arabidopsis thaliana
MFFYLYLSSSAKEVLKTHDLETCTRPKMVTTGLFSYNFKDIGFTQYGEEWGEMKKLIGLELFSPKTQKSFRYIREEESDLLVKKISKSAQTQTLVDLGKPLFSFTAGIIFRLAFGQNFRKCDFIDRERVEELVVESETNVGTLAFSDFFPTGLGWLIDRLSGQSSRMNKVFSKLTNLFEHVIDDHLKTEQHQDHSNLISAMLNMINKPTNIGSFKITSDHLKGVMSVSVYDFLTGTLIRATLGSNKERITEEDLEKVEYLKMVIEETFRLHPPAPLLLPRLTMSDVTIQGYNIPKNTMIEINTYTIGRDPKCWTNPEEFIPERFSNTSINYKGQHFELLPFGAGRRSCPGMSLGITILELGLLNLLYFFDWRLPNGMTIADIDMEEVGALNIAKKVPLELVPTLHHS

SEQ ID NO: 52275 - protein, 514 aa, Bacteroides fragilis NCTC 9343
MKELINRLEELNRQAEKGGGDARIEKQHSVGKLTARERIDLLLEKGSFIELDKLVTHRCTDFGMEKQKISGDGVVTGYGMIGKRLVYVFAQDFTVFGGALSETYAKKICKVMDMAMQMGAPIIGLNDSGGARIQEGVRSLAGYAEIFLRNSLASGVIPQISAIMGPCAGGAVYSPALTDFILMVKNSGYMFITGPDVVKSVTQEEVSKEDLGGADVHTMKSGVAHLSAENDIECINYIRELISYLPGNNMEEPPFVATTDSPTRLTPELSDLVPTNPNQPYDMKEMIRAVADDNSFFELQEEFARNIVIGYIRLNGKTIGVVANQPLALAGTLDINASVKAARFVRFCDAFNIPLLTLVDVPGFLPGVDQEYGGIIRNGAKLLYAYCEATVPKVTVIARKAYGGAYDVMSSKHIRGDVNLAYPTAEIAVMGPDGAVNILFHKEIDKAADTEARRKELQDDYRSKFANPYRAAELGYVDEVIDPAITRMRLIRSFEMLANKRQSNPPKKHSNLPL

SEQ ID NO: 52276 - protein, 454 aa, Kineococcus radiotolerans SRS30216
MRYAETVVDLVGGTPLVKLNRVTEGLACTVLAKVEYLNPGGSVKDRIATRMIEAAEAEGLLKPGGTIVEPTSGNTGVGLALVAQQRGYKCVFVCPDKVGADKRNVLKAYGAEVVVCPTAVPPEDPQSYYSVSDRLVREIEGAWKPNQYSNVHGPRSHYETTGPEIWADTEGRITHFVTGVGTGGTITGTGRYLKEQGPVKVIGADPEGSVYSGGTGRPYLVEGVGEDFWPTAYDPSIPDEIIAVSDADSFEMTRRLAREEGLLVGGSCGMAVVAALRAAKDLGPDDVVVVLLPDGGRGYLGKIFNDDWMASYGFLDSGARGTVGEVLRAKTTGLPALVHTHPTETVHDVIEIMREYGVSQLPVVGAEPPVMAGEIAGAVNERALLDALFTGRAKMSDAVSAHMGPALPLVGAGQSVEDVRSVFSGADAAVVVEDGKPTGVITRHDLLAYLAISH

SEQ ID NO: 52277 - protein, 197 aa, Oryza sativa Indica Group
ALVELKASFQNANKDHTIKHTFLPFLIKSLSKALSKYPLLNSCFVEETNEVIFKGSHNIGVAMATEHGLVVPNIKNVQSLSILEITKELSRLHEMASHNRLSTEDIAGGTITLSNIGAIGGKFGSPLLNLPEVAIIALGRIQKLPRFDDDENVYPSSIINVTVGADHRVVDGATVARFCNEWKSLVEKPELLLLHMR

SEQ ID NO: 52278 - protein, 360 aa, Streptococcus pyogenes M1 GAS
MTKRLLILEDGTIFEGEPFGADIDVTGEIVFNTGMTGYQESITDQSYNGQILTFTYPLIGNYGINRDDYESISPTCKGVVVSEVSRLASNWRKQMTLDAFLKIKGIPGISGIDTRALTKIIRQHGTMKATMADDGDSIQHLKDQLRATVLPTNTIEQVSTKTAYPAPGIGKNIVLVDFGLKHSILREFSKRQCNITVVPFNITAEEVLQLNPDGLMLSNGPGNPEDLPEALDMIRGVQGKIPIFGICMGHQLFSLANGAKTCKMTFGHRGFNHAVREIATGRIDFTSQNHGYAVERSSLPDTLMVTHEDINDKTVEGVKHRDFPAFSVQFHPDAAPGPHDASYLFDEFLEMIDSWRCTSK

SEQ ID NO: 52279 - protein, 382 aa, Mycobacterium smegmatis str. MC2 155
MRAMVYRGPYKIRLEDKPIPAIEHPNDAIVRVTKAAICGSDLHLYHGMMPDTRVGTTFGHEFIGVVEKVGPSVQNLSVGDRVMVPFNIFCGSCYFCARGLYSNCHNVNPNATAVGGIYGYSHTCGGYDGGQAEFVRVPFADVGPSIIPDRLDDEDALLLTDALATGYFGAQLGNIAEGDTVVVFGAGPVGLFAAKSAWLMGAGRVIVIDHLEYRLEKARTFAHAETINFVDCDDIVVKMKRTTDHLGADVAIDAAGAEADGNFLQHVTATKLKLQGGSPIALNWAIDSVRKGGTVSVVGAYGPMFSAVKFGDAFNKGLTLRMNQCPVKREWPRLLSHIKNGYLKPNDIVTHRIPLEHIAEGYHIFSAKLDDCIKPIIVPTAS

SEQ ID NO: 52280 - protein, 515 aa, Crocosphaera watsonii WH 8501
MNPPVTMKETHQRRLLANRYQLIDMVGSGAMGQVYRAEDKLLGGVTVAVKFLSQALLNSKMRDRFEREATVSALLGEKSNHIVRVRDYGVDEKEIPFYVMEFLKGESLSNVIKFRPLNLERFLKIVRQICFGLECAHKGIMFEGEMCPIIHRDIKPSNVLVVQDPALGELVKILDFGIAKLIQSGEAQTQSFMGTLAYCSPEQIEGKELDSRSDIYSLGVMMYEMLTGEMPIFPENSSFGGWYEAHHYAKPKPIPAKFRLPSDLESLIFQCMAKAPGERPQTATDILKKLEKLESSPAESEQETLVAKPKPRTDKAIKSTKPTFRKTSPKGDDICLKMTWPEDKPQQKIVFPHVVRASEGNFASLWVMLNEEDIANRLSSIRYNQFVFITNPHPMILWITLLYHREHGPRWLPCYLDLKSSSGQRFARLLGESGYYWILFFALEKGKKCQHVLTTSIAADQCQNLQQWADKSQLLPGGKPQITKRMLKKEFEKLKPTIENKLKASYTTSRNGSSL

SEQ ID NO: 52281 - protein, 504 aa, Vitis vinifera
MRNKLFSFIALFSWKPKWRDKAALSDPFLADLEELSDNEADLAVNDMGVGNMEEDDDGEMADIEALNYDDLDSVSKLQKTQRYIDIMQKVEDALEKGSDMSNHGIVLEDDPEYQLIVDCNALSVDIENEIVIIHNFIRDNYRLKFPELESLVHHPIDYARVVKKIGNEMDLTLVDLEGLLPSAIIMVVSVTASTTSGKPLPEENLKKTVDACDRALALDLAKKKVLDFVESRMGYIAPNLSAIVGSAVAAKLMGTAGGLTALAKMPACNVQLLGAKKKNLAGFSTATSQFRVGYIEQTEIFQSTPPSLRMRACRLLAAKSTLSARVDSTRGDPTGKTGRTLREEILKKIEKWQEPPPAKQPKPLPVPDSEPKKKRGGRRLRKMKERYAITDMRKLANRMQFGVPEESSLGDGLGEGYGMLGQAGNGKLRVSVGQSKLAAKVAKKFKEKQYGSSGATSGLTSSLAFTPVQGIELSNPQAHANQLGSGTQSTYFSEIGTFSKIKRT

SEQ ID NO: 52282 - protein, 336 aa, Streptococcus suis
MVVKVGINGFGRIGRLAFRRIQNVEGVEVTRINDLTDPVMLAHLLKYDTTQGRFDGTVEVKDGGFEVNGKFVKVSAEREPGNIDWATDGVDIVLEATGFFASKEKAEQHIHANGAKKVVVTAPGGNDVKTVVFNTNHDILDGTETVISGASCTTNCLAPMAKALHDAFGVQKGLMTTIHGYTGDQMVLDGPHRGGDLRRARAAAANIVPNSTGAAKAIGLVIPELNGKLDGAAQRVPVPTGSVTELVATLDKKVTAEEVNAAMKAAATESFGYTEDQLVSSDIVGISFGSLFDATQTKVIEVDGEQLVKVVSWYDNEMSYTAQLVRTLEYFAKIAK

SEQ ID NO: 52283 - protein, 201 aa, Oryza sativa Japonica Group
MEAGEEIEDGEPSTPTYKAHHPPPHLPPPMRSSGVSLVLSVADLVLRFVAIGGTAGSAIAMATTSETLPFAAPFVRFRAEYSDLPTLMFFVVASSVVCAYLVLSLPASVVHVVRPGARSSRAILAFLDTVMLALLTASASAAAAIVYLAHRGSARANWLGICQQFTSFCQRITASLVGSFAAAVVLVALVFLSALSLARRA

SEQ ID NO: 52284 - protein, 711 aa, Vitis vinifera
MALCTLSFPAHFSQAAASNPQRLTPQCSHLFLGVDLQCQSQQRSKARKRPNGRPPTPLLDTINYPIHMKNLSVKELKQLADELRSDVVFNVSKTGGHLGSSLGVVELTVALHYVFNAPQDRILWDVGHQSYPHKILTGRRDQMHTMRQTDGLAGFTKRSESEYDCFGTGHSSTTISAGLGMAVGRDLKGKNNNVIAVIGDGAMTAGQAYEAMNNAGYLDSDMIVILNDNKQVSLPTATLDGPIPPVGALSSALSRLQSNRPLRELREVAKGVTKQIGGPMHELAAKVDEYARGMISGSGSTLFEELGLYYIGPVDGHNIDDLVAILKEVKSTKTTGPVLIHVVTEKGRGYPYAEKAADKYHGVTKFDPATGKQFKSSAPTQSYTTYFAEALIAEAEVDKDIVAIHAAMGGGTGLNLFHRRFPTRCFDVGIAEQHAVTFAAGLACEGIKPFCAIYSSFMQRAYDQACQSYYHIFLIKCYDLQKLPVKFAMDRAGLVGADGPTHCGAFDVTFMACLPNMVVMAPADEAELFHMVATAAAIDDRPSCFRYPRGNGVGVELPPGNKGIPIEVGRGRILIEGERVALLGYGTAVQSCLVASSLLEQHGLRITVADARFCKPLDHALIRSLAKSHEVLITVEEGSIGGFGSHVAQFLALNGLLDGTTKWSPMVLPDRYIDHGAPADQLAMAGLTPSHIAATVFNILGQTREALEIML

SEQ ID NO: 52285 - protein, 181 aa, Magnetospirillum magnetotacticum MS-1
MDLKKIPIGKNPPRDVNVVIEIPLRGDPVKYEICKESGAMFVDRFLNTAMYYPVNYGFVPHTLSADGDPVDVMVVGRIPVAVGSVMRSRPIGVLLMEDEAGMDEKILAVPHAKLHPFYDGVNSYEDLPKILVQQIEHFFVHYKDLEVGKWVQLKGWGGPERAGQIIQESIDRAIAAKPKKK

SEQ ID NO: 52286 - protein, 336 aa, Streptococcus suis
MVVKVGINGFGRIGRLAFRRIQNVEGVEVTRINDLTDPVMLAHLLKYDTTQGRFDGTVEVKDGGFEVNGKFVKVSAEREPGNIDWATDGVDIVLEATGFFASKEKAEQHIHANGAKKVVVTAPGGNDVKTVVFNTNHDILDGTETVISGASCTTNCLAPMAKALHDAFGVQKGLMTTIHGYTGDQMVLDGPHRGGDLRRARAAAADIVPNSTGAAKAIGLVIPELNGKLDGAAQRVPVPTGSVTELVATLDKKVTAEEVNAAMKAAATESFGYTEDQLVSSDIVGISFGSLFDATQTKVIEVDGEQLVKVVSWYDNEMSYTAQLVRTLEYFAKIAK

SEQ ID NO: 52287 - protein, 426 aa, Helicobacter pylori 26695
MLTIKDIHALEVMDSRGNPTIQASVVLSDNTKASAIVPSGASTGKREALELRDNDKTRFLGKGVLRACENVNSVIKHHLIGLEAINQAFVDERLRALDGTPNYANLGANAVLGVSMALARASAKALNLPLYRYLGGANALTLPVPMLNIINGGTHANNSIDFQEYMIMPLGFESFKEALRASAEVYHTLKKLLDGKNQLTSVGDEGGFAPNFSNNVEPLEVISQAIEKAGYKLGEEIALALDVASSELVDENFNYHLKGENKILDSHELVAYYKELVAKYPIVSIEDGLSEDDWEGWAFLSKELGRQIQLVGDDLFVTNASLLQKGIEKNIANAVLIKPNQIGTISETLETIRLAKHHAYQCVMSHRSGESEDSFIADFAVALNTGEIKTGSTARSERIAKYNRLLEIEHELKGGIYIGKELFKHG

SEQ ID NO: 52288 - protein, 486 aa, Vibrio campbellii AND4
MDMKAHYIDGAMHLGCSEEHFTTYNPANGEPLANVKQANQQDMQAAIESAKRGFAIWSAMTATERSRILLKAVALLRERNDELAALEVVDTGKPIQEANCVDIVTGADVIEYYAGLAPSMHGEQQPLNESQFFYTRREPLGICAGIGAWNYPIQIAMWKSAPALAAGNAMIFKPSEETPLTALKLAEIYSEAGLPDGVFNVIQGDYRVGQMLTAHPDIAKVSFTGESGTGKVVMGDSATTLKQVTMELGGKSPMIIFDDAKLDDAVSAAMVANFYTQGEVCTHGTRVFVHEGIYDEFVAQLKTRTELLVVGDPLDEQTQIGALISKEHESKVLSAIEQAKASKATLLAGGYKVTENGLASGNFVVPTVFIDCEDDMPHVQQEIFGPVMSVLKFSEEDEVIARANNTDYGLAAGVFTQNLSRAHRVIHQIQAGICWINTWGDSPAEMPVGGYKLSGIGRENGVETLKHYTQTKSVLVHLGDFDSPYA

SEQ ID NO: 52289 - protein, 428 aa, Lactobacillus johnsonii
MTVYVEKVRALEIFDSRGNPTVEVHAYLSDGTVAKAEVPSGASTGEKEAVELRDGGKRLQGKGVTQAVANVNGPINDALKGLSPYNQAEIDRTMIKLDGTQNKAKLGANAILGTSMAIARAAARSKDEPLYRYLGGCDLEMPQTFHNVINGGKHADNGIDIQEFMITPVAKNSFRDGFEKIVNTYHALKAVIEEAGFETGLGDEGGFAPNLKSSEEALKMLRTAIIKAGYKPGEDIAIAFDAAASSFYNTEDGKYHFEGHIWNGEEMLQYYDKLLKEFPEIISCEDPFDENDWENFEKFTAKFGSTHQVVADDNVCTNPKLVRKAIKDKLCNSILIKLNQIGTITETLETIRLARKNNMTTMVSHRSGETGDTFIADFTVATNAGQLKSGAPARSERVEKYNRLLEIENQIGVENERLNHFPNNVDFD

SEQ ID NO: 52290 - protein, 347 aa, Streptomyces avermitilis MA-4680
MRATTIHAPYDMRVEDVPEPVVRQPTDAVVRVLRACICGSDLWAYRGEAARQPGQRIGHEFLGIVEETGSEVTGVRRGDLVVAPFMWSDGVCDYCREGLTTSCEHGGFWGSVGHDGGQGEAVRVPYADGTLVQLPKDAASDEHLLSALLTLSDVMGTGHHAALGAGARPGATVAVVGDGAVGLCAVLAAKRLGAERIIALGRHEVRTDIARRFGATDVVAERGEAAVEAVRELTRGQGAHCVVEAVGTEQSMRTAVDITRDGGAIGFVGVPHGSGTGLDLGVMFDRNIALRGGVAPVRAYIPELLPDILAGRIDPSPVFDRTVDLEGVPEGYKAMDERTALKVLVTN

SEQ ID NO: 52291 - protein, 474 aa, Physcomitrella patens subsp. patens
MYFSPKPKGILTWLAGDEPSNAPALHEPMPRVHLPPQLCTEMKPGGTKMTKLKNGVRIASENSHSPISTVGVYIDSGSVHESPNVAGVSHLLERMAFKSTSNRSHFRLVRDVEAIGGHVMANASREQMSCTADSIKTYMPHMVELLVDCVRNSMCYNSEVHDQLVRVKAETGEIVNNPQRILLEALHSAGYAGALGQPLLAPEASLHKLNEEVLCNFVSQNYTAGRIALAASGCDHDELLQIAEPLLSDMCGSGPPTPPATEYVGGDWRQAAESPKTNIALAFEIPGGWRNEKDSFAVTVLQTLLGGGGSFSAGGPGKGMYSRLYSQVLNKYEQVQSFTAFNCIYNQPGIFCIHATSGSEFVPHLVDLATKEFIAVATPGEVTEAEIQRAKNMTISAVLMNLESSVVVTEDIGRQILTYGNRKPVAEFIHGVQSLTLADLSRVAQKIIFTPLTMASWGDVTQVPRYDQVANRFS

SEQ ID NO: 52292 - protein, 147 aa, Pfiesteria piscicida
MALRRIQKELADLGNDPPANCSAGPTGEDMFSWSATIMGPHDSAYQGGVFFLNIHFPTDYPFKPPKVAFTTKIYHCNVNANGAICLDILKDQWSPALTISKVPLSISSLLTDPNPNDPLVPEIAQVYLKDRKKHDQTAREWVQKYAV

SEQ ID NO: 52293 - protein, 368 aa, Pseudomonas aeruginosa PAO1
MSNPTSTPRADGFRMPAEWEPHEQTWMVWPERPDNWRNGGKPAQAAFAAVAKAIARFEPVTVCASAGQYENARARLDDGNIRVVEISSDDAWVRDTGPTFVIDDKGDVRGVDWGFNAWGGFEGGLYFPWQRDDQVARKILEIERRARYRTDDFVLEGGSIHVDGEGTLITTEECLLNHNRNPHLSQAEIERTLRDYLAVESIIWLPNGLYNDETDGHVDNFCCYARPGEVLLAWTDDQDDPNYLRCQAALRVLEESRDAKGRKLVVHKMPIPGPLYATQEECDGVDIVEGSQPRDPSIRLAGSYVNFLIVNGGIIAPSFDDPKDAEARAILQRVFPEHEVVMVPGREILLGGGNIHCITQQQPAPRKA

SEQ ID NO: 52294 - protein, 336 aa, Streptococcus suis
MVVKVGITGFERIGRLAFRRIQNVEGVEVTRINDLTDPVMLAHLLKYDTTQGRFDGTVEVKDGGFEVNGKFVKVSAERKPGNIDWATDGVDIVLEATGFFASKEKAEQHIHANGAKKVVITAPGGNDVKTVVFNTNHDILDGTETVISGASCTTNCLAPMAKALHDAFGVQKGLMTTIHGYTGDQMVLDGPHRGGDLRRARAAAANIVPNSTGAAKAIGLVIPELNGKLDGAAQRVPVPTGSVTELVATLDKKVTAEEVNAAMKAAATESFGYTEDQLVSSDIVGISFGSLFDATQTKVIEVDGEQLVKVVSWYDNEMSYTAQLVRTLEYFAKIAK

SEQ ID NO: 52295 - protein, 345 aa, Xanthomonas oryzae pv. oryzae KACC10331
MIAPMSDSTHKIAVIGAGSWGTALAALLARHGHPTVLWGRDAAMVDTIDRTHENARYLPGIALPDSLRATTDLQAAVADAAWILVVVPSHAFTETIRLIAPLRPACPGVAWATKGFEPGSGRFLHEVARDILGPSVPLAVVTGPSFAKEVTLGLPTAITVHGDDATFAQAVADAMHGPTFRAYTGDDMVGAELGGAMKNVLAVATGVADGMQLGLNARAGLITRGLNEMLRLAAAIGARPETLMGLAGLGDLVLTCTGDLSRNRRLGLALGRGQSLNDAIRQIGQVVESVQMADEVMRQAEHHGIELPISNAVRAVLHGEITPEAGLKELLARERKPEYPQTLFT

SEQ ID NO: 52296 - protein, 455 aa, Bacteroides fragilis NCTC 9343
MARFEIKMPKLGESITEGTILSWSVQVGDVVNEDDVLFEVNTAKVSAEIPSPVAGKVVEILFKEGDTVPVGTVVAIVDMDGEGSGEASETAGSVETASAPKAAEVSDTASVPKVQAEVAAPKVERWYSPAVLQLAREAKISQEELDSIPGTGYEGRLSKKDIRTYIEMKKGAPAADVSTTVVSTVLANNSGSSPVPSAEVQKKAAAAAPQAQHGQSASAVSSDASVEVKEMDRVRRIIADHMVMSKKVSPHVTNVVEVDVTRLVRWREKTKDAFFRREGVKLTYMPAIAEATAQALAAYPQVNVSVDGYNILYKKHINVGIAVSQDDGNLIVPVVHDADRLNLNGLAVAIDSLAKKARVNKLMPDDIDGGTFTITNFGTFKMLFGTPIINQPQVAILGVGVIEKKPAVVETPEGDVIAIRHKMYLSLSYDHRVVDGSLGGNFLHFIADYLENWKE

SEQ ID NO: 52297 - protein, 172 aa, Pediococcus pentosaceus ATCC 25745
MTLDLHDYVASIQDFPEKGVTFRDISPLMENGEAYRQATNAIIKFARDKGVEMIVGPEARGFIVGCPVAYEMGIGFAPARKKGKLPRETVKATYGLEYGKSELYLQKDAIKPGQKVLITDDLLATGGTIAATIELVEKLGGIVVGTAFFIELKDLNGREKIKDYDTLSLMEY

SEQ ID NO: 52298 - protein, 652 aa, Arabidopsis thaliana
MDSEGVLMPLIHKHRMMPWNDLRRGDCCGRFESICDGYYCKICDIFVHKKCGESSEYIEHPSHPNHTLQLLSTRGNSHDCDLCGKNIGDLFYRCEICDFDMDLYCAKYPPPEVINISKTHHHKLNLLKELIQFDYCVWHPPEVNHTLEVNHSYHSLHPLKLHTGQLPNYSDRKCRLCAKEIEVGLFYHCSLCNFTLDMSCVLNPPQRYLWNLKAHDHQLTLLPSLRSFLCSACGLNGDRSPYICVQCDFMIHQVCLHLPRVININRHDHRVSRTSVLGVVNSVCGVCRQKVDWTCGGFSCPRCPGYAAHSLCATREDVWNGKELEGVPEEIEDIEPYVVIDDNTIQHFSHKEHYLRLHVNSVLCDDNKRCSACTHPICLQSFYGCMDCDFILHQNCAGFLRMKWHVLHNERLTLVTNETEVFKCYACERWSNGFRYQQGYKSFDVRCGSISEPFFHPSHPDHPLYCILPYGKIFCNGCYKFKYGMLVCVEYECNHLICFNCATLPPVVKHRVDDHPLSLCYGEKASGICWCDICEAKADPEIWFYTCKDQRASLHTSCVLGDFSGLMPGSTLKSASNSSEVLLNNIVSRPFCSFLELMPGSTLESAGKSVEVGLNKSTSRPFCISCKLHCIFPIILKRLGTSDEYFCSILCI

SEQ ID NO: 52299 - protein, 475 aa, Rubrobacter xylanophilus DSM 9941
MGDPKGFLKIGRKPVPKRPVEERVRDYRWVYEPMPEGELRRQASRCMDCGVPFCNTGCPLANLIPDWNDLVYRDHWREAIDRLHATNNFPEFTGILCPAPCEAACVLSINDRPVTIKEIERSIIERAFEEGWVVPKPPPPERRTGKRVAVVGSGPAGLAAAQQLNRAGHSVVVFEKDDRPGGLLRYGIPDFKMEKWVIDRRLRQLEEEGIEFRTGAYVGYDPTAEELRRGFDAVVLAVGALQGRDLPVPGRELRGIHLAMEYLVQQNRRVAGLPVEGEEITARGKHVIILGGGDTSADCLGNVHREGCASVRVLTHGPKPPESPDPLEWPDWPFVLHTYPAHEEGGERGWNVAVTGFSGEGGRVRRMHCVRTRRDPDGRTHHLPGTEFELEADLVLLAIGFTGPVRDRLLEELGVEFGPRGAIATREGFDTGIPGVFVAGDARRGADLIVTAIAEGRKAARQVDAYLMGRSLLPG

SEQ ID NO: 52300 - protein, 479 aa, Kineococcus radiotolerans SRS30216
MYDPATGKRTKRVVLADPADVDAAVAAAKAAFPAWRDTSLARRTAVLFRFRELLNERKGELAEIITAEHGKVLSDALGEVSRGQEVVELACGINHLLKGAFSENASTGIDVYSVRQPLGVVAVISPFNFPAMVPMWFFPVAVAAGNAVVLKPSEKDPSAANFIAQLWKDAGLPDGVFNVLHGDKVAVDGLLAHPDVASVSFVGSTPIAKYVYETATAHGKRVQALGGAKNHMLVLPDADLDLAADAAVNAGFGSAGERCMAVSALVAVDSVADELVARIRQRVATLRTGDGRRGCDMGPLVTGAHRDKVAGYVEAGVREGAELVIDGREVVPDAQDDEAAADGFWLGPTLFDRVDPGMSIYTDEIFGPVLSVVRVAGYDEGLDLINRNRYGNGVAIFTNDGGAARKFRNEVQVGMIGVNVPVPVPVAYFSFGGWKQSLFGDTHAHGVEGVHFFTRGKVVTERWLDPSHGGLNLGFPQND

SEQ ID NO: 52301 - protein, 336 aa, Neurospora crassa
MARVYADVNQNMPRAYWDYDSVNISWGVLENYEVVRKIGRGKYSEVFEGINVVNYQKCVIKVLKPVKKKKIKREIKILQNLAGGPNIVALLDVVRDSQSKTPSLIFEYVNNTEFRTLYPRFNDFDVRYYIFELLKALDFCHSKGIMHRDVKPHNVMIDHENRKLRLIDWGLAEFYHPGTEYNVRVASRYFKGPELLVDFQEYDYSLDMWSLGAMFASMIFRKEPFFHGQSNSDQLVKIAKVLGTDELFDYLDKYEIELDAQYDDILGRFQRKPWHSFINAENQRFVSNEAIDFLDKLLRYDHNERLTAKEAMAHPYFAPVRDEATRARYLAGETIN

SEQ ID NO: 52302 - protein, 405 aa, Thermoplasma acidophilum DSM 1728
MAYIQVKEDGTLQVPDRVTIGYIEGDGIGPDISKTTINVLNAALDIAYGGKRSIEWKKILAGDEAYDKTGDRLPQSSLDELKKCVVSLKGPLTTPIGEGFRSLNVTLRQYLDLYANIRPVRYFPGVPSPVVHPEYMNMVVFRENTEDLYAGIEWRYDSDGAKKVREFLASTFNINLTSDTGIGIKPISKFKSTRLVRKAIQYAIANKRKSVTLVHKGNIMKYTEGAFKEWGYEVAKTEFGNYTVTETEYLQDPEKYSNKIVIKDRITDNMFQQVLTRTQEYDVIATPNLNGDYLSDALAAQVGGIGLAPGANIGDHYAVFEAVHGTAPKYAGMDVANPTSLILSGEMMLQHIGWNEAANILDEAIMQTYRDQKLTQDIARLLNVKALKCSEFGEEIINRMKKPVH

SEQ ID NO: 52303 - protein, 298 aa, Escherichia coli W3110
MIRVACVGITVMDRIYYVEGLPTESGKYVARNYTEVGGGPAATAAVAAARLGAQVDFIGRVGDDDTGNSLLAELESWGVNTRYTKRYNQAKSSQSAIMVDTKGERIIINYPSPDLLPDAEWLEEIDFSQWDVVLADVRWHDGAKKAFTLARQAGVMTVLDGDITPQDISELVALSDHAAFSEPGLARLTGVKEMASALKQAQTLTNGHVYVTQGSAGCDWLENGGRQHQPAFKVDVVDTTGAGDVFHGALAVALATSGDLAESVRFASGVAALKCTRPGGRAGIPDCDQTRSFLSLFV

SEQ ID NO: 52304 - protein, 485 aa, Pseudomonas putida
MPDVRGALLIGGKARAASDGGTFERRHPVSGEVVSVVAAATLADADAAVEAAQAAFPAWAALGPGERRARLLKAADALDARRDEFLAMAGETGAKANWYGFNVMLAANILREAASMTTQIQGSVIPSDVPGSFAMALRQPCGVVLGIAPWNAPVILATRAIAMPLACGNTVVLKASEASPAVHGLIGQVLQAAGLGDGVVNVICNAPHDAPAVVERLIAHPAVRRVNFTGSTHVGRIVGQLAARHLKPAVLELGGKAPFLVLADADLEAAAVDAAAFGAYFNQGQICMSTERLIVDQAVADEFVAKLGEKVRRLRAADPSQPDAPLGSLIDAGAGERIQALVDDAVGKGATLVAGGERTGSVMQPVLLDHVNAGMRLYREESFGPVAVVLRASGDEALLALANDSEFGLSAAIFSRDTQRALALAQRLESGICHINGPTVHDEAQMPFGGVKASGYGSFGSTAAIDAFTQLRWVTVQHGARHYPI

SEQ ID NO: 52305 - protein, 163 aa, Platanus x acerifolia
TADAVRQYLWLFEEHNVMEFLVLAGDHLYRMDYERFIQAHRETDADITVATLPMDEKRATAFGLMKIDEEGRIIEFSEKPKGEQLKAMKVDTTILGLDDERAKEMPYIASMGIYVVSKDVMLKLLREKFPGANDFGSEVIPGATSIGMRVQAYLYDGYWEDIG

SEQ ID NO: 52306 - protein, 208 aa, Wolbachia endosymbiont of Drosophila melanogaster
MTLIPIVVEQTSRGERAYDIYSRLVKERIIFVTGPIEDNMASVIVAQLLFLESENPNKDICMYINSPGGVVTAGLSIYDTMQYINPDVSTLCIGQAASMGSLLLAAGTKGKRYSLPHSRIMIHQPSGGYHGQATDIEIHANEILRVKKKLNQIYEKHTGNSLKKIEGMMERDKFMDPEEARKIGLIDRVIAERTDIEIENIKVKQKVG

SEQ ID NO: 52307 - protein, 482 aa, Pseudomonas fluorescens
MLDVPLLIGGQSRPARDGRTLERRNPVTGAVVSRVAAATLDDADAAVAAAQAAFPAWAALAPNERRSRLLKAAEQLQARSGEFIAAAGETGAMANWYGFNVRLAANMLREAASMTTQINGEVIPSDVPGSFAMALRQPCGVVLGIAPWNAPVILATRAIAMPLACGNTVVLKASELSPAVHRLIGQVLQDAGLGDGVVNVISNAPVDAAAIVERLIANPAVRRVNFTGSTHVGRIVGELAARHLKPALLELGGKAPLLVLDDADLDAAVAAAAFGAYFNQGQICMSTERLIVDAKVADAFVAKLAAKVATLRAGDPSAADSVLGSLVDVSAGTRIKALIDDALSKGARLVVGGQLDGSILQPTLLDGVTESMRLYREESFGPVAVLLRGSGDEELLRLANDSEFGLSAAIFSRDTGRALALAQRVESGICHINGPTVHDEAQMPFGGVKSSGYGSFGGKASIEHFTQLRWVTLQHGPRHYPI

SEQ ID NO: 52308 - protein, 540 aa, Chlamydia trachomatis
MSSEVKSFSKFRGYFFPIYRSEFSKFIPLFFLAFFVGVNYALLKTTKDSLVLVGSRAGAEVIPFLKVWGIVPGAVIVTMIYGWMSRRYSRGTVFISLVGGFLGFFALFATVIYPIGDALHLNKLAAKLQSILPPGGRGFVVMVQYWSYSLYYVMSELWSSVVLSTLFWGVANHITSVREAGRFYALINTGLNLSSVFAGEVSLWLGRSPVIAFPMAVDPWHEMLLNITLLIVLAGGVILYLYQKLDRLMDETSMLEEGLAAEMSVAQLKKEKKRSKAKAKSLFALLLRSRYLLGIAVVVLSYNLVIHLFEVVWKDQVCRIYASRVEFNSYMSRITTLTGIVSALAGIFAAGQTIRRWGWTVGALVPPLTILITGALFFGAIYAVKGDAMIFGGILGISPLVLTAWLGGVQNVFSRAIKFTYFDQTKEMAFIPLEDDEKNYGKAAIDGVISRVGKSGGSLVYQGLLIIFSSVAASLNAITIVLLLALGSWIFVIAWLGREYTAKTETLVRVNASEEDVLQEEREASSLVDAESREEPVTTL

SEQ ID NO: 52309 - protein, 774 aa, Mesorhizobium loti MAFF303099
MEGENKKTARSDLDEAALYFHKHPTPGKLEIQATKPLGNQRDLALAYSPGVAAPCLEIRDNPATAADYTARANLVGVVSNGSAVLGLGNIGPLASKPVMEGKAVLFKKFAGIDVFDIEIDAPEIERMVETVAALEPTFGGINLEDIKAPECFEVEERLKARMSIPVFHDDQHGTAIIVAAAVLNGLEFAGKTISDIKVVTSGAGAAALACLNLLVSLGVRIENIWVTDRFGVAYKGRTEEMDRWKDPYVKDTEARTLADVIPGADVFLGLSAAGVLKPELLQHMAPKPLILALANPNPEIMPEVARAARPDAMICTGRSDFPNQVNNVLCFPYIFRGALDCGASAINEEMKMAAVRAIAALAREEPSDVAARAYSGETPIFGPDFLIPSPFDPRLILRIAPAVAKAACDTGVATRPITDFAAYIDKLNRFVFRSGLVMKPVFSSAKASSAKRVIYADGEDERVLRAAQVVLEEGIAEPILIGRPHVIEVRLKRYGLRIKPGVDFGLINPEDDPRYRHYVDLLIELAGRRGVTTEAARTMVRTDNTVIAALALKRGDADAMVCGLEGRFERHLRNVTLIIGPRAGIKDYDLSTLSMLISQRGIIFLTDTHVSVDPTAEEIAEMTVLAAEEIQRFGIEPKAALLSHSDFGSRDSPSALKMRQAAAILARIAPELQCDGEMHADSALSEHLRQRVYPHSRLKGEANLLVFPNLDSANITLTALRAMMDALHVGPILLGTDKPAHILTPSVTSRGVVNMTALAVVEAAHKAQAIANLD

SEQ ID NO: 52310 - protein, 250 aa, Hordeum vulgare subsp. vulgare
MPVSRIAVGSHREVYEVGALKAALAEFISTLIFVFAGQGSGMAFSKLSPDGVATPAGLISAAIAHAFALFVAVSVGANISGGHVNPAVTFGAFVGGNITLFRGLLYWVAQLLGSTAACFLLRFSTGGLPTGTFGLTGIGAWEAVVLEIVMTFGLVYTVYATAVDPKKGSLGTIAPIAIGFIVGANILVGGAFSGASMNPAVSFGPALVSWEWGYQWVYWVGPLIGGGLAGVIYELLFISRTHEQLPTTDY

SEQ ID NO: 52311 - protein, 411 aa, Oryza sativa Japonica Group
MALYSTDSKKVGFLSFLNFFHNSTAFSNLIGCCLFILPSYLVGHYIEHHHLVSPFIPENQYICCISSIIKPGLSSSVAHLLVCLSSCLQQTMDADRDPIFPVQQMPSLLFPPPPPRPLALDSTSSASSSFVPHHPSITSFPILVLTVLGILTTSVLLLTYYIFVIRCCLNWNSSSSSDTRTAGLISRRRRGAASSSLPAVAEPRGLEEAAIQSLPAFRYRKAIKDTTADSSECAVCISEFQEEERVRLLPSCLHVFHVDCIDTWLQGNANCPLCRAAIATNDSQLPLDQFVRPEVVVIQVITGAEEEGAQAPQQEANTAASDPAVDATSTNQQVSSKKTKNQNAWHVSISKGDECIAVRRDRNVLPLRRSFSMDSLGGAGEVHLQIQNILQRSTHFHRDISDSSSSSTGTL

SEQ ID NO: 52312 - protein, 319 aa, Oryza barthii
QLSPAIAQLQHLTKLSISMNSISGSLPPDLGSLKNLELLDIKMNTFNGSIPATFGNLSCLLHFDASQNNLTGSIFPGITSLTNLLTLDLSSNSFEGTIPREIGQLENLELLILGKNDLTGRIPQEIGSLKQLKLLHLEECQFTGKIPWSISGLSSLTELDISDNNFDAELPSSMGELGNLTQLIAKNAGLSGNMPKELGNCKKLTVINLSFNALIGPIPEEFADLEAIVSFFVEGNKLSGRVPDWIQKWKNARSIRLGQNKFSGPLPVLPLQHLLSFAAESNLLSGSIPSHICQANSLHSLLLHHNNLTGTIDEALKGA

SEQ ID NO: 52313 - protein, 458 aa, Pseudomonas aeruginosa PAO1
MSVPQRAVQLTEPSEFLKEHPEVQFVDLLIADMNGVVRGKRIERNSLNKVFEKGINLPASLFALDITGSTVESTGLGLDIGDADRICYPIPGTLSMEPWQKRPTAQLLMTMHELEGEPFFADPREVLRQVVARFTEMELTIVAAFELEFYLIDQENVNGRPQPPRSPISGKRPQSVQVYSIDDLDEYVECLQDIIDGARAQGIPADAIVAESAPAQFEVNLNHVNDALKACDHAVLLKRLVKNIAYDHEMDTTFMAKPYPGQAGNGLHVHISLLDKHGNNIFTSEDPEQNAALRHAIGGVLETLPASMAFLCPNVNSYRRFGSQFYVPNAPSWGLDNRTVALRVPTGSPDAVRLEHRVAGADANPYLLLAAVLAGVHHGLTNKVEPGAPIEGNSYEQMEPSLPNNLRDALRELDESEIMAKYIDPKYIDIFVACKESELEEFEHSISDLEYNWYLHTV

SEQ ID NO: 52314 - protein, 319 aa, Oryza meridionalis
QLSPAIAQLQRLTKLSISMNSISGSLPPELGSLKNLELLDIKMNTFNGSIPATFGNLSCLLHFDASQNNLTGSIFPGITSLTNLLTLDLSSNNFVGTIPREIGQLESLELLILGKNDLTGSIPQEIGSLKQLKLLHLEECQFTGTIPWSISGLRSLTELDISDNNFDAELPSSMGELGNLTQLIAKNAGLSGNMPKELGNCKKLTVINLSFNALVGPIPEEFADLEAIVSFFVEGNKLSGRVPDWIQKWKNARSIRLGQNKFSGPLPVLPLQHLLSFAAESNLLSGSIPSHICQANSLHSLLLHHNNLTGTIDEALKGA

SEQ ID NO: 52315 - protein, 456 aa, Pseudomonas aeruginosa PAO1
MNSQITNAKTREWQALSRDHHLPPFTDYKQLNEKGARIITKAEGVYIWDSEGNKILDAMAGLWCVNVGYGREELVQAATRQMRELPFYNLFFQTAHPPVVELAKAIADVAPEGMNHVFFTGSGSEANDTVLRMVRHYWATKGQPQKKVVIGRWNGYHGSTVAGVSLGGMKALHEQGDFPIPGIVHIAQPYWYGEGGDMSPDEFGVWAAEQLEKKILEVGEENVAAFIAEPIQGAGGVIVPPDTYWPKIREILAKYDILFIADEVICGFGRTGEWFGSQYYGNAPDLMPIAKGLTSGYIPMGGVVVRDEIVEVLNQGGEFYHGFTYSGHPVAAAVALENIRILREEKIIEKVKAETAPYLQKRWQELADHPLVGEARGVGMVAALELVKNKKTRERFTDKGVGMLCREHCFRNGLIMRAVGDTMIISPPLVIDPSQIDELITLARKCLDQTAAAVLA

SEQ ID NO: 52316 - protein, 440 aa, Staphylococcus aureus subsp. aureus COL
MSNGKELQKNIGFFSAFAIVMGTVIGSGVFFKISNVTEVTGTAGMALFVWFLGGIITICAGLTAAELAAAIPETGGLTKYIEYTYGDFWGFLSGWAQSFIYFPANVAALSIVFATQLINLFHLSIGSLIPIAIASALSIVLINFLGSKAGGILQSVTLVIKLIPIIVIVIFGIFQSGDITFSLIPTTGNSGNGFFTAIGSGLLATMFAYDGWIHVGNVAGELKNPKRDLPLAISVGIGCIMAVYLLINATFLLTLPIELLAGNLNAASDTSKILFGENGGKIITIGILISVYGTINGYTMTGMRVPYAMAERKLLPFSHLFAKLTKSGAPWFGAIIQLIIAIIMMSMGAFDTITNMLIFVIWLFYCMSFVAVIILRKREPNMERPYKVPLYPIIPLIAILAGSFVLINTLFTQFILAIIGILITALGIPVYYYKKKQKAS

SEQ ID NO: 52317 - protein, 392 aa, Sulfitobacter sp. EE-36
MLDALAALPEDPIWGLTSAFRADPRSHKIDMVIGVYRDDNGATPNMKAVRMAERALAQDSAPKTYRALAGNAVFNAGMARLVLGDAPARIARSHVIQTVGGTGALRVLGDMLASLRPDTTVWSTDPGYVNHRPIFEGAGLTLQLYRWQAKGDALDLDRVLADLAAAKPGDVVLLHGCCHNPTGIDPDANMWHALARFCAARGLIPLIDIAYQGFGRGLDEDAAGLRVMVDAVPVAMVAASGSKNMGLYCERIGAAMVLGPDAASIAHVGRHLETLTRANYSMPPEHGAAVACHVFDTRTIWEEELNSMRARVQSLRQQLADALAAIDAAPAFQALRHHRGMFSLLPLAPDQMESLRRDHAIYGTATGRINIAGLRSTQIEQVAAALREVSQA

SEQ ID NO: 52318 - protein, 961 aa, Vitis vinifera
MMMRSSSDVHTQTLFNGKYVNQIDLLRDNRPPSLRLSRCGRRVRLTRCQDSSSAFKPKRWEPPLGSLSRAQAILTPVSDTTPTTKKRVFTFGKGRSEGNKGMKSLLGGKGANLAEMASIGLSVPPGLTISTEACQEYQQNGKKLPEGLWEEILEGLESVEKEMGAFLGDPSKPLLLSVRSGAAISMPGMMDTVLNLGLNDEVVAGLAAKSGERFAYDSYRRFLDMFGDVVMGIPHSSFEEKLEKLKDAKGVNRDTGLTAAHLKELVEMYKNVYLEAKGERFPSDPKKQLELAVKAVFDSWDSPRAIKYRSINQITGLKGTAVNIQCMVFGNMGNTSGTGVLFTRNPSTGEKKLYGEFLLNAQGEDVVAGIRTPEDLDTMKNCMPEAFKELVENCEILERHYKDMMDIEFTVQENRLWMLQCRSGKRTGKGAVKIAVDLVNEGLIDTRTAIKMVEPQHLDQLLHPQFEAPAAYKEKVVATGLPASPGAAVGQVVFSAEDAEAWHAQGKSVILVRTETSPEDIGGMHAAVGILTARGGMTSHAAVVARGWGKCCVSGCSDIRVNDTEKVVVVGDKVIKEDDWISLNGSTGEVILGKQALAPPALSGDLEIFMSWADQIRHLKVMANADTPDDALTARNNGAQGIGLCRTEHMFFASDERIKAVRKMIMAATHQQRKAALDLLLPYQRSDFEGIFRAMNGLPVTIRLLDPPLHEFLPEGDLDHIVGELTAETGMTEDEVFSRIEKLSEVNPMLGFRGCRLGVSYPELTEMQARAIFQAAVSMSSQGVKVFPEIMVPLKLDIFEWQELGHQASLIRSVAKRVFSEMGLTLSYKVGTMIEIPRAALVADEIAKEAEFFSFGTNDLTQMTFGYSRDDVGKFLPIYLSEGIIQNDPFEVLDQKGVGQLIKMATERGRAARPSLKVGICGEHGGEPSSVAFFAEAGLDYVSCSPFRVPIARLAAAQVAA

SEQ ID NO: 52319 - protein, 339 aa, Mucor racemosus
MSTINTGINGFRSHWPYCLACSLENPKVKVVAINDPFIDLEYMVYMFKYDSTHGRFKGTVEHKDGKLVVNGHEIAVHAERDPAQIPWGSHGADYVIESTGVFTTKDAASAHLKGGAKKVIISAPSADAPMFVVGVNLDKYTSDLTVISNASCTTNCLAPLAKVIHDNYGILEGLMTTVHATTATQKTVDGPSNKDWRGGRGAGANIIPSSTGAAKAVGKVIPELNGKLTGMAFRVPTPDVSVVDLTVRLEKPASYDEIKATIKKASESEELKGILGYTEDQVVSTDFVGDAHSSIFDAKAGIQLSPTFVKLISWYDNEFGYSTRVVDLLAYVAGKDGAL

SEQ ID NO: 52320 - protein, 360 aa, Sulfitobacter sp. EE-36
MKKLFTLLGIALLALLAYLAFWPVSVAPVAWEAPPDQGYTGDFAANDRLTALKIVELEGRSGPEDADIGPDGLVHVATHDGEILRIEENGAITVFAQTGGRPLGIEFDDSGTLYVADAYRGLLSVDRGGKVTLLAETTTDGSPILYADDVDIAADGSVYFSDASTRFGAQDNGGTLAASVLDLVEHSSNGRILKYDPTSGETTVFADGLNFANGVAVDDANSAVFVVETGSYRVWRFPMDGSAGTVVLENLPGFPDNINNAPDGTFWVGLVSPRNPVMDQLANSPFLRRVIMRLPDAMKPAPLRYGFVLRMDASGKVLETLQDPAGDYALTTGAVTLPDGRIAVTSLTEPRLGMLDAAPR

SEQ ID NO: 52321 - protein, 446 aa, Solibacter usitatus Ellin6076
MAEKQIGDEGLVRGFGLLHATALNMSNMVGVGPFITIPLIIASMGGPQCMLGWLLGAVLALCDGLVWSELAAAMPGTGGTYLYLREAFRKTRLGGILPFLFIWQFIISGPLEIASGYIGFAQYVGYFWRGMGPWETRLLSLSVGTVVIVLLYRRVTAVAKMAVVLWIGMLATVLWIVVSGLANFNARVVFDFPPGAFTFSRGFLAGLGSAMLIAMYDFMGYYDICYVGGEVRNPARVIPRSIIYSVLAVAAIYALMNLSIIAVVPWREAMNSKFIAAQFIEKLYGTRAAAVVTVLVLWTAFASVFALLLGYSRIPYAAAVNGDFFAVFGRLHATGKFPHVSLLVMGALSIVASLWNLDAVISALLTSRILIQFVAQIFALHYLRRHRHDIERPFRAWLYPLPSVIAFAGWAYIFLTSGWNFAGFGVLTLAAGVGAYLLWRKVTKYS

SEQ ID NO: 52322 - protein, 338 aa, Mucor racemosus
MVTQVGINGFGRIGRIVLRASLSNPEVQVVAINDPFIPLEYMVYMFKYDSVHGRFQGTVEAKDGKLVVNGKEISVFSERDPAQIPWGSVEAAYVVESTGVFTSIDAASAHLQGGAKKVIISAPSGDAPMFVCGVNLEKYTSDLKVISNASCTTNCLAPLAKVINDNFGIVEGLMTTVHATTATQKTVDGPSNKDWRGGRGAGANIIPSSTGAAKAVGKVIPELNGKLTGMAFRVPTPDVSVVDLTVRLEKGATYEEIKAVIKKASENELKGILGYTNDQVVSTDFVGDAQSSIFDAAAGIALNDKFVKLVSWYDNEFGYSNRVIDLLAYAAKVDAAAQ

SEQ ID NO: 52323 - protein, 309 aa, Alkaliphilus metalliredigens QYMF
MMKVKKAIIPAAGLGTRFLPATKAQPKEMLPIVDKPTLQYIIEEAVASGIEEILIITGRNKKSIEDHFDKSVELELELESKGKTELLEEVRKISDMVNIHYIRQKEPKGLGHAIHCAKSFIGNEPFAVLLGDDIVDAPKPCLKQMIDAYNEYKTSILGVQEVPWEDVNKYGIVKGMHIEDRIYKVKDLIEKPAVNEAPSNVAILGRYIITPNIFEILENTPPGKGGEIQLTDALRVLAQKEAMYAYHFEGRRYDVGDKQGFLEATVEFALKREDLREDFLAYLQKITRREVEREQTQVQVQEVAMTDKE

SEQ ID NO: 52324 - protein, 219 aa, Oryza sativa Indica Group
MGGDKENLDLSDLNASLPAAAAALSAEDRAGLVNALKDKLQSLAGQHTDVLEALSPNVRKRVEYLREIQGQHDEIELKFFEERAALEAKYQKLYEPLYTKRYNIVNGVVEVDGGNDEPASENAAEFKDADAKGVPDFWLTAMKTNEVLSEEAVQAEDFDDMEDDEEDDEDDDEDEEEEEDEDEDEDDEEEKSKPKKKSAGKPKYFALNCPGNYWLVVHG

SEQ ID NO: 52325 - protein, 364 aa, Cryptococcus neoformans var. neoformans JEC21
MSLWSNIWLWIRYQVNVIIHCGFPCFFWVQPTWSIDKIENQEGKVVLITGGNSGTGYATALALYNAGATVYIACRNLTRAKEAAEDIKKGGERGIWGVTYPRKELDKAGGNKKGRVEIIQLDLTDLASVEKCAEEFLNKEKKLDLLFANAGIMATPEGQYTKQGYTLQFGTNTLGHHRLITLLLPLLLSSPPSLPSRVILTSSAGHSMAPKGGVNFKSVVRDPSDTGSGQGKYELDKWTEYAQSKWGNIASAKYLEDTYGKEGRLIAVAVHPGLVATNLTNHLPFVGIFYRWVPWLRHLFTRDPSTGALNQLYAATLPLPDAWFLNGEYVVPYNTVGICRSDLLDKKRIEEVWNWCDEQGKKFA

SEQ ID NO: 52326 - protein, 556 aa, Kineococcus radiotolerans SRS30216
MSGRGRRADAGSRPDTGPVLPQLLLVLVGALALTIVSVRRGWQAPLVLAVCGAAVSFVPGLPRLELPPDVILSVVLPPLLFSTTTGFSWRGFVRRWRSITNLGVLLVVVTTAAVGAVAAYAVPWLGLGTALVLAAVVSPPDAVTAVAIGGRLGLPTRVLTTLKGESLVNDAAALTLFSTATAAVAGTETLVENPVLFFLVEAAGGILLGAVLGRLVHLVRTRLHNPANMTALAVLTPFTAYAVAEALETSGVLAVVAAGFALSRRSVRTVYATRIAEREVWNLLDVLLEAFVFAYLGLQFRFLLADALDAGTSATGLLGAGLVVLAAVVAVRAVWVLGGGLLMRRVLHGRFSPGGRHYTAREDLVIAWTGMRGVVTLAAAAGIPATTSTGEPFPHRADLQVLAFGVAVGTLLLQGSTLPALIRRLHLEAPEEREWLDEQRRRARELSSRTARAELRAAHDEAGDPVQRHVAELVLERAEQLAALRAADDADQEAASEGRRAAETGVALRRRAIRAQRAALVAAQEEGRIAEEAVAEALEQLDLDEASLSHRSSPRL

SEQ ID NO: 52327 - protein, 457 aa, Wolbachia endosymbiont of Drosophila melanogaster
MNEYDITVIGSGPGGYIAAIRAAQLGFKTAIVEKEKNLGGICLNWGCIPTKSLLRASEVYRLIKRSKEFGIEVKGANFDIQSIVKYSRNVVDKLSSGVAYLMKKNNIKVHQGFGKLAGNGTIKVVSDKEEQEIVSKHIILATGVRARNLPGIEADGDLIWNAQHAMTPERLPKSLLIIGSGAIGIEFASFYSTLGVDVTIIEIKSTILPLEDKDISDLAQEIFTKQGIKIYTNSSVKALTKSKDSAQVLLSSGESKEFERVIVAVGIQANIENIGLENTKIKLSPSGFIETNEWYETSESNVYAIGDVAGPPCLAHKASHEAVICIEKIAGKNAHALKKECIPNCTYSHPQIASIGLTEEQAIKGGYDIKIGKFHSNFNGKSVALSETEGLVKTIIDKKTGEILGSHMIGAEVTELISNFALAKQLEGTDFDIKSTIFPHPTISEMIHESVLAADVK

SEQ ID NO: 52328 - protein, 384 aa, Porphyra purpurea
MIKKIPAILVLEDGTYYKGWSFQADQSIVTIGEVVFNTGMTGYQEIITDPSYFQQIVTFTYPEIGNTGINSEDIESQTISIKGLVAKNICKISSSWRQQESLVQYLNRYKIPFIFGIDTRSLTQYLRRSGTMNGCISNKNLNHAYLQRKISEVPHMTGLDLIPNVTTNIMYDWDEKSLPSWYLADRNREKIYSQLKVIVIDFGVKLNILRRLATLGCQITVMPASTPTQDILSCKPDGILLSNGPGDPSAVNYGIKTVKELLNQNIPIFGICMGHQILNLALEAKTFKLKFGHRGINHPSGLKQQVEITSQNHGFAVDLQSVLKLSLQVTHFNLNDITVAGTGHSRSPYFSVQYHPESSPGPHDADYLFEYFIEIMKQFRKEAN

SEQ ID NO: 52329 - protein, 302 aa, Arabidopsis thaliana
MGKSSNIVFDRIKEERQMLSFFKIFQRADLSSDCMRALPYSFISKVSEKDFSYKMVIRAQWGKTWDVEVSKNPTYYYIETRGWDLFVSDNALGQNEFITFTHRGNMVFHVNIYEQNGLEMRKPRKFQTMGPSSGIKKEEGENSLIDVKKEEESDESPGRAEFLVRKKKTEDSKSSKKKMTRNKVKKKSKSKSKQVLDGVPEFKITIRKSYLKFLAIPKHFVDDHIPNKSKIFTIRHPNGGSWKVLCLVREIRTIFSGGYSKLAREFPLMVGDKCTFKLIKPFEFVLLTSKKNREKMDQCMID

SEQ ID NO: 52330 - protein, 144 aa, Platanus x acerifolia
KIEFYRRRKITCETNRATNRDKEKVFLANQEKFHAEADKNYWKAIAELIPHEVPAIERKRGKKDQDKKPSIAVIQGPKPGEPTDLGRMRQILVKLKHNPPSHMKPAPPPAPAPAPTPAKDTKTTPAAASKAAAVATPLEAVAVA

SEQ ID NO: 52331 - protein, 535 aa, Legionella pneumophila str. Lens
MNKNLSALSLLWISITSMVGSGWLFGSLYSAHFAGPAAIIAWPLAGFLLLFVALSYAELGTMFPQSDSLACLPLYTHGRLTGIIMNVMTWFSLAILPVIETQGVIQYASNYIPDLVSHDALHYRNTPAGYMLSLVVLMSFVLFNYFGIGLFARINAAFTIWKIIIPILTIASLLTMSYHPGNFFQHGGFMPYGWQGVMAAMSSGGVLFSLLGFRQVVIMMGELEKPGQYIPLILGGSLMFVTLLYTGLQWSFIGSVSEQALEKGWVNLSFTGDAGPFAALAALAGMLWLSILLYADAFISPYSTGLVYSTTAAHMLSSMGSVVPAPVILTKQNRYQVPWVSLGVNFLLAATMSLVLHGWQEMSAFLVAILMISYSIGPVALVCLRQQLPNYKRPFRLQGSNLIGFLGFYVCTVGVYWAGFHSVRKLLAITILGLVCSFLYCLIKNTHREIDSKQALWFIFYLFGLGIFSFLGNYGGKHILPQYWDLLYLLVFSLLVFGFALLSRKPSVHTQNMVAQNTHTNITAPAFSIERYDIV

SEQ ID NO: 52332 - protein, 308 aa, Burkholderia pseudomallei K96243
MPATFPDVLALGEAMVEFNQARPGEPNYLQGFGGDTSNFCIAAARQGARAGFVSAVGGDHFGRLLLDLWRGERVDTSYVRVDDGAPTGVYFVSHGEHGHAFDYLRAGSAASRYAIRDLPLDALAAARFVHLSGVSLAISTSACDAAFAAIAHARANGARVSFDTNLRLKLWPLPRARAVMTEALRHTDVCLPSWDDVTALTGLDERDAIVDALLALGPRVVALKLGRKGAYVATPGERRVVPGFVVDALDATGAGDCFGGAFVARLAAGDDPFSAARYANAAAALSTQGIGAVAPIPSRDAVERLLGA

SEQ ID NO: 52333 - protein, 534 aa, Vibrio sp. Ex25
MAIIKSKTKPTDELFLSNKAAMETLVTQLNQHIETIKQGGGEKAIQHQRQKGKLPARERIARLLDDNTDFLEISQFAAWQVYDESIPCAGVIAGIGFIAGIQCMVIANDASVKGGTYYPLTVKKHLRAQEIAQRCQLPCVYLVDSGGANLPHQSDVFPDKEHFGRIFFNQARMSAKGIPQVAVVMGLCTAGGAYVPAMADVSIMVKEQGTIFLAGPPLVKAATGEVVTGEELGGADVHCRKSGVADYYAENDEHALMLAREAIANANRAKPIKPENTVLPPRYDAEEIYGIVNANLRLSFDVREIIARIVDDSDFDEFKALYGRTLVCGFARIHGHLIGIVANNGILFSESAQKGAHFIELCAKRKIPLIFLQNITGFMVGKKVEEEGIAKHGAKLVMAVACADVPKFTVIIGGSYGAGNYGMCGRAYDPTMMWMWPNARISVMGGEQAAGVLTQVRKDAKERQGEAWSEQEEHTFRESIIDLYETQGHPYFASARLWDDGIIDPKQTRQVLSHALTAALNAPIPDSEFGVFRM

SEQ ID NO: 52334 - protein, 396 aa, Escherichia coli
MFENITAAPADPILGLADLFRADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAYQGFARGLEEDAEGLRAFAAMHKELIVASSYSANFGLYNERVGACTLVAADSETVDRAFSQMKAAIRANYSNPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 52335 - protein, 515 aa, Zea mays
MATKGGNARGVPVGALLVAALLLSSLVPTSASSYPARVVSGFLSNAASAVVKRLWSLKSTTKTAASGGKSMVKYEGGYTVETVFDGSKLGIEPYSVEVTQSGELLVMDSMNSNIYRMALPLSRYSRPKLVAGSPEGFPGHVDGKLREARMNHPKGFTVDDKGNIYVADAMNMAIRKISDTGVTTIAGGKSGRGGHVDGPSDEAKFSTDFEVRYIGSSCSLLVIDRGNQAIREIQLHFDDCVYQYEAGFPLGVALLLAAAFFGYMLALLQRRVLGMYSNGDEQEDESPVKAKLSSIPPPYQKPLKPSLRPPLIPNDDEPVKQEEEGLFTSIGKLVGVAKSSVAEIVVATFSRKKRVNVHHQQLGRPTSWPVQESYAIPRDETPPPLDTRAPTPRKSYAFMSKEPEKIHHIRHGRPQSHGWTGEAAAAAPQQQAASLPPPQQQQQVHHQQYHNRQYSAGPQTFYEPSCDASKEIVFGAVQEGDTGRRRPVEIKPVNHGDAAPFELNGLRFRSSYGMG

SEQ ID NO: 52336 - protein, 340 aa, Colwellia psychrerythraea 34H
MSLLITGGTGYIGSHTVVELLQSTKEQEIVIVDNLSNSSTKVLERIKQITNKTVTFIKADVCDENALEQVFNEHKIEAVIHFAGLKAVGESNEIPLAYYQNNVSGTITLLRVMAKYQVKNLVFSSSATVYGNNVSPLNETMATSATNPYGQTKLMVEHVLFDLAKSDASWSIACLRYFNPIGAHQSGLIGENPNGIPNNLLPYVAQVAVGRLEQLQIFGDDYDTQDGTGVRDYIHVVDLAQGHVKALESLGHAKGTVKGCQAINLGTGNGTSVLEIVNTFKDISKQDIPYQVVPRRAGDLATVYADASLANELLDWQAKLDLTAMIQDTWRWQSENPNGF

SEQ ID NO: 52337 - protein, 498 aa, Vibrio sp. Ex25
MMTRLVPLFIGGEFRESQTSDWVEVTNPATNDVIAYVPCSTDHEMEAAIDNAKETFQSWKEVAVSERARVMLRYQHLLKEHHDELATLLSHETGKILADAKGDVWRGIEVVEQAANIASNMMGETVENVATDIDSYSMIQPLGVCCGITPFNFPAMIPLWMFPIAIAAGNTFVLKPSEQVPLTSIRLAELFEQAGAPKGVLQIVHGRKDQVDFLLAHPDIRAVSFVGSVPVARYIYTTGTKHFKRVQAFAGAKNHMVIMPDANKEQVVNNLVGASVGAAGQRCMAISVAVFVGDSKQWITDLKQAMAKVHPGPWDDEQAAYGPLISEQAKQRILDLIEDGKQQGAVCELDGSQCEVEGFPDGNWIGPTLFSGVTANMSIYTQEIFGPVLVCMELDTLQEAIELVNRNPYGNGTSIFTANGAAARKYQHDIQVGQVGINVPIPVPLPFFSFTGWRGSFYGDLHAYGKQAVRFYTETKTVTARWFDDDIPTGPNLTIQLR

SEQ ID NO: 52338 - protein, 274 aa, Thermosynechococcus elongatus BP-1
MEITSQDPCVPDPLKPYVQIDGWGEVPVVLGHGFGTDKSAWDYLTPFLPKGFTYIRYDLAGCGSDEDTQHRYDVQRHSHLYGYADDLIELLDQLGVQSCIYVGHSVSCMIGAIAAIARPDLFRRHIWIGPSPCYLKDENYPGTLTPDDLQAIYEAMVTNYQAWAAGFAPLMFGLKEEHRLADFSQTLFRLQPRIALRTLQMIFDSDTRSFVGKVQQPVHLIFNRNDFVVPQGVALWLHATLPHSTLDWIDAQGHLPHMTHPTAVGSLLKKYMSI

SEQ ID NO: 52339 - protein, 792 aa, Xanthomonas campestris pv. campestris str. ATCC 33913
MNENILWLHELRLVDLARVGGKNSSLGEMIGNLAGLGVSVPGGYATTAEAFKDFIAHNDLSKRIFDKLETLDVEDVTALTVAGKEIRGWVIDAPLQPELDRDIRSAYEKLCAENGGGEVAVAVRSSATAEDLPDASFAGQQETFLNVTGADDVVHKVKEVFASLYNDRAIAYRVHHGFKHEDVFLSAGVQLMVRSGVGSSGVLFTLDTESGFRDVVFVTSSFGLGEMVVQGAVNPDEFYVYKPTLTAGKPAILRRSLGSKAIRMVYSDVPGERVRIEDTPVELRNTFSISDEDVQELSKQALVIEKHYGRPMDIEWAKDGVSGKLFIVQARPETVKSRSHATQIERFSLEAKDAKILVEGRAVGAKIGSGVARVVRSLEDMNRVQAGDVLIADMTDPDWEPVMKRASAIVTNRGGRTCHAAIIARELGVPAVVGSGNATDVISDGQEVTVSCAEGDTGFIYEGLLPFERTTTDLGNMPPAPLKIMMNVANPERAFDFGQLPNAGIGLARLEMIIAAHIGIHPNALLEYDKQDADVRKKIDAKIAGYGDPVSFYINRLAEGIATLTASVAPNTVIVRLSDFKSNEYANLIGGSRYEPHEENPMIGFRGASRYVDPSFTKAFSLECKAVLKVRNEMGLDNLWVMIPFVRTLEEGRKVIEVLEQNGLKQGENGLKIIMMCELPSNALLADEFLEIFDGFSIGSNDLTQLTLGLDRDSSIVAHLFDERNPAVKKLLSMAIKSARAKGKYVGICGQGPSDHPELAEWLMQEGIESVSLNPDTVVDTWLRLAKLKSEG

SEQ ID NO: 52340 - protein, 268 aa, Triticum aestivum
PALEIEAYLGDTLEQVCTKKQAGTGPEFPGYRRPTRPLPHLLPPRNSLLLPEPKLSPVATQNKMQRAIQAIGSHGSVLKSAVLQHISVVKPAMLPAVFPRFMSVSPAQIEESGFESSTVADILKSKGKSADGSWLWCTTDDSVYDAVKSMTQHNVGALVVVKPGEDKSIAGIVTERDYLRKIIVQGRSSKSTKVGDIMTEENKLITVKPETRVLKAMQLMTDKRIRHIPVISGTEMMGMVSIGDVVRAVVSEHKEELNRLNAYIQGGY

SEQ ID NO: 52341 - protein, 625 aa, Streptococcus pyogenes M1 GAS
MSHFLVEKLTKTVGDKTVFQDISFIIHDFDRIGIIGVNGTGKTTLLDVLSGRLGFDGDHSPFSKANDYKIAYLTQDPEFNDAASVLDTVLSADVKAIQLIRQYELLMANYTEDKQESLESLMSEMDRLDAWSIESDVKTVLSKLGITDLEQKVGDLSGGMRRRVQLAQVLLGAADLLLLDEPTNHLDIDTIAWLTTYLKTAKKTVLFITHDRYFLDHVATRIFELDKAGLTEYQGNYQDYVRLKAEQDERDAANLHKKKQLYKQELAWMRTQPQARATKQQARINRFSDLKKEVHQDSSADKLEMTFETSRIGKKVIHFEDLSFAYGDRQLIKDFNLIIQNKDRIGIVGDNGVGKSTLLNIINGDLKPTSGKLDIGDTIRVGYFSQQLKDMDETKRVINYLQEVADEVKTSVGTTSISELLEQFLFPRSSHGTLIAKLSGGEKKRLYLLKLLIEKPNVLLLDEPTNDLDIATLKVLENFLANFAGPVITVSHDRYFLDKVATKILAFEEGDIRVFYGNYSDYLDEKVFEKETVEADLAKTTVTEEVPLPQKEERKRMSYLEKQEWAQIEDKIATIEANIEEIENQMLTVVSDYGQLAQLQKELDQRNNDLLLAYERFEYLSGLDI

SEQ ID NO: 52342 - protein, 170 aa, Carboxydothermus hydrogenoformans Z-2901
MDLKKYIYDIPDFPSPGIIFRDITPLLQNPETFRRTVELLAEKVVDLRPTHVVAIESRGFMFGAPLAYKLGLGFVPVRKEGKLPRESISVSYDLEYGNNTLEIHTDALKPGDRVVIVDDVLATGGTMKATVELCERLGAKVEALLFVIELLALEGRKKLTGKKVISLVQY

SEQ ID NO: 52343 - protein, 365 aa, Zea mays
  misc_feature (296)..(296): Xaa can be any naturally occurring amino acid
MGVYLSTPKTEKVSEDGENDKLKFGVSSMQGWRTTMEDAHSALLDLDNDTAFFGVFDGHGGKVVAKFCAKYLHREVLRSEAYAAGDLGAAVHRAYFRMDEMMRGQRGWRELQALGDKINQFSGIIEGLIWSPKASDSNDRHDDWAFEEGPHSDFTGPNCGSTACVALIRNKQLVVANAGDSRCVISRNGQAYNLSRDHKPELEAERERIRSAGGFVLMGRVNGNLNLSRAIGDMKFKQNKFLPPDKQILTANPDINIVELCDDDEFIVLACDGIWDCMSSQQLVDFIREHIDTEEXLSAVCERVLDRCLAPSTMGGEGCDNMTMILVQFKKPIAQVEDASGAEPAGDAGCCETHGAHENGSGKQV

SEQ ID NO: 52344 - protein, 592 aa, Spiroplasma citri
MKLQDYQNHTDLKKLKTKALIELAADVRCLIIETVTKNGGHLASNLGTVELTISLLKTFDIDNNDLIIFDTGHQTYAYKILTDRKTHFSTIRLADGLTAFQHINESKYDHLSNGHAGTGLSTAIAYSYNQKYNNIICVIGDAAFTNGLTLEALTYLGTISNKIIVILNDNGMSISKNVNVLHTTVSKVRTGWLYRSASKVAKVLRYIPPLTLLWLGHLLIEKIIRSFAIPGLFAGFNLDYIGAVDGHNFRKLAKSLRQAKKRNASVVLHLKTKKGYGYGLSQAEQEKYHSYSLTDNKHNEWSYYVAKTIEKIFQTATEKFYFISAAMQASVHLEEFMLQNPQYFFDVGLAEEHAVTLAAGFALDHQKVIVNMYASFLQRTYDQILHDVVRNHLPVVFLIDRASLALADGDSHHGIYDIGFLNSMGDLPIISQPATSSEFDQLLKLALINKKNPFFIRYPKGGITQQVLSVPFSVGQWEYVIKNPKARILLITYGNNVIKTKTVITKLDTKKINVINARFINPVDKEMLKQINTEKYQQIIIFEEVIKETGLYAKIIDFLINHNATISHYGYENGLIKKDVNNLEEILRNLIN

SEQ ID NO: 52345 - protein, 385 aa, Schizosaccharomyces pombe
MSGYGQQGVSAANIDSIRPKKRLSIGVVGSGNWGTAIAKICGENARAHGHHFRSKVRMWVFEEEIEYKGEKRKLTEVFNEAHENVKYLPGIECPPNVIAVPDVREVARRADILVFVVPHQFIERVCDQMVGLIRPGAVGISCIKGVAVSKEGVRLYSEVISEKLGIYCGVLSGANVANEVAREQFCETTIGFNPPNEVDIPREQIAAVFDRPYFSVVAVDDVAGVALGGALKNVVAMAVGFADGLEWGGNTKAAIMRRGLLEMQKFATTFFDSDPRTMVEQSCGIADLVTSCLGGRNNRCAEAFVKTGKSLETLEKELLGGQLLQGAATSKDVHEFLLTKDMVKDFPLFTAVYNISYEDMDPKDLIIVLQPLKEDSENEGGTETE

SEQ ID NO: 52346 - protein, 774 aa, Arabidopsis thaliana
MVKTGYVWSSLGLLNNEYALTDADIVHRKIELDLLKCIDFPEFTGSVVKALKREEKNSETIPFDLVIEILTRLPVKSIARFRCLSKLCASTLNNSDFTESFFTISSSRPKLLFTCPKDGETFFFSSPKPRDSSPLASYENLKGRTISKPLICNPSTGESWPLPRVKTNRTIITSYFGYDPINKEFKVLCMTKSKFGVFGEHQVLTFGTGKELSWRKIKCDMAHYPDVVDYEASGYPRPLYDGICINGVLYYLGRVHDDLDGFPDIVCFDIKFEKFSYIKKANGMKRNSGVNLQPTLVNHKGKIAKLQANIGPGSIRYTGIQLWVLEDAEKHQWSSYIYVLPPPWKNIIEETKLRFVGTSDTGDIVLSPCNISNSFYLLYYNPERNAITRVEIQGVEAFKSHKSYAFLDYAENIVKPKPTLFFFVVSVHGSDTTGTESISGILVNGKVNSPIPGGGARSFTFKELAAATRNFREVNLLGEGGFGRVYKGRLDSGQVVAIKQLNPDGLQGNREFIVEVLMLSLLHHPNLVTLIGYCTSGDQRLLVYEYMPMGSLEDHLFDLESNQEPLSWNTRMKIAVGAARGIEYLHCTANPPVIYRDLKSANILLDKEFSPKLSDFGLAKLGPVGDRTHVSTRVMGTYGYCAPEYAMSGKLTVKSDIYCFGVVLLELITGRKAIDLGQKQGEQNLVTWSRPYLKDQKKFGHLVDPSLRGKYPRRCLNYAIAIIAMCLNEEAHYRPFIGDIVVALEYLAAQSRSHEARNVSSPSPEISRTPRRDL

SEQ ID NO: 52347 - protein, 175 aa, Oryza sativa Japonica Group
MAPTVMASSATSVAPFQGLKSTAGLPVSRRSTNSGFGNVSNGGRIKCMQVWPIEGIKKFETLSYLPPLTVEDLLKQIEYLLRSKWVPCLEFSKVGFVYRENHRSPGYYDGRYWTMWKLPMFGCTDATQVLKELEEAKKAYPDAFVRIIGFDNVRQVQLISFIAYKPPGCEESGGN

SEQ ID NO: 52348 - protein, 329 aa, Alkaliphilus metalliredigens QYMF
MAVLVCGGAGYIGSHTVLALLKEKVEVIVLDNLSKGHREALPSEVKLYQGDLRDEKLLAGIFIDNEIDGVIHFAADSLVGESVEAPLKYYENNVYGSLSLLKAMAKHGVKKIVFSSTAAVYGEPREVPIVEESLTLPTNPYGETKLAVERMLKWAQEAHGIEFVVLRYFNAAGAEEEGTIGEDHSPESHLIPLVLEVALGKREKIYIFGEDYPTEDGTCVRDYIHVMDLADAHLLALKRLQRGEGSGTYNLGNGKGFSVQEVIETARRITGKPIPAEMAPRRAGDPAVLIASSDKARKELGWTSQYDSLEKIIGTAWKWHHSNPYGFKS

SEQ ID NO: 52349 - protein, 180 aa, Brassica napus
  misc_feature (100)..(100): Xaa can be any naturally occurring amino acid
  misc_feature (117)..(117): Xaa can be any naturally occurring amino acid
  misc_feature (169)..(169): Xaa can be any naturally occurring amino acid
MESDNSAGFTYLGRNFSNLSVNDHSSAFSDCNSDRSGEFPSASSESRRLLLSCASDNSDNLIRHLAAHLDSSSSSVDEQKQAAMEIRLLSKNKPENRIKXIANAGAVKPLISLISSXSDPQLPGDGGTPPPIPPLCDENKDLIASSGAIKPIVRALKMGNPTAKENAAXALLRLSQVEDK

SEQ ID NO: 52350 - protein, 337 aa, Mucor racemosus
MVVQVGINGFGRIGRIVLRATESNKDVQVVAINDPFIPLDYMVYMLKYDTVHGRFDGSVEAKDGKLVVNGHAIAVSAERDPTSIPWGSAGADYVVESTGVFTTTEAASAHLKGGAKKVIISAPSADAPMFVCGVNLEAYKSEYKVISNASCTTNCLAPLAKVINDNFGIADGLMTTVHATTATQKTVDGPSHKDWRGGRAAAANIIPSSTGAAKAVGKVIPALNGKLTGMAFRVPTPDVSVVDLTVNLSKGASYDEIKQAIKKASETTMKGVLGYTSDAVVSSDFVGEVCSSVFDAAAGIQLTPTFVKLIAWYDNEYGYSNRVVDLLVHAAKVDGAL

SEQ ID NO: 52351 - protein, 488 aa, Oryza sativa Japonica Group
MGENVVGTYYYPPSAAAMDGVELGHAAAGSKLFDDDGRPRRNGTMWTASAHIITAVIGSGVLSLGWAIAQLGWVAGPAVMVLFSLVTYYTSSLLSDCYRSGDPVTGKRNYTYMDAVNANLSGFKVKICGFLQYANIVGVAIGYTIAASISMLAIGRANCFHRKGHGDPCNVSSVPYMIVFGVAEVFFSQIPDFDQISWLSMLAAVMSFTYSVIGLSLGIVQVVANGGLKGSLTGISIGVVTPMDKVWRSLQAFGDIAFAYSYSLILIEIQDTIRAPPPSESAVMKRATVVSVAVTTVFYMLCGSMGYAAFGDDAPGNLLTGFGFYEPFWLLDIANAAIVVHLVGAYQVFCQPLFAFVEKWAAQRWPESPYITGEVELRLSPSSRRCRVNLFRSTWRTAFVVATTVVSMLLPFFNDVVGFLGALGFWPLTVYFPVEMYVVQKKVPRWSTRWVCLQMLSVGCLVISIAAAAGSIAGVMSDLKVYRPFKGY

SEQ ID NO: 52352 - protein, 438 aa, Streptomyces sp. 139
MRVSVFGLGYVGCVSAACLASMGHEVIGVDVNPVKVDLVNDGKAPVVEERIGELIAEVVGSGALRATTDVREAIAGSEVSLICVGTPSEPNGSLCTTYLERVTEQIGAALAERGGRHTVVFRSTMLPGTCLGLLVPVLEKHVGGTAGVDIGVAVNPEFLREGTSVRDFFDPPKTVIGELDPASGDVVAALYADLPGEVFRVPVPTAEAIKYADNAFHGLKIGFANELGAVCRALGVDSHQVMDVFLADRKLNISPAYLRPGFAFGGSCLPKDLRSLVHAAQRADVSVPILAHVLPSNEEHLQRAIELVERTGRRKVGLFGLSFKPGTDDLRESPLVELAERLFGKGYDLRIHDANVSLSRLLGANREYIETRLPHLAQLLADSVDEVLEHAEVVLVGTKDPAVLSALPHGGGPVIVDLVRLPDAEARRAEPGYVGLAW

SEQ ID NO: 52353 - protein, 316 aa, Kineococcus radiotolerans SRS30216
MTGTTSTGSPRSRTVVVGEALVDVVRTAGSATGTEHPGGSPLNVAYGLGRLEHDVALLTRLGDDEHGALLRAHLDRAGVQLFPGTVDADPTAVARAEIDAEGKATYDFDLLWRVPEVELAPDVTLVHTGSIGAAVSPGAETALSLLRSVRGRATTSYDPNVRPAFFDGPARALARVEEFVDAADVVKASDEDLAWLLPGEDPEVVAHRWQTRGPALVVVTRGSAGAIAVSGAGTLHVPAPRVDVVDTVGAGDAFMSGLLHALHEHDLLGAQGLPRLRHLGLGTLESLVATAIRSASITCSRAGANPPTRAELTAPA

SEQ ID NO: 52354 - protein, 293 aa, Hordeum vulgare subsp. spontaneum
MSPTLSLKLKKSSHTPQSSVSSSTKLRLFKKEAACQSPSTLPVAMDMGLEVSSSSPSSSSVSSSPEHAARRASPAKRPAGRTKFCETRHPVYRGVRRRGNTERWVCEVRVPGKRGARLWLGTYATAEVAARANDAAMLALGGRSAACLNFADSAWLLAVPSALSDLADVRRAAVEAVADFQRREAADGSLAIAVAKEASSGAPSLSPSSGSDSAGSTGTSEPSANGVFEGPVVMDSEMFRLDLFPEMDLGSYYMSLAEALLMDPPPTATIIHAYEDNGDGGADVRLWSYSVDM

SEQ ID NO: 52355 - protein, 505 aa, Dactylis glomerata
MYRAASGLGALKKHGADTQMLNMAIRSASTSVAQRSSGGFLSWLTGARSSALPPPDFALAGVTIPDPLPDHVEPAKTKITTLSNGVKIASETSPGSSCSVGVYVNCGSVYEAPETLGATQLLNKLAFTTTRNRSQLRVVREIGAIGGNAKASSTRELTSYSYGALKTYMPEMVEVLVDCVRNPALLDWEVKEEITKLKAELAKASINPKSFLLDALHSAGYSGALANPLIASEASISRLNTDVLEDFLAENYTSSRIVLAASGVDHDELVSIAEPLLSDIPNATGTAKPKSVYVGGEYRRAADSSNTEIALAFELPGGWLKEKDYVTASVLQALLGGGGLFSWGRPGKGLHSRLNHLVNEFDQIKSISAFKDVHSTTGIFGIHTSTDAAFAPKAIDLAARELTSLATPGQVDQTQLDRAKALAKSAILASLESKASATEDMGRQVLAFGERKPVEQLLKIVDGVSLKDVSALAEKIISSPLTMASHGDVLNVPAYETVRGKFSSK

SEQ ID NO: 52356 - protein, 478 aa, Arabidopsis thaliana
MHKMMVVEKERSIEERLLQLKNQNDDSECRITACVILSTFIAVCGSFSFGVSLGYTSGAEIGIMKDLDLSIAQFSAFASLSTLGAAIGALFSGKMAIILGRRKTMWVSDLLCIIGWFSIAFAKDVMWLNFGRISSGIGLGLISYVVPVYIAEISPKHVRGTFTFTNQLLQNSGLAMVYFSGNFLNWRILALLGALPCFIQVIGLFFVPESPRWLAKVGSDKELENSLLRLRGGNADISREASDIEVMTKMVENDSKSSFCDLFQRKYRYTLVVGIGLMLIQQFSGSSAVLSYASTILRKAGFSVTIGSTLLGLFMIPKAMIGVILVDKWGRRPLLLTSVSGMCITSMLIGVAFTLQKMQLLPELTPVFTFICVTLYIGTYAIGLGGLPWVIMSEIFPMNIKVTAGSIVTLVSWSSSSIVTYAFNFLLEWSTQGTFYVFGAVGGLALLFIWLLVPETKGLSLEEIQASLIREPDRINQS

SEQ ID NO: 52357 - protein, 452 aa, Dactylis glomerata
MAQEEKEKPDESTSSRRPQAKETKPNPAPEPEPEMATVAMDISKPPPAAAGDDSAKGARAGGEGLRQYYLQHIHDLQLQIRTKTHNLNRLEAQRNDLNSKVRALREELQLLQEPGSYVGEVVKVMGKSKVLVKVHPEGKYVVDIDKSIDITKITPSTRVALRNDSYMLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNEDSRGDILKIHSTTMNLMRGIDLKKIAGKMNGASGAELKAVCTEAGMFALRERRVHVTQEDFEMAVAKVMKKDNEKNMSLRKLWK

SEQ ID NO: 52358 - protein, 119 aa, Atropa belladonna
QVPEDEEDIDEDAAEELQNLMEQDYDVGSTIRDKIIPHAVSWFTGEAAEDDYADLEDDEDEDEDDEEDEDEDEEDDEDEEDEEDDAKTKKKSSAARKRSGRAPAGDGQSGERPPECKQQ

SEQ ID NO: 52359 - protein, 110 aa, Triticum aestivum
  misc_feature (49)..(49): Xaa can be any naturally occurring amino acid
  misc_feature (70)..(70): Xaa can be any naturally occurring amino acid
  misc_feature (81)..(81): Xaa can be any naturally occurring amino acid
  misc_feature (86)..(87): Xaa can be any naturally occurring amino acid
  misc_feature (90)..(90): Xaa can be any naturally occurring amino acid
  misc_feature (92)..(92): Xaa can be any naturally occurring amino acid
LRRHFSKKRSVDVRRINPKVPKEEAVAISGRLLQILSDHGPLTVGNTWXNHAKDAGIAGLNSKTHMKILXLKWMTGRNVLXADCVXXGNXKXFLYPPNNSSNARTSSSAN

SEQ ID NO: 52360 - protein, 779 aa, Frankia sp. CcI3
MSSIQALQAEGSGIDLSGRALGLVAGVAIVAALALLVAGYLVREVLAASPGTPRMVEVGRAVQEGAAAYLRRQFTTLAGFVVVIPFVLLLLPAENTGAKIGRSIFFVVGAIFSALVGFVGMSLATRANTRTAAAAMTRGERAAVRIAFRTGGVVGMFTVGLGLLGAAAVVLVFRDTAPQVLEGFGFGAALLAMFMRVGGGIFTKAADVGADLVGKVEQGIPEDDPRNAATIADNVGDNVGDCAGMAADLFESYAVTLVAALILGVEAFGERGLVFPLLIPAVGVVTAVIGIFAVSPRAGDRTGMSAINRGFFISAVVSAIGVVAVSLLYLPTSFADFPGMQGSTQSGNPRVIAIGAVLIGIVLAAAIQLLTGYFTETGRRPVRDIAKASLTGPATNILAGIGVGLESAVYSSLLIGAAIFGAYLLGSGSVTIALFAVALAGTGLLTTVGVIVSMDTFGPVSDNAQGIAEMSGDMDEAGAAILTSLDAVGNTTKAITKGIAIATAVLAASALFGSFTDTVTTALRDAGALPEAGRGIVGGLNIAYPDALVGLTIGASVVFLFSGLAINAVGRAAGRVVLEVRNQFRSRPGIMTGDEKPDYSAVVDICTRDSLRELITPGTLAVLAPIAVGFGLGYPPLGAFLGGAIAGGVLMAVFLANSGGAWDNAKKMVEDGHHGGKGSEVHAATVIGDTVGDPFKDTAGPSINPLLKVMNLVSLLIAPTVVKYSVGADENTGLRIGVALAALAAIAAVIIISRRRSSMINDVPDMTQPTPAPSEKINA

SEQ ID NO: 52361 - protein, 334 aa, Triticum aestivum
  misc_feature (47)..(47): Xaa can be any naturally occurring amino acid
ARRRSSPGPGSRDGRRAPVVTFGFTPDSKYGESGDDMSRAVRWRSPXQEKRRRRRRMACNRCGKRKWESKEACIVCDARYCGYCVLRMMGSMPEGRKCVSCIGGPIDESKRSKLGKSSRTLARLLSPLEVRQILKAEKECQANQLRPEQLIVNGCPLRPEELTDLLSCSRPPQKLKPGRYWYDKESGLWGKDGQKPDRIVSSNLNFSGKLHAKASNGNTQVYINGREITKSELKILKVAHVQCPRDTHFWVYDDGRYEEEGQNNIKGKIWESALTRFACALFSLPVPPGDSNGTKDEIPFVPRTVPDYLDQKRIQKLLLLGPPSAGTSTIFKQA

SEQ ID NO: 52362 - protein, 749 aa, Arabidopsis thaliana
MKRRRLFFCVLLSILTLFINGPLVTTAQSPPSSTSCNRICGRIEIPFPFGIGRRDCFLNDWYEVVCNSTTSGKSLAPFLYKINRELVSITLRSSIDSSYGVVHIKSPVTSSGCSQRPVKPLPLNLTGKGSPFFITDSNRLVSVGCDNRALITDIESQITGCESSCDGDKSRLDKICGGYTCCQAKIPADRPQVIGVDLESSGGNTTQRGNCKVAFLTNETYSPANVTEPEQFYTNGFTVIELGWYFDTSDSRLTNPVGCVNLTETGIYTSAPSCVCEYGYFSGFGYSNCYCNQIGYRGNPYLPGGCIDIDECEEGKGLSSCGELTCVNVPGSWRCENGVGKIKPLFPGLVLGFTLLFLVLGIWGLIKFVKKRRKIIRKRMFFKRNGGLLLKQQLTTRGGNVESSKIFSSKELEKATDNFNMNRVLGQGGQGTVYKGMLVDGRIVAVKRSKVLDEDKVEEFINEVGVLSQINHRNIVKLMGCCLQTEVPILVYEHIPNGDLFKRLHHDSDDYTMTWDVRLRIAVEIAGALAYLHSAASTPVYHRDVKTTNILLDEKYRAKVSDFGTSRSINVDQTHLTTLVAGTFGYLDPEYFQTSQFTDKSDVYSFGVVLVELITGEKPFSVMRPEENRGLVSHFNEAMKQNRVLDIVDSRIKEGCTLEQVLAVAKLARRCLSLKGKKRPNMREVSIELERIRSSPEDLELHIEEEDEEECAMEINMDDSWSVDMTAPASLFDLSPKLDVEPLVPQRTW

SEQ ID NO: 52363 - protein, 378 aa, Triticum aestivum
  misc_feature (179)..(179): Xaa can be any naturally occurring amino acid
  misc_feature (219)..(219): Xaa can be any naturally occurring amino acid
  misc_feature (244)..(244): Xaa can be any naturally occurring amino acid
  misc_feature (273)..(273): Xaa can be any naturally occurring amino acid
  misc_feature (298)..(298): Xaa can be any naturally occurring amino acid
  misc_feature (303)..(303): Xaa can be any naturally occurring amino acid
  misc_feature (306)..(306): Xaa can be any naturally occurring amino acid
  misc_feature (316)..(316): Xaa can be any naturally occurring amino acid
  misc_feature (327)..(327): Xaa can be any naturally occurring amino acid
  misc_feature (330)..(330): Xaa can be any naturally occurring amino acid
  misc_feature (334)..(334): Xaa can be any naturally occurring amino acid
  misc_feature (343)..(343): Xaa can be any naturally occurring amino acid
  misc_feature (348)..(348): Xaa can be any naturally occurring amino acid
MSAYCGKYKDELIQNAAYIGTPGKGILAADESTGTIGKRFASINVENVEDNRRALRELLFCTPGALQYLSGVILFEETLYQSTKGGKPFVDILKAGNVLPGIKVDKGTIELAGTNGETTTQGFDDLGKRCAKYYEAGARFAKWRAVLKIGATEPSQLSIDQNAQGLARYAIICQENGLXVPIVEPEILVDGPHDIDRCAYVTEVVLAACYKALNDQHVXLLEGTLLKPNMVTPGSDSKKVAPEXVIAEYTARTLQRTVPAAVPAIVFLSGGQXSEEEATLNLNAMNKLQTKKPWNLSXSFGRXLQXSNLKAWSGKXENEEKGKAAFXVKXKANXKATSGTKKXNANLXEGASEEPQVKDYKLLIDLPSWLLALGSRLQ

SEQ ID NO: 52364 - protein, 602 aa, Glycine max
MDALRVAPTTPPLLRRHPLRKMAPHPLTARPRRAPLIVATLSMPPEATHSSAVAIVEDPSEAAPPPRPRVSPDSLQYPPGFVGAIPASSRSDGGDGDGMNNAMTYLTNILSSKVYDVAIESPLQLAPKLSARLGVKVWLKREDLQPVFSFKLRGAYNMMAKLPTELLEKGVICSSAGNHAQGVALAAKRLNCSAVIAMPVTTPEIKWKSVEALGATVVLVGDSYDEAQAYAKKRGVEEGRTFIPPFDHPDVIMGQGTIGMEIVRQMQGPIYAIFVPVGGGGLIAGIAAYVKRVNPEVKIFGVEPTDANAMALSLHHDQRVILDQVGGFADGVAVKEVGEETFRICKELIDGIVLVSRDSICASIKDMFEEKRNILEPAGALALAGAEAYCKHHGIQGKNIVAITSGANMNFDKLRVVTELANVGRKQEAVLATVMAEEPGSFKQFCELVGQMNITEFKYRYNSNEKAVVLYSVGVHTISELRAMQERMESSQLKTYNLTESDLVKDHLRYLMGGRSNVQNEVLCRLTFPERPGALMKFLDSFSPRWNISLFHYRGEGETGANVLVGLQVPKSEIDEFHDRANKLGYDYKVVNNDDDFQLLMH

SEQ ID NO: 52365 - protein, 444 aa, Xanthomonas campestris pv. campestris str. ATCC 33913
MSSEIVPIAEPIRPADGGLGAAHASVAVPKGGHWWFRLLAFLGPGYMVSVGYMDPGNWATDLAGGSQFGYLLLSVILLSNLMAIVLQGLSARLGIATGLDLAQACRARYPRGINLALWGLCELAIIACDLAEVIGTAIALKLLFGIPLTLGAIITALDVVLVLLLMNRGFRALEAFVMALLLVIFVCFGIQIALAAPPIAAVLAGFIPRAEVVTNPHALYLAIGIIGATVMPHNLYLHSSIVQTRAYPRTDAGRRSALRWAVTDSTVALMFALFINAAILILAAAVFHAQGRTDVQEIEQAHALLAPMLGVGLASTLFAVALLASGVNSTVTATLAGQIVMEGFLRLRLPPWMRRLLTRGIAIVPVVVVTWLYGEAGTARLLVLSQVVLSMQLPFAVIPLVRFVADRGLMGALVAPAWLVRLAWVIALVIVGLNLKLLWEFALG

SEQ ID NO: 52366 - protein, 396 aa, Bacillus cereus E33L
MKQFELSRAAESLQPSGIRKFFDLAANMKGVISLGVGEPDFVTPWNVRQACIRSIEQGYTSYTANAGLLELRQEIAKYLKKQFAVSYDPNDEIIVTVGASQALDVAMRAIINPDDEVLIIEPSFVSYAPLVTLAGGVPVPVATTLENEFKVQPEQIEAAITAKTKAILLCSPNNPTGAMLNKSELEEIAVIVEKYNLIVLSDEIYAELVYDEAYTSFASIKNMREHTILISGFSKGFAMTGWRLGMIAAPVYFSELMLKIHQYSMMCAPTMSQFAALEALRAGNDEVIRMRDSYKKRRNFMTTSFNEMGLTCHVPGGAFYVFPSISSTGLSSAEFAEQLLLEEKVAVVPGSVFGESGEGFIRCSYATSLEQLMEAMERMERFVENKKRTKHNTFCP

SEQ ID NO: 52367 - protein, 711 aa, Acinetobacter sp. ADP1
MSAIKYEKNADNIVILTLDSSGQSANTMNAEFRDALNDVSQKLKAETDLKGIIFRSAKKTFFAGGDLDELIQVQPEHATEFFKMIEKLKADLRTIETLGVPVVAALNGTALGGGWELALGCHYRIAINDPKSKFGLPEVTLGLLPGGGGIVRMVRLLGLQNAFPFLMEGKQFGVDQAKSLGLVHDTAENQQELLDKAIVWVKANPKSQQPFDVKGYKIPGGDPKTPAVAQVLAIAPAMLRDKTKGCYPAPEAIMAAAVEGAQVDVDTALRIESRYFTQLAIGQIAKNMIGTFWHGLNAIKSGASRPADVARWQATKVGVLGAGMMGAGIAYSTAIKGIPVILKDVSVENAEKGKAYSQKLLDKRVSQGRMTAEKRNQVLALITATADAADLQGCDLIIEAVFENQELKAKVTQEAEQYLAEGGIFASNTSTLPITGLATASKDAKNFIGLHFFSPVDKMQLVEIIKGKQTSAETLAKAYDFVQQIAKTPIVVNDSRGFFTSRVFGTFIQEGMRLLAEGVHPAKIEMAALKAGMPVGPLAIQDEVSLTLTEHVASETRKALQAEAKDLAKTPVDEVVHTMIHELNRKGKAAGAGFYEYPEHGKKHLWQGLDRWQKDHDISEQEMIDRFLFVQALDTLRCYEEGVLESVIDANVGSIFGIGFAPWTGGAIQFLNQNGIERSLQRSEELAQKYGERFNPPPYLKEKAQQKQIIQ

SEQ ID NO: 52368 - protein, 267 aa, Bordetella pertussis Tohama I
MTIPSFGVGTFRLTGQTVIDSVRNAIDLGYRAVDTAQIYGNETEVGQTIAESGVARSELFVTTKIWTDNYARAKLLPSLRASLEKLRTDYVDLTLIHWPAPGNGVALPEHMEALAEAKALGLTRRIGISNFNIALTRQAIAAVGQGEIATNQIELSPYLQSARLTAFLREQGIAVTSYMTLAYGKVLKDPVLARIADKHRSTVAQVALAWALQQGYAVIPSSTKRENLASNLLARGLALDADDMARIAALERNGREVDPEGLAPAWD

SEQ ID NO: 52369 - protein, 323 aa, Psychrobacter arcticus 273-4
MVDMTNKRLSVAPMIDWTTTDYRYFARLFNPHVYLYTEMISTGALIHGNRARHLRFDALEHPLVLQLGGADMTEMTQCAEFAQQHGYDEVNINVGCPSDRVQHNKIGACLMAEPNTVADLVKHMQAAVDIPVTVKHRIGIDDFDSYEFMADFVQKVAAGGCTRFIVHARTAWLQGLSPKQNREIPPLRYEDVYRLKQDFPALDIEINGGIETVADIEAHLEHIDGVMIGRAFYHNPYLLAEANSLWGTPVPKRSDILAQLYPYLEEQIAKGEALPTMTRHYLGLFQGLVGARKWRQALSGKPHLTIDDIKYAATEVLALNPDA

SEQ ID NO: 52370 - protein, 435 aa, Burkholderia pseudomallei K96243
MNSRPLAARSPSSRRPSASGGPGGGRRWAAFVGAGVLVAVGYMDPGNWATALAGGAGYGYALLGVVIAASLMAMLLQWLAARIGVVSGRDLAQLCRERFDPRATVLLWIAAEIAIVACDVAEVVGAAVALQMLLGVSLSTGVLVSAVGTLAMLALERHGRRTLEAAIASLIFFVGLCFVIEVALARPDWHAALAGAAPSPRLLREPGMLWLAAGILGATVMPHNLYLHSMLVKHHASARDEPSIRRALFGVNLDTFVSLGFAFVINAALLIVAAAVFHASGHDDVTDLADAHRLIAPLVGNRWAGPLFAAALLACGLSATVTGTLAGQAIMEGFLKLTLPRWQRALLTRALAIGPALAAVGLFGQHGSNQLLVASQVVLSLQLPLAMVPLVVFASSRALMGRWRVRGLPLAAAWMCAAAIVALNGALVWQVVAAG

SEQ ID NO: 52371 - protein, 520 aa, Nicotiana tabacum
MASIGALKSSPSPKNCINERRNDATRAMSFRNLSFSSSHIYGDKLMSMATLHSQQRHSSERRSPLIVSPKAVSDSQNSQTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEFLVLAGDHLYRMDYEKFIQAHRETDADITVAALPMDEKRATAFGLMKIDEEGRIIEFAEKPKGEQLKAMKVDTTILGLDDERAKEMPFIASMGIYVISKDVMLNLLRDKFPGANDFGSEVIPGATSLGMRVQAYLYDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETDADRRFLAAKGSVPIGIGKNSHIKRAIIDKNARIGDNVKIINSDNVQEAARETDGYFIKSGIVTVIKDALIPSGIII

SEQ ID NO: 52372 - protein, 359 aa, Nocardioides sp. JS614
MAAVDNFWAVIPAGGAGTRLWPLSRSSSPKFLHDLTGQGRTLLQGTHDRLAPLVADRFVVVTGAAHRAAVLEQLPEVSPERVLGEPAPRDSMGAIGLAAAVLEREDPDAVMGSFAADHVIPDRAAFAEAVRIAAEVARDDWLVTLGIQPVFPSSAFGYIHLGDPLAGHAGASAVREFVEKPSVRTATEYVATGRYRWNAGMFVVRPTVLLDLLATWHAEFAGALRAIAADPARLEELWPGLPKIALDHAVAEPAAAAGRVACVPSSFHWDDVGDFDSLAALLGTTATATTILGDADLVRVVDASGLVVPGSGRTIAVVGLDDVVVVDTPDAVLVTTRSRAQEVKQVVEALKADGRADLT

SEQ ID NO: 52373 - protein, 333 aa, Clostridium acetobutylicum ATCC 824
MDLIESIWECAKQDKKRIILAEGEEKRNLIAADKIIKEGLAELVLVGDENKIKEKASELNLDISKAEIMDPETSLKTETYARDFYELRKHKGMTIEKSEKMVRDPLYFATMALKDGYVDGMVSGAVHTTGDLLRPGLQIIKTAPGVKIVSGFFVMIIPDCDYGEEGLLLFADCAVNPNPTSDELADIAITTAETARKLCNVEPKVAMLSFSTMGGAKGEMVDKVKNAVEITKKFRPHLAIDGELQLDAAIDSEVAALKAPSSNVAGNANVLVFPDLQTGNIGYKLVQRFAKAKAIGPICQGFAKPINDLSRSCSSEDIVNVVAITVVQAQRGI

SEQ ID NO: 52374 - protein, 1105 aa, Bradyrhizobium japonicum USDA 110
MRDIMSFKKLLIANRGEIAIRIARAAADAGIATVAIHPADDALSLHVRVADEALEIPGRGARAYLDIEAVVTAAKGAGCDAVHPGYGFLSENAAFAKACGEQGITFVGPKVTALELFGDKVAARQLAKRCGVPIIAGTSGPSSLEEITAFFTSLGGNAAIVIKAMAGGGGRGMRVVENAADLAEAYARCQSEAKAAFGFDGVYAERLIRQARHIEVQIIGDRHGAVSHLWERECTIQRRHQKLVEVAPSPSLSGPLRGRIIEAARQLATAAAYDNLGTFEFLVDGTAEDSFAFIEANPRLQVEHTVTEAVLGLDLVRAQLAVAAGSTLDSLDLAQGSIPKPRGYAMQLRVNMETLDETGATHPTGGVLALFEPPSGPGVRVDSFGYAGYKTSAAFDSLLAKVIVHTPGEAWHDVVAKASRALREFRIDGVVTNIAFLQAVLAHPDFRTNRIATDFIDRNIAKLVEAADGAAKPLYFAPTERGGGHGMETHITQAVPEGAVMVAAPLQGTIVTIQVKEGEVVRPGQQLAVIESMKMEHLVMAEQGGRVTKLVAGDGATLMHGEPILYLEPLDVAADASAAEADVDLDHIRPDLAELIARQANTLDANRPASVERRRNTDQRTARENVAQLVDDGSFMEYGSLAIAAQRRRRKLDDLIQNTPADGLVMGVATVNAERFGPEGARCIVVAYDYTVLAGTQGHMNHKKIDRMLTLAEDWRVPLVFYAEGGGGRPGDTDRLGMTGLDGPSFVQFARLSGLVPVIGVVSGYCFAGNAAMLGCCDVIIATKNASIGMGGPAMIEGGGLGVYHPAEVGPVSFQSPNGVIDILVEDEEEATRVAQKYLSYFQGAVTDWQAADQRLLRRAIPENRLRVYDIRSVIDLVADRDSVLELRRDYGVGMITALIRIEGKPFGLIANNPRHLGGAIDADAGDKAARFLQLCDAFDLPIVSLCDTPGFMVGPEAEKTAIVRHVSRMFVTGASLTVPLFGIVLRKGYGLGAQSMIGGGFHASFFTAAWPTGEFGGMGLEGYVRLGFRKEMEAIADPEERETYYRNKVAELYANGKAVSIASVFEIDNVIDPAETRRWIMAGLRSVPKPPARTEKKRPCIDTW

SEQ ID NO: 52375 - protein, 216 aa, Xanthomonas oryzae pv. oryzae KACC10331
MLQARCLGAAPEASIAQVSSAACPHLAARRLTGDAVIPIRPFLEHAPQLGARVYIDPACTIIGKVNLGDDVSVWPGTVIRGDVNHVQIGARTNVQDGTIIHVSHHSPFNKAGYPTVIGEDVTVGHGTILHACTIEDLCLIGMGACVLDGATIKRYGFVGAGAVVGPGKVVGEAELWLGSPARLARTLSDKEIESLHYSAQHYVRLKDQYLGVPGGS

SEQ ID NO: 52376 - protein, 168 aa, Vitis vinifera
MATGASKSAAIGFLILNFLLYGIITIIASWAVNHGIERSREAASVLSIPARIFPIYFPVGNMASGFFIIYSLIAGVVGMVSSIISIINVIQWNPSNLHAATASSLLTWLLTLLAMGLACKEIHIGWADSTLRALEALTIIVSATQLLCMGMIQAGVENVEQSRLRMMR

SEQ ID NO: 52377 - protein, 392 aa, Deinococcus radiodurans R1
MTEVTSVRPSSIKNAAVNLPYGGGKGGIRIDPRKYSQGELERVTRRYTTEIGLIIGPEKDIPAPDVNTGPQTMAWMMDTYSMNVGRTATGVVTGKPVSLGGSLGRADATGRGVFVTGAEAMKKLGMPLEGARIAVQGFGNVGEAAARIFHQHGAKIVAIQDVTGTIHSAAGIDPGKALAHLRQTGKITGLEGSEEMQKDDFWSVDCDVLIPAALEKQITLQNADKIRARLVVEGANGPTIPAADDLLAQKGVTVVPDVLANAGGVSVSYFEWVQDFSSFFWTEDEINERLDRIMREAFQSLWDVKEQHGVTLRTAVYIVACTRVLEARACAGCIRKSTREKGRFLDGAALFVGCWGAFRTFDRKRHPPPLFARPSPIKVKGQRQNRSFCQML

SEQ ID NO: 52378 - protein, 157 aa, Schizosaccharomyces pombe 972h-
MGKFALNLNAELTGVKNLAPKDEESFYYAFKVQCSGCREIHDNAIEISRSETHSIPGSKGEANLIWTCKNCRKTCSFVIEGPFSPYNDSQETKKVLVLECRGCELVEFIPQGEWIANGAESNTLFDEIVLEDDWYDYDENASSEVSITNLEWSISKA

SEQ ID NO: 52379 - protein, 247 aa, Chlamydomonas reinhardtii
MSGEYNKFRQVTYCYADECVNLSSENAARSSPGPVFSAFGSAEQPDNFWTETQASASPASTSAPAPPPAAGGNNAGLALGAVAAAVVLFAVTRLGGGGGAPTLATLESLSTPLEVALVNGRPTLVEFYANWCEVCRELVPQEYELEKQYGGKVNFVMLNIENSKWAPEAAEFGVRGIPHFVFFDKTGEPQAAAVGRVPKQVVEDNLQALLQDAPLPYSGAQGRASAAAAPDVMAGPSRSAAMPRDHA

SEQ ID NO: 52380 - protein, 361 aa, Kineococcus radiotolerans SRS30216
MALTIGIVGLPNVGKSTLFNALTKNDALAANYPFATIEPNVGVVALPDPRLDELARVFSSEKTVPAMVSFVDIAGIVKGASEGEGLGNKFLANIREADAICQVTRAFADPDVVHVAGAVDPADDIETVHTELVLADMQTLERAIPRLEKEVKGKKADPAVLRAAQAAQAVLDSGRTLYAATAKDDVDVALLKELGLLTTKPFLYVFNVDETVLGDAARMQELRDLVAPAEAVFLDAKLESELAELSAEEAAELLESVGQSESGLDQLARVGFATLGLQTYLTAGPKESRAWTIPRGATAPQAAGVIHTDFQRGFIKAEVVSFEDLTAAGSMAEAKAAGKVRIEGKDYVMADGDVVEFRFNV

SEQ ID NO: 52381 - protein, 642 aa, Cryptococcus neoformans var. grubii
MGFNGPSLTPSRPAPAPPGRGAKQMPNSTTPHGTSAHESNFSSASYSSSFPSIVSSTGNPARNIVFNKDAVVRSGTANVKEEGLRAFMWSKRWLVLRNSEFCIYKNENSPSPIYALPLENVQDVQRVDLKPFCIEIETGDRLIYFAVRTDDDVYGWMDDIYSRSPRLGVSQPTNFVHQVHVGFDPKSGGFTGLPAQWSKLLTSSAITKEEAAKNPEAVLDVLQFYTQQHASDGGETIGPSSVPMLPQQSLSTSAAATRFEGVGLGGQQKLEHVRGLMNDKKVSQSTSQMPSCSSVSDERILKKGKVVVRYEPSSGAERRPSRDPHHLSDPSSSSPMSLPVEKRISTMNESQIMGKLRSVVSVQDPTFLYSKIKKVGQGASGLVFVAKTVSSGRKVAIKQMDLSQQPRKELIVNEIIVMKESQHANIVNFLDAFLLKGSELWVVMEFMEGGALTDVIENNKLTEDQIAAICLETCRGLQHLHSRSIIHRDIKSDNLLMNSHGEVKITDFGFCAKLTDQKSKRATMVGTPYWMAPEVVKQKEYGAKVDIWSLGIMTIEMIESEPPYLDEEPLKALYLIATNGTPTLKSPDTLSQNLKHFLSVCLCVDVAFRATSTELLKHEFLQIACPVKQLAQLLKFKQSSVS

SEQ ID NO: 52382 - protein, 400 aa, Bacillus anthracis str. Sterne
MMTYTLATRMKAFQSSIFSELGAYKKEKIAAGHKMIDLSIGNPDMPPADFVREEMVHTANQKESYGYTLSGIQEFHEAVTEYYNNTHNVILNADKEVLLLMGSQDGLVHLPMVYANPGDIILVPDPGYTAYETEIQMAGATSYYMPLKKENDFLPNLELIPEEIADQAKMMILNFPGNPVPAMAHEDFFKEVIAFAKKHNIIVVHDFAYAEFYFDGNKPISFLSVPGAKDVGVEINSLSKSYSLAGSRIGYMIGNEEIVGALTQFKSNTDYGVFLPIQKAACAALRNGAAFCEKNRGIYQERRDALVDGFRTFGWNVEKPAGSMFVWAEIPKGWTSIDFAYALMDRANVVVTPGHAFGPHGEGFVRIALVQDKVVLQQVVENIRNSGIFALEKVDELVKN

SEQ ID NO: 52383 - protein, 643 aa, Cryptococcus neoformans var. neoformans
MAFNGSSLTPSRPAPAPPGRGAKQMLNSTSPHTASALESNFSSTSYSSSFASIVSSTVKPTANIVFNKDAVVRSGTANVKEEGLRAFMWSKRWLVLRNSEFCIYKNENSPSPIYAFPLENVQDVQRVDLKPFCIEIETGDRLIYIAMRTDDDVYGWMDDIYSRSPRLGVSQPTNFVHQVHVGFDPKSGGFTGLPTQWSKLLTSSAITKEEAAKNPEAVLDVLQFYTQQHVSDGRETIGPSSVPMLSQQSLSTSAAATRFEGVGLGGQQKLEHARGLMNDKKVLQSTSQMPFYHSSVSDERILKKGKVVVRYEPRSGAERRLSRDPHHLSNPPSSLPISLPVEKRISTMNESQIMGKLRSVVSVQDPTLLYSKIKKVGQGASGLVFVAKTVSSGRKVAIKQMDLSQQPRKELIVNEIIVMKESQHANIVNFLDAFLLKGSELWVVMEFMEGGALTDVIENNKLTEDQIAAICLETCRGLQHLHSRSIIHRDIKSDNLLMNSQGEVKITDFGFCAKLTDQKSKRATMVGTPYWMAPEVVKQKEYGAKVDIWSLGIMTIEMIENEPPYLDEEPLKALYLIATNGTPTLKSPDTLSQNLKHFLSVCLCVDVAFRATSTELLKHEFLQIACPVKQLAPLLKFKQSSHV

SEQ ID NO: 52384 - protein, 354 aa, Solibacter usitatus Ellin6076
MLNWLLIFVPVAIGLEFFTPGQHTLIFITACLAVIPLAGWLGHATEELARYTGEGAGGLLNATFGNAAELIIAFMAIRKGLYSVVKASLTGSIIGNILLVLGAAVLAGGLKHKHQRFNVTGARAQATLLTLAAIALVMPAAFHALAGPPNIVKEDGLSLAIACVLLIAYGLHLLFSLRTHKQLFEGEPEHQEEPEPAAWSLKRALLTLAGATLVIAWVSEILVGSVEQTAAAFGMTKVFIGVIVVAIVGNAAEHSSAVMLALKNRMELAMGIAVGSSLQIALFVAPLLVIVSHFIGPRPMDLMFTPAEVLAIFLAVLITGQISSDGESNWIEGVQLLAVYVIMAIVFFFLPEAG

SEQ ID NO: 52385 - protein, 179 aa, Frankia sp. CcI3
MDLEFDVTIEIPKGQRNKYEMDHHTGRIRLDRMLFTSTHYPSDYGFIEGTLGRDGDPLDALVLLEEPTFPGCLVRCRTIGMFEMTDEKGPDDKVLCVPVADVRQEHLRDLRHLPEFDRLEIQHFFEVYKDLEPGKSVEGASWVDRKEAEREILASIKRLREAEAAEADGHDQEAEPRSA

SEQ ID NO: 52386 - protein, 308 aa, Populus trichocarpa
MASSKSHDLEITIISAKHLKNVNWRNGDLKPYATFYLDNSDRRLATHADDSLSTRPVWNERFTLPITRQIYDSVLTLEIFHSKPSETPQPLVGTVKFPLSNLMVSDESLSCEVLTLELLRPSGRPQGKVRVKLEVKERPLPPPVQDYHTAPNYSHYYNPAPAPPPPPPPPPARDYREYSPSPYGYADPYGYYPAYYPPQPPRPLYNRASNYSLPGGPSAPVDLSAQSSPSPYDHKPPPPPPGLFQKTSNYGVPSGPSAPVDYSHGKGSGSLISGAMGGLSLEEGSNYEKEKVATDKESHSYHDYRREY

SEQ ID NO: 52387 - protein, 1406 aa, Bacillus cereus E33L
MKKKNRFVTGIVTAGVLFSTALPFNVLAENPINQIDSSNAQSLLSKLSKEQRQALQTLDANPGFTISPDINTSSSEPVNIIVEFQTAPVKINELKQKEKGLQAAPKNIKARIDQEHEEFQKGLKRLYHFSPSVKSGNFQSVQIKRSYKHAINGVALTLPANTVEELLRIGVVKRIWKDYEVKLNLPKQSEQKVPQKLTDSIPQIGVDKLHSEGITGKGIKVGVLDTGIDYNHPDLKDVYKGYRAKPGEDSSKIDPNSVKGWDFISNDADPMETTYTEWQQSGAPEFDDRGSSFYTAHGTHVAGIVSAQKKNKSDSAVKGVAPDIELYNYRVLGPYGSGASSGIIAAIDKSISDGMNVINLSLGDESNNPLDPTSIAVNNAMLSGVVTVVAAGNSGPNPATLGSPGASPFAITVGASDSSISLPKLSSHAGQVQFPNLILFGKNFTDKIEDFKGQTLSIESVGIGTPDEFSKKDVKGKIALVARGTLSFDEKIANAKQAGAKAVIIYNNVDGEIPFYVGESTKYIPAFRLTKEDGEKLKAQIEQGNTSFTFDELSYIQTEGDHLADFSSRGPVTSNDDIKPDITAPGVAVLSTVPEYINDPQEGENYDVSYERMQGTSMASPHIAGVAALILQEHPEYSPFDVKASLMNTADDLKEKYSVYEVGAGRVDAYNSVHTETSFKVLDTTKTVVNDEVIEVPEETGSIAFGKFYQKDGEALEQKRNIKVENHNKQEKKEFKTEISYTPASSINDAIANGVKVSTPETITLDAGKSDEIEAKVNVPAGVKQGRYEGYIHITNTKNKEETYQIPFSIRVSEPGIEDAVLSRKSISTDTTKFNPYRESYVHGAFQLNSNLETLDLIVKDSKTNKALGFLGTLNTGGLQTDVYYYLDAFFSGKVYPFTNDPAKPIGDEKINLPEGDYTIEFVGYDKDGKARVKGDYVIIDNTPPEVKLTGLKPGIYELNEENYTVEDGKKALWIKGNVYDSNVDYLKGKGLNITQEANGVMYYDYSPYLHKFLPIDANGDFKVGITPESFKVEGPMNTGVYIFDYATAGPDYPSGVNNYWFIQQGAQYAKANYDKKELYKGDEFTVTLNAKHVKQFVAGEFNVKFLEKNFKFANAKLNPAFEKLLSEKGVTAKVNEPKLEEGSVTVGGSIDDKNFAGLDGDFPFIDVTFKVENDEFYEANAQLESPVFVYWKPGETEPNRMRVLQDQTFSVMSLNSLVEGNIKPGAFLNERGYLDEKFDYTKLGVKVYATDSYRHKFEGSLDKYGYFKLNGLPVNKRDYNLFVEVPGHLTSRLTTKLGTEKDGKLFGQYYYARLDENLAGDVNGDKVIDIKDAEIIASNYGKKGVSVKDGDLNKDGIVDEKDIRFVEKNFLKKGPDASKSQTAAEKSKSGTLADILKKLGLTPKK

SEQ ID NO: 52388 - protein, 334 aa, Mycobacterium bovis AF2122/97
MRAVVITKHGDPSVLQVRQRPDPPPPGPGQLRVAVRAAGVNFADHLARVGLYPDAPKLPAVVGYEVAGTVEAVGDGVDPNRVGERVLAGTRFGGYCEIVNVAATDSVVLPDALSFEQGAAVPVNYATAWAALHGYGSLRAGERVLIHAAAGGVGIAAVQFAKAAKAEVHGTASPQKHQKLAEFGVDRAIDYRRDGWWQGLGPYDVVLDALGGTSLRRSYTLLRPGGRLVGYGISNMQHGEKRSMRRVAPHALSMLRGFNLMKQLEESKTVIGLNMLRLWDDRRTLEPWIAPLTKALNDGTILPIVHAIVPFAEAPEAHRILAARENVGKVVLVP

SEQ ID NO: 52389 - protein, 486 aa, Vibrio sp. Ex25
MTFINNVQAEKSLYIAGEWQSGMDTIANINPSDISENIGDFAQASVSQVEQAIQAAKSAQPEWEKTPIERKQAVLQAIGDELIARCDELGTLLSREEGKPFAEGRGEIYRAGQFFQYFAAEVLRQIGDNAASVRPGVSVEVTREAVGVIAIISPWNFPTATAAWKIAPALAFGNSVVWKPANLTPASAVALTEIIHRQGLPAGTFNLVLGSGSQVGNTLINSKDVNGVSFTGSVDTGRKVAAATAPNFVRCQLEMGSKNALVVADDADIQIAVEATIAGSFSGAGQKCTASSRLVVMDGIHDAYVEALIKRMSELKVGHALEEGVFMGPVVDGNQLNANFEWIENARQAGAELAFGGERLSLEHDGYYMSPTLFLNTQNNWEVNQEEVFAPMASVIRVSDLDEAIAVANDTRFGLTGGIITQSLRNSAIFKQQVQTGCVMVNLPTAGTDYHVPFGGRKESSFGPREQGQYAKEFYTVVKTAYQRPY

SEQ ID NO: 52390 - protein, 521 aa, Xanthomonas campestris pv. campestris str. ATCC 33913
MSSLHNDKILILDFGAQYTQLIARRIREIGVYCEIWAWDHDPSEIAGFGAKGIILSGGPESTTLPGAPVAPQEVFDSGLPVFGICYGMQTLAAQLGGATEAADQREFGHAEVDVVAADALFSGLTDHAGASRLNVWMSHGDHVSQVPPGFTITAVTDRIPVAAMSNEDKRWYGVQFHPEVTHTLQGQTLLRRFVVDVCGCQTLWTAANIIDDQIARVREQVGDDEVILGLSGGVDSSVVAALLHKAIGDKLTCVFVDTGLLRWQEGDQVMAMFAEHMGVKVIRVNAADRYFAKLEGVSDPEAKRKIIGNLFVDIFDEESNKLANAKWLAQGTIYPDVIESAGSKTGKAHVIKSHHNVGGLPEHMKLGLVEPLRELFKDEVRRLGVELGLPRTMVYRHPFPGPGLGVRILGEVKREYAELLAKADAIFIDELRKADLYDKTSQAFAVFLPVKSVGVVGDARAYEWVIALRAVETIDFMTAHWAHLPYDFLGTVSNRIINELRGVSRVVYDISGKPPATIEWE

SEQ ID NO: 52391 - protein, 321 aa, Bifidobacterium longum NCC2705
MTPELRHMLRDDDLNHEEQKQVLELAIKFHHDRFYKQPFAGPQAVAVLFDKPSTRTRSSFSIGVAELGGYPLVIDKSGSQLGRGEPVADTARVLNRMAYGVVWRTFGQGRVEEMAKYSTHPVVNALTDDFHPCQILADFQTIAEHRGGVDNLKNQTIAYLGDAANNMANSYLLGGAVAGMDVRVAGPYGYLPRPDIVADAKRVAAETGGSILVTTDAKEAVKDADCVFTDTWVSMGEEAEYAIRSKPFWDYQVNTELMALAKPDALFQHCLPAYRGKEVTAEVIDGPQSVVWDEAENRLHAQKALLTWLTGKARGDESLLA

SEQ ID NO: 52392 - protein, 240 aa, Bacillus cereus E33L
MRTPLSFDKDTAILLASCCELTYEQYKQNGIFEIPDGFQYVQGFQGKTIQTTEWFGFILESEDTVIVAFRGTQTDTDWIIDSLVNQKPYPYALNSGNVHNGFLSIYESCRDSIMDMLVSLPAHKKLLATGHSLGGALATLHILDARINTAFAQYGLYTFASPKVGDIAFRNYYKLQVASSFRFVNLFDVVPLLPPRNVHFNEQDWEYAHVHHNMTFTKNTKSITNNHAMTTYKTCLTSHF

SEQ ID NO: 52393 - protein, 616 aa, Xanthomonas campestris pv. campestris str. ATCC 33913
MSQPAESSELINVVTLLGAAVVAIPLFRRLGLGSVLGYLAAGLAIGPFGFGLFDDPQAILHVAELGVVMFLFVIGLEMRPSHLWSLRSEIFGLGTVQICVCALVLTGIGILLGFAPPVAFVAASGFVLTSTAVVMQLLAERGDVALPSGQKIVAILLFEDLLIVPLLAIVAWMGASGDPQAASQRWQGIGIGLACIVGLLVAGRWLLNPLFRILAASKAREVMTAAALLVVLGAALLMQVGGLSMAMGAFLAGVLLSESTFRHQIEADIEPFRGILLGLFFLGVGMSLDLRVVAADWRLILVGVLALMVGKAVCIYAVARLMRSDHRQALDRGVLMAQGGEFAFVLFAAASASGVIDAQVNASLTAIVVLSMALTPLFVLLQRRLTPAAAVSLDGVEEASGQTGSVLIIGFGRFGQVASQSLLARDVDVTIIDNDIEMIQSAEEFGFKIYYGDGTRLDVLHASGAHTARAIAVCVDNREAANRIVELATREFPHAKLLVRSFDREHALELIAAGVDYQIRETFESAVAFGEVALVELGVDEDEARTIAREIRRRDAERLELEIAAGNVRAGAGLMYGNIMPTVPKPTPFTPPKRESRTLNRDALPQELREETAERD

SEQ ID NO: 52394 - protein, 297 aa, Xanthomonas campestris pv. campestris str. ATCC 33913
MSKRIRKAVFPVAGLGTRFLPATKTVPKEMLPIIDKPLIQYAVDEAIQAGCDTLIFVTNRYKHSIADYFDKAYELEQKLERAGKLEQLELVRHALPEGVRAIFVTQAEALGLGHAVMCAKAVVGDEPFAVLLPDDLMWNRGDAALTQMADVAEASGGSVIAVEDVPHDKTASYGIVSTDAFDGRKGRINAIVEKPKPEVAPSNLAVVGRYVLSPKIFEYLESTGAGAGGEIQLTDAIAELLKQEQVDAFRFEGRRFDCGAHIGLIEATVHFALEHEKHGAPAKEIIRSALAAADARG

SEQ ID NO: 52395 - protein, 446 aa, Physcomitrella patens subsp. patens
MPPSAVQDDFPSTPGKVKVDRSNYLGRMTSRWHSSTATKILCTTSILLALTIFAVLWMGLPRGSEGYSGQRTQGFQRSHEWEKKVIHSCVTNREDNALTVLVTGAAGFVGTHVSLALKKRGDGVVGLDNFNSYYEVSLKRARQELLNKHGVFVVEGDINDKFLLESLFEVVQFTHIMHLAAQAGVRYAMQNPLSYVHSNIAGLVNIFEVCKSANPQPAIVWASSSSVYGLNTKVPFSEADRTDQPASLYAATKKAGEEIAHTYNHIYGLSITGLRFFTVYGPWGRPDMAYFSFTRDILKGKPISVYSGPGGKDLARDFTFIDDIVKGCVASLDTAEKSTGSGGKKTGPAMLRVFNLGNTSPVTVPALVDILEKYLNVKAKREIINMPRNGDVPFTHANISSAQEQLHYRPVTNLDTGLKKFVKWYLSYYGDNSNRKLWLGKHEQIL

SEQ ID NO: 52396 - protein, 391 aa, Deinococcus radiodurans R1
MTGTVGVMSDPLPAHLPLNRERLIAPGPVEVAPDVLLALAQPQMHHRAPQGVAKLMEAREKLTRLLGDPYDAVITTSSGTGAFEGALVSTTPTGAKVVNAQAGKFSERWGDMAKRFSYDTQIVAKPWGEMLDPDEVADACRGAHTLTITHSETSTGALHDLEAIAGAAKAQNPDLIIIADCITSYGNAELRPAAWGVDVVVSGSQKGTATPPGLGFVLFSPEVQGRMIKNTPHGFYLDMTRELAGQKAGSTPQTPAINLIYALSVALDHLLRVPLEVLWAEQRRKTDALIAAGTALGAPAWAARPSAAVAVLRPPEGIGGKQVAARLAEMGQRALPGQAPHEDTVFRVSTMGYADRYDTLGIAGMLEDCFASLGVQFERGAGVQAAWEVLR

SEQ ID NO: 52397 - protein, 534 aa, Chlamydomonas reinhardtii
MVWFHCEDCGDTIKKPKVVNHFRMCSASRFSCVDCLQYFTRATVQCTVCNVNCTSRETLVNHAAGAKHKRRARAALAAQNGGAAAGAAGAGAAGAGANGNGAAAAPAAPAANGNAAGQKRKADSSSSSDSSSSDDSSSSSGSEDSADKKKKAAAPAAKRQAVGAGAKPTAKKADSSSSSESSSSSEDSSDSDDSGDQKKKAPAAAAAKPAAAATKKADRSSSSSSDDSSSSDNESSEDSDDKKKKKAPAKAPAAAAGKPAAAAAAAAPAAKKAASSGSSPSSSEDDSSSSDESSDSDSDDKKAKKAPAAKAAAAAAAATKPAAAKPAASSSSSESSSEEEENSSSSDSDSDSGDAKTSSRPASEPSKTPVSNRSAAAAKAAKAAEAGGDGSGQGSGPGTSSSSSDSESSDSESSDSDDGDTKKAAKPAAAAKPTPTPTATATPAKKAAAASSGDDSSSSSSEEESSSDDSDSDSDSGDAKATKAKATPAAAPASSGKRKAASSSSGDDSSSSDESDSSSEDSSSSEDEAPAKKT

SEQ ID NO: 52398 - protein, 453 aa, Mycobacterium smegmatis str. MC2 155
MRMVVMGTGYLGATHAACMAELGHEVLGVDIDPAKLAKLEAGEVPFFEPGLSEVLRRHTSSGRLRFSSSYQEAAEFADVFFVAVATPQKKGDYGADLCFVDAVIDNLAPLLDKPSLIIGKSTVPVGTATRLGRCVRDLAPAGDAVELVWNPEFLREGFAVQGTLHPDRLVLGVERPGSGRAEGIVREIYADLINDGVPFIVTDLATAELVKVSANAFLATKISFINAIAEVCEAVDADVTVLADAIGYDSRIGRRFLNAGLGFGGGCLPKDIRAFMARAGELGANQALTFLREVDSINMRRRTRVVEIAREICGGGFIGSRVAVLGAAFKPDSDDVRDSPALNVAGQIQLQGACVNVFDPQAMDNSRTLFPTLNYATSAFEACDGADVVLVLTEWEEFRSIDPAELKTTVRSAAVIDGRNCLDAAAWCAAGWYYRALGRPAAPRGANASVVTK

SEQ ID NO: 52399 - protein, 461 aa, Solibacter usitatus Ellin6076
MATTREGGLIKGLGLVDSTTLVMGSMIGSGVFIVAADISRQVQSPGLMMMTWFVTALLTLIAALSYGELAAAMPHAGGQYVYLREAFGPLYGFLYGWTLFMVIQTGTIAAVAVAFAKYAGVFFPWISDQNYLLGAGKVGFTTQQLVAIAIIVFLTWSNTRGIRTGAMVQNIFTIAKVAAILGLIAAGFLVGRNPEAIASNFNGFWRNSGWNFDTVRLVGVAMVGSLFSSDAWNNVTFTAGEVRNPRRNLPLSLALGVCIVSALYILSNFVYLNVLTFDAIQHAPKDRVAALAAEHMLGPVALQIMAAAIMISTFGCVNGLTLAGARVYYAMAKDRLFFRRATELDPKTNAPVFSLTVQCAWSVALTLSGSYNDLLDYVIFAVLLFYILTIAGLFVLRRTRPDMDRPYKAIGYPVLPAVYILAAGLIEVLLLAYKPNYTWPGLIIVLLGLPVYFIWRGKATI

SEQ ID NO: 52400 - protein, 130 aa, Chlamydomonas reinhardtii
MLCARSQLVCKPVKAARASRATVKVQAFQVTLRMPSGKTKTMEVGPDEALFDAVERYDVDLPYLCRTGTCGTCAGRVQEGQVELKGQHILDPDQVKAGFILMCSAYPRSDCTILTHQEERLHTCEYGKHQ

SEQ ID NO: 52401 - protein, 479 aa, Solibacter usitatus Ellin6076
MSSQLFGTKSLSRIIAESEGGEHHLKKTLGPVNLVALGIGAIIGAGLFSLTGIAAADNAGPAVVLSFIVAAIGCAFAGMCYSEFSTMIPIAGSAYTYAYATMGELLAWIIGWDLVLEYAVGAATVSVSWSSYVVKLLQSFSIELPSSFIHCPWDEVPGIINLPAVLIVCAISILLMIGISESAKVNAVIVVVKVAIVIVVIAVGYSYIKPENYTPFIPPNTGTFGEFGFSGVMRAAAVIFFAYIGFDAVSTAAQEAKKPQRDMPIGIIGSLIVCTILYILFARVLTGMVNYKTFHGDASPVATVIHLFPSVALQTTIVIGIIAGYTSVILVMLLGQSRVFFSMSKDGLLPAVFSDIHPKFQTPWRCNMIFMVFVSLFSGFLPIAKLGHMTSIGTLLAFVIVCIGIIWMRKTNPNAPRPYRTPFVPVVPILGVLVCFAMMASLGAETWIRLFVWLAIGLVIYFTYGVKNSHLRKAPLNKR

SEQ ID NO: 52402 - protein, 215 aa, Hordeum vulgare subsp. vulgare
MSQEDSTSAAAAQQPTSRPAPKLNERILSSLSRRGGGAHPWHDLEIGPGAPAVFNVVVEITKGSKVKYELDKKTGLIKVDRVLYSSVVYPHNYGFIPRTLCEDNDPMDVLVLMQEPVIPGSFLRARAIGLMPMIDQGEKDDKIIAVCADDPEYRHYSTSVSLLPRLQEIKRLEDYKKNENKEVAVDAFLPATTAREAIQYSMDLYAQYILQSLRQ

SEQ ID NO: 52403 - protein, 107 aa, Porphyra purpurea
MSVSQVTDASFKQEVINNDLPVLVDFWAPWCGPCRMVSPVVDAIAEEYESSIKVVKINTDDNPTIAAEYGIRSIPTLMIFKSGERVDTVIGAVPKSTLESTLNKYIS

SEQ ID NO: 52404 - protein, 250 aa, Triticum aestivum
  misc_feature (84)..(84): Xaa can be any naturally occurring amino acid
  misc_feature (96)..(96): Xaa can be any naturally occurring amino acid
  misc_feature (120)..(120): Xaa can be any naturally occurring amino acid
  misc_feature (125)..(125): Xaa can be any naturally occurring amino acid
  misc_feature (156)..(156): Xaa can be any naturally occurring amino acid
  misc_feature (197)..(197): Xaa can be any naturally occurring amino acid
  misc_feature (217)..(217): Xaa can be any naturally occurring amino acid
  misc_feature (232)..(232): Xaa can be any naturally occurring amino acid
SPGCRIRYEALKNWSGKRPRSCSKRDEGEYASLQAIHDAVPSLCPQPLGHGRFESQPSTSFLVTEFLHLTGRSSSKSNPPSLAXKLAKLHTLPAPXPEGCDKPMFGFPVTTCCGDHHKDXNSYRXSWADYYAENRLRSILRSAEQNGRRDGRSRSXQQTAAMVVPRLIGDIISIRQGVCTRRLHGDLWSGNASAGVXGIRKGEVVDWFTTRRTCYAXHNEFELGAMKFGGFXREFLKESLSCVQDGAVRI

SEQ ID NO: 52405 - protein, 411 aa, Glycine max
MNALAATNRNFKLASRLLGLDSKLEKSLLIPFREIKVECTIPKDDGTLQSYVGFRVQHDNARGPMKGGIRYHPEVDPDEVNALAQLMTWKTAVANIPYGGAKGGIGCDPAELSISELERLTRVFTQKIHDLIGTHTDVPAPDMGTGPQTMAWILDEYSKFHGYSPAVVTGKPIDLGGSLGRDAATGRGVLFATEALLNEYGKSVSGQRFVIQGFGNVGSWAAQLISNKGGKVVAVSDITGAIKNSNGLDIPSLLEHSKVHRGVKGFNGSDPIDPNSILVEDCDVLVPAALGGVINRENANEIKAKFIVEAANHPTDPEADEILKKKGVVILPDIFANSGGVTVSYFEWVQNIQGFMWDEEKVNNELKTYMTKGFKDVKEMCKTHECDLRMGAFTLAVNRVARATVLRGWEA

SEQ ID NO: 52406 - protein, 397 aa, Oryza sativa Japonica Group
MPLTREAADAFGVATITLFAIFAVLGLFCIFQSIYFRFRIRRGAFIPLGYFNGPWVTRIVLILITIWWGVGEIVRLSFLKRKLFSSILLQKGVCDAYILSNLGFAEPSIFFAFAFLLHGSLQKRELGTLNQRWNWKTIGYMLVFCVPVFFVQALLVFVGPTFVKDENNTHGRKKIAKYFIRTSMPVGDTNICTYPLFGTIFLGLIDAILMSYVSYVGSRVLSLVINKALRRRVSLLMLSVLFFLPIRVLLLGFSVLPQPGDVAFEVIIFLSFLMMISCTTVGVLLLVYYPVADSLALREIGQREITEMVPYDDYYYEGASLVANQSFREIERNSDTSTKRGSISFRTMIREDQLQQDGVDEIGFSSRSGAHIGSPSPSGSSPSAAMPMLPLKEVPRY

SEQ ID NO: 52407 - protein, 174 aa, Porphyra purpurea
MKHTLSVLVQDEAGVLSRISGLFARRGFNIASLAVGPAEQIGVSRITMVVQGDNRTIEQLTKQLYKLVNILNVQDVTNIPSVERELMLIKIQVNSQNRIEALEIVKIFRANVVDIAEDLIIVEVTGDPGKIVAIEQLLTKFGIIEIARTGKISLVRTSKINTEYLKDKVVAYNA

SEQ ID NO: 52408 - protein, 293 aa, Hordeum vulgare subsp. spontaneum
MSPTLSLKLKKSSHTPQSSVSSSTKLRLFKKEAACQSPSTLPVAMDMGLEVSSSSPSSSSVSSSPEHAARRASPAKRPAGRTKFRETRHPVYRGVRRRGNTERWVCEVRVPGKRGARLWLGTYATAEVAARANDAAMLALGGRSAACLNFADSAWLLAVPSALSDLADVRRAAVEAVADFQRREAADGSLSIAVAKEASSGAPSLSPSSGSDSAGSTGTSEPSANGVFEGPVVMDSEMFRLDLFPEMDLGSYYMSLAEALLMDPPPTATIIHAYEDNGDGGADVRLWSYSVDM

SEQ ID NO: 52409 - protein, 711 aa, Bacteroides fragilis NCTC 9343
MHWFDLSLQLPITDPTWVFFLVLIIILFAPMILGRLHIPHIIGMILAGVVIGEYGFNVLERDSSFELFGKVGLYYIMFLAGLEMDMEDFKKNRTKGLVFGWFTFIIPMALGVWSSMELLGYGFTTAVLLASMYASHTLIAYPIISRYGLSRLRSVNITIGGTAVTVTLALIILAVIGGMYKGTVDGMFWVLLVVKVAFLSFLIVFFFPRIGRWFFRKYDDSVMQFVFVLAMVFLGSGLMEFVGMEGILGAFLAGLVLNRLIPHVSPLMNRLEFVGNALFIPYFLIGVGMIIDVRTLFTGGEALKVAVVMTVFATLSKWLAAWITQKIYHMQPNERSMMFGLSNAQAAATLAAVLIGHEIIMENGERLLNDDVLNGTVVMILFTCVISSLVTERSARRFALHEEMQFEDNKEKTEQEQILIPVANPDTIEDLINLALVIRDTKQKKELIALNVINDNNNSENKELQGKRNLEKAAMIAASADVSVNMVSRYDLNIASGIIHTIKEYDATDVVIGLHRKANIVDSFFGNLAESLLKGTHREVIIAKFLMPVNTLRRIIIAVPPKAEYETGFSKWVEHFCRMGSLLGCRVHFFANEQTLMRLQQLVKKKHGSTPTEFSRLDEWDDLLLLTGQVNFDHLLVVISARRGSISYDPSFERLPNQLGKYFSNNSLIILYPDQFGEPQEIVSFSDPRGYNESQHYDKVGKWFYKWLKKN

SEQ ID NO: 52410 - protein, 236 aa, Bacteroides fragilis NCTC 9343
MENWQQRTELLLGAEKMERLRKSHVLVVGLGGVGAYAAEMICRAGVGRMTIVDADIVQPTNINRQLPATHATLGMEKAKVLEARFRDINPEIELTVLPVYLKDDNIPELLDAARYDFIVDAIDTISPKCYLIYHALQRRIKIISSMGAGAKSDITQVRFADLWDTYHCGLSKAVRKRLQKMGVKRKLPVVFSTEQADSKAVLLTDDERNKKSTCGTVSYMPAVFGCYLAEYVIKRL

SEQ ID NO: 52411 - protein, 207 aa, Triticum aestivum
  misc_feature (76)..(76): Xaa can be any naturally occurring amino acid
  misc_feature (79)..(79): Xaa can be any naturally occurring amino acid
  misc_feature (99)..(99): Xaa can be any naturally occurring amino acid
  misc_feature (101)..(101): Xaa can be any naturally occurring amino acid
  misc_feature (107)..(107): Xaa can be any naturally occurring amino acid
  misc_feature (109)..(109): Xaa can be any naturally occurring amino acid
  misc_feature (114)..(114): Xaa can be any naturally occurring amino acid
  misc_feature (125)..(125): Xaa can be any naturally occurring amino acid
  misc_feature (132)..(133): Xaa can be any naturally occurring amino acid
  misc_feature (135)..(135): Xaa can be any naturally occurring amino acid
  misc_feature (143)..(143): Xaa can be any naturally occurring amino acid
  misc_feature (147)..(147): Xaa can be any naturally occurring amino acid
  misc_feature (150)..(151): Xaa can be any naturally occurring amino acid
  misc_feature (155)..(155): Xaa can be any naturally occurring amino acid
  misc_feature (161)..(162): Xaa can be any naturally occurring amino acid
  misc_feature (164)..(164): Xaa can be any naturally occurring amino acid
  misc_feature (167)..(167): Xaa can be any naturally occurring amino acid
  misc_feature (169)..(169): Xaa can be any naturally occurring amino acid
  misc_feature (171)..(173): Xaa can be any naturally occurring amino acid
  misc_feature (175)..(176): Xaa can be any naturally occurring amino acid
  misc_feature (178)..(179): Xaa can be any naturally occurring amino acid
  misc_feature (182)..(182): Xaa can be any naturally occurring amino acid
TKVPSKPASSIPTRSTPQLPVEQDKATTSRAIEVTTDSAKTDDIQLAIRMPDGPSLQIKLTKEDVLRKVKTFVDEXPRXVGLGAYNLAMLYPRVVFAEXEXETSWVXSXGIETXPRPLVSFRDVXLLRVGRXXSXLPSSDLDXAGAXDRXXGWGXLGEALXXVXPWXYXRXXXHXXSXXDRXKKIPTAQIQLLGDGAAPEFGGDEKK

SEQ ID NO: 52412 - protein, 282 aa, Physcomitrella patens subsp. patens
MASESVTFPIDITKTRLQLQGEMGATAGAPKRGAISMAISIGKEEGIAGLYRGLSPALLRHVFYTSIRIVAYENLRTALSHGEHPENLSVAKKAFIGGTSGIIGQVIASPADLVKVRMQADGRLVKLGQQPRYTGVADAFTKIARAEGVTGLWRGVGPNAQRAFLVNMGELACYDQSKQWIIGRGIAADNIGAHTLASVMSGLSATILSCPADVVKTRMMNQGAAGAVYRNSLDCLTKTVKAEGVMALWKGFFPTWTRLGPWQFVFWVSYEQLRRISGLSSF

SEQ ID NO: 52413 - protein, 382 aa, Cryptococcus neoformans var. neoformans JEC21
MSDFHQAPHKLLVIPGPIEFSDPVLAANATPGTAHTSPAFIPVFGEALSLLRDVLLSAKESGSQPLLIAGSGTLGWDAVAANLIEKGEEAVVLNTGYFSDSFGECLEAYGAKVTHVKAEVGGIPTDDAIISALASKPKLLTITHVDTSTGVLSPADHIASLVKKHSPDTLIALDAVCSVASEEIKFDEWGLDVVLSATQKGLGVPPGLSVVLASKRAVETVEKRKTPIPAYYVSWKKWIPIMQNYESGKPSYFATPPVQLVYALHTSLKSITSAPLADRFKAHKAASAYVKDSLAELGLEFVPKSRDIAANGMTAVRFPKGVKAPDVLPKLAERDIVVAAGLHKAIVSEYFRIGHMGITAVDRQRGDLEKVVKGIKEVLGKA

SEQ ID NO: 52414 - protein, 431 aa, Bifidobacterium longum NCC2705
MATEHEEKLGTEDSKWLGEYSQVHMNVFGTPLRVMDHGQGAHIWDVDGNEYLDFLAGIAVNSLGYAHPKWVKAVADQAAKVAHISNYFASEPQIELASKLVKLAGAPEGSKVYFGNSGAEGNEAALKLAKLYGRTLPGALPSIGGKPARILAMTHGFHGRTMGALSATWKPGIRKPYDPLVPNIEFVRAGDKVALHDAFAQTGLGRYGKGPVAAVILELIQGEAGVQPLGADYVKFVRELCDINHALLIIDEVQTGIGRTGKWFAFQRDDLSGGVTPDMVTFAKGVAGGFPMGGMIAFGEKLAALFTPGSHGSTFAGNPLGAAAGLATLDVIEDENLVANAEARGEQLRDGIMATGNPLFVSVRGRGLLDAVELKHPCSHAVMNYCLEHGLIVNAVAPNALRFAPPLIVTAQDVDQALAILKDVPTDLPDD

SEQ ID NO: 52415 - protein, 222 aa, Candida albicans SC5314
MSDPINANPTIIDVADLPTRLNNDNNNNNDNNYQTTNKLNLKKNKQMISQLVSLSLLNPDESPEAADDETSLSSDEENEDDDFDPIDEQEIFDLIATISDPEHPLTLAQLAVVNLSDIKITNPPNCGGDGGDGGGGGISEVLIKITPTITHCSLATLIGLGIRVRLDRSLPSRYRIKILIKEGTHQSENQVNKQLNDKERVAAACENDQLLNVISQMLSTCK

SEQ ID NO: 52416 - protein, 318 aa, Bifidobacterium longum NCC2705
MSTELKGPGFHFDVHTDLRADQKAEVLIEALPWLEEFAGQRIVVKYGGNAMVDDHLKQCFAEDMVFLRQVGLHPIVVHGGGPQISHMLKALGIKSEFKGGLRVTTPEAMDVVRMVLTGKVSRELVGLINAHGPLAVGMSGEDGGLFSAMQRRPVIDGKPTDIGLVGDVVSVDASAVEDLVAAGRIPVVSSVAPNEEDATEVLNVNADSAAAALAAAVGAHKLVILTDVDGLYADWPDKNSLIGRIGVENLRDMLPDLESGMRPKMEACVRAIDGGVPQAHVIDGRKPHSILNEIFTSAGIGTMVMPDEGLEMRSSYGY

SEQ ID NO: 52417 - protein, 356 aa, Oryza sativa Japonica Group
MRLALAASLLVISCFIVVKIRKSGKFQLRIIGKNSNPKENIEELLDNYGSLAPKRYKYSQLKDMTGSFSEKLGEGGYGMVYKGTSPDGHSVAVKFLHDLTRNGEEFVNEVISIRRTSHVNVVTLVGFCLEGSKRALIYEYMPNGSLEKFIYAENSKTTLGWDKLYDIAVGIARGLEYLHRGCNTRIIHFDIKPHNILLDHDFVPKIADFGLAKLCNPKESYLSMAGMRGTIGFIAPEVFSRRFGVVSTKSDVYSYGMMLLEMVGGRKNLKASVDNPSEMYFPDWIYRCLADVGSLHSFDMEHETEEIARKMASIGLWCIQVSPSSRPTMSKVLEMFERSADELEIPPKHCFYSAIQ

SEQ ID NO: 52418 - protein, 107 aa, Zea mays
  misc_feature (30)..(30): Xaa can be any naturally occurring amino acid
  misc_feature (94)..(94): Xaa can be any naturally occurring amino acid
NIVSMANPKGLGYAMYTTQHLKFVKDISAXTGIVLDTVHSGKAVYRLLKDMLCNPSTWKGRKVLFIHSGGHLELYDKAVQLSSVAGSWLIMAIXDCVPWIDGTGKMF

SEQ ID NO: 52419 - protein, 142 aa, Brassica napus
TKLAFTLKQIGEYGPKAFYNGTVGVNLARDIRKAGGVITLKDLQSYRVKVTKPLSANILGYELLGMPPPSSGGAAMMLVLNILSQYGIPSGVSGSLGVHRLIEALKHAFAVRMNLADPDFVDVTKVVSDMLSPEFAKDLKKK

SEQ ID NO: 52420 - protein, 839 aa, Sorghum bicolor
MTRLLSSYLLTVIFTVFLLLLKASAAGTPSDTLSSSSNITDGETLVSSGSSFTLGFFSPAGVPAKRYLGVWFTMSPEAICWVANQETPLNNTSGVLVVDDSTGTLRLLDGSGHTAWSSSSSTTTTSSAPPPPVVLPQAQLLDSGNLVVRDQSTGDVLWQWFDHPGNTYLAGMKFGKNLRTGAEWTTTSWRASNDPAPGDYWRSLDTRGLPDTITWHGNVKMYRTGPWNGQWFSGIPEMASYLDLYSNQLVVGADEIAYSFNTTAGAPISRLLLNENGVMHRLGWDPVSLVWTSFAEAPRDVCDNYAMCGAFGLCNMNTASTMFCSCAVGFSPVNPSQWSMRETHGGCRRDVPLECGNGTTTDGFKMVRAVKLPDTDNTTVDMGVTLEQCRERCLANCACVAYAAADIRGGDHGCVMWTDAIVDVRYIDKGQDMYLRLAKSELVEKKRNVVLIILLPVTTCLLALMGMFFVWVWCRRKLRGKRRNMDIHKKMMLGHLDETNTLGDENLDLPFFSFDDIVSATNNFAEDNMLGQGGFGKVYKGILGENREVAIKRLSQGSGQGTDEFRNEVVLIAKLQHRNLVRLLGCCIHGDEKLLIYEYLPNKSLDSFIFDAARKNVLDWPTRFRIIKGISRGVLYLHQDSRLTIVHRDLKTSNILLDADMNPKISDFGMARIFGGNQQEANTNRVVGTYGYMSPEYAMDGAFSVMSDTYSLGVILLEIISGLKITSTHSTSFPSLLAYAWSLWNDGKAMDLVDSFVLESCSANEALRCIHIGLLCVQDNPNSRPLMSTVVFMLENETTLLSVPKQPMYFSQWYLEAQGTGENTNSSMNNMTVTVLEGR

SEQ ID NO: 52421 - protein, 520 aa, Oryza sativa
  misc_feature (262)..(262): Xaa can be any naturally occurring amino acid
QVLLFIRLFFFLSLYHHFALPILLAPLLFPKLPRNFELFKMPRTDNAASANSVEPDKSEECLEFDDEEEEVEEEEIEYEEIEEEIEEEEEVEEDEDVVEEVEEVDEEEDEEEDEESDETEGVSKTKGDHQKDVTEKGKHAELLALPPHGSEVYVGGISSDVSSEDLKRLCEPVGEVVEVRMMRGKDDSRGYAFVNFRTKGLALKVVKELNNAKLKGKRIRVSSSQAKNKLFIGNVPHSWTDDDFRKAVEEVGPGVLKADLMXEYARQEMSSPTFKLDSNAPTVSWADPKNNDSVSTSQVKSVYVKNLPKNVTQAQLKRLFEHHGEIEKVVLPPSRGGHDNRYGFVHFKDRSMAMRALQNTERYELDGQVLDCSLAKPPAADKKDDRVPLPSSNGAPLLPSYPPLGYGIMSVPGAYGAAPASTAQPMLYAPRAPPGAAMVPMMLPDGRLVYVVQQPGGQLPLASPPPQQAGHRSGSGGRHGGSGSRYGGGGGSSGSSRPGAKRQRGDDNSSSRHKGRRRPY

SEQ ID NO: 52422 - protein, 488 aa, Psychrobacter arcticus 273-4
MLKTTLNLSNPDLIKQQCLIKDGWYAANDEATIEVSNPFNGDVIGTVPSLTTADVNDAVTYSHEAQITWAAKTPQERAQLLQKWADLIDANKEDLAIIMTAEQGKPLAESRGEIGYANSFIRWFAEEGKRVYGDVIPATNSQLRYVVLKQPVGVCAAITPWNFPAAMITRKAAPALAAGCTIIIKPATETPFSALALGALAEQAGIPAGVIQVVTGKSSTIGDILTGDARIHKLSFTGSTEVGRTLMAQCAPTIKKLSLELGGNAPFIVFDDADLEKAADGLIASKYRNAGQTCVCANRVYVQDSIKDEFLGIFIKKVAELKVGNGMEEGVNVGPLINEKALQKVQALLKDALDKGATLIAGGSTNNASALAYNPTVITDISADMDIASEEIFGPIAPVFTFSSEEEVIRAANDTIYGLAAYFYSSDYARAWRVTEGLEYGMVGHNTGMLSTEVAPFGGVKQSGFGREGSKYGIEEYVVTKYWCSDVS

SEQ ID NO: 52423 - protein, 321 aa, Bacteroides fragilis NCTC 9343
MDKKISISQIKEVVQQAYEQVKGNTGGKNADYIPYLANIDKNLFGISVCLLNGQTITVGDFDYRFGIESVSKVHTAILILRQYGAQKVLEMIGADATGLPFNSIIAILLENDHPSTPLVNAGAISACSMVTPIGNSDKKWDAIVQNITDLCGSAPQLIEELYKSETATNFNNRSIAWLLKNYNRIYDDPNMSLDLYTRQCSLGVTAQMLSVAAGTVANGGVNPVTKKQVFDAELTPKITSMIATVGFYEHSGDWMYTSGIPAKTGVGGGVMGVLPGVFGVSAFAPPLDGSGNSVKAQLAIKYIMNKLGLNVFNGARVTIVD

SEQ ID NO: 52424 - protein, 419 aa, Psychrobacter arcticus 273-4
MTTNQSLLARRKAILPTGLGVAFPIFAEKAKNSEVWDVEGNRYIDFVGGISVLNTGHSHPKITQRVHEQLDKFTHTAAQMINYECYVDLAEKLCEKAPISGDTKAFFLTTGAEAVENCIKIARAKTGRPGVISFVGGWHGRTLMCMSLTGKVLPYKKNFGPMPGPVFHALFPAEELNVTEEQALHSLEMIFQADIDPSEVAAIIIEPVQGEGGFHQVTPSFAKSLRDICDEYGIVLIFDEVQCGFARTGTLFACEQLGVEPDLMTSAKSLAGGYPISAVIGRADIMDAPQIGGLGGTYSGNPLACVAALAVMEVIEEENLLERSIEIGDKIESFLKDLNLSSIGHIRHKGAMLAFELIDNEGKPDVEATTNLKAKSFEQGLLLASCGMYGNAIRVMVPLTVEDEVLQEGLDIIKGILTA

SEQ ID NO: 52425 - protein, 725 aa, Physcomitrella patens subsp. patens
MAATAALSQAVALNKLAAPVSSSSSVLRADSSGFFGIQKLNLLRGQHTSLCLRSNEKSKILAAKVPENGAEYPSEKPPTPLLDTVNYPVHMKNLTKRELKQLADELRAETIHTVSKTGGHLGSSLGVVELTVALHYVFNAPDDKILWDVGHQTYPHKILTGRRGKMQTLRQTDGLSGFVKRAESEYDPFGAGHSSTSISAGLGMAVGRDLKGKKNNVISVIGDGAMTAGQAYEAMNNAGYLDCNMIVILNDNKQVSLPTATLDGPAPPVGALSSALSRLQSSRPLRELREVAKGVTKQFGGSAHILASKVDEYARGMISGSGSTLFEELGLYYIGPVDGHNLDDLVTILREVKNTSTTGPVLIHLVTEKGRGYPYAERAADKYHGVVKFDPATGKQKKVKTATQAYTTYFAEALIAEAELDKSIIGIHAAMGGGTGMNMFAKRFPERCFDVGIAEQHAVTFAAGLACEGLKPFCSIYSSFLQRGYDQVVHDVDLQKLPVRFAMDRAGLVGADGPTHCGAFDVTYMACLPNMVVMAPSDEAELFNMVATAVTIEDRPSCFRYPRGNGIGVELPANNKGAPIEVGKGRILLEGTQVALLGYGTMVQNCLAAHSLLAKLGISATVADGRFCKPLDRDLIRQLAKNHQVLITVEEGSIGGFGSHVAQFMALDGLLDGKLQWRPLVLPDRYIEHGSPKDQYAEAGLTAGHIAATVLNVLGKTREALELMS

SEQ ID NO: 52426 - protein, 394 aa, Zea mays
  misc_feature (76)..(76): Xaa can be any naturally occurring amino acid
MKVLVLAVLALVAAAAAAGQGEEGGGPPLPFAVGAAPAGCDVAQGEWVRDDDARPWYQEWECPYIQPQLTCQAHGXRPDKAYQSWRWQPRGCSLPSSFNATLMLEMLRGKRMLFVGDSLNRGQYVSLLCLLHRAIPDGAKSFETVDSLSVFRAKNYDATIEFYWAPMLAESNSDDAVVHSADDRLIRGAPMDRHSSFWKGADVLVFNSYLWWVAGDKIQILRGADNDPSKDIVEMKSEEAYRLVLHQVVRWLERNVDPGKSRVFFVTASPTHTDGRAWGDDDAEGSSNCYNQTSPISAASSYRGGTSREMLRATEEVLATSRVPVGLVNITRLSEYRRDAHTQTYKKQWVEPTAEQRADPRSYADCTHWCLPGVPDTWNELLYWKLFFPSNDQV

SEQ ID NO: 52427 - protein, 347 aa, Xanthomonas campestris pv. campestris str. ATCC 33913
MTGMTDSVRFPAEWESQSAILIAWPHAGTDWAERLAEVEDTYIALVTAITRFQPVIICVADDDLQIYAEARLRSARVEMAQVRFVVAAYNDTWLRDSGPITLRHGDGFRLMDFRFTGWGGKFEASLDDQLVSSLDAASVFVPADVQTVDFALEGGAIETDGAGTLLTTWKCLHERHPQRSRDSLSSDLATWLAQDRVLWLDHGYLEGDDTDAHIDTLARFAGADAIVYQGCAVPSDSHYAELQAMGEELAALRKADGQPYRLFVLPWAEPILDQGRRLAASYANFLIVNGAVLMPAYGDAADAAAQAVLADAFPQHQIVPVPCRPLIWQNGSLHCLTMQLPAGLLAA

SEQ ID NO: 52428 - protein, 501 aa, Physcomitrella patens subsp. patens
MKSRSGFTSSGNGVDIRWIKTNGDDTSNQTAGVVYPSKSCKSKSCKVAVIGAGAAGLVTARELLREGHDVIVFEQTKSVGGVWVYDPEIEGDDLLGLSQDRKRVHSSMYASLRTNLPREIMGYTDFPFLPRDGRDGRRFPGHAEVAAYLQDFAEFYHLLDCVQFSTSVDYVGSCKDQNKISWKVRTRRRHQTDDVKEEQFDAVVVCNGHYSQPKLAEFPGSSSWPGVQMHSHNYREPSSFTDQTVVVIGNAASGEDISREIADVAKEVHISGRTWSASVDFSEPIGQHGNIWRHSTIECACEDGTVLFAEGGCVSADIILHCTGYFYHYPFLDTKGEVAVDENCVGPLYEHVFPPSLAPSLSFVGLPWKVVPFQLCELQSRWIAMALSRKIDLPSTQEMMDSVESFYAELEASGKPKRLAHNMATTQYDYDNWLADQTGSAPVETWRIQIFEATSKNKRANPETYRDEWPDEELHQEAFARLEELDLSCRLTVECIQQAKL

SEQ ID NO: 52429 - protein, 349 aa, Carboxydothermus hydrogenoformans Z-2901
MRWEGVIKAYREYLPVTEKTPLLTLNEGNTPLIYAPYLSQRVGAKVYLKFEGANPTGSFKDRGMVVAVAKAMEEGARAVICASTGNTSAAAAAYAAKAGLKCVVLIPEGNIALGKLAQALFYGAKVIAIKGNFDEALKLVREIGKNHPIAIVNSINPYRIEGQKTAAFEICDVLGDAPDYLFIPVGNAGNITAYWRGFKQYYELGKTKKLPKMMGFEAEGAAAIVKGEPIPNPETIATAIRIGNPASWQGAVAAANESGGKISYVTDEEIIEAYRLLARKEGIMAEPASAASVAGLLKYRREHEFNQDDVVVLVLTGHGLKDPDNALKQNANQPAVVEPDYNEVLKIIL

SEQ ID NO: 52430 - protein, 500 aa, Mycobacterium smegmatis str. MC2 155
MADPTGFLRVPKIEAAKRPVDERVGDWREVYERQDPHERAGEVSQQARRCMDCGIPFCHSGTAGCPLGNLIPEWNDLVRRGRWDAASDRLHATNNFPEFTGRLCPAPCEAACVLSISEEHTGGSVTIKRIEQSIADQAWMDGTVEPQPAQISTGKSVAVVGSGPAGLAAAQQLTRAGHEVTVYERDDRLGGLLRYGIPEYKLEKATLNQRLAQMRAEGTRFVTECEVGVDVSVEQLRNRHQAVVLAVGALRGRDNDVPGRELAGVHLAMEHLVPANRECEGDGPSPISAAGKHVVIIGGGDTGADCLGTAHRQGAASVTQLDYNPEPPERRDDTLSPWPTWPLVLRTSPAHAEGGARRFEVAVQRFVGDDNGHVRAVEIAEVRVTRDAEGRRQITPVGEPLEIPCDLALLAIGFEGVEHMPLLDDLHIELNKRGAIPCGSDWQTDAPGVFVCGDAHRGASLVVWAIAEGRSAAHAVDAYLMGESDLPSPVRPGTLPLAVV

SEQ ID NO: 52431 - protein, 178 aa, Legionella pneumophila
MSLMEIPSGRDVPNEVNVIIEIPMHGEPVKYEVDKKTGALFVDRFMTTAMFYPTNYGYIPNTLSEDGDPVDVLVITPVPLISGAVISCRAVGMLKMTDESGVDAKILAVPTTKLSKMYQSMQTYQDIPQHLLLSIEHFFKHYKDLEEGKWVKVEGWVGPDAAREEITSSINRYNHIKK

SEQ ID NO: 52432 - protein, 183 aa, Zea mays
  misc_feature (117)..(117): Xaa can be any naturally occurring amino acid
PPLEKELRSQIIVDAEEFKKAFVEKRKLNAETSKGQNRDREKLFLANQEKFHAGADKQYWKAISELIPHEIANIEKRGARKDKEKKPGIVVIQGPKPGKPTDMARMRQILLKLKHTXPPPHMKPPPPPAAATGKDGAPAAAGKDGAKPATVANGSVPEMEKAAAEASVPAAAPPAAIEPIAAA

SEQ ID NO: 52433 - protein, 447 aa, Mycobacterium smegmatis str. MC2 155
MSSTAEVAEGHLKRALGLPSLVLFGLVYMVPLTVFTTYGIVTQTSGGRVPLSYLVTLAAMVFTARSYARMSVAYPVAGSAYTYTQKSFGAPVGFLAGWSLLLDYLFLPMINYLVIGLYLSAAIPAIPAWVFILIAIAIVTVLNIVGIVSVARANFVIIAVQAIFIVAFLILATSKVFSYGTVDLAAPFTGDGTAPGFSPVLAGAAILCLSFLGFDAVSTLSEEAKDPKRTVPRAIMIATLASGLIFVVLSYVAQVVFPSNEFSDVDSGSLDVMMTAGGNFLQVFFTAAYVAGATGSAITSQASVARILYAMGRDGVLPRPFFGHVSPRFSTPVYAILAVAVISLLAIVIDLGILASVISFGALVAFSAVNLSVIKHYFVDHRERAGAQAINSLVLPLIGFALTVWLWFSLDGLALIIGLCWLAIGFVWLAGVTRGFQRPTPVLDMKE

SEQ ID NO: 52434 - protein, 231 aa, Triticum aestivum
MDSGDAWGRSSSTSSAAAAAARRLQSRYDLYMGFDDADAGGDEVEARGAEAYNCPFCGEDFDFVGLCCHIDDEHAVEAKSGVCPICATRVGADLIGHLTMQHGSYFKMQRRRRVRKVSSGSHSLLSLLRKDLRDGSLQSFLGGSSYVSNPPAAAPDPFLQSLICSLPVAEPSKDFRSESSDKTFLLNKFPDEKIVERAETSLSDKDQKERAQRSAFARGLVLSTIFDDDTM

SEQ ID NO: 52435 - protein, 293 aa, Hordeum vulgare subsp. spontaneum
MSPTLSLKLKKSSHTPQSSVSSSTKLRLFKKEAACQSPSTLPVAMDMGLEVSSSSPSSSSASSSPEHAARRASPAKRPAGRTKFRETRHPVYRGVRRRGNTERWVCEVRVPGKRGARLWLGTYATAEVAARANDAAMLALGGRSAACLNFADSAWLLAVPSALSDLADVRRAAVEAVADFQRREAADGSLAIAVAKEASSGAPSLSPSSGSDSAGSTGTSEPSANGVFEGPVVMDSEMFRLDLFPEMDLGSYYMSLAEALLMDPPPTATIIHAYEDNGDGGADVRLWSYSVDM

SEQ ID NO: 52436 - protein, 524 aa, Mycobacterium smegmatis str. MC2 155
MSTFTGALASPHALATEAGMAAFAEGGNAIDAAISAAAVLTVVYPHNVALGGDLIALVRTPDGIIRCVNASGWSGAQATAERMRTRHGRSLPARHADSVTVPGGVRGWEALRSLGCRISWAQTLAPAQRVAEAGVAVAKSLAHHIADPENADLAESEDFCRVFRPGGRMLATGEVLVQPALASTFAALRQQGPAAFYTGALADSMLAHLGKHGSCLAAADFAEFTPEFTEPLSARFGDLTVLTSPPNTHGFAMLRALRAIEERDVADPLGAGIGTLMRIFHHGNVLRERRLGDPRLSDIDTHALVNGALGEVAELGKHPGPVLVPHGDTVGVAAADSDGFVVSLIQSVYHAFGSGLIDPGTGVLFHNRGTSFSLDPDSPNVIAPRKRPAHTLMPALTTRDGAVRHVLATMGGQGQPQILTQVLLHAVAGDSAQSAVSAPRAIAGGQVDGATADSVVVEADLEAQARESLHASGLSMVEVPVHTEAMGQANVVFVDAGAMQAASDPRSDGAGMVAHYPRGPLTGG

SEQ ID NO: 52437 - protein, 235 aa, Photobacterium leiognathi
ASDGIMVARGDLGVEIPVEEVIFAQKMMIEKCNRARKVVITATQMLDSMIKNPRPTRAEAGDVANAIMDGTDAVMLSGESAKGKYPIEAVTIMAQICARTDDVVKPELGSRLDSPRLRITEAVCKGAVDTAEKLNAPLIIVATEAGKSARSVRKYFPTARILAVTTNTKTAAQLCLSKGVTPVVVDSIESTDAFYLRGKELALETGLGAKGDIVVMVSGALVASGTTNTASVHVL

SEQ ID NO: 52438 - protein, 1885 aa, Cryptococcus neoformans var. neoformans JEC21
MPIDPDAYMAGAIPTLSRGGSWLQGERQLRDSTLPPSHLHEGSRYSSSPGSNYNPQIPPTPGPSQFGGNPFILPRSPFQRPLSISDWALPSIYNGGRPPPMPMLSQLQTDISGASFIQGLKSEQVFGPVQHHAWLKSSSEADQNSVTSRSFDVQSLVSGARSVTSSVSVPQNVKSIRRMQYSHHHFDEHSSPEQGRSWENRGGSPKPLAPEPGYGMKKSPYMKLDGHLRRTSDASNQPPPYRKLSSQQIFPPVSSHDDYFLSSPTSSRHDGQLAIAKHRYPHSPNFLSPRPRHKKLGDQDLFRSAQLNSRTARLSLAGRECRTPDPEPSPDLSGYTIAPHAALRPSGGDDKRPSMERRHTASHIPEPTHASSSLPISPPIHKTLHQLKRTRHNSSSRALSFESSSYDEQATSGSTIDFTMSSPMSSRSSAGSNQSTPVNKQFPHLKADTSSQDSERSWSSWRLAEAHYMYLDGGCVCRRNWKAVKPGVAVGNASDATDRTEKSGGKRIRIMSVLAAISSLPATSYYHPIAQVPAGASKLNPYLPLPQSSTPTVLFTNANLLHSLPTASLSRTVIHVFDAEEIVTPKGANAVSLISRSSQGAYDHALLSLRLAQDKDAVVYHFIPSGLEGEIQTLEDAQAWLSGPLDAPDLSNGDDAEPSAEAKLIAAYESISLSLLKLTRRPQRPFIHSKAESSRLVVNFLPSPVKSENTIDVVLAIPAPKEKLSSSLSGVQEVVVVEAGSGKYGPAWASVVDALEGADVTIRSVLVGASASSEEIAAAITGDTPITRIGKPLSYNIPSNAVTVPSPESTYTELLASSPSPLEVLNDPSHLAANESTSPLYAFGKAVAIRKERARLVELAKKVLKAPNTKPEVHEALSAWLLVRDEKKGAVEAGKKVEAAIGAGKGDEKEIVELGQKGHWEKRALWIVISNSWAVDLASSGLHHALASGLDINLLVYETAASPFSPNAPAQPPKERKKDLALYALNMGDVYVASVAVYADYAGVLNAMREAENYSGPGLVLAYLPWGEKEDGQAVSDSENAGPLERLRETKRAVSGGWWPMFRWNPSLPDEKRFSLDSSHIKAALSEFLDRQSHLSQLTLATPAIDSSVTSSAGTELLAARKEKARKAYDALLNSLDGPGLLVLYASDGGNAEKLAKRLVGRAKMRGVSASLRVLDEVAGSIVETLSQEQNVLIVSSTAGQGESPLNGREFTKALSKLSPSDEFKETKVAVFGMGDSHYWPRPEDAGYYNKPARDLFPKLISLGCQELLPLGLGDDSDPDGVQTGYKPFEASLWRALGVDSVEVTEEKEEVVANEHIKIASDYLRGTILEGLADKSTGAISASDAQLTKFHGTYMQDDRDIRESLKAQGLEPAYSFMIRVRMPGGICSAKQWLDMDRISDEHGNGTFKLTTRQTFQFHGIIKSHLKKAMQAINKSLLDTIAACGDVNRNVQCTVNPSLSKTHATVYEFSKAVSEHLLPATNAYHEIWLDKKKISGDAVQPFDSDSEPLYGPYYLPRKFKIAIAVPPDNAVDVFTNDVGFIAIVENDEVIGYNVSVGGGMGVTHGNKKTYPRLGDVIGFITPEDGKKVAESIMLVQRDHGNRQDRKNARLKYTVDRLGLPKFKAFVEERWGKKFAPARAYHFDSNLDHYGWSQGHDGKWHFTMFIENGRVEDNSRHQFKAGLREIASVHKGTFRLTANQHLILSDIASEDLDEMKRLLAKWGLDNLDHSGVRLSSSACVAFPTCGLAMAESERYLPVLIDKVEKICEEAGVKSDDLVMRMTGCPNGCARPWAAEVAFVGKAPGSYMMMLGGSHLGTRLNKPFLESASEPEILAVLKPMIKRWALERHEGERFGDWTIRAGYIKPTTHGTNFWEDAFPAQAGTTVTA

SEQ ID NO: 52439 - protein, 244 aa, Zea mays
MAAAEATRPLLVAISLAVAACCLAQLAVGDTNGVYEPCSDARIQRGDGFTFGVVFAGYNAFFSGNTQLSPCDRRLNLAASGQLAVFRPKVDEISLLTINTTTGFNPASAGGFMVAFAGRKYAARSIPIFVSNTSVTVSSFTLVLEFNKGRLQNLHWKKDGCGACSGKSNFVCLGKQTCAIRTQSCKSQGPVDCSVGIQLAFSGTDKHESVLNSWYEVSNLRQYSLYGLYSNLKDTLSGQFNKIF

SEQ ID NO: 52440 - protein, 175 aa, Zea mays
MVFSAQAFWDYSEKKLVAKTKAECSVTSEWSPDGRHFMTATTAPRLQIDNCIKIFDHNGSLQFKKMFERLYQADWKPEAAERFTDIADLTTSLISAQGSKSAQTSSKAPAITAPKPTAYRPPHAKGSAELQDKLFGGLAPAGGEMSKNALRNKKRREKQKEKKAAEASGSPADES

SEQ ID NO: 52441 - protein, 480 aa, Psychrobacter arcticus 273-4
MSELKKSLGTLDVIALAFGAMVGWGWVVLAGGWILSAGTWGAMLAFFIGGLAVILIGVTYAELAASMPITGGEHTYTHRALGVNVSFICSWSILFGYFSVVAFEAVALPTVVEYFIPNYNQGYLWTIAGWDVYATWVGVGMLGSVIVTWLNIRGMEVSAWFQKTAVLGILFVGTLLFIGAVLYNPDTSTAIQSPAFIGGVGGMMAVIVMVPFMFVGFDVIPQAAEEIDLTRPNIGKFLIISIVVAVMWYVGIAWSVGTTLPLVQAESSTLATADAMTNAWQGKWAGILLVIGGVLGILSSWNAFLIGGSRLLYAMSKARMLPAFLGKLHPKYKTPSNAILLIGGLATLAPLFGRKMLVWIVDAGGFGIVIAYTCVAISFLVLRYREPDMVRPFKIPAGKLVGMVTIVLSVGLLMLYMPGMPSALTAVEWWIFFGWTMLGIVLYGYARVKYPGISESIMAEELRELKIVNQLWLKDNSTKK

SEQ ID NO: 52442 - protein, 496 aa, Bifidobacterium longum NCC2705
MSEQFDLVIIGAGPGGYSTALRAAELGMKVALVERDATVGGTCLNRGCIPSKALITATHTIDTVHRAAELGVNASVNGIDFGTLRDYRLRVVKTMVGGLAGLLAHRGITVFRANAAFHADETAPATSNHIVHLVPSPDQSDILTYHKADVPEPSGPTMDLTATNIVIATGAKPRPLPGNPFAGALIDSTQALEVNEFPSSAVIIGAGAIALEFASMWNAAGSKVTLLIRKDRVLSAWDRRAGTTLTRELKRHGVNIITRASVTHVDTGANLGATVHYTCEGQDGEQSVWGEIALVAIGRDPITDPAWGVTIDDHGHVATDAYGRTDKPGVWAVGDVTAGHALAHRAFEQGIVIAETIAGLNPKPVDEATVPQIVFSFPEAASVGLTVEQAQAREDLIEIKETNYPMLANARMLMSGTAGSLTIVSGCDAANPDTPRVLGVHMVSQMASDIIAEAEQLVGNHVPLADAARLVHPHPTFSETLGEALLKADGRPLHTR

SEQ ID NO: 52443 - protein, 198 aa, Helicobacter pylori
MLVTKLAPDFKAPAVLGNNEVDEHFELSKNLGKNGAILFFWPKDFTFVCPTEIIAFDKRVKDFHEKGFNVIGVSIDSEQVHFAWKNTPVEKGGIGQVSFPVVADITKSISRDYDVLFEEAIALRGAFLIDKNMKVRHAVINDLPLGRNADEMLRMVDALLHFEEHGEVCPAGWRKGDKGMKATHQGVAEYLKENSIKL

SEQ ID NO: 52444 - protein, 418 aa, Aeromonas hydrophila
MKFETISVVGLGYIGLPTAAVIASNGIRVIGVDVNQRAVDTINQGKIHIVEPGLEDLVKQAVQDGHLSAHTSPQKADAFLIAVPTPFQGEEHEPDLKYIESASRALAPMPEKGNLVVLESTSPVGATEQMAKWLAEERSDLTFPHTVAEGQTPDIFVAHCPERVLPGQVIRELVENDRIIGGMDKASTAAATLVYKMFVKKGECIATEARTAEMSKLTENAFRDVNIAFANELSLICDKQGINVWELISLANRHPRVNILQPGCGVGGHCIAVDPWFIVNQNPDTAKIIHQARLVNDYKPHYVVEQVEKAVAGLVNPKIACLGLAFKPDIDDLRESPALDITKTLANNPAYQILAVEPNIEVLPPVLENRNNVLLTDISSALSEADIVIVLVKHKQFLGINQHDAVKKNLIDFVNAAN

SEQ ID NO: 52445 - protein, 382 aa, Vibrio sp. Ex25
MKTFNLPDLGEGLAESEIVKWHVNVGDMVKLDQVILTVETAKATVDVPAPYSGRVVSRHGEEGDIVNIGALLLEIDETGAERGAAVEKKETADAATVVGNVSHQAHHVNVDDFWIGGNHNTTESNLVTALPSARLLAQKLGVDLNLVSGSGPNGLIVDADIYDEAGKQRPGTEVLKGARRTMVSSMTESHEHVAAVTITEEALLEDWLPNEDISIRLVQAIVHACQEEPALNAWFDAETMTRCVHNTVNLGIAVDSRHGLYVPVLRHADEYEPQDVRRWLDQTVEGIRERKIGREQLQHATITLSNFGAIAGIYATPVVTPPQVAIVGAGRILDRVVIRNGQAISVKAMPLSVTFDHRACTGGEAARFTKVLAEHLQRPSEK

SEQ ID NO: 52446 - protein, 410 aa, Psychrobacter arcticus 273-4
MNSSTEIQAILALADGTIFRGISIGSLGHRVGEVVFNTAMTGYQEILTDPSYARQLVTLTYPHIGNTGTNAEDVESGNGHKVWADGLIIRDATMVTSNFRHSESLSDYLQNHNTVAIADIDTRQLTRLLRDKGAQNGCIMTASNGETISSDDEQQAIKLAQEFAGIEGMDLAKECCTPTTFEWTAGSWDLSDTLLNRDIAGSHDSGTGGFFKHLGTHIEAKYNVVAYDFGSKTNILRMLVDRGCHVTVVPAQTPIADVLAMNPDGIFLSNGPGDPAACDYAIDAVRHIIEETNIPTFGICLGHQLIGLASGANTIKMKTGHHGANHPVQDLATGTVMITSQNHGFAVDEDTLPENVKSTHRSLFDGTNQGIELTNKPVFSFQGHPEASPGPHDAAPLFDKFADMLAAAKA

SEQ ID NO: 52447 - protein, 478 aa, Bifidobacterium longum NCC2705
MTELKSKEDVEALINKEGIEYVSVRFTDLIGVQQHFTVPASEFLKDAFTDGMPFDGSSVQGFQAINESDMKLVPDVETSFVDPFRKHKTLDVAFSIVDPLTDEPYSRDPRQVAGKAEAYLKSTGIADTASFAPEAEFFIFDKVRFENGMNRSFYEVDSIEAPWNSGVDVEEDGTPNIGFKNRVKKGYFPVPPIDHTQDLRDDMVANLQKVGLILERSHHEVAGAGQQEINYRFNTLQHAGDDLMKYKYVVHETAALAGKAATFMPKPIADDNGTGMHCHQSLWKDGKPLFYDEKGYAGLSDLARWYIGGLIKHSSSVLAFTNPSLNSYHRLVPGFEAPVNLVYSARNRSAAIRIPLAGTSPAAKRIEFRAPDPSCNPFLAFSAQLMAGLDGILNHIEPPEPVDKDLYELPPEEHAGIKQVPSSLAEAMDALEEDHDFLTAGDVFTDDLIETWIGLKRDEIDQARLSPTPLEYELYFHI

SEQ ID NO: 52448 - protein, 178 aa, Psychrobacter arcticus 273-4
MIYQYLDRVPTFAVPFNGWIADSACVIGDVYLGHQASVWFGAVIRGDNERIHIGDYSNVQENSVIHTDAGIEVKIGNHVTIGHLAMLHGCEVGDNSLIGIGAVILNNAKIGKNCIIGAKALVTEGKEIPDNSLVVGAPAKVIKTLTDEQAVMMKLSALHYAERCQKFKTGLREIEQPK

SEQ ID NO: 52449 - protein, 274 aa, Oryza sativa Japonica Group
MAGSSHVSADARKLVGKVAVITGGASGIGACTARLFVKHGARVVVADIQDELGASLVAELGPDASSYVHCDVTNEGDVAAAVDHAVATFGKLDVMFNNAGVTGPPCFRITESTKEDFERVLAVNLIGPFLGTKHAARVMAPARRGSIISTASLSSSVSGTASHAYTTSKRALVGFTENAAGELGRHGIRVNCVSPAAVATPLARAAMGMDMDDETIEAIMEKSANLKGVGLKVDDIAAAALFLASDDGRYVSGQNLRVDGGVSVVNSSFGFFRD

SEQ ID NO: 52450 - protein, 274 aa, Oryza sativa Japonica Group
MAAGSSHVSADARKLVGKVAVITGGASGIGACTARLFVKHGARVVVADIQDELGASLVAELGPDASSYVHCDVTNEGDVAAAVDHAVARFGKLDVMFNNAGVSGPPCFRMSECTKEDFERVLAVNLVGPFLGTKHAARVMAPARRGSIISTASLSSSVSGAASHAYTTSKHALVGFTENAAGELGRHGIRVNCVSPAGVATPLARAAMGMDDEAIEAIMANSANLKGAGALKADDIAAAALFLASDDGRYVSGQNLRVDGGLSVVNSSFGFFRD

SEQ ID NO: 52451 - protein, 407 aa, Physcomitrella patens subsp. patens
MAYDGFSGGADDLSGYSGFDDSARFDSSRLESARFDSSFRAADDYKPDPFGLDDNREGFDEFKGASDGYGHPAPIYENEESGGGMPSTYGAGYAGAEYASNPTDEGSYHKELDEDLFGGDGGGGPMLPPPEEMQEEGAVLRQWKRENAQRLQEKEREEKEKLQQIIDDADDYKAKHKAKREANREARMKENRDKETVYHADQEHFHKTAGKQYWKAVTELVPKELPASLEPKSRQMKEKKEKKSTFVALPGPKPGKPTDLGRFRQVLLKLKHNPPAHMIPPPPAAPKPEAKEGEKGAKGEAGKEGGKGKENAPGAPGAAVEGAEVPEAPATCYSAGSSRDEGIGEISFRFLLVGTLCEWTGSDAPFVKGASGASLRKCAHCCIFIFFVDVSVMFVGVAVATLESAGA

SEQ ID NO: 52452 - protein, 584 aa, Magnaporthe grisea 70-15
MSMTADGSSPAGNASTTHGSFRMNGLGIEGLLMPLLGGGMHANPLMRTFMLVNQTLGAYLGIDPTALVTAMGFVWATYRLTRQFWSLVWHGLVLEYMTSSVSVVSDDEIFDHVMVWLAAQPRTERSRLLMAETALQSAWEGDRGEYAATRQAVPVTVSEDGKEYVNFSQQKASTKPVMEGSNIAPAAVTIRDKETMVISCFGLSPEPIKELLAHAREHYYKDHYAKTLIKRPNSSLIRRHGRHSWTSVANRPVRPMNTVVLDQKQKTAVLSDMNEYLQPETPRWYANRGIPLRRGYLFHGPPGTGKTSLSFALAGVFGLDIYVVSLLEPQLSEEDLSNLFNCLPRRCVVLLEDIDTAGLTRTEEKIGHSVRTNTKTTTTTGSNATSPPSGPNEWKVTDLARALKGGRGSDGEQKGISLSGLLNAIDGVASHEGRVLIMTTNRPESLDDALIRPGRVDLQVAFSNATQEQASELFQRMYTPDQSTKSPPFTDLQPQKETRLFLGKQDAIDGKDDSETPITDADELSRIAAEFGSKIVSGQLSPAEIQGFLLKRRKWPRKALRDVEGWVKAMVEQKASKSKVTQAQ

SEQ ID NO: 52453 - protein, 278 aa, Acinetobacter sp. ADP1
MSATLKSNITFIGGGNMAQALIGGLIARGLPSTRIMVSDPVEAIRQVLQEKEIQALNNNVEAIQHADVVVLAVKPQVLATVLKPLQGLFDGKLIVSIIAGAEIETIAELSGTDRIVRVMPNTPALVQTGAHGLYANENVGSDDRDLASQILAATGLTIWVNSEAQIDAVTAVSGSGPAYFFYLMESMIRAGKNMGLDEKVATALTLQTALGAAQMAITSSNTPSELRKNVTSPNGTTQAALEVFDRAQISQNIQTALAAAQKRSQELAHELSDSTKTT

SEQ ID NO: 52454 - protein, 338 aa, Thermosynechococcus elongatus BP-1
MDVLVTGVAGFIGHGAALALLRRGDRVIGLDNLNDYYDVNLKKSRLEHLNISSQPGQFIFRKIDLVDRLGVNQLFADFSPQKVIHLAAQAGVRYSLENPFAYIDSNIVGFLHILEACRHHRVEHLVYASSSSVYGANKKLPFSVHDNVDHPLSLYAATKKANELMAHTYSHLYNIPTTGLRFFTVYGPWGRPDMALFKFTRAILNNEPLPVFNYGKHRRDFTYIDDIVEGILRVLDRPAAPNPAWCGETPDPATSLAPWRVYNIGAHRPIELLRYIELLEEYLGKKALITFLPLQPGDVPDTYADVTALKEDTGYEPITPVEIGVQRFVEWYRDYYRV

SEQ ID NO: 52455 - protein, 339 aa, Myrothecium gramineum
MAPIKVGINGFGRIGRIVFRNAVEHSDVEIVAVNDPFIEPKYAAYMLKYDSTHGLFKGEVTVDGDDLTVNGKKVRFYTERDPAAIPWKETGAEYIVESTGVFTTKDKAAAHLKGGAKKVIISAPSADAPMYVMGVNEETYDGSADVISNASCTTNCLAPLAKVIHDKFTIVEGLMTTVHSYTATQKTVDGPSAKDWRGGRGAAQNIIPSSTGAAKAVGKVIPDLNGKLTGMSMRVPTANVSVVDLTARIEKGASYDEIKQVIKDAANGPLKGILAYTEDEVVSSDMIGNTASSIFDAKAGISLNDNFVKLVSWYDNEWGYSRRVLDLLAHVAKVDASKA

SEQ ID NO: 52456 - protein, 427 aa, Thermosynechococcus elongatus BP-1
MQQMEYSNLSIAVIGLGYVGLPLAVEFGKKYPTLGYDLNSLRVSQLIEGYDHTGEISSEELKGASYLTYTTNIQDLKKCSFFVVAVPTPVDDHKVPDLGSLKTASQHLGNVLPRNSIVVYESTVYPGVTEEICVPILEQASGLVFNQDFFVGYSPERVNPGDKEHRLTTIVKVTSGSTPEVAEIVDRVYASIVPAGTHRCSSIRVAEAAKVIENIQRDVNIALVNELSILFNRLGIDTQEVLTAAGTKWNFLPFRPGLVGGHCIGVDPYYLTYQASAYGYHPELILAGRRINDYMGTYVAQQFIKLLIQKGIYPQQARVLVMGLTFKENCPDLRNTRVVDIISELQDYGIQVDVYDPWADPDLAKKEYGISLIEELYPEYWDGAVIAVAHRQFFELGAAGIRRCLKTPSALYDVKWVLSKEDADGRL

SEQ ID NO: 52457 - protein, 515 aa, Oryza sativa Japonica Group
EPPRLPWNFELFKMPRRTDNAASANSVEPEKSEECLEFDDDEEEEVEEEEIEYEEIEEEIEEEEVEEDEDVVEEVEEVDEEEDEEEEEESDETEGVSKTKGVHQKDVTEKGKHAELLALPPHGSEVYVGGISSDVSSEDLKRLCEPVGEVVEVRMMRGKDDSRGYAFVNFRTKGLALKAVKELNNAKLKGKRIRVSSSQAKNKLFIGNVPHSWTDDDFRKVVEEVGPGVLKADLMKVSSANRNRGYGFVEYYNHACAEYARQEMSSPTFKLDSNAPTVSWADPKNNDSASTSQVKSVYVKNLPKNVTQAQLKRLFEHHGEIEKVVLPPSRGGHDNRYGFVHFKDRSMAMRALQNTERYELDGQVLDCSLAKPPAADKKDDRVPLPSSNGAPLLPSYPPLGYGIMSVPGAYGAAPASTAQPMLYAPRAPPGAAMVPMMLPDGRLVYVVQQPGGQLPLASPPPQQAGHRSGSGGRHGGSGGRYGGGGGSSGSSRPGAKRQRGDDNSSSRHKGRRRPY

SEQ ID NO: 52458 - protein, 106 aa, Triticum aestivum
  misc_feature (13)..(13): Xaa can be any naturally occurring amino acid
  misc_feature (94)..(96): Xaa can be any naturally occurring amino acid
MVKKGIQYVVVDXFTAQPFKGNPAAVCFLEDDAAAPAGDGRWMQSVAVEFNLSQTAFFSRDSSCAADAATPRFHLRWFTPVTEVALCGHATLAXXXFLFTSVLAER

SEQ ID NO: 52459 - protein, 474 aa, Agrobacterium vitis
MFIRSNRRAKIVATVGPASSSPAILRSLFLAGVDTFRLNFSHGSRDDHAAAYRHIRALEKELGTSIGILQDLQGPKIRIGVLHEGRLQLTKDAEIRFVCGTEPGRGLMDIPLPHREIFAAVKPGDDLLIDDGRVRVRALGVSDEFIDAKVIVAGPISNRKGVNLPGTVLDISPLTPKDRKDLEFGLELGVDWIALSFVQTARDMIEARSLVSDRAGLIAKIEKPSALDEIDDIVALSDAIMVARGDLGVEIPPEDVPGRQKELIRACRIAAKPVIVATQMLDSMVTSPTPTRAEASDVAGAIYDGADAVMLSAESATGAFPVETVEIMSRIIEKTEKHKFYRPILEATEPQIAHTPPHAVATAAADVALALKAPVIVAFTVSGTTASRISRARPPLPILALTPSEQTARQLGLMWGVVSLLSPTVDTYEQSVDRATQAAVQTGLAEKSDQIVVVTGFPFATAGSTNNLRVTQAG

SEQ ID NO: 52460 - protein, 262 aa, Zea mays
MANLFLKQAKQYVATRPVYPPELFDFIASKTPRRDMAWDVGTGNGQAAASLAKLYKHVVGTDTSAQQLAYATRLSNTRYVHTPADLPLEGIHATVAPPASVDLVTVAQAFHWLDLPRFYAQARSVLRPGHGVLAAWCYTEPRVDAAVDAVFWRLYHGSQGFWAPNRRMVDDEYRSADFPFDPVEGEKHTGPFQFSTHRRMDLDDYLMYITSWSAYQTAKDNGVELLDAPTVQEFAAAWGGDAKEVKTVTYPIFLRIGKVRSE

SEQ ID NO: 52461 - protein, 309 aa, Mycobacterium smegmatis str. MC2 155
MRNAPVSEENPQRAPVGVFVGLATLDVIHRIAKPPAVNEKITSTAQFVAAGGPAANAAVTFAALGGEATLVTALGDDPVADLIRADLTAYGVSVIDAAAGSARPVPVSSVAVVESTGDRSVISSDAVTSDAAPPDAIAELVARADVVLVDGHHPLMARAAAQHANQRGTTVVVDAGRWKPVMADLVPHVSDMVCSGDFRTPGADTSNATAAGLVESGVRTVVITHGGDPVTWWSGGESGEVPVPPVTVVDTLGAGDAFHGAYAYYSTRSDSGVAERIDRSSRVAALRCSVVGPRAWLSKLPDQIRKRER

SEQ ID NO: 52462 - protein, 293 aa, Hordeum vulgare subsp. spontaneum
MSPTLSLKLKKSSHTPQSSVSSSTKLRLFKKEAACQSPSTLPVAMDMGLEVSSSSPFSSSVSSSPEHAARRASPAKRPAGRTKFRETRHPVYRGVRRRGNTERWVCEVRVPGKRGARLWLGTYATAEVAARANDAAMLALGGRSAACLNFADSAWLLAVPSALSDLADVRRAAVEAVADFQRREAADGSLAIAVPKEASSGAPSLSPSSGSDSAGSTGTSEPSANGEFEGPVVMDSEMFRLDLFPEMDLGSYYMSLAEALLMDPPPTATIIHAYEDNGDGGADVRLWSYSVDM

SEQ ID NO: 52463 - protein, 383 aa, Zea mays
  misc_feature (153)..(153): Xaa can be any naturally occurring amino acid
MEAQIQQLEQEAYCSVLRAFKAQSDAITWEKEGLMTELRKELRVSDKAHRELLNKVNNDNIICSIREWRSTGGLQASMSNNPQPIHDPVPSPTTSGRKRQKTSQSVPALPAPPPAMHSQQLATPTQPSSSTARKAVPPVHKGKKMKPGQKVPXGGSAAKPMPSSAGPSGRGPHMNRNFPGGSAPEAQAQNVDPLVGRKVMSRWPEDNSFYEAVISDYNAETMGPEDIRWKEDDSGIDPVAYLRSRGAPSSGVRKPTGRGGPIPGSGRGRGLPKNMSRKDFPPPQKGVGKRSSDDIDILHTESLIKEGEKVFSVSNPDPQEVEKAKKALKEQEQSLIDAIARLAEASDGESEGLNRGRRNLYAGNQHQANYVDDMPVGDQADPM

SEQ ID NO: 52464 - protein, 293 aa, Hordeum vulgare subsp. spontaneum
MSPTLSLKLKKSSHTPQSSVSSSTKLRLFKKEAACQSPSTLPVAMDMGLEVSSPSPFSSSVSSSPEHTARRASPAKRPAGRTKFRETRHPVYRGVRRRGNTERWVCEVRVPGKRGARLWLGTYATAEVAARANDAAMLALGGRSAACLNFADSAWLLAVPSALSDLADVRRAAVEAVADFQRREAADGSLAIAVPKEASSGAPSLSPSSGSDSAGSTGTSEPSANGVFEGPVVMDSEMFRLDLFPEMDLGPYYMSLAEALLMDPPPTATIIHAYEDNGDGGADVRLWSYSVDM

SEQ ID NO: 52465 - protein, 482 aa, Agrobacterium vitis
MFIRNNRRSKIVATVGPASSSPDMLRSLFLAGVDTFRLNFSHGARADHAEVYRNIRALEQEHDAAIAVLQDLQGPKIRIGVLAHGRLDLARGSTIGFILGREGGEGMNDIPLPHREIFEVAVPGMDLLIDDGRIKVRIMEVMDGRLVCEVLNGGALSNRKGVNVPGAVLDISPLTAKDREDLEFGLELGVDWVALSFVQRARDMIEARSLVGDRAGLIAKIEKPSALDDIEDIVRLSDSVMVARGDLGVEIPPEDVPGKQKEIIRACRLAAKPVIVATQMLDSMVSSPTPTRAEASDVAGAIYDGADAVMLSAETATGAYPVEAVEIMNRIIEKTEKHKHYRPILEATEPDVAQSPPHAVATAAANVAVALGSPVVVAYTSSGTTAARISRARPALPILALTPSEQVARRLNMFWGVVGVRSQDVHTYEASLIHAQQAVQEAKLASPSDHIVIVAGFPFAQQGSTNNLRVVQIAATDNLEIA

SEQ ID NO: 52466 - protein, 377 aa, Mycobacterium smegmatis str. MC2 155
MRTRAAVTYGLNTRFEVKEVELDEPGPNEVLVHLVASGVCHSDMHHVTGDQIAALPMIFGHEGAGVVEKVGNNVTHVGPGDHVVMSYLPSCGTCRWCTDGQTNLCDLGAHTVEGPQLDGTYRFHDDDGVNLGQFCLVSTFSEWTVVPAQSVVKVDEHYRLERACLVACGVTTGVGTAIYRGGVEPGEDVMVYGVGGIGMNIVQGAKIAGAKRIIACDTNDWKLEQAKLFGATHTVNPNTTDPVEFATELTWGVGVDKAFEAIATPETIGQAVRSVRKSGTVAVVGLTRHDQPTIPVNPSDFVLWQKTLTGSLNGGCNPRNDIPKMLKLWDSGQINLDGLVTKEYRIEQINEAYDDLLAGKNLRGVIRYEWADNGVPQ

SEQ ID NO: 52467 - protein, 220 aa, Thermococcus litoralis
MVREMELPSHKTKIIATIGPASKQKESIKKMIKAGMSVARINFSHGTLEEHAKTIETVRDVAEKLERRVAILGDLPGLKMRVGKIKGDSVTLRKGDKVVLTTRDIEGDETTIPVEFKDLPKLVSKGDTIYLSDGYIMLRVEEVRENEVECVVVNGGILFSHKGINIPKANLPIEAITPRDFEIIEFAIEHGVDAIGLSFVGSVYDVLKVKSFLEKKSADL

SEQ ID NO: 52468 - protein, 257 aa, Solibacter usitatus Ellin6076
MNTPELFSLKNRVAVVLGGTSGIGLAIARGFAQAGAITIASSRDQAKVDSTAAELEALGARTLRLTSDVQDRASLQRLCDETVLAYGQVDVLMVTSGALKKAPSAELTDEDWERVVDINLNGSFRANQVFGRQMLKQKRGSIINTCSMTTFVSFGEVAVYSASKAGVNMLTKSLACEWATQGVRVNAIAPGVFRTPLNTNALDIPERMAAIIGRTPMGRVGHVDELVGCAIFLASDASSFVTGQTIPVDGGFLAKGI

SEQ ID NO: 52469 - protein, 1486 aa, Cryptococcus neoformans var. neoformans JEC21
MSNPTSPTDPPDAGPPAPAIASSSKTGRRSVRLFAPDEEDSSDEDGLIGVPAETTFNDDEVPPSNTRSASYPGPPAHTSPTSKISSIVSSASAAQPKLARSITYVAPSAISSRPAYPLHPAGPETLHASYETWRKTRYTLESFSRAKADGKNAAQRGRSYTDPDVGYFSPDAGDDGWGSDDEDELRSPGWGISHHNMDSGGKTDGSPQLPIKPADVTEDEGQERLDWQGMLESVLNSDVFKVEEQRIYNSMPTDSFREEIGKTLWWQIRAKLRGRTEAEEKKRVQERRARVVDPVLEEINEFKYDPKNNPEGEEDSDADPQDATSTAAPQSKALNQVNTILAKLHAVKGLYPNLAAMRADKSLYTDENFRKRADALTSWSIIVSSLQTQLKLLQKWTGSDELDITKPNTTHEKALVGKYKYHHSIDSKGTPGRDAADDSSFLDRVIKEDNLQRTFERRAFVDMINLVRNAKETVINYLPQFQEQNLPDFQYEIVRLIGFPGRLIIEAVKVRLDAASRLLDPNPMVVEDFIENLRLSISLAVLIRKQYDEIMAPDAEGRWKIPHCLPTEYNDVLLDALRTFFKLLHWRLRGVGKASYYKETEVLEEEAPFLYEAAEAIVGGDMVVAEQYCALSNKLLIRSANYLDQQLRVPIHSHSRDKERGGDKERDGSSSSQRDRNRDGSLAGPPKHMKVEELFSWYSKLLDSARMRHRKTQRFCRKLTQRFDNSAEYSIEETDVDVLVETLQDTGHFLVYTGKFEANGTYIVADGSLWGQPDDVRHLLKRVFSVTIPGSRVRPRQTTSQVSGGGGVLANGQVAAAQPDPADPYPEADDFDDEALAAYILLISPRQNFVWSGAVMTLDVDYIDYELADNRVRLIADGPTKRLALCKHYFTQALIHPDTGETIDLPCVVEAQAHLPTIQKQLVKIAKSSYRLSECIVQSAPLVRNAFRGKPGSQELVENWYSFATEHGTRVLVHIEPSAWDRFNRLLMRLAISWISFISQECNPTDRKTFRWTVAALTYAFNMTRGSNILALDRSEFSLLRRYVGVCVSLLVSHFDILGARSSMEAKKEADRIEAMRRLQRLQENLDDEFLPRTPTESGGQPRIDRSIRLTVEERLRLIAELEARRSELAPAPVGQVLDEEVSEDRALVFLAASKSNISMRWQQGAYIGGGASGSVYLGYSLQDNTVFAVKILPTVDLQSSPALYESIKRESDVMSLLSHPNVVGFLGLEVHRNRVCLFQEYCEGGSLAGMLEYGKIDDEEVVGAFTIQLLRGLEYLHTNRIEHRDLKPENILIGANSVLKLADFGTAKIIKSNKTLARTRGGAHAKMEGLEGTPMYMAPEMIKNQRTGKLGACDIWGLGCIVLQMITGRKPWSFLDFDNEWAIMFHLGATKEPPPLPDPNEMSDQGIEFIDQCLSLDPEARPVASELLQDEWLVPMLEQMAELEQEYPDVLAMGQSDSLVPPPENASLTSNAPTLQDDITPPPLE

SEQ ID NO: 52470 - protein, 319 aa, Legionella pneumophila str. Lens
MGILIDGIWHDENNINTDKEGRFVRAESGFRQHITANGESGFKAEPDRYHLYLSYACPWACRTLIMRKLKGLEKIISVSFSDPVMGKNGWSYGESGNETADEINHIHYLKELYLVARKDYTGRVTVPVLWDKKKKTIVNNESSEIMRMLNSEFNAFSSTDHDYYPKQWRQKIDEINQLVYENINNGVYKCGFAKSQKAYEEAFDALFNTLNQIENLLATQRYLIGEQLTEADWRLFTTLIRFDAVYHGHFKCNLQQIADYPHLSNYLRELYQCPGIKETVNFNHIKQHYYRSHLSINPTGIVPKGPKLNLDEPHNRYEF

SEQ ID NO: 52471 - protein, 74 aa, Brassica napus
VRGLDIHGKFVIFTVIGVYLDAVAVPSLSVKWKGKTTEELTESVPFFREIVTGSFEKFIKVTMKLPLTGQQYSE

SEQ ID NO: 52472 - protein, 224 aa, Methanopyrus kandleri AV19
MRTVRRALRRGEPVFIFDSEDREGETDMVFWAPEVTPDHVAELRRTAGGLICVVIHPEHAREIRLPFLVDVYERADHPLLRATWPDDIPYDERSTFSITVNHRDTFTGVTDEDRALTVRKLAEFFTRNHEDPVREFGEEFRSPGHVHLLRPFDGLLEERRGHTELTATLLELVGLEPKVAVICEMLEPGGGALPREEAERVARERGAPFLTGEDILKAWKGGER

SEQ ID NO: 52473 - protein, 74 aa, Brassica napus
VRGLDIHGKFVIFTVIGVYLDAVAVPSLFVKWKGKTTEELTESVPFFREIVTGSFEKFIKVTMKLPLTGQQYSE

SEQ ID NO: 52474 - protein, 511 aa, Pseudoalteromonas tunicata D2
MTQDFILPDIGEGIVECEVVEWLVAEGDTVSEDQPICDVMTDKALVQIPAVYSGVIAKLYYQKGEIAKVHAPLFAMSVADGSQVNEPEINLPDTSAVTAVQSDILEDFILPDIGEGIVECEIVDWLVTEGQQIEEDQAVCDVMTDKALVQIPAKYSGIVEKLYYQKGEIAKVHSPIFQMRLSQSKPSEIVTEITPVVVAGNPNTMAQVTKAAQGKALASPAVRRRARELDVDLSEVPGTGKNGRVFKEDIERYLSLPKPDQSVLSVETKVPAVVSSNATRVEPIRGIKAAMAKQMMASVTTIPHFTFSDEIDLTQIIDLRLQLKQQYQDQGVKLTMMPFFVKALSLAITEFPVLNSQVNDECTELTYFTDHNIGMAVDSKIGLLVPNIKQCQQKSIIDIAQEISRLTDSAREGRVAPDDLKGGTISISNIGAIGGTTATPIINKPEVAIVALGKVQHLPRFDVNGSVVSRAIMQVSWSGDHRVIDGGTIARFNNLWKEYLENPAKMLMAMR

SEQ ID NO: 52475 - protein, 274 aa, Zea mays
MAEASTYPLDAVKTRLQLHRNPGGAPGRGVIRVAAELVRDGGVYRGFCPAVLRHLIYTPLRIVGYEHLRSTLASEGREVGLSEKALAGGLSGVAAQVVSSPADLIKVRMQADSRMLSQGIQPRYTGMADALTKIIRAEGFRGLWKGVVPNAQRAFLVNMGELTCYDHAKHLIIHKEICSDNLYAHTLASVASGLSATTLSCPADVIKTRMMNQGKEGKAMYRSSYDCLVKTLRHEGVTALWKGFLPTWARLGPWQFVFWVSYEKLRQASGISSF

SEQ ID NO: 52476 - protein, 528 aa, Ehrlichia ruminantium str. Welgevonden
MSKVAIIDFGSQFTQLLARRIRDLNIYSEIFLPNVAFDLIKGVDAFILSGGPRSVPNSDGIPKIVHDILQFNEKTSIPVLGICYGLQILSNYFESDVVSNCNKEFGKTILNIIKNSKIIENIWESGDQACVWMSHADSVYNIPRGFEVIAYSVLNNSIAMVANEQRRIYGMQFHPEVYHTPDGINLLANFLDIAGCQKDWTVTSFIDDQQDAIKKQIGNKKVIAALSGGVDSSVAAALTYKAIGDQLHCVFIDNGLLRYNEVEKVKQLFINELKIPVTIVDKSAVFLNRLKSITDPERKRKIIGETFIEIFEEEANKLEGVEFLMQGTIYPDVVESGGSGSIAKESVVIKSHHNVGGLPKTMKFKLVEPLKYLFKDEVRILGRNLGISTEILMRHPFPGPGLAVRIIGEITEEKVKMLQAADDIYINLIKKYELYDVMWQAFVVLLPVKTVGVMGDRRTYGHACVLRAVNSHDGMTAESFPFCMDEETQWKFFKCIQEASNAIINSVNGINRVAYDITSKPPATIEWE

SEQ ID NO: 52477 - protein, 241 aa, Zea mays
ELSAQQKRRWLLEASLAGSVATNAPRKISSPTAMAAADASRTLLAAVSLALAACCLAQLAAGDTNGVYEPCSDGRIQRGDGFTFGVVFAGYNAFFSGNTQLSPCDRRLNLAASGQLAVFRPKVDEISLLPFTPPPGFNPVLEFNKGRLENLHWKKDGCGACSGKSNFVCLGKQTCAIRTQSCKSQGPVDCSVGIQLAFSGTDKHESVLNSWYEVSNLRQYSLYGLYSNLKGTLSGQFNKIF

SEQ ID NO: 52478 - protein, 3896 aa, Oryza sativa Indica Group
MSRLRARIAERLLQSQSTKAILTTFNEVNMAPVMELRKKFQDSFTKEHGTKLGFMSFFVKAAVHALKKFPVLNASVDGNDIVYHGYFDIGIAVGSPRGLVVPILRNADQMSFADIEKKIAEFGKKAQEGKLGIEEMTGGTFSISNGGTFGSMLSTPIINPPQSAILGVHATKDRAVVENGQIVVRPMNYLAMSYDHRIIDGREAVLGLMPVLGVAMRLGILWLVCLGLVAGCGGGGSSSSNPASNPPSGNPSIPAPISNPAGLSFEPSSWTAESYQGDVLEFNVKVKLEKPLQGRVNVRIVDDQGVLYKAPTVKYLDQSTATANLTLSPKLAPKNYQGNFVVSFCLDDPSVCQQPYSEASWSYPYQLLVRPLPNLTVLSPLLKGSDWTTVQGNAAHNGYVPEKLDPSKFELRFRYAPERAQMHGPMITKDGFAVFTTRSSGAHEFMHALDENKGVLAWLKPLGVGNIPLTMGDGVLYYPGYTDSTGFGIVALDVITGAVRNSAPTTVDEGVYENGALYFSHIINYPKGDFSAEKLNGFDFAPVWNSIESKPESRPRSTRVPALDANFAYYYEGDTRFSSAPSSRLAKLDKQSGKTVASIYMPRVSAFDENRYVSPPVICNSQNILISDGSGPGSRIRMVDLEKNALRYELVGNYSSEAPVCDQGMFYIVGVSGLEAHRISDGSLAWILNPPAGEEMFNAFGTHLVSNLILFENIIFVSFGENLYGIELTKREPAWVGKRTGGRKLTVSKNGILYAAEGSSSKRYAMSSKQFDVIVIGWRPRRLHRRHPRGPAGLQRGLHRRVEEREGRPRTGRHLHERGLQSPPMRCCSPRSIFEHATKHFAEHGITATDVKIDVAKMIGRKDAVVKQNNDGILYLFKKNKVSFFHGRGSFVKAAEGGYEIQVAGAAQETLVGKQIIVATGSNPRALPGVPFDEEKVLSNDGALRIGATPKKLGLIGAGVIGLEMGSVWRRVGADVTVLEGLPTFLGAVDEQIAKEAKKAFDKQGLKVELGVKIGEVKTGGDGVTVAYTDAKGEARELAVDKLIVSIGRVPNTIGLNPEAVGLKLDERGAIVVDADCKTNLPGVWAVGDVVRGPMLAHKAEEEGVAVAERIAGQHGHVNFNTIPWVIYTSPEIAWVGRTEQQLKADGVQYKAGTFPFLANGRARALGDTTGMVKFLADAATDEILGVHIVGPMASELISEAVVAMEFKASAEDIARICHAHPSLSEATKEAALAAYEAELAAKGFRSDPAQLRAVEALQRCADDWAAYKEKRSNALKKLIHRPEVPRGVYMYGGVGRGKSFLMDCFFNAVPIRRKVRLHFHEFMREVHRELAGLQGTVNPLDVLGERIAKRYKLICFDEFHVADITDAMILHRLLAALFDNGVGFVTTSNFKPDDLYPGGLHRDRILPAIDLLNEKLEVVNVDNGTDYRRRTLEQVRLYHCPLGPQAEAEMEAAFDQLAESRDEDPVLHIEAREIRARRKAGGVVWFDFDVLCGGPRSQNDYLEIASQFHTVLLSNVPYMPVAMASPARRFTWLVDVLYDRRVKLILSAAVPPEQLYTEGPLAHEFPRTVSRLNEMQSKEFLALERRPGHQRVAGHQLRDGVDGHGRVALGAQAPHQDVGVRMGVGLGLGDLAAVHQRLDVGVVAGAVPELRTPEVIDARVARMRPVAVAAGMDEEGRHGTAVSAAFAEDGPLAIAQARFQPRAGQAAMAAAVAETIDRGGALVVEAGTGVGKTFAYLVPALLSGERVLISTATKALQDQLHSRDLPRLLQALALPARTALLKGRGSYLCLHRLGIARQHPSAADTAVARVLARAEVWAHATATGDLAELPGWDERSAATPLFTSTRDNCLSSSCPRFRECHVYQARREAMAADVVVINHHLFFADHAIRGSGVAELLPSVRVVVFDEAHQLNETGVQFMGTQMGSSHWLDLARDVLAAGLQFARGLADWQGAAAALERAARDWRMAAGARAPGTRLRWSGPVPDGVERAAWDDALGRLSAAAREALAALDTVSEIAPDFVRLHERCVELMERLALFLDPAPPDAVRWVEVGQHQVRACLVPLDIAQPLRRLWFPHEEAAGPSAAAADAGDGDGPAPGLPHDLPWSDEGGDPDPWAAAPVHGSALPAPGAAALPGAGSGEGGGRPRAWVFTSATLGDDASLKWFTAACGLEGARVLQVPSPFDYAAQAAVYVPRQLPSPSDPGHGAAVARWAGDAARVLGGRTLVLTTTLKALRTIGDALRERFPDGSGIEVLVQGDWPKRRLMERFREADAGGDRPGCVLVASASFWEGFDVPGDALQLVVIDKLPFPPPGDPVVEARSQRLEQEGKSAFRHFALPDAAIALKQGAGRLIRNEQDRGLLAVADARLVTMGYGKRLLAALPPMRRIQDEAEWDEALRGLAALGHAERVIGLDEDVERFLERGHVLVVGQGDLRAVDGGHVGAALVVVAGHVDLVLRQRVDDVRHALLRVARVARIGEAGDELAEGFERILGGLLVALGEILARQPGEQPEVVVEVDQPLQVERVVVGRARGVQLHEAVERGDRLGLLAALVLGVGLFQLGLLRERGAGGAALELLEQRDGLVVGVAVELVPRLGIDAVGAPARGLVFGGAGAAREHACGKQGGQERQGKTRHGSGFLTIGEGRPAHARRAPRRRPGMGRIPTIAPMFVHLRLHTEFSVVDGTARIDEVAKAASKDGQPALAITDLHNLFGAIKFYKEARGKGVKPVLGAEVSIEPETAGNPPGRILLLAQGRQGYLNLCELLARAWTRNVVKNVKKEGDKNNYALELEPMLYERVRKEEDVKTVIEMAQKLEGMTRNIGMHAGGVLIAPGKLTDFCPLYQQPGSESAVSQYDKDDVEAIGLVKFDFLGLATLTILEIAREFIMKRHKGQENFAFENIPLDDAPTYRLFSEGKTEAVFQFESRGMQGMLKEARPSRLEDLIALNALYRPGPMDLIPTFVNRKHGKEPVEYPHPLVEPVLAETYGIMVYQEQVMQTAQVLGGYSLGGADMLRRAMGKKKAEEMAEHREIFRKGAAEKGIGQDKADEVFDLMEKFAGYGFNKSHAAAYSLLAYHTGWLKVHYTAEFFCANMTVEMDDTDKLKVLYEDAMKMGLTFEPPDVNRGMYRFEPVTDKVIRYGLGAVKGTGQQAIEAIIAAREGRGVGPRGETKGPFASLFDFCARVDRTRLNKRTLEALIKAGAFDAIEMNRASLVASIDRAFDFANSLIANANQGGLFDMMGDDSHGSSTQDPALVEMLPWGVKERLTQEKTAVGFYLSGHLFDEVEKEVRRFIRTPIEELADSREPQIMAGIVSDFRVINGQRGRLALFKLDDKSAMIEASADENVINAHRDLLKEDEFVVLLGRLQLDHFSGGLRVKVMQGWDLASARAKFGRYLQVAVGDCAPDVQRLVREFPPKRQETPEGEVLVHGLRVRMGVRCRSEGQEAVAELQLGEGSRFFPSDAGLAAWSAEAGSGVVNVVMVRMATKPPSMTPTPPTGVPSRDDGGSVVLERRTQRTQPPQMYQVVMLNDDYTPMEFVIVVLQEFFGKDREAATQIMLKIHLDGKGVCGVYSRDVAATKVEQELEVSLHMAFVEARQQRHEFITVEHLLLALLDNPSAAEVLRACSANVEDLRSSLANFIKDNTPQVAGTDEVDTQPTLGFQRVIQRAIMHVQSTGNGKKEVTGANVLVAEWGEMTMCDAERRLLANALLDISNEWFVLVSESCIPIFNFNTTYRYLQNSSQSFVMAFDDPGPYGRGRYNWNMTPEVELTQWRKGSQWFEVNRELAIEIVRDTLYYPKFKEFCRPHCYVDEHYFPTMLTIEAPQSLANRSITWVDWSRGGAHPATFGRGDITEEFLRRVQEGRTCLYNGQNSTMCFLFARKFAPSALEPLLELAPTVLGFG

SEQ ID NO: 52479 - protein, 459 aa, Vibrio vulnificus CMCP6
MTQNIKPTHFRSEGDVNTTPARQAWNASMDDESTQALLKRDSEVFLHQAMSTPCLDTLEAAEGIYIQDATGKKYMDFHGNNVHQLGYGHPHVINRVQEQIAKLPFSPRRFTNETAIECAEKLTQICGGELNRVLFAPGGTSAVGMALKLARHITGNYKVVSLWDSFHGASLDAISVGGEACFRQGMGPLMAGVERIPPAVSYRGAFPVADGSDVHYADYLEYVIEKEGGVGAFIAEAVRNTDVQVPSKAYWKRIREICDKHNVMLIIDDIPNGMGRSGEWFTYQAYDIEPDMLCIGKGLGGGLVPIAAMVTKDKYNTAEQISMGHYTHEKSPIGCAAALATMEAIEQEGLLDKVKVDSQFMREKLLEMKAKYPVIGDVRGIGMLWGIELVTDHESKARAYDEAEAVLYQCLNNGVSFKVSQGNVIQLSPPLIITREQLTEALAIFEEAIAKVCKDFNYF

SEQ ID NO: 52480 - protein, 562 aa, Oryza sativa
MQVLNTMVNKHFLSLSVLIVLLGLSSNLTAGQVLFQGFNWESWKENGGWYNFLMGKVDDIAAAGITHVWLPPPSHSVGEQGYMPGRLYDLDASKYGNEAQLKSLIEAFHGKGVQVIADIVINHRTAEHKDGRGIYCLFEGGTPDSRLDWGPHMICRDDPYGDGTGNPDTGADFAAAPDIDHLNKRVQRELIGWLDWLKMDIGFDAWRLDFAKGYSADMAKIYIDATEPSFAVAEIWTSMANGGDGKPNYDQNAHRQELVNWVDRVGGANSNATAFDFTTKGILNVAVEGELWRLRGEDGKAPGMIGWWPAKATTFVDNHDTGSTQHLWPFPSDKVMQGYAYILTHPGNPCIFYDHFFDWGLKEEIERLVSIRNRQGIHPASELRIMEADSDLYLAEIDGKVITKIGPRYDVEHLIPEGFQVVAHERVAVERAVAGCTRRTRRIQCREGRGSTAADLGSGGEEVRGNSIQKASAHMADLVVVRAGSGGAQLRRSSAAEARRPEATPSSRRRRAGTQVEAAVGRRLAAAARWRIEAVDPGLTNGVVEAEAVEADGARWRTSNFC

SEQ ID NO: 52481 - protein, 343 aa, Oryza sativa Indica Group
MSAPAGLRQHCALGRAIAVVAICLLVIVGTYLLSSPAAGDGDTEEEFFSVDAGDDDLEAAVRGAAYANGTLIVSVLNRAYADEDGGLLDLFLRSMREGEGTEQLIAHVLLVAMDRPAFLRCRRLGGVRCYQLPAAQDGADDLSSEQLYMSDGFIRMMWRRIRLLGDVLKLGYSFIFTDLDVMWLRNPLPRLEYRAEEEDLLISSDQFNGRPGDIAGNELNTGFFFVASNNRTAALFDEWHAARDRSAGMKEQDVLNDMKRRGALRRLGVRARVLDTARFSGFCQDSRDAREVATVHANCCRTMRAKVADLAAVLAAARRRLDGDGASPVLRWPPHSQCVKSWE

SEQ ID NO: 52482 - protein, 382 aa, Xanthomonas campestris pv. campestris str. ATCC 33913
MPVTTKLPKVGTTIFTVMSQLAAEHGAVNLGQGFPDFAVPQRLVDALGQAMAAGHNQYPPMTGVAALRQAIAGKAQRCYGAQVDADTEITVTSGATEAIFNAIHAVVRAGEEVIVLDPAYDCYEPAIDLAGARAVHVALDPQTFAVDWDALRAAITPKTRLLMINSPHNPSGAMLSAADMQTLTELLHGTDIFLLSDEVYEHIVFDGRRHESVLRWPELRARAFVISSFGKTYHCTGWKIGYAIAPPALSAEFRKVHQYNTFTSFGPAQHAFAAMLRDEPEHDEQLGAFYQAKRDRFREQLLTTRLVPLPVPGGYFQLVDYSAISDLPDTEFVKWLTVEKGVAAIPLSPFYETAPAGQRLARLCFAKNDATLDAAIARLQQL

SEQ ID NO: 52483 - protein, 376 aa, Oryza sativa Japonica Group
MAGTLQVAGGCLAPLLPSRRAAAAVRPPRASGASASAAAAAAAVEEDGKVRLGGSDVAVTKLGIGAWSWGDTTYWNEFQWDDRKLKAAKGAFDASVDCGITFFDTAEVYGAGISGAINSESLLGRFIKERQQKEQVEVAIATKFAALPWRLGRGSVISALKDSLSRLGVSSVELYQLHWPGIWGNEGYLDGLGDAYEQGLVKAVGVSNYSEKRLRDAYERLKKRGVPLASNQVNYSLIYRNPEENGVKAACDELGITLIAYSPIAQGVLTGKYTPNNPPTGPRGRIYTPEFLTKLQPLINRIKEIGGSYEKTPTQVVLNWLICQGNVVPIPGAKNAEQAREFAGALGWSLTDQEVEELRSMAREIKPVIGFPVEKL

SEQ ID NO: 52484 - protein, 522 aa, Deinococcus radiodurans R1
MTQGSVVDPRPAQVRAALAPQEWDVIVVGGGASGLGSAVEAATRGHSVLLLEGHDYAKGTSSRSTKLVHGGVRYLAQGNVSLVREALHERGLLRKNAPHLVRDLGFVVPAYDWWAAPFYGIGLKMYDVLAGKLNLGSSTYLDRDKVLSRVSTYKEKGLRGGILYFDGQFDDARLAVTLLRTLEDFGGVALNYAPVIGLIKDGEQVRGVRFRDEESGQEHEARAKIVVNATGVWVDDIRRMEDPTVKPMLSPSQGVHVVVEKKFLPGDSAIMIPRTDDGRVLFAVPWHDHVVIGTTDTPVPQADFEPHALEEEVEFILRTAGRYMDPAPGRADVLSVYAGLRPLVKNEKSDGAGSTAALSRDHVIRISKGNLITLTGGKWTTYRRMGEDTINRAEKLGGLPERLTITPGLHLHGWSEDERPDHWKVYGNDAERVQQLPGADAQLHPDLPYSEAELRWAVRHESARTVEDVLARRTRSILLGARASMEAAPRAAAILAEELGKDAAWQAQQVEAYRQVASGYVL

SEQ ID NO: 52485 - protein, 484 aa, Mycobacterium smegmatis str. MC2 155
MSVTSDAAVTLHSRFARELPELAIGWQAEPAPAPRLLVLNDALATELGLDADWLRSPDGIGLLLGTDVPEGATPVAQAYAGHQFGGYVPRLGDGRALLLGELTDVHGRTRDLHLKGSGRTPFARGGDGLAVVGPMLREYIVSEAMHALGIPTTRSLAVVATGRDVWRETKQPGAVLARVASSHLRVGSFQYAYQYATAAKDDEVLRRLADHAISRHHPQAAEADNPYLALFEAVVSAQASLLAQWMLVGFIHGVMNTDNMTIAGETIDYGPCAFMDTFDPATVFSSIDHGGRYAYGNQPAVAHWNLARFAETLLPLIAEDVDTAVDLVTAALGQFPQQFDTAWSTGMRTKLGLSARVDHTTATALVNDLLVLLQQTRTDYTSAFRDLGRVARGAQPSLPFTDEWLSRWRACDPDPDVMDRVNPVYIPRNHLVEDALTAATTGDLAPLATLMTALKTPFTERAGFEAHAAPAPEDFGPYRTFCGT

SEQ ID NO: 52486 - protein, 464 aa, Alkaliphilus metalliredigens QYMF
MATGNVGKLVQIIGAVVDIRFSSEEIPALLSAITIQGPDGLVTVEVAQHIGDDTARCVAMRSTDGLVRGMEAIDTGAPITVPVGRETLGRIFNVLGEVVDEGKPVEAKMHLPIHREAPSFEEQEAATEIFETGIKVVDLIAPYARGGKVGLFGGAGVGKTVLIMELINNIAKEHGGLSVFAGVGERTREGNDLYHEMIESGVIDKTSLVYGQMNEPPGARMRVGLTGLTMAEYFRDQEGQDVLLFIDNIFRFTQAGSEVSALLGRMPSAVGYQPTLATEMGALQERITSTKKGSITSVQAVYVPADDLTDPAPATTFAHLDATTVLSRQISELGIYPAVDPLDSNSRILDPATVGQEHYEVARGVQEVLQRYKELQDIIAILGMDELSDEDKLTVARARRVQRFLSQPFFVAEQFTGMAGKYVPLKETIRGFKEILDGKHDDLPESAFLFVGSIDEAVEKANKG

SEQ ID NO: 52487 - protein, 127 aa, Haemophilus ducreyi 35000HP
MAYSDKVIDHYENPRNVGTFDKEATDVGTGMVGAPACGDILRLQIKVNDDGIIEDARFKAYGCGSAIASSSLITEWVKGKSLDEAGAIKNSDIAEELELPPVKVHCSILAEDAIKAAIADYKEKQAK

SEQ ID NO: 52488 - protein, 182 aa, Shewanella sp. MR-7
MPFNLPIALTLFRLFLLPIFVVLFYLPYSWTPFVAAFVFWLAAITDALDGYAARKLKQLTRFGAFLDPVADKLMVITALVLLVEQYADIWLTLPALFMIGREIVISALREWMAELGKRGTVAVSWIGKYKTAAQMVAIIGLIWQYNPLMITAAFVLLYIAAVLTFWSMMSYILAAWKDLTAE

SEQ ID NO: 52489 - protein, 489 aa, Nocardia farcinica IFM 10152
MADPQGFLKHTKRELPDRRPVPLRLMDWKEVYEENFSHQTLQTQASRCMDCGIPFCHNGCPLGNLIPEWNDLVYRDRWREAIDRLHATNNFPEFTGRLCPAPCEASCVLGINQDPVTIKQVEVEIIENAFDEGWVAPVYPTRLTGKKVAVVGSGPAGLAAAQQLTRAGHTVTVFERADRIGGLLRYGIPEFKMEKRFIDRRLAQMEAEGTIFKTGVNVGVDITADELREQYDAIVLAGGATQARDLPIPGRELDGIHQAMEFLPWANRVQLGDPVTDADGLPPIHAKGKKVVIIGGGDTGADCLGTSHRQGAASVHQFEIMPRPPAERAASTPWPTYPLMYRVSSAHEEGGERVFSVNTERFVGKDGKVTGLEAHEVKMVNGRFEKVEGTDFTLEADLVLLAMGFVGPEKGGLLTDLGVGYDQRGNVQRDKNWATNVPGVYVAGDMGRGQSLIVWAIAEGRAAAAAVDQFLEGETALPAPITPTMVAQR

SEQ ID NO: 52490 - protein, 293 aa, Hordeum vulgare subsp. vulgare
MSPTLSLKLKKSSHPPQSSVSSSTMLRLFKKEAACQSPSTLPVAMDMGLEVSSSSPSSSSVSSSPEHAARRASPAKRPAGRTKFRETRHPVYRGVRRRGNTERWVCEVRVPGKRGARLWLGTYATAEVAARANDAAMLALGGRSAACLNFADSAWLLAVPSALSDLADVRRAAVEAVADFQRREAADGSLAIAVAKEASSGAPSLSPSSGSDSAGSTGTSEPSANGVFEGPVVMDSEMFRLDLFPEMDLGSYYMSLAEALLMDPPPTATIIHAYEDNDDGGADVRLWSYSVDM

SEQ ID NO: 52491 - protein, 344 aa, Mycobacterium smegmatis str. MC2 155
MRAVVCSTVGVLPRVTEMPDPSCPSDGVLVQVAATGVCRSDWHAWRGHDPVQLPIIPGHEFAGVIAAVGADVSGWQVGDRVTTPFVLGCGRCEFCRAGDAQVCPNQEQPGFTLPGSFAQLVAVPRAAANLVRLPDDVSFVAAASLGCRFATAFRALVNHGAVKAGQWVAVHGCGGVGLSAVMIAKAFGAKVVAVDVTADALAAAQRLGADEIVNSTEIDDVATEIVQRTGGGAHIGVDAVGNPVSAAASVASLRRRGRHVQVGLLLGADAHTAFPMDRVIAQELAIFGSHGMPAVDYPAMLDLLASGALQPERLVTRRISLDDAPDALAGMDSFAGSGMTIIEP

SEQ ID NO: 52492 - protein, 431 aa, Salmonella enterica subsp. enterica serovar Paratyphi A str.
MKTPRLLQYLAYPQKITGPIIEAELRDVAIGELCEIRRGWHQKQVVARAQVVGLQRERTVLSLIGNAQGLSRDVVLYPTGRALSAWVGYSVLGAVLDPTGKIVERFAPEVAPISEERVIDVAPPSYASRVGVREPLITGVRAIDGLLTCGVGQRMGIFASAGCGKTMLMHMLIEQTEADVFVIGLIGERGREVTEFVDMLRASHKKEKCVLVFATSDFPSVDRCNAAQLATTVAEYFRDQGKRVVLFIDSMTRYARALRDVALASGERPARRGYPASVFDNLPRLLERPGATSEGSITAFYTVLLESEEEADPMADEIRSILDGHLYLSRKLAGQGHYPAIDVLKSVSRVFGQVTTPTHAEQASAVRKLMTRLEELQLFIDLGEYRPGENIDNDRAMQMRDSLKAWLCQPVAQYSSFDDTLSGMNAFADQN

SEQ ID NO: 52493 - protein, 238 aa, Wolbachia endosymbiont of Drosophila melanogaster
MSTIKIEKKSQLVKEVFDSVASRYDTMNDIMSLGMHRLWKDKMVNSVHFTKNSKVLDVAGGTGDIAIRVVRKEPSAKVTVCDINQNMLNRGRDKAINSNQINFDWVCASAESLPFEDSEFDYCTIAFGIRNVSDRKKALNEAHRVLKPHGKFICLEFAPMHYQNEIFTKLYDLYSFKVIPKIGSIVAKDKSSYEYLVRSIREFPTQADFKMEIEEVGFKNVEFHNMSYGIVALHIGTK

SEQ ID NO: 52494 - protein, 75 aa, Brassica oleracea
GVRGLDIQGKFVIFTVIGVYLDPVSVPSLSVKWKGKTTEELTESVPFFREIVTGSFEKFIKVTMKLPLTGQQYSE

SEQ ID NO: 52495 - protein, 185 aa, Candida albicans SC5314
MSFKEGSKFPAGVEFSYIPIQLDDLELINPLKCDVASQLKLDNLLTKLSTTDTPNLLIVSVPGAFTPTCTESHLPPYLENLAKLHDKKIGAIVVLATNDQFVVNAWGKVLIKAYVKTSGKFPEVMFASDGGFSEKYGLAGDRGGIIRNKRYAAVIDSKTKDVVYLGVETEKGVQSSGIDAVLAKL

SEQ ID NO: 52496 - protein, 211 aa, Ehrlichia ruminantium str. Welgevonden
MGIIVSENPSFISSIEDIIEDAKAGKVFVLIDDEQRENEGDLVVLAEKVTTDAINLMVTHGSGIVCLSITEDLMYKLGLELIPRRNINNNSASFATSIDARYGITTGVSVHDRVRTILTAVSKNVTMDDLVTPGHIFPIVSKKGGVLERLGHTEASVDIAKIAGLTPAAVVCELMNPDGTMSRLSDIIEFSQRYDIKVTTIAKLVEYINTH

SEQ ID NO: 52497 - protein, 71 aa, Brassica napus
LDIQGKFVIFTVIGVYLDPVSVTSLSVKWKGKTTEELTESVPFFREIVTGSFEKFIKVTMKLPLTGQQYSE

SEQ ID NO: 52498 - protein, 162 aa, Candida albicans SC5314
MSTVYFDVSADGQKLGKITFKLYDDVVPKTAENFRALCTGEKGFGYKGSIFHRVIPQFMLQGGDFTNFNGTGGKSIYGTKFADENFVKRHDRPGLLSMANAGPNTNGSQFFITTVPCPWLDGKHVVFGEVTDGLDIVKKIESFGSGSGATSKKIVIEESGQL

SEQ ID NO: 52499 - protein, 339 aa, Arabidopsis thaliana
MMSNLPLDLVEEILSRVPATSLKRLRSTCRQWNALLKDRRFTEKHFRKAPKESLVLMLKEISVNLNVTPPSIEFKDALGLKDSHSNSEQVDIVQVLHCDGLLLCTTKDNRHVVWNPCLGETHWIQFKVDYGRVYSSFALGYIQNNESCRSYKILWRWKSNDYKSSPRQRGFEIYEFISDKWRVIDDVNHDSLVNHNYLGRCCRVSLKGNIYWLVDDVEDNSRSLLMFDFKTERFKRLCLPHFENVGHMVLSFVREEQLSVLYWSRATPKMEIWITNNIDTDATLLWRLHLDTRFNCVRIFSSLYFEEEKKVVLCCNVKLLMMIRSARTWYTLSERTMDI

SEQ ID NO: 52500 - protein, 363 aa, Lolium perenne
MVQPVFDAALLSGQSDIPSQFIWPADESPTPDATEELHVPLIDIGGLLSGDREAAAEVTRLVGDACERHGFFQVVNHGIDAELLADAHRCVDAFFTMSLQDKQRALRRPGESCGYASSFTGRFASKLPWKETLSFRSCPSEPDLVVDYIVATLGEDHRRLGEVYARYCSEMSRLSLEIMEVLGESLGVGRAHYRRFFEGNESIMRLNYYPPCQRPNETLGTGPHCDPTSLTILHQDDVGGLQVHADGRWLSIRPRADAFVVNIGDTFMALSNGRYKSCLHRAVVNSRVPRKSLAFFLCPEMDKVVAPPGTLVDEANPRAYPDFTWRALLDFTQKHYRADMKTLEVFSDWIQQGHQPAATTTTT

SEQ ID NO: 52501 - protein, 350 aa, Clostridium acetobutylicum ATCC 824
MLCALIMAGGKGERFWPLSTDEKPKQFLQLLSDKTMIQMTVERLEDLIDIERIFVVTGERYVDLLKEQLPNLPEKNIIVEPVGKNTAPCIALSAFVINKHYKDANIVVLPSDQLIVDDSKLLDTIAAAEKFIDQNKASIVTLGMEPTRAETGYGYIKSGNLEKEISGFQIKKVESFVEKPDKKSAESYVEAGNFLWNGGMFIWKCSTILKLTEKYLNKTYNILNEIAEANDTNFNETLKKKYVDVEAISVDYGIMEKADNIYVIPCSFGWDDIGTWHAVERYRDKDEDNNVCVGDIKSIDSKNNILVGKKKPIVVVGLSEVFVVESDDIIFVGKKEDIERIKEIKKKVKE

SEQ ID NO: 52502 - protein, 117 aa, Vitis vinifera
MGFAQLVIGPAGSGKSTYCSSLYQHCETMRRTIHIVNLDPAAESFDYPVAMDIRELVSLDDVMEELGLGPNGGLMYCMEHLEENLDDWLTDELDNYLDDDYLVFDCPGIHAHVYLID

SEQ ID NO: 52503 - protein, 491 aa, Deschampsia antarctica
GPKSRSVEAISACLKAGMSVARFDFSWGDAAYHQETLENLKLAIKATKKLCAVMLGTVGPELQVVNKSEVTISLEENESVVLTPHQGQEASSKLLPINFSGLAKALKPGDTIFVGQYLFTGSETTSVWLEVSEVQGDDVVCVIKNSATLAGSLFTLHCSQIHIDLPTLSDEDKDVIKKWGAPNKIDFLSLSYTRHAEDVRQAREYLSKLGDLSQTLIFAKIENVEGLNHFDEILEEADGIFLSRGNLGIDLPPEKVFLFQKSALHKCNMAGKPAVVTRVVDSMTDNLRPTRAEATDVANAVLDGSDAILLGAETLRGLYPVETISTVGRICAEAEKVFNQDLYFKRTVKYVGEPMTHLESIASSAVRAAIKVKASVIICFTSSGRAARLIAKYRPTMPVLSVVIPRLKTNQLKWSFTGAFEARQSLIVRGLFPMLADPRHPAESTSTTNESVLKVALDHGKTSGVIKSHDRVVVCQKVGDSSVVKIIELDD

SEQ ID NO: 52504 - protein, 273 aa, Thermosynechococcus elongatus BP-1
MPNNTIVPRVPALGIIGCGRMAEAMLARLLAKGLLPDHVWVSARSPQRQQYLAHTYGVRVTTNLEVATAETLLLAVKPQVLADIESELADTPVAQEMGVVLSIMAGIHSGRLRRLFPQRLIFRAMPNTPAQVGAGVIALASDSAASELEIQKIKNLLGVLGQVVAVSEGQMDAVTALSGSGPAFVALIVEALCDAGVAVGLSRSLTQELVYGTIAGTVQLLKERGLHPAQLKDAVASPAGTTIAGLEVLEAAGMRGTLMQTVKAAYERSQALN

SEQ ID NO: 52505 - protein, 361 aa, Thiobacillus denitrificans ATCC 25259
MSLASTLEIIEELKAGRMVVLVDEEDRENEGDLVMAAEHVTPDAINFMAKYGRGLICLTLTDARCRQLGLKQMVSDNQTPHGTAFTISIEAAEGVTTGISAADRAVTIRAAVTKDAKPSDIIQPGHIFPLRAQPGGVLVRAGHTEAGCDLAGLAGLEPASVICEILKDDGSMARLPDLVPFAQEHGLKIGAIADLIHYRNQTESLVERAADRLIQTIYGAFRLIAYRDKCAKETHIALVKGEIHADRETLVRVHEPLSVMDFLDVTGGGHSWPIMGAMERIAESQSGVLVLLHRPETADALLGRINPAPAASHKYDLRDYGIGAQILRDLGVGKMKLLASPRKMPAMDGFGLEVTGYSEKA

SEQ ID NO: 52506 - protein, 399 aa, Thermococcus kodakarensis KOD1
MKIPDDIRKDIPLTSEVIYFDNTATSLTPKPVIEAMDEYYLKYRANVHRGVHRLSQIATHKYEESRKVVADFINAKFEEIVFTKNTSESLNLVALGLEHIFEKGDKIVTTPYEHHSDLLPWQRLAKKKGLRLEFIEGDLEGNLDLADAEKKIKGAKLVAVQHVSNALGVIHEVEELGKMAKEEGAIFVVDAAQSAGHMEVDVKKLYADFLGFSGHKGPMGPTGIGVLYINSEFFDVFEPPLIGGGTIEDVDLDSYKLAEPPERFEAGTPNIGGAIGLAAGIRYIERIGIEKIEKQEHKLVKRTTEGLDELEVPWYGPRNLKKHAGVVSFNVPPLHPHDVAAILDEHNIMVRSGHHCALPAMKKLGVEGTVRASFHVYNSVEEVETFLSVMENLIRGLRG

SEQ ID NO: 52507 - protein, 155 aa, Thiobacillus denitrificans ATCC 25259
MGTSSDIFELDPIYQGKGLRIGIVMSRFNKDICEGLLSACETELDRLGVAREDVLLVDVPGALEHPLALQKMAQSARYDALIAIGAVVRGDTYHFEIVSNESSRGILDVQLETGVPIANAILTVDTEEQAHVRMAEKGRDAARVAVEMANLLKRL

SEQ ID NO: 52508 - protein, 255 aa, Prochlorococcus marinus str. MIT 9313
MDSSCSPKHGWFDSVAESYAQQRPYYPESLFTWISSKAASHQRCWDVACGSGQASLGLARHFDRVDASDLSPAQVAAAPAHSNIHYQVAAAEDSGFPNACMDAIVVAAAIHWLDVPRFNEEALKVARPGGLMVWVGYDPPQGAPPALQLWLDQLYSERLSSWWPPQRHHVDNHYQNLPFPTISKTLPQELCISLKWSCEQLIGYIGTWSALRKATQEGHDLLPQLSMELQRLWPADQKTIPLIFPLMGRWGYLAR

SEQ ID NO: 52509 - protein, 204 aa, Picea sitchensis
MAGAAAGIVTNTNTTCTEVHFAEKSIQTTVTDDGHVVENWVNQQTGQEIVGFDMEWRPSFQRGWENDTALLQLCTDNGCLIIQMLFLDFIPEALVSFLKDPGVKLVGVGIERDAAKLMNDHGLECGGQVELGALAAEKLERRELKQAGLKGLAKEVLGLRLSKPKSISMSNWAWAILQHRQIQYACIDAFVSLAIGKKLMESEN

SEQ ID NO: 52510 - protein, 281 aa, Bradyrhizobium japonicum USDA 110
MTAIRGAAAITGAASGIGRALAIELAQRGCDLALADRDEAGLKALAAEIGEGSEKARKVTVHRVDVSEPGDIAQFASEATAAHPSLGILVNNAGVALLGTFEEINQAQMEWLFDINFWGVVHGTRAFLPHLKTMEAAHIVNVSSVFGIIAPPGQSAYAAAKFAVRGFSESVRHELAVAGSPVKLSVVHPGGVATAIARSSRTGVGVTDNARRSQMIERFENAAKTTPKDAALRIIKGIERNEPRILIGNDARFMDLLQRFRPGTYWAPLQRRLEKMAKGKK

SEQ ID NO: 52511 - protein, 139 aa, Thermosynechococcus elongatus BP-1
MAETYPVTLVNSVNPYRLEGQKTAAFEVVDSLGNAGNITAYWMGFCQYREQNRCDRLPRMMGFQAAGSAPLVKGEIVTHPETIATAIRIGNPANWQRAIAVKEASQGAFNAVTDEEILKAYCLLAIEPTEQTVAKVMGF

SEQ ID NO: 52512 - protein, 632 aa, Ralstonia solanacearum GMI1000
MQSHDLLANFVIYLAAAVAVVPLARRLGLGSVLGYLLAGVIVGPWGLRLITNVQSILDFSEFGVVLMMFVIGLELEPARLWSLRRSIFGYGGLQLVVCALAVGLAVMAVDHPWRAAVVAGLGLALSSTAIALATLAERNLMRTPAGTASFGILLFQDIAAIPMIALLPLLAPDTGDTAGGHHWLAAAKAVGVVAAVIFGGRTVLRPVLRAIARTNMREMFTSFSLLLVVGIALLMHSVGLSMALGAFIAGVLLADSEYRHALETDIEPFKGLLLGLFFLAVGMSIDFGVLMRQPLAVVLLVAVFLVVKIGALRVLAMRFGIARGQAWLFAFLLSQGGEFAFVMFGPGVAGDVLGAETAATLNLVVALSMAATPLLLLFHDKILAPRLMAGKTRAPDAIGPQGNEVIIAGFGRFGQIVGRLLYSQGYTATVLDHDPDQVDMVRRFGFKVFYGDATRMDLLETAGADTARIMVVAIDDMETSLEVVDRVRERFPRLKLYVRARNVSHVYQLRDRGVEGIEREMFEGSLTLARHVLEGLGKEPYEALRVAQTFRRHALNSMDQLYPVYRDQKKLVPLAQQGREELAEMFRRDRLQRKRLRESGMPWGEGGPHTAGADAQDAGDGDAAGTPAAHEG

SEQ ID NO: 52513 - protein, 308 aa, Chlamydomonas reinhardtii
MDVEASAEQPLLRGDEARKRPNSLRCGVVAWAVFAAVLVFLIVMTATFAGRGGGSSGSSSSGKPTFAVPPVGRYGVSWLYSPARAEVLAAEAAEPRIQPPLSYTLPGPVPYTLLVPPPPSSGPVLYLALSVLLGYLNSSSNGAATANATAAATAAWAAAMGGLPELATHRTVMADIADPAFAAELRAAINDSSVLDLANYGGRWNPKRTGVSPDDHGTSHLSVLDGEGNAVSLTTTVNTGFGSGLVSRHPADRDQGDTLEPFYDQLGDVQAILLDEQQPPAGGGGGGGGVAATAVSDPRKDGAPAAAG

SEQ ID NO: 52514 - protein, 379 aa, Arabidopsis thaliana
MMSDLPLDLVEKILSRVPATSLKRLRSTCRRWNALLKDRRFTEKHFHKAPKESRVLMLKEYRVFPISVNLKVTPPSVDFKGALGYSHSNSEQVVITEVFHCDGLLLCTTNDDRLVVWNPCLGETKWIQLKVDYRRYVSIFALGYIQNNESCRSYKILWTWYSYDYNSSPPQRGLGFEIYEFSSDSSWRVLDDVNHDSVVNHNSIIRSGVSLKGNTYMLAYDIEENSKFLLMFDFTTERLKRLCLPHFQDVGEMDLSVREEQLSVLNWSRITSKMEIWITNNFDTEATLLWKRVHLDSQCNCVRIFSSLYFDEEKKVVLYCNVKDGETSKKVVYIIGEDDGHYIEIPFVKSIKIERLQLIHTTRWYSLIFNYVPSLFQIQ

SEQ ID NO: 52515 - protein, 377 aa, Streptomyces glaucescens
MAEPSGVRAVLLAGGEGRRMGPLGAGRLKPLVPYGGVCRLIDFSLANARASGLGEVLLLSQYEERQLMDDLHRVWNRADGFRVHFGPYDDAYRSAGDALPRELPERTWPAERGTADALIRKAGHVFGGDREQVLVLHADHVYRFDYRPLIREHRASGAALTIAYQRIERRWVHLFGMVRFNRAGRLTEFVEKPAEPTSDLVFAAFCVFDAAVLHRYLEKLDGTDWQHDISRDVIPAMLAGGEDIRGHEVVGHWEDIGTVERYHRAHLMLAAGGPRAALPVERMPRTVRPRVDRGWVADSLGVVASLVPADLVNEGRVEHSVLFPGVRVGEGARVRRSVLLPGATVSPGQDIDSAVVLENGHVQRVEDTAAVTEGTRT

SEQ ID NO: 52516 - protein, 89 aa, Triticum aestivum
RRPGRCIGRSKEELPEERALDIMDLCAEQPRFTLSYSKGSSQVMAQYYQLIRLGFKGNRKMMDNCKKNAMVLKEGLERTGRFNMVSKDQ

SEQ ID NO: 52517 - protein, 447 aa, Aspergillus nidulans FGSC A4
MPHSVLYTKIDTRPPEVIHSRGNYLHTSDGRTIFDASGGAAVACLGHNEPQVKQAIMAQLDKVAYIYSPFFTVPAAEEIATFLTESTGGAMSKVFIVSSGTEAIEAALKMTRQYFTELSKPQLQRTKFIARRQSYHGNTLGSLAAGGHKARRAIFEPILAASTSHVSPCYPYREMKKGESNEEYVSRLAEELENEFQRVGPDTVCAFIAETMSGTTLGCIPAVPGYLKAMKQVCDRHGALFVLDEVMSGMGRTGTLHAWQQEGVVPDLQTVAKGLGAGYAPVGALLVGNRVADVLSKGTGSFTHSQTYQGHPIACAAACAVQKIIQKENLLDNVRRQGEYLGRLLNERLGGHRNVGDVRGRGLFWALEFVRDKETKEPFPAEAGIAQKVHLTGLQKEHSISVIPGAGVADGRNGDIIQIAPAYNVSKEDIELIVERVEGVVHAAFGA

SEQ ID NO: 52518 - protein, 180 aa, Nicotiana tabacum
MASSVLSSAAVATRTNVAQANMVAPFTGLKSAASFPVSRKQNLDITSIASNGGRVQCMQVWPPYGKKKYETLSYLPDLSEEQLLSEIEYLLKNGWVPCLEFETERGFVYRENNKSPGYYDGRYWTMWKLPMFGCTDATQVLAEVGEAKKAYPEAWIRIIGFDNVRQVQCISFIAYKPEGY

SEQ ID NO: 52519 - protein, 357 aa, Aspergillus nidulans FGSC A4
MPAQHRPLWWYGWNALRGGNPTFLTPDQVPVPDLSGKWIIITGSNSGIGLEAAKAFASAGANLILGCREPAAWETHPAAAAEECQTLARVNGHTESVIEWWKIDMADLSAVDAFAQRWLDTGRALDILCNNAGMGPTGSRKPILTKDGLEILHQVNFTSHVLLTLRVLDSLAKAPQPRIVCTTSCFHFRGYFDLDHFNGELGMAGDPYPNNKLYFQVWLTELHSRLLASPNYRHVTVNGINPGYVNSGIWNNPLSETKNTWIDTAYKFWKFVASILAISPQQGSLAIVYAATSAEFGPDPVTQGVGEIGGKGGGHYINRIWEGEAMPHCSDEECRKEVWEKVGKELGLEERGLGHWV

SEQ ID NO: 52520 - protein, 364 aa, Triticum aestivum
MGGAGGAKAYGAVVLIRVMYSGMHIMSKIALDQGMNPFVFVFYRHTTAALVLIPIAFALERQKTKPVTLKIAGKMFVHALYGVTACGVLFNLGLNYASATSSSALYNVQPVVTFILAVIIGMESMKLKKLHGNLKVAGILCCVAGVTVLAFYEGPMFRSFNHHRLFQHGSSSSSSGAGTYSKNQWVFGIFLMTLSNILAGLWTVLQGPLIEDTSKLMNTTLQISCASVQAFVVAVAAERDFSKWKIGWNISLAAIIYSGVIVTALSYYMQMWTIAKRGPVFLAMSMPLTLIFTIIISSFVLGEAVSLGSIIAGILLIGGLYNVLWGKSMERKDDDTNKMGGGKPAQELQDKEQARVPDDAAAKV

SEQ ID NO: 52521 - protein, 353 aa, Bifidobacterium longum NCC2705
MEKVKAFADWLTKWFTVIVIVWAVFNYFVPAASLWGKAYTGYMLGIVLFGMGLTLTLDDFKRILTQPLMVIVGTVAHFIIMPLIAVALCAIFHLSGPLAVGVILVGCCPSGTSSNVMSYLSRGDVALDVSIGILSTLCAPFMIPLLMQLLASQYVSVPTQSLFLNAVKVVLFPIALGVICHMIFGKKIEKVTVALPIVSQVAILLIIGVVVAANGPKLFVASSLVAIPVVILHNLCGYSLGFGFSKLMYKIYPKGFRYAQQKAITFEVGMQDSALGATLALTSFATNPLAAVPSTFFSVWHNISGSILSSWWRNHDDKHEIHWDSDNGEKGSAKSTVSAAHPFDADKAAKVAA

SEQ ID NO: 52522 - protein, 581 aa, Aspergillus nidulans FGSC A4
MSLARFKHLPRATQGPIKCPYKGAALLGNANYNKGSAHSERERREFNLHGLLPPNIQTLDEQVERAYQQYKSRPDDLAKNTFMASMKSQNQVLYYRLLQTHLKEMFSVIYTPTEADAIQNYSRLFRKPEGCYLSIRDHGEKEIDECFANFSGGDDVDYIVVSDGEQWQILGIGDQGVGAILISVAKLVITTACAGIHPSRQLPVVLDCGTNNEELLNDKLYLGLRQRRAQGEEYDKFVDKFVRMARKRFPNAYIHLCSEDFGLQNAKRILDRYRSQLPCFNDDIQGTGCVTLAALMAGLHVSNVKLKDVRVVCYGSGSAGTGIADQISDAIATEAGFSKSDALKQIWCIDKQGLLLKSQGDALTASQKYFAKEDNEWPEGQDIDLYSVIKHVKPHVLIGTSTKPGSFTEETIREMAKHVDRPIIFPLSNPTRLHEAQPQDITKWTDGKALIATGSPFPPVEYNGTKTEIVSAECNNSTAFPGIGLGAVLSRASRLSEKMVVAASKALAAKAPALEDPNKPLLPDVENVRELSLNVAKAVIQTAVKEGLAQEEGIPEDEKDLEDWIRAQMWEATYRDLEKAD

SEQ ID NO: 52523 - protein, 418 aa, Pseudomonas stutzeri
DQAGKSPNAVRYHGGDEIILQGFHWNVVREAPNDWYNILRQQAATIAADGFSAIWMPVPWRDFSSWSDGSKSGGGEGYFWHDFNKNGRYGSDAQLRQAASALGGAGVKVLYDVVPNHMNRGYPDKEINLPAGQGFWRNDCADPGNYPNDCDDGDRFIGGDADLNTGHPQVYGMFRDEFTNLRSQYGAGGFRFDFVRGYAPERVNSWMTDSADNSFCVGELWKGPSEYPNWDWRNTASWQQIIKDWSDRAKCPVFDFALKERMQNGSIADWKHGLNGNPDPRWREVAVTFVDNHDTGYSPGQNGGQHHWALQDGLIRQAYAYILTSPGTPVVYWDHMYDWGYGDFIRQLIQVRRAAGVRADSAISFHSGYSGLVATVSGSQQTLVVALNSDLGNPGQVASGSFSEAVNASNGQVRVWRS

SEQ ID NO: 52524 - protein, 357 aa, Solanum lycopersicum
MKKGSFAPNLKLSLPPPDEVALSKFLTESGTFKDGDLLVNRDGVRIVSQSEVAAPSVIQPSDNQLCLADFEAVKVIGKGNGGIVRLVQHKWTGQFFALKVIQMNIDESMRKHIAQELRINQSSQCPYVVICYQSFFDNGAISLILEYMDGGSLADFLKKVKTIPERFLAVICKQVLKGLWYLHHEKHIIHRDLKPSNLLINHRGDVKITDFGVSAVLASTSGLANTFVGTYNYMSPERISGGAYDYKSDIWSLGLVLLECATGHFPYNPPEGDEGWVNVYELMETIVDQPEPCAPPDQFSPQFCSFISACVQKHQKDRLSANDLMSHPFITMYDDQDIDLGSYFTSAGPPLATLTEL

SEQ ID NO: 52525 - protein, 328 aa, Salmonella enterica subsp. enterica serovar Paratyphi B str.
MPLHHLTRFPRLELIGAPTPLEYLPRLSDYLGREIYIKRDDVTPIAMGGNKLRKLEFLVADALREGADTLITAGAIQSNHVRQTAAVAAKLGLHCVALLENPIGTTAENYLTNGNRLLLDLFNTQIEMCDALTDPDAQLQTLATRIEAQGFRPYVIPVGGSSALGAMGYVESALEIAQQCEEVVGLSSVVVASGSAGTHAGLAVGLEHLMPDVELIGVTVSRSVAEQKPKVIALQQAIAGQLALTATADIHLWDDYFAPGYGVPNDAGMEAVKLLASLEGVLLDPVYTGKAMAGLIDGISQKRFNDDGPSLFIHTGGAPALFAYHPHV

SEQ ID NO: 52526 - protein, 569 aa, Ehrlichia ruminantium str. Welgevonden
MHDSKYLLDIITLLSAAILIVVLFWKLNISPVLGYFVAGTLIGAHGLNLVESSVIIQNLGEFGVVFLLFLIGIELTFERLIAMRLHVFGFGTLQVIVTTLAIWYIANKFGIDSKGSIIIGGALALSSTAIVLQVLQEKGCQSTQVGRLSIAILLLQDLAVVPLIVLLPLLSGESHHSIPISLLYSFIKAAVALTLIFITGRLLLRPLFNTIAAIKSSEIFIATTLLIVLGSAFITENFNLSMALGAFVSGLLVAETEYRHDVEQVVLPFKKLLLGLFFMTVGMSIDIKFVVNKLPIIGLISFSLITLKSLIIFILCRFFKFHVAAAIQAGLLLSQGGEFAFILFGLAAEKNVLPSDLAQTLMMITTVTMAFTPPLAALGDWIAKLITKKKISLNSQELTLDTKDLDQHVIVVGFGRVGRMVAKVLVAEHVNYIASDIQPKTVKDGRDAGFPVYLGDLTKLATLESMAISRAKMIIIAINNEVTIKKIISLVAQRFPNIIIIVRLPDLNNAEVYKELGAHYLIPETYEVGLQLGAIALSNTGFSNHAISLLKDRFRTVNYAAVKNKEANE

SEQ ID NO: 52527 - protein, 499 aa, Kluyveromyces lactis NRRL Y-1140
MLRLHLRSKSTMSGSSVINYPQEFVNFLNSSPTPYHAVHNIKSHLQSNGFVELKETDPWESHFKKLGKYFVTRNNSSIVAFVVGGKWKPGNPVAIVGAHTDSPVLRIKPISKRTNEGFSQIGVECYGGGIWHSWFDSDLSVAGRVMVQDSKSKNIVSRLVDLKKPLLKIPTLAIHLDRDVNTKFEFNKETQLLPIAGLSIKDKKEETKKSEGCCGDSQPLSEDQFSSLKSIIERHHEDLLELIRKDLELENVTDIEDFELILYDHKPSTLGGIHDEFVFSGRLDNLTSCFTSMHGITEAADTGLSEDEGIRMVAMFDHEEIGSSSAQGADSNFLPNVLERITPLAGSDDVQQTSASSLLQSAAKSFFLSSDVAHAVHPNYSSKHETQHKPQFGAGPVVKINANQRYMTNSPGLVLLKKIADEAEIPLQLFVGANNVPCGSTIGPILASKTGIRTLDIGNPILSMHSIRETGSAKDIELQVKLFKKFFERYSELQHTIEV

SEQ ID NO: 52528 - protein, 481 aa, Mycobacterium bovis AF2122/97
MVGPRTRGYAIHKLGFCSVVMLGINSIIGAGIFLTPGEVIGLAGPFAPMAYVLAGIFAGVVAIVFATAARYVRTNGASYAYTTAAFGRRIGIYVGVTHAITASIAWGVLASFFVSTLLRVAFPDKAWADAEQLFSVKTLTFLGFIGVLLAINLFGNRAIKWANGTSTVGKAFALSAFIVGGLWIITTQHVNNYATAWSAYSATPYSLLGVAEIGKGTFSSMALATIVALYAFTGFESIANAAEEMDAPDRNLPRAIPIAIFSVGAIYLLTLTVAMLLGSNKIAASGDTVKLAAAIGNATFRTIIVVGALISMFGINVAASFGAPRLWTALADSGVLPTRLSRKNQYDVPMVSFAITASLALAFPLALRFDNLHLTGLAVIARFVQFIIVPIALIALARSQAVEHAAVRRNAFTDKVLPLVAIVVSVGLAVSYDYRCIFLVRGGPNYFSIALIVITFIVVPAMAYLHYYRIIRRVGDRPSTR

SEQ ID NO: 52529 - protein, 372 aa, Aspergillus oryzae
MTCGLKLAAARYGNHTLRQKIPLNAVRRYTSHTATSTTPPTSPFAPRHFLSIADLTSTEFATLVRNASSHKRTIKSGSIPQNLLGSMTGQTVAMLFSKRSTRTRISTEGAVVRLGGHPMFLGKDDIQLGVNESLYDSAVVISSMVSCIVARVGKHAEVADLAKHSTVPVINALCDSFHPLQAIADFQTIYETFTPKAHRSDSLGLEGLKIAWVGDANNVLFDMAIAATKMGIDIAVATPKGYEIPAPMLELIKQASNGVSKPGKIIETNVPEEAVKGADILVTDTWVSMGQEAESIKRVKDFEGFQITSELAKRGGANEGWKFMHCLPRHPEEVSDEVFYSPRSLVFPEAENRLWAAISAMEGFVVNKGRIE

SEQ ID NO: 52530 - protein, 483 aa, Omphalotus olearius
MLKHLLVCIGVYRYTGDTIPVTLTNFCPPIMSLTAVTTSMHENSVVAEPQLVQVESNARTYARKFPAQFQKGEGLMLYDVEGTLDMFTPRFLLTLPLGHNHPILRQAILDYVESGLPQQCLDLATTAKAEFVTELWHWLPEKLRPDAKIQFTSPAGTDAVEAAMKLVRIATGRSTIIAFDGGYHGHTVGSLAAMGNIDTKSQLKTGVLGDIAFFPYPHPDYSPFGLESADQTAQVSAKYLESRLADPDSGITKPAGIIVECIQGEGGVVPAPREWLKALRKIATKFDIPLIFDEVQSGFARTGTGFAFEYAEGVVPDVIVMSKAVGGGMPLACVVYHKRLDIWQPGSHAGTFRGNQIALFTGSQVLRYMRINNLAAHAADVGELFKARFLGYAEENRVRDRVLSVRGRGLMMGIQLVSPDGSRKEDGDLALRVQRTLFDKHRFIIERGGRFGSVLRVLPPLTITREEIVRCAETLVKGITESL

SEQ ID NO: 52531 - protein, 174 aa, Oryza sativa Indica Group
MASRLLHLRRLLPSARPSAGGGGDGGAVAAFSTVTPTPRVSALVDEICGLTLIEASSLTDALRGRLGVDQLPPLAILTGGAAPLAGGGAATGAAGEEAKAKEEKMAFDVKLEGFDAAAKLKIIKELRAFTNLGLKEAKELVEKAPAVLKAGVPKEEAESIAEKMRAIGAKIVLE

SEQ ID NO: 52532 - protein, 396 aa, Yarrowia lipolytica CLIB122
MTFHSLVNKVSGQPPSYNKKADYKFGKTLGAGTFGIVKYAKQHSTGEEVAVKIIVKKNLKGNDHVVIEELSLLKECHHPHIIAFKDWFESKEKFYIVTQLATGGELFDRICDYGKFTEKDARQSVKDILEAVDYLHSKDIVHRDLKPENLLFVTPDPHASLVLTDFGIAKHLKSPDEVLHSMAGSFGYAAPEVLKGTGHGKPCDIWSLGVITFTILSGYSPFRSETVRDFLEEIEGPNALVFHKKYWQDVSEDAKDFIKSCLALDPALRPTSAELLKHEWITGDTTKSIDLLPNIREGFNARSKFRQAIEAVRLHNRIKSLNMVDSDDEDEEEEAVADTEKPSLLSVASSMRPRAHSRSKSGTGAAAFQEVVLAAKRNKELLEKEKASKQDAAEEK

SEQ ID NO: 52533 - protein, 172 aa, Triticum aestivum
VEFATTEAAEKAYKLNGRDLAGRPVRLDFACERGTITPGSRRDNSSFKKPGQSSSYAAFIRGFDSSLGEDENRRSLQQHLSSCGEITRVSIAKDYDTCASKGIADMEFIDKSSLPKALELTGSDLGGCSLSVDEAKPSPDNRDGADSDRGCGQSGAPPRQSAGTLSAECWHT

SEQ ID NO: 52534 - protein, 388 aa, Thermosynechococcus elongatus BP-1
MAKIIVLCGCTLSSASNLFIFLDCVPVPVTLSAPPIRPAWHGLIHAYGDFLPVSDRTPVVTLYEGNTPLIPVPQIAARIGRNVSVYVKYDGLNPTGSFKDRGMTMAISKAKEAGAEAVICASTGNTSAAAAAYARRAGLRAYVLVPEGYVAQGKLAQALLYGAEVIAIEGNFDKALEIVRLMAETYPVTLVNSVNPYRLEGQKTAAFEVVDSLGNAPDWLCIPMGNAGNITAYWMGFCQYREQNRCDRLPRMMGFQAAGSAPLVKGEIVTHPETIATAIRIGNPANWQRAIAVKEASQGAFNAVTDEEILKAYCLLASEEGIFCEPASAASVAGLLKLADQVPSGATVVCVLTGNGLKDPETALKQESDRFHRHIEPTEQTVAKVMGF

SEQ ID NO: 52535 - protein, 433 aa, Leptospira interrogans serovar Copenhageni str. Fiocruz L1-130
MIWYPFTLQFEPDSPLKIERAKGEFLYDELGNSYIDGISSWWVSIHGHNHPKIVQAVKNQLEKLDHVLLAGFTHDPAEKLAAELLKITDGLFQKVLYSDNGSTAVEIMIKLAYQYFQNIGEVDRKIFIKWNSSYHGDTIGTMSVGGNSVFNRVFQGLMFPTKEFQTPNCNFCPMGKKPESCKVECIDPIEEFFQKSPKAVAGIVIEPLILGSGGMIFYKEEVLQRLETISKKYGSLLLLDEVFTGFGRTGSVFAYQRAKIRPDFIALAKGLSAGVSAVAVTLTTDRIHSAFVTADPEKGFYHGHTMTGNPIACSAALASLKIFFEENRLEQILRLESKLNVGLKKIAKEFPKAVKNCRVLGAVGVLELEVGKASGYHYPGNKILKKKFLEKGVLLRPLGNVIYLTPPYNIENSSLEKIFSAIRETLSEISFGN

SEQ ID NO: 52536 - protein, 486 aa, Vibrio vulnificus CMCP6
MEVTAHYIGGKPFVGDTGESFATLNPATGEVLAHIEQADERVLGHAIESAKLGFSVWSSMSAAERSRCLLKAAQLIRDHNDELAELEVRDTGKPIQEASVVDIATGADVIEYFAGLVNGLGGEQQSLGSNQFFYTRREPLGICAGIGAWNYPIQIAMWKAAPALAAGNAMIFKPSEETPLSALKLAELFTQAGVPDGVFNVVQGDYRVGQMLTAHPEIDKVSFTGESGTGKKVMADSAATLKPVTMELGGKSPLIIFDDADLDDAVSAAMVANFYTQGEVCTHGTRVYVQRAMYDAFVEQLKERTEKLIVGDPMNMETQIGSLISKSHLEKVLGAISSAKESGATLLTGGFQVTERGLEKGCFVAPTVFVDCRDEMPHVQNEIFGPVMSVLVFDDEDEVIARANNTQYGLAAGVFTQNLSKAHRVIHQLQAGICWINTWGNSPAEMPVGGYKLSGIGRENGQETLLHYTQTKSVFVELGAFDSPYA

SEQ ID NO: 52537 - protein, 164 aa, Magnaporthe grisea 70-15
MSTEHQEKFLRKPELQRLVRGVRGFDEILVLICGHGGRDQRCGIYGPLLRTEFEKTLPRLGVDVLTGPVDSVSESGGNKKPSSRIGLISHIGGHKFAGNVIIYIPPSLQTDDGLPHPLAGHGIWYGRVEPKNVEGIIHETIRKGNVIEEHFRGGITPSREILRL

SEQ ID NO: 52538 - protein, 385 aa, Haemophilus influenzae R2846
MALELSDIRQQITQIDRSLLKLLSERHRLAFDVVRSKEISQKSLRDVEREQQLLQELVQFAENENYQLEAQYITSIFQKIIEDSVLTQQVYLQNKLNEQRNQNLHIAFLGKRGSYSNLAARSYAARYQKQFVELGCQSFEQVFEKVQTEEADFGVLPLENTTSGAINEVYDLLQHTDLSLVGELAYPIKHCVLVNDKTDLNQIDTLYSHPQVIQQCSQFIHSLDRVHIEYCESSSHAMQLVASLNKPNIAALGNEDGGKLYGLSVLKTNIANQENNITRFIVVAKEPREVSSQIPTKTLLLMTTSQQAGALVDALLVFKKHQINMTKLESRPIYGKPWEEMFYLEIEANIHHPDTKQALEELKNYSNYLKILGCYPSEIVKPVSV

SEQ ID NO: 52539 - protein, 438 aa, Oryza sativa Indica Group
MDLRVAAPASVAAAARCGTSLARPWPARAVPIGGAYRLIDVPMSNCINSGINKVYILTQFNSASLNRHLSRAYNFSNGVAFGDGFVEVLAATQTPGSEGKRWFQGTADAVRQFDWLFDDAKAKDIDDVLILSGDHLYRMDYMDFVQSHRQRGADISICCLPIDDSRASDFGLMKIDDTGRVIAFSEKPKGDDLKAMQVDTTVLGLPQDEAKEKPYIASMGVYIFKKEILLNLLRWRFPTANDFGSEIIPASAKEINVKAYLFNDYWEDIGTIKSFFEANLSLAEQPPRFSFYDANKPMYTSRRNLPPSMINNSKITDSIISHGCFLDSCRIEHSVVGIRSRIGSNVHLKDTVMLGADFYETDLERGELLAEGKVPIGIGENTKIQNCIIDKNARIGKNVTISNSEGVQEADRTSEGFYIRSGITIVLKNSIIADGLVI

SEQ ID NO: 52540 - protein, 488 aa, Lachancea kluyveri
MSKRGSQHVVGIHYAVGPKIGEGSFGVIFEGENILNSNNNNSSNNSSSASTGTANPVDPVAIKFEPRRSDAPQLRDEFRAYRILNGITGIPHAYYFGQEGMHNVLIIDLLGPSLEDLFEWCGHRFSVKTTCMVAKQMIDRVRSIHQRDLIYRDIKPDNFLISEYQRELPTGQILRSCSSSSNGDPNLIYVVDFGMAKQYRDPKTKQHIPYRERKSLSGTARYMSINTHFGREQSRRDDLESLGHVFFYFLRGSLPWQGLKAPNNKLKYEKIGTTKQRLSPEKLLSDGIPEQFATYLKYCRNLKFDEDPDYDYLISLMDEALNTSGSVEDGHYDWMDLNQGQGWNIRVNRRANLHGYGNPTPRDQKAKNLQQQQQPQSQSQQKQPQQQQQQQQQQQQQQQQPNTTSGSLPTTPHRNSYSKHTFQRFRNNDGVLSVNPSVKQMHGPSTMAIRSPGYDSMGKRMQTSLQGNNNDNDSIEQAGFFRKLCCWC

SEQ ID NO: 52541 - protein, 108 aa, Thermosynechococcus elongatus BP-1
MTKRDHNKVYNVTLVNEERGLNKTIRVHADEYILDAAEAQGIPLPYSCRAGACVNCAGRIIKGTVDQSDHSFLKPKELDAGFVLLCAAYPTSDCVISTHEEDNLLNLA

SEQ ID NO: 52542 - protein, 227 aa, Oryza sativa Japonica Group
MAAEMEVDDVDVHEVPECIASMIDRGSVESHRLFLARRTAMEMLRDRGYSVPEAEIARTLPEFRAWWAEKPGIERLAFTTTLVSDPSKKVQLVFCPPEPVKIATIREIYLQTKEENLSRLVLILQSKILSRAREAIKEIFKFKVDIFQATDLLVNITKHVLKPKHEVLSADQKAKLLKEYNVEDSQLPRMLETDAVARYYGFDKGTVVKVTYDGELTGKRVAYRCVF

SEQ ID NO: 52543 - protein, 430 aa, Streptomyces glaucescens
MTGLRQTQHLAREARHLAPGASEEAVHGRRVFAEGRGPVLTDLDGNQYLDFAAGTLTQSLGHGHPEVVEALTTQARRLWNVHDSATPDRAGLLELLARLLPEQLDTYAFFSTGAEVVEAALRVVQATAAPGRNRIGALRHGFHGKTMGARMLVHWDIGHQAFSGNSVLGYSPYCYRCPLGLEYPSCDVRCATLVRRHIAEKPNVSALVFEPVLGAAGVIVPPPGYWERIAGACRDGGVLLVADEVLTGGGRTGAFLASELFGIEPDLAMLSKGTASGFPFAVLAGRAELLRRPEAATPGAYASTYASNPLGIAAARATLEVVERDRLIDRVRVLGELMEERLRALESRFPQLGQVRGLGLLWGLEFVTDAVGRAPAPETARAVYTTALDLGLRTSLGGHILRLAPPFTLDEALLDEGLRLLETAVERVIA

SEQ ID NO: 52544 - protein, 355 aa, Streptomyces glaucescens
MKALVLAGGTGSRLRPFTHTAAKQLLPIANKPVLFYALESLAAAGVREAGVVVGAYGREIRELTGDGTAFGLRITYLHQPRPLGLAHAVRIARGFLGDDDFLLYLGDNYLPQGVTDFARQSAADPAAARLLLTPVADPSAFGVAEVDADGNVLRLEEKPDVPRSSLALIGVYAFSPAVHEAVRAITPSARGELEITHAVQWMIDRGLRVRAETTTRPWRDTGSAEDMLEVNRHVLDGLEGRIEGKVDAHSTLVGRVRVAEGAIVRGSHVVGPVVIGAGAVVSNSSVGPYTSIGEDCRVEDSAIEYSVLLRGAQVEGASRIEASLIGRGAVVGPAPRLPQAHRLVIGDHSKVYLTP

SEQ ID NO: 52545 - protein, 259 aa, Kluyveromyces lactis NRRL Y-1140
MSAPQAQGQQAPRRGGFGGANRGGRGGRRGGRRDQEEKGWVPVTKLGRLVKAGKISSIEEIFLHSLPVKEFQIIDQLLPNLKDEVMNIKPVQKQTRAGQRTRFKAVVVVGDSNGHVGLGIKTAKEVAGAIRAGIIIAKLSVIPIRRGYWGTNLGQPHSLATKTSGKCGSVSVRLIPAPRGSGIVASPAVKKLMQLAGVEDVYTSSTGSTRTLENTLKAAFVAIGNTYGFLTPNLWEVQALTPSPMDVYADYATASKKKL

SEQ ID NO: 52546 - protein, 338 aa, Actinobacillus pleuropneumoniae serovar 1 str. 4074
MAILVTGGAGYIGTHTIVELLNINREVVVLDNLHNSSEVSLERVKQITGKAVKFYKGDVLDREILRKIFAEHKIESVIHFAGLKAVGESVQKPLFYYENNVGGSIVLVEEMIKAGVNTIVFSSTATVYGVPEVVPVTEACRVGDTTSPYATSKYMVERVLADTVKANPQFSAVILRYFNPVGAHESGLIGEDPNGIPNNLMPFISQVAVGKLPQLSVFGGDYETHDGTGVRDYIHVVDLAIGHLKALDKHQDDAGLHIYNLGTGIGYSVLDMVTAFEKANDIKVPYQIVARRAGDIDSYYSNPQKALDELGWKTERGLEQMMKDTWNWQKNNPNGYKG

SEQ ID NO: 52547 - protein, 413 aa, Nicotiana tabacum
MPEKPLFGKYELGKLLGCGASAKVYHAREINNGQSVAIKMINKNNKDNIPNENIEREISILRQLRHPYIVKLYEVLATKSKIYFVMEYVKGGELFTKIADHGRFSEDLSRKYFQQLISALNYCHSRGIYHRDLKPENILIDENGDLKISDFGLSATTDQIQKFDGLLHTVCGSPAYVAPEILTIKGYDGAKTDIWSCGIILYVMIAGYLPFYDQNLMLMYKKIYKGEFKCPKWMSPDVIRILSRLLDTNPATRITIDEIIKDPWFRKGLKFIKFAGEEEDKYSLSSNCLNAFDLISFSQGLDISGLFKSNNPANDLERTVVEQSPESVIERVEEMAKKENFRLRKKKEWGIEMKVQNGKLTMSVDIYRLTERFVIVEVKREAGNGDLYTDLWRNKLKAVILGQQIAEIQDSGS

SEQ ID NO: 52548 - protein, 222 aa, Triticum aestivum
  misc_feature (68)..(68): Xaa can be any naturally occurring amino acid
  misc_feature (83)..(83): Xaa can be any naturally occurring amino acid
  misc_feature (94)..(94): Xaa can be any naturally occurring amino acid
  misc_feature (106)..(106): Xaa can be any naturally occurring amino acid
  misc_feature (127)..(127): Xaa can be any naturally occurring amino acid
  misc_feature (147)..(147): Xaa can be any naturally occurring amino acid
  misc_feature (172)..(172): Xaa can be any naturally occurring amino acid
MGRKFFVGGNWKCNGTVEQVESIVNTLNAGQIASTDVVEVVVSPPYVFLPTVKAKLRPEIQVAAQELXWVKKGGAFTGEVSAXEMLVNLGVPWXVILGHSEKEDLXGEQSELLGEKVAYALAQGLEXIACVGETLEQRETGSTLEVXLTRKNHFLGKIKDWTNGALADKPLXAFGPGKVFKPGPGAGSHGNLKGWAHRQLGTLKLVPPPRNFFGRSCNWAKL

SEQ ID NO: 52549 - protein, 470 aa, Solibacter usitatus Ellin6076
MPNTKIVATLGPATDAPGVLRQLLAAGVDVFRLNASHGAQDAHAARIDAVRAAAREAHVHAGILLDLQGPKIRLGRFENGGVTLVTDAIFTITTEQVMGTSERASTGYSRFAKDVKAGDRILLADGIIELIALESDGVSVQTRIVNGGPIGDHKGINLPGVQVSIPSLTEKDLADLHFGLNAGVDIVALSFVRTADDVRQLRDRLGGRPVSIVAKIEKPEGYENIEPILDVTDGVMVARGDLGVEISLERVPRIQKSIIRRARRKGRFVITATQMLESMIENPRPTRAEVSDVANAIYDGTDAVMLSAETSVGKYPVEAVRYMAKIAAESEDSIRKKGYIDPPHQPQPSNAEILADAAHHAARDSGAAAIVVFSSRGSSARLVSRYRPPVGVFAITPHDTTARQLSVSYGVTPLLAPDVSSTDEMLSQMDRVLIEGGYLQKGQLVVFVAGQPVGRPGTTNLMKLHRVGLG

SEQ ID NO: 52550 - protein, 78 aa, Triticum aestivum
  misc_feature (24)..(25): Xaa can be any naturally occurring amino acid
  misc_feature (36)..(36): Xaa can be any naturally occurring amino acid
  misc_feature (40)..(40): Xaa can be any naturally occurring amino acid
  misc_feature (47)..(47): Xaa can be any naturally occurring amino acid
  misc_feature (50)..(50): Xaa can be any naturally occurring amino acid
  misc_feature (62)..(62): Xaa can be any naturally occurring amino acid
  misc_feature (65)..(65): Xaa can be any naturally occurring amino acid
  misc_feature (71)..(71): Xaa can be any naturally occurring amino acid
  misc_feature (74)..(74): Xaa can be any naturally occurring amino acid
VPQILDLNPQNPRRRLRSNPEFFXXFDPWPVFFRRXWGRXWPFLAGXAVXGALITKMTAGFXEEXLKNSKXIQXHKKK

SEQ ID NO: 52551 - protein, 350 aa, Clostridium acetobutylicum ATCC 824
MLCALIMAGGKGERFWPLSTDEKPKQFLKLLSDKTMIQMTVERLESLIDIEKIFVVTGERYVDILREQLPRLPKRNIIVEPVGRNTAPCIALSAFVINKYYKDASIVVLPSDHLIVNEDKLLDAIRSAEEFIEKNDNSIVTLGMEPTRAETGYGYIKSGEVKEEISGFKIKKVDEFVEKPNKEKAEEYVKAGNFLWNGGMFIWKCSTIFKLTEKYLNKTYNILRSISEANGDEFNVLLKREYVKVDNISVDYGIMEKADSIYVIPCDFGWDDIGTWHAVERYRDKDEDNNVCVGDIKSIDSKNNILVGKKKPIVVVGLSDVFVVESDDIIFVGKKDDIERIKEIKKKVIK

SEQ ID NO: 52552 - protein, 359 aa, Zea mays
MAEHLASIFGTEKDRVNCPFYFKIGACRHGDRCSRLHNKPSISPTLLLCNMYQRPDMITPGVDAQGNPIDPERIQEDFEDFYEDIFVELSKHGEIESLHVCDNLADHMIGNVYVEFREEEQAARALQALQGRYYSGRPIIAEFSPVTDFREATCRQFEEHSCNRGGYCNFMHVKQVGRDLRRKLFGHLHRSLRSHSRGSRSPSPYRRRGSSSRSRDRDDYHDYYYHYYRSGSGSRRSSERHRSHDSDGSRRRRGRSRSRSRSPVREGSEERRAKIEQWNREREAAQVVIGLASCHVAVAEACYHVLWCGSGRAYRGESAASEYVHPLGVEIEQWNPECVTDTISRVVESIDFRADPIKL

SEQ ID NO: 52553 - protein, 726 aa, Nicotiana tabacum
MASAAIFSSLRRQRSPSLEAFLAPVDLTEVGLLQTLTALSSELISSFSGKRVPFYQQKNCKSLLRKIQAFSVLLDCLVENSDNNRSGRGGSSDLPFTAFLCFKELYLLLYRSKILLDYCSQSSKLWLLLQNHSISGHFHDLNQEISTLLDVFPLKELTLPEDVMEQVELLQKQARKSMLFVDKHDEMLRLKLFSFLNEFENGGIPGSAQLYSFFVDKLVICNPRSCRVEIEFLEEQIVNHEGDIEPTASVLNGFVALIRYCRFLLFGFEEDDVGLGVGKHKKQKKGLISQEIADTSISVPKDFCCPISLDLMRDPVIVSTGQTYDRASISRWMEEGHCTCPKTGQLLDHTRLVPNRALRNLIMQWCAAHKIPYDNMEGGDPCVESFGAASPSKAAVEANRATTALLIKQLANGTQIAKTIAAREIRLLAKTGKENRAYIAEAGAIPHLKNLLSSPDAVAQENSVTAMLNLSIFDKNKGRIMDEVGCLTLVVGVLIFGHTTEARENAAATLFSLSAVHDYKKQIAKEDGAVEALAGLLREGSPRGKKDAVTALFNLSTHTENCARMIELGAITALVGALGSEGVAEEAAGALALIVRQPIGAAAVGNEEMAVAGLIGMMRCGTPRGKENAVAALLELCRGGGAAATERVLKAPALASLLQTLLFTGTKRARRKAASLARVFQRCEHASMHYGGLGVGYAFAGNSATVRDSTFAGDVSVSMSISVPVL

SEQ ID NO: 52554 - protein, 363 aa, Ehrlichia ruminantium str. Welgevonden
MGLNCGIVGLPNVGKSTLFNALTCTTVAEVANYPFCTIEPNIGKALVKDDRLKTLAQMASSKKIIYNQVECVDIAGLVSGASNGEGLGNKFLSHIREVDAIIHVLRCFSDQNISHVNQSIDPIGDAEIVEMELILADIESLKRRLITMEKAVKANKEPKKKLDNMLEVLSILEAGNLAKNAQHIDNNELKQLNLITTKPMMYVCNVEESNVISGNTLSEKVKIMAKNNNNKFCCISAKLEADVASLDTEEEKLSFLAEFNLKEAGTTSVVKTMYELLDMITFFTLGPQEARAWPIKRLSTASTAAGVIHTDFEKGFIKAELISFDDYIKYNGEAKCKEAGKVRFEGRDYIVQDGDIIHFRHSN

SEQ ID NO: 52555 - protein, 130 aa, Pseudoalteromonas tunicata D2
MNESIEKMHQQGGILLYLRQEGRGIGLYNKIDAYVLQSQGMNTYEANNHLGFADDLRDFSDAVLMLKAMGIHDVQLMTNNPKKLKALTDAGIKVRNLVGTHAHLKEGNEAYLATKVKHGSHMLDLSKTKK

SEQ ID NO: 52556 - protein, 173 aa, Ehrlichia ruminantium str. Welgevonden
MSKHTNIPMFRIGIGYDVHRFDNINNDDSNTSITICGIKINYHKKIIAHSDGDVGLHALADAILGAVGCGSIGQHFPNTDKKWKNAESSHFVIEAQKKAQERGYIISNADIIIICEQPKIMPYALEMQHYIAQFTSIDPSFINIKATTTEKLGAIGRNEGIAAQAIVLCSQQY

SEQ ID NO: 52557 - protein, 151 aa, Solanum palustre
  misc_feature (7)..(7): Xaa can be any naturally occurring amino acid
RKSFYYXAENNVVFEGILLNPSMVTPGAEHKEKATPDTIAKYTLTMLKRRVPPAVPGIMFLSGGQSEVEATLNLHAMNQSPNPWHVSFSYARALQNTVLKTWQGRPENVDAAQRALLIRAKANSLAQLGKYSAEGESEEAKKGMFVKGYTY

SEQ ID NO: 52558 - protein, 307 aa, Acinetobacter sp. ADP1
MNTVEPNFLADEFLLDHYVGKTPLVRLQRLACHTQSVVLAKLEGNNPAGSVKDRPAYNMIMQAEKRGKIRPGDTLIEATSGNTGIALAMVAAMRGYKMKLIMPNNMSQERKDAMLAYGAELIEVTQQQGMEGARDLALKMQSEGQGLVLNQFGNPDNVEAHYLTTGPEIWQQTNGKITHFVSSMGTTGTIMGVSKYLKEQNPDIQIVGLQPSEGSSIAGIRRWPQEYLPTIFEPSRVDRIIDIPQIEAEKTMRRLAREEGISAGTSSGGAVWASLKIAEEQPDAVIVCIICDRGDRYLSTGLFSVQD

SEQ ID NO: 52559 - protein, 115 aa, Oryza sativa
MADAAAPSTRGGMGRGRGGRGRGRGRRGAKKDEEKEWVPVTKLGRLVKDGKIKSIEEIYLFSLPVKEYQIIDILLPKLKDEVMKIMPVQKQTRAGQRTRFKAFVAIGDFDGHLGL

SEQ ID NO: 52560 - protein, 447 aa, Xanthomonas campestris pv. campestris str. ATCC 33913
MSLPAQPHKQTRQTIVRLLSSMASAKEISQYLKRFSQLDAKRFAVVKVGGAVLRDDLEALTSSLSFLQEVGLTPIVLHGAGPQLDAELSAAGIEKQTVNGLRVTSPHALAIVRKVFQASNLKLVEALQQNGARATSITGGVFEAEYLNRDTYGLVGEVKAVNLAPIEASLQAGSIPVITSLGETPSGQILNVNADFAANELVQELQPYKIIFLTGTGGLLDAEGKLIDSINLSTEYDHLMQQPWINGGMRVKIEQIKDLLDRLPLESSVSITRPADLAKELFTHKGSGTLVRRGERVLRATSWDELDLPRLTSLIESSFGRTLVPDYFSNTKLLRAYVSENYRAAVILTDEGMLGASALIYLDKFAVLDDAQGEGLGRAVWNVMREETPQLFWRSRHNNQVNIFYYAESDGCIKQEKWKVFWYGLENFEQIQHCVAHCATRQPTLLG

SEQ ID NO: 52561 - protein, 363 aa, Prochlorococcus marinus str. MIT 9313
MLKAGIVGLPNVGKSTLFNALVANAQAQAANFPFCTIEPNVGSVAVPDERLQLLCDLSKSKEMIPTRMEFVDIAGLVKGASEGEGLGNKFLANIREVDAIVHVVRCFEDEDVIHVSGSVDPSRDAEVINLELGFADLSQIEKRRLRLKKQTRTSNDAQFEDAALERIQSVLEQGGAARAVELSDEEAKIIKPLGLLTAKPIIYATNVSEDDLAGGNAYCEEVTTLATREGAECVRISAQVEAELIELGEAERIDYLEGLGVSEGGLKSLIKATYRLLGLRTYFTTGEKETRAWTFKAGMTAPQTAGVIHTDFERGFIRAQTIAYQKLLEAGSFAEARNKGWLRSEGKDYVVEEGDVMEFLFNV

SEQ ID NO: 52562 - protein, 277 aa, Citrobacter freundii
EIVAINDLLDADYMAYMLKYDSTHGRFNGTVEVKDGHLIVNGKKIRVTAERDPANLKWDEVGVDVVAEATGLFLTDETARKHITAGAKKVVLTGPSKDNTPMFVKGANFDKYEGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAASYEEIKKAIKAASEGPMKGVLGYTEDDVVSTDFNGEVCTSVFDAKAGIALNDN

SEQ ID NO: 52563 - protein, 76 aa, Arabidopsis thaliana
  misc_feature (26)..(28): Xaa can be any naturally occurring amino acid
  misc_feature (31)..(31): Xaa can be any naturally occurring amino acid
  misc_feature (59)..(59): Xaa can be any naturally occurring amino acid
MASSMFSSTAVFTCGGQSTIVAPFTXXXSSXSFPVTRKANNYITWITSNLLIVICIKKXPPIRNNNFHTLSYLPDL

SEQ ID NO: 52564 - protein, 404 aa, Leptospira interrogans serovar Copenhageni str. Fiocruz L1-130
MDLSAKRLNVIEPSPTLVITAKANELKKKGEDIVSFGAGEPDFETPSHIRDAAKNAIDRGMTRYTAVSGTVELKEAIVHKFKRDNGLDYDKSQVIVGTGGKQVIYNYFLATLNAGDEVIIPAPYWVSYADIVRLAEGVPVIVNTTPEANFQITPEQLKKVITPKTKCLILNSPSNPTGAGYTKKDIEALGEVVLSTGIQVMSDDIYEKIVYDGFVFSNLAMLSPELKKQTFVINGVSKTYSMTGWRIGYGAGDLNIVKNMETIQSQSTSNPSSISQAAAQAAIAGDQSCVEEMRKAFQVRRDLIVSLLNAIPGVKCNNPQGAFYVFPYLTDVYKTTGFIKLKQGSSETSLSKIFCSTLLEKYKVAAVPGIAFGEDQALRLSYAMGENDIRRGVERIAEMIRDLN

SEQ ID NO: 52565 - protein, 339 aa, Xanthomonas campestris pv. campestris str. ATCC 33913
MSLKHFLNTQDWSRAELDALLTQAALFKRNKLGSELKGKSIALVFFNPSMRTRTSFELGAFQLGGHAVVLQPGKDAWPIEFNLGTVMDGDTEEHIAEVARVLGRYVDLIGVRAFPKFVDWSKDREDQVLKSFAKYSPVPVINMETITHPCQELAHALALQEHFGTPDLRGKKYVLTWTYHPKPLNTAVANSALTIATRMGMDVTLLCPTPDYILDERYMDWAAQNVAESGGSLQVSHDIDSAYAGADVVYAKSWGALPFFGNWEPEKPIRDQYQHFIVDERKMALTNNGVFSHCLPLRRNVKATDAVMDSPNCIAIDEAENRLHVQKAIMAALVGQSRP

SEQ ID NO: 52566 - protein, 490 aa, Thermosynechococcus elongatus BP-1
MIEAEVHRQLRAFLRSSGDRRWPHHLTLARLVARALRLRRGCLLQVSQRAVLQHRYGLSYLLPLLLYPEPALLVVPQERLTRLLHQEIPELLSFLAVTKPIQHSHCPQPVFEGVLVMNLEDWCRQATPYPNVVTIIDGIEALPAIAQQQMTCTITTSDWEHLKLAIPSAIGAIRQVYAQLVQHLFQRPQNPYGDYLLTPTEQQPLLELLHQWPQSLPPQWSQLRHYLNRDDTVIWGRRHPTAGYFTLHSHPLNLRPYFQDLWCQAPFVLIGSGPDTDPPLAYVQQELGIPAQTTIKFASDRHSEAITLAIAEDLPLPNTPEFAPAVLRRLYDLLGTIGHQRAVILVSDVPLREQLATQLAALYGSRVQVETTTLETNTILVTGETFWLRHGAQLPCPALLVLTTLPFPSPEKAVVSARIEWHKRQKQDWFRQYLLPECLTVLDRALAPVRQDDTLVAILDRRLTERSYGREILQSLSPYNRVRDRAQSPR

SEQ ID NO: 52567 - protein, 286 aa, Xerophyta humilis
MEGKEEDVRLGANKFSERQPIGTSAQTERDYVEPPPAPLFEPGELSSWSFYRAGIAEFIATFLFLYITILTVMGVVKSPTKCSTVGIQGIAWAFGGMIFALVYCTAGISGGHINPAVTFGLFLARKLSLTRALFYMVMQRLGAICGAGVVKGFQKGLYMSQGGGANAVNPGYTKGDGLGAEIIGTFVLVYTVFSATDAKRSARDSHVPILAPLPIGFAVFLVHLATIPITGTGINPARSLGAAIIYNRSHAWNDHWIFWVGPFIGAALAALYHQVVIRAIPFKSRA

SEQ ID NO: 52568 - protein, 233 aa, Oryza sativa Indica Group
MTISLVIQHILHPDFQSSSQAHDFVGVKMQRAIQAIGSHGSLLKSAVLRHISAPKPSILPAVYSRSMSVSSAQIEESGFETATVADILKSKGKSADGSWLWCTTDDSVYDAVKSMTQHNVGALVVVKPGQDKSIAGIVTERDYLRKIIVQGRSSKSTKVGDIMTEENQLITVKPDTRVLQAMQLMTEKRIRHIPVIDGTGMVGMVSIGDIVRAVVSEHREELNRLNAYIQGGY

SEQ ID NO: 52569 - protein, 504 aa, Solanum tuberosum
MAISTLARRKATTFLSSRLLYSTSKYSFSLTRGFASGSDENDVVVIGGGPGGYVAAIKAAQLGLKTTCIEKRGTLGGTCLNVGCIPSKALLHSSHMFHEAQHSFANHGVKFSSVEVDLPAMMGQKDKAVSNLTRGIEGLFKKNKVNYVKGYGKFLSPSEISVDTVEGGNSVVKGKNIIIATGSDVKGLPGITIDEKKIVSSTGALALTEIPKRLVVIGAGYIGLEMGSVWGRLGSEVTVVEFASDIVPTMDGEVRKQFQRALEKQKMKFMLNTKVVSVDATGDGVKLTLEPSAGGDQTILEADVVLVSAGRVPFTSGLGLDTIGVETDKAGRILVNERFATNVPGVHAIGDVIPGPMLAHKAEEDGVACVEFIAGKEGHVDYDMVPGVVYTHPEVAYVGKTEEQVKSLGVDYRVGKFPFLANSRAKAIDDAEGIVKVIAEKESDKILGVHIMSPNAGELIHEAVLALQYGASSEDIARTCHAHPTMSEALKEAAMATYDKPIHM

SEQ ID NO: 52570 - protein, 139 aa, Chlamydomonas reinhardtii
MAPVVLNVYDLAPQNQWTIFCGVGIFHSGVEVHGVEYAYGQHDYDYSGIFATNPRDAPGQVVFRESILMGETHLSQAEIHALVQRMGNDYKGTNYHLLQRNCNHFANDLCVQLIGKEAPTWVNRLAGIAVMLHCLIPPS

SEQ ID NO: 52571 - protein, 501 aa, Actinobacillus pleuropneumoniae serovar 1 str. 4074
MLQIRPLVTNQNQQEKTMSVKGDIGVIGLAVMGQNLILNMNDNGFKVVAYNRTTSKVDEFLAGAAKGTNIIGAYSLEDLAAKLEKPRKVMLMVRAGDVVDQFIDALLPHLEEGDIIIDGGNSNYPDTNRRTAALAEKGIRFIGTGVSGGEEGARHGPSIMPGGNIEAWEHVKPILQAISAKTDKGEPCCDWVGKEGAGHFVKMVHNGIEYGDMQLICEAYQFLKDGLGLSYDEMQAIFQEWKKTELDSYLIDITTDILGYKDTDGTPLVEKILDTAGQKGTGKWTGINALDFGIPLTLITESVFARCVSSFKDQRVAASKLFNKTIMPIEGDKKVWIEAVRKALLASKIISYAQGFMLIREASENFGWDINYGATALLWREGCIIRSRFLGNIRDAYEANPDLVFLGSDDYFKGILENAMADWRKVVAKSIEVGIPMPCMASAITFLDGYTSDRVPANLLQAQRDYFGAHTYERTDKPRGEFFHTNWTGRGGNTASTTYDV

SEQ ID NO: 52572 - protein, 574 aa, Chlamydomonas reinhardtii
MLSSVRLAALRAGKTNSVFQAVRAFAAEPAAAATTDAGFVSQVIGPVVDVRFDGELPSILSALEVQGHNVRLVLEVAQHMGDNTVRCVAMDSTDGLVRGQKVVNTGSPIKVPVGRGTLGRIMNVIGEPVDEQGPIECSEVWSIHREAPEFTEQSTEQEILVTGIKVVDLLAPYQRGGKIGLFGGAGVGKTVLIMELINNVAKAHGGFSVFAGVGERTREGNDLYREMIESGVIKLGDKRGESKCTLVYGQMNEPPGARARVALTGLTVAEYFRDVEGQDVLLFVDNIFRFTQANSEVSALLGRIPSAVGYQPTLATDLGGLQERITTTTKGSITSVQAVYVPADDLTDPAPATTFAHLDATTVLSRSIAELGIYPAVDPLDSTSRMLNPNIIGAEHYNIARGVQKVLQDYKNLQDIIAILGMDELSEEDKLTVARARKIQRFLSQPFQVAEVFTGTPGKYVDLKDTISAFTGILQGKYDDLPEMAFYMVGGIHEVVEKADKLAKDVAARKDESKKAKSSEALKDVPSLEKMAGEIKDEVIDADDSLEEDFKAEAISSENMVLNEKGEKVPLPKK

SEQ ID NO: 52573 - protein, 278 aa, Desulfitobacterium hafniense Y51
MDSEKVVNMVPKMKMSKSFITFGLVIVLLVILALDAFVIVNAGQRGIVLQLGAVRPIVLTEGLHFKIPFVQSVVPMEVRVQKSQSEQTAASKDLQIVTTTVAVNFHLDPIQVNKLYQNVGLSYGERIVDPAIGEAVKAITAQYTAEELISKRSEVSAKIKETLASKLATYYMVLDEINITEFKFSQEFNNAIEQKQIAEQQALKANLDLQRIEIEAKQKVEQAKAEAESLRLQKQEVTPELVQLREIEAKIKAIEKWDGKLPNVTGGAVPFIDVNSGQ

SEQ ID NO: 52574 - protein, 128 aa, Arabidopsis thaliana
  misc_feature (86)..(86): Xaa can be any naturally occurring amino acid
MSMAYSLNISNLQHFMVLIKPSSPIRQEVLVFDFQPRNPESIEAAISLLSGNLIPGVVLQRRLKNVPRQRCWMVGPSKGNDAMEMXMEFNKSWETDLRVGFHDCRHYTNELVQHLTGEMQIVERLPRS

SEQ ID NO: 52575 - protein, 495 aa, Actinobacillus pleuropneumoniae serovar 1 str. 4074
MNIENSCIVIFGASGDLTFRKLIPALYNLFRVGRLGQHFSVLGVARSELTDDSFRTKMRDALVKFEKAQGQELEDFCTHLYYQAVNTSDALDYAKLLPRLDELHDKYGSCGNTLYYLSTPPSLYGVIPECLAAHGLTTEEYGWKRIIVEKPFGYDIKTAKELDEKIHHYFEEHQIYRIDHYLGKETVQNLLVLRFSNGLFEPLWNRNFIDYVEITGAEAIGVEERGGYYDGSGAMRDMFQNHLLQVLAMVAMEPPAIINADSMRDEVAKVLHCLHPLTAEDVKNNVVLGQYVAGEVDDQMVAGYLAEKGVPADSNTETYMAIKCEIDNWRWAGVPFYVRTGKRLPTRVTEVVIHFKTTPHPVFSQNAPENKLIIRVQPDEGISMRFGLKKPGAGFEAKEVSMDFRYSDLSSASSLLTAYERLLLDALKGDATLFARTDAVHACWKFVQPILDYKAERGRVYEYEAGTWGPTEADKLIAKHGKVWRKPSGVMKKKV

SEQ ID NO: 52576 - protein, 271 aa, Actinobacillus pleuropneumoniae serovar 1 str. 4074
MQPLNSTLLEAVKRIAIEAGEHLKRFYQCSVQVKIKADHTPVTEADLFISQFVTEKLRQLTPDVPILSEENCNIALADRQTWQEYWIIDPLDGTQQFIDRTDQFSVVIGLVQDHRPVLGVIHSPILAKTYFAMAGNGAFLQENGEIRQLVGHQGLLQDNRLKITMGASAQQAVLNSVDKSYQAEIFQYGSSSLKAGLLAEGKADCYVRFGDTGEWDTAVAEVLLSEVGGKIFNLKFEPLTYNRRSTFINPYFVMVADKHLAWEQIFRFNAQ

SEQ ID NO: 52577 - protein, 116 aa, Arabidopsis thaliana
MSMAYSLNISNLQHFMVLIKPSSPIRQEVLVFDFQPRNPESIEAAISLLSGNLIPGVVLQRRLKNVPRQRCWMVGPSKGNDAMEMAMEFNKSWETDLRVGFHDCRHYTNGLVLYKL

SEQ ID NO: 52578 - protein, 64 aa, Arabidopsis thaliana
MSMAYSLNISNLQHFMVLIKPSSPIRQEVLVFDFQPRNPESIEAAISLLSGNLIPGSDSQTSNV

SEQ ID NO: 52579 - protein, 445 aa, Mycobacterium leprae
MRRSKQGAEGKAEKKAARSAGVCRTTLPGGLRVVTEHLPAVRSASVGVWVGVGSRDEGATVAGAAHFLEHLLFKSTSTRTAMDIAQAIDAVGGELNAFTAKEHTCYYAHVLDSDLELAVDLVADVVLNGRCAVDDVELERDVVLEEIAMRDDDPEDALGDMFLAALFGDHPVGRPVIGTMESVSAMTRTQLHSFHVRRYTPERMVVAVAGNVDHDEMVALVREHFGSRLIRGRQSAPPRKSTGRINGGPALTLGKRDAEQTHVLLGVRTPGRSWEHRWALSVLHTALGGGLSSRLFQEIRETRGLAYSVYSALDIFADSGALSVYAACLPGRFADVMQVISEVLASVAGDGITEAECRIAKGSLRGGIILGLEDSNSWMSRLGRSELNYGKYRGIEHTLQQIDEVTVEQVNALAHQLLNKRYGAAVLGPYASKKTLPRQLRIMVN

SEQ ID NO: 52580 - protein, 304 aa, Nocardia farcinica IFM 10152
MPRIAYFGPTGTFTEMALAELESSGHFDGPVERVAAPSQPAALDLIRSGAVEGAVVPIESSIEGSISATLDSLAIGPRLQIVAETELEVSFEILARPGTTLADVRTLAAFPVAAAQVRMWVERTLPQVRMYTSASNAAAAEDVVAGHAEAAVSTALAGQRLGLVALASKVVDYEQAVTRFVLVRRPCVAPPATGADRTSIVLELPNVPGSLMRAFAEFATRGIDLTRIESRPTRTGLGTYRFYLDCVGHIDDAAVAEALKALHRTARIRFLGSWPATSATGTPPPSDEEAAQWLTQLRKGVADL

SEQ ID NO: 52581 - protein, 165 aa, Picea sitchensis
MLRQAGISITSAARAAHASAMGGVRAYHERVVDHYNNPRNVGSFDKNDPDVGTGLVGAPACGDVMKLQIKVDSETGKIVDSCFKTFGCGSAIASSSVATEWIKGKPMEEVVSIKNSDIAKHLSLPPVKLHCSMLAEDAIKAAVKDYEAKRAKNTDVKQEEKVAEA

SEQ ID NO: 52582 - protein, 234 aa, Methanopyrus kandleri AV19
MKPIRVCPECGKYTEKHTCERCGRRTEEFLDGRRRLALSKLLSGILRHFPEEVKVKLDDEGFTDCDVHELAERIKKYWKNREYYRWLTGEHIIAVVETCPKGRFEIDEHGRIRARYGHSRRLSVRPTLPEAENVKELYHGTARENLESILQHGIKPMGRRAVHLTDDEREALITALRHTRNPVILVVDAERLRRHGLVPRKAGKNVYVVEGTVPPDCITRVIRNPRRSVESEKR

SEQ ID NO: 52583 - protein, 174 aa, Codonopsis lanceolata
MSNPKVFFDIVIGKMKAGRIVMELFADSTPKTAENFRALCTGEKGIGLSGKPLHYKGSIFHRIIPNFMCQGGDFTRFNGTGGESIYGAKFADENFKNKHTGPGILSMANSGPNTNGSQFFICTEKTSWLDGKHVVFGKVVDGYSVVKEMEKVGSDGGNSKSTVEIEECGQIQEN

SEQ ID NO: 52584 - protein, 545 aa, Bifidobacterium longum NCC2705
MTNQTFEQLKKTYESGRTRPLAWRRAQLNALRRLVTENRDAFVSSAMADLGKPAAETVLMELNLVAGEAQFVRNRLSLWTARHPKAMHWMLQPAAGWTIAEPKGVVLIISPWNYPVLLALEPMADALAAGNAICLKPSELSPNTSRLIAELVPQYLDPEAVRVVEGGPKETGDLLKNPFNHIFYTGGGHVGKIVMRAAAEHLTPVTLELGGKSPCFVDRTADINVAARRIAWGKFTNAGQTCVAPDYVLATPDVAEALAERIAVAITEFYGEDPKASPDFGRIINDRHFERLCKLLPVGTVPPEEPSSPLVQVASAVGAAMDMVGRRFNAVTTGRGGAGEMAGSANNAAKPTAGSNMAAADDGATASAAVEPSEIHKVPGVFDLAGRIVCGGKVDRAARYIAPTVLYGTSPDAPVMKEEIFGPILPILVVEDAESAIRFINKRSRPLAAYVFSRDHEVRLTFERQTSSGALGYSLPLGHLLSSRLPFGGVGASGIGTYHGKAGFLTFSHVKTVVTKPQFPDTLRLVYPPFNEAEAKLFDIIAKFS

SEQ ID NO: 52585 - protein, 394 aa, Methanopyrus kandleri AV19
MGLDEIVNGFPLKEEWVYLDNAATSLKHERVISAMERVLREFGVNVGRGAHPPGECATEEFERARDIVASFLGVEPECLAFTLNTTHSIHYVLASIRWKKGDAVVTTALEHHSNLAPWLRFSEVLGFEVEVVGFDRETGEVDMAELESVVDDNTRLIAITHESNALGSLQPVDEILELAEEVGAYVLLDAAQSLGHMDHDWSRYHFLAAPGHKGLLGPHGTGILYVREDVMEELELRLLGGGSTDYVTRDLEVVPREPPLSFESGTPNLPGVIGLAEGVKILEEVGLNRVERRIRKVTRRILNGLEELEGVEILAPEAERKTIVPFLVDGVDYAEVGKKLGERNICVRTGRHCASLVFERLGLDGCVRASVAFYNDIEEAERFLEVVEEIARGS

SEQ ID NO: 52586 - protein, 146 aa, Brassica napus
RLFISIKDEQGNPLLTADEIKPTIKELVMAAPDNPSNAVEWAMAEMVNKPEILHKAMEEIDRVVGKERLVQESDIPKLNYVKAILREAFRLHPVAAFNLPHVALSDATVAGYHIPKGSQVLLSRYGLGRNPKVWADPLSFKPERHL

SEQ ID NO: 52587 - protein, 539 aa, Clostridium acetobutylicum ATCC 824
MIKKGISASKGYAIGHVFIKADNEVKIVEKKISDIESEKARLQGAVEKAREQLTKIKEKAEKDLGADKAAVFESHMMFLDDPDFIGSAENIISDEMINAEKALENVMKNYVAIFEGIEDEYVKERIADVKDVGNRVLQNLAGNDMTSLADVDNNTVVVAHDLTPSDTAQLDKNRVIGFLTNIGGRTSHSAIMARTLEIPAVVGLQDIVESVKNGDTIVVDGAEGIAIINPDEATLKEYEAKKAEYEKKQEKLRELINVETRTKEGKRVEVCGNIGKAKDVEAVLQNGGDGVGLFRTEFLYMDRDQMPTEDEQFEAYKAVVEKMGEKPVVIRTLDIGGDKKLPYLPLPEEMNPFLGYRAIRLCLGRKDIFKIQLRALLRASVYGNLKIMFPMISSLEEFLSAKEVLKECMGELDKEGKKYNAKLETGIMVEIPAAAVNSEELAKYVDFFSIGTNDLIQYTLAADRMNEKVSYLYNPMHPAVLKLIKMTIQSAHKEGKWCGMCGEMAGDEKAIPTLVEYGLDEFSMSASSILTAKELIMKA

SEQ ID NO: 52588 - protein, 411 aa, Desulfitobacterium hafniense DCB-2
MSLRENALKLHADHRGKIKIALKVPCRDYNDLSLAYSPGVAEPCMEIAQDPELVNTYTNRANCVAVVSNGTAVLGLGDIGARAAMPVMEGKSLLFKNFAGVDSFPICLDTKNIDKIVEVVKLLEPTFGGINLEDIKAPECFEIEEKLKAVYDGPVFHDDQHGTAVVTLAAMFNALKIVNKELKDVKIVTSGAGAAGMAIVKLLMDCGLQNVIMCDTKGTIYKGRAEGMNKYKEEIALRTNPAMVKGSLGEALKGADVFIGISVGNTVTQEMIRTMAKDAIVFAQANPVPEIMPEEAKEAGAAVIGTGRSDYPNQINNILSFPGIFRGTFDVEAREINGPMKIAAAEAIASIVSPEELSAEYIIPKAFDKRVAPAVAAAVAKAAMESGVAKRKVDPEQVALNLTSLLAQEGK

SEQ ID NO: 52589 - protein, 353 aa, Picea sitchensis
MGAEEELCKTAVEGDYIRVKELIDGGADVTYFDSDGFTPLMHAAKHGHSQVVQCLLDFGAPWNALHPSGLSAGDFAMEAGHQDAFDLLLNAGMRAELVLGKITRSQNSNTEYLEQRVLYSEDKLLDEENKGVMMAWEKPLMEAHARAVCSGGESGHILNVGFGMGLVNEAIQKYKPASHTIIEAHPDVYARMHATGWGDKPNVKIIFGRWQDVLPQLESYDGVFFDTYGEYYEDMKEFHEYLPKLLKPGGIYSFFNGLCGDNAFFHVVYCQLVALELAHLGYTTQFIPLPVKDCLEENVWEGIKQKYWQLDTYYFLSVKHLLKIIPDDLICISDCLSFCSHSLSKIIGYYYSF

SEQ ID NO: 52590 - protein, 325 aa, Coccidioides immitis RS
MAVRTASRSLSQAISRSQSASGVFASPPRWMIFTPRTVYTQAARIPVITSSRSRHRPTLLRQHQPVAAQMPANVPANNRTIFIQTEVTPNADALKFIPNYPVLPENFPAPFLEYLSPRSTLAAPHPSPLAAKLLNVDGVSSVFYGPDFITITKAGDANWAHIKPEVFSLITEAVTSGEQLVNTVAVAEGAQAGQEGSGEEAVEYNEEDEEVVGMINELLETRIRPAIQEDGGDIEFRGFKDGNVMLKLRGACRTCDSSTVTLKNGIESMLMHYIEEVKSVTQVIDEEEEVALKEFERFEEKLRQQKGPGATASTVGKGSLDTADA

SEQ ID NO: 52591 - protein, 220 aa, Enterobacter cloacae
YDSTHGRFDGTVEVKDGHLVVNGKTIRVTAEKDPANLKWNEIGVDVVAEATGIFLTDETARKHITAGAKKVVLTGPSKDNTPMFVRGANFETYAGQDIVSNASCTTNCLAPLAKVINDNFGIVEGLMTTVHATTATQKTVDGPSHKDWRGGRGAAQNIIPSSTGAAKAVGKVLPELNGKLTGMAFRVPTPNVSVVDLTVRLEKAASYEEIKKAIKAASEG

SEQ ID NO: 52592 - protein, 341 aa, Acinetobacter sp. ADP1
MFGSVFMKSSLETLKPRISVAPMMDWTTKDYRFFARLFNPNVVLYTEMVTTGAILFGDTKRHLDYSHGEHPIVLQLGGSNPKDLAECTKMAQDWGYDEVNLNVGCPSDRVQNNKIGACLMAEPDLVAECIAKMQQVVDIPVHVKHRIGIDDMQSYDEMLNFVDTVAKTGCHHFVVHARIALLKGLSPKENREIPPLRYEDVYRLKQDRPELFIEINGGIKTVAETQAHLQHVDGVMIGREAYHNPYLLAELGQLWNLDLPDRFNIMQQMMPYIEQRLAEGAPLSIITRHILGLFQNLPGARKWRQALSGGNAKTRSDIEHALCNIHEAIQRTEASLQVQDI

SEQ ID NO: 52593 - protein, 584 aa, Zea mays
  misc_feature (385)..(385): Xaa can be any naturally occurring amino acid
MEARRTGRDLLASFVLAALAAQAFVAVVESRASPAEKASQGDDVKKPDCVPGMDPRSFPGIGSGSHGGGITPVTPSHSHGGSTGTPSHGGGGGGGDLPSPSHGGTTLPSPSHGGSGGDLPSPSHGGTTLPSPSHGGSGSTPTSPSTGGSPSHGGSGSSPTAPSTGGGYGGSPSHGGGAYGGSPSTPARSKQYTHTAARSTEEDRRRSKRAEAAAAMEARRTGRDLLASFVLAALAAQAFVAVVESRASPAEKASQGDDVKKPDCVPGMDPRSFPGIGSGSHGGGITPVTPSHSHGGSTGTPSHGGGGGGGDLPSPSHGGTTLPSPSHGGSGGDLPSPSHGGTTLPSPSHGGSGSTPTSPSTGGSPSHGGSGSSPTAPSTGGGYGXAPPSHGGGAYGGSPSTPGSGGAYGGGSPSPAHGGGAYGSSPTPAYGDAPSHGGIGTSSPTPFDPHSFGSLPGSCDYWRSHPMEIWSAIGGRFPGTSSSMGTMGHFFGAAGRVGGTDVSIQDALANTRSDGAGALLREGAAALLNSMTRSGFPYTTEQVRDTFAAAAAAAAGGSDGAAALEYPSRGPSLRVPSFLYPAFL

SEQ ID NO: 52594 - protein, 396 aa, Bradyrhizobium japonicum USDA 110
MTQHDNDPAWPDHKPTALLVLADGTVLEGFGLGAEGHAVGEVCFNTAMTGYEEILTDPSYAGQLITFTFPHIGNVGTNEEDIETVNMAATPGARGVILRTAITDPSNYRATKHLDAWLKARGIIGLSGIDTRALTALIRSKGMPNAVIAHARNGEFDLHGLKEEAREWPGLEGMDLVPMVTSGQRFTWDETPWLWDKGFGQQDKTEFNVVAIDYGIKRNILRLLAGVGCKVTVVPATTSAEDILAMKPDGVFLSNGPGDPAATGKYAVPVIRDVIKSGTPTFGICLGHQMLGLAVGAKTKKMHQGHHGANHPVKDETTGKVEITSMNHGFAVDEKTLPKGATQTHISLFDGSNCGIQLDGKPVFSVQYHPEASPGPRDSHYLFQRFAELMRQKKSA

SEQ ID NO: 52595 - protein, 257 aa, Acinetobacter sp. ADP1
MTTNLQTDEYDRRFAGVAKIYGDDAFNHYEKSHVMVIGIGGVGSWAVEALARTAIGEITLVDMDVLAASNINRQLPALSSTLGQEKADIMAERCRQINPHVKINIVDDFLSADNVADILASQPDVVLDCIDDVKAKLALMLYCRFNKIPLIVSGGAGGKLDPLKIRVADLSKTEQDPMLAKLRSQLRAKGICKKPKEKFGITCVYSIDNPFSGTEVCAAAGLRCGGYGSAVVVTSTFGMIAAAEVLKKLDMKKTKPE

SEQ ID NO: 52596 - protein, 460 aa, Leptospira interrogans serovar Copenhageni str. Fiocruz L1-130
MKEYDIIVIGTGGGTKLVTPPSKIGYKIAVIEKENPGGTCLNRGCIPSKMLIYPAEILSLTKHSEKFQISFPKKPEVDFKTLIERISKTVDDESASILPAYDKNSNITYISGTASFISDKVITVNGEQLTAERIFIASGARPAIPDIPGLAGTPFMTSRETLRRTDLPKSMIVIGGGFIALELGFAYSSFGSEVTFLVRNRMLKNEDKDIVDEFERIFTKEHNVLLHTNIHKIEYNKNLFYVEAISQGKTILLQSEALLVATGIKPNTDLLNLQNTNIQTDKNGYIVVNEYLETTSPGVYALGDITGKYFYRHSVNFEGEFLFRTLYQEKKRTPIEYPPVPHAVFTHPQIAKVGKTEEELIQEGIDYVAAKNSYSASATGMARLSDSGFVKILIDKKSKMVLGAHVIGDEASNLIHLFILLMTMKGTLDDLLKMIYVHPALPEIARNAARKAKELLQSKK

SEQ ID NO: 52597 - protein, 205 aa, Haemophilus influenzae R2846
MSEIKLNYHKTHFLTSAPNIRSIPEDTGIEIAFAGRSNAGKSTALNALTNQKNLARTSKTPGRTQLINLFEVEPNYKLVDLPGYGYAAVPEQMKIQWQKSLGEYLQKRECLSGLVVLMDIRHPLKDLDQQMIEWAVSADLPILLLLTKADKLSQSARSKQVKMVREAILPFQGDIQVEAFSAQNKIGIDKLAAKLDFWFSPLFAK

SEQ ID NO: 52598 - protein, 520 aa, Kluyveromyces lactis
MFTRDANGRHKEVDALVDDMVNFSFDTDAKVMLDPPSTPTRIRGSPSPTRSIVKNPENSLMDIDDDTQGDLTADITKSPKKLPKDFYKKSSKTKSKRLVSVCQMYFLDYYCDMFDYVISRRERTRQVINYLEEQRRSNLMGTEQITNEWQGYLTKETNILRKRRLKPKHKDFEMITQVGQGGYGQVYLARKKDTKEICALKILNKKLLMKLEGTDHVLTERDILTTTRSEWLVKLLYAFQDPQSLYLAMEFVPGGDFRTLLLNTKFLQAPHARFYISEMFCAVNALHQLGYTHRDLKPENFLIDSKGHIKLTDFGLASGTVSMERIESMKIRLQEVKNLEFPEFRERSMDDRRRMYNKLREEEVRYAHSTVGSPDYMALEVLEAKNYDFTVDYWSLGCILFESLVGYTPFSGNSTNETYENLRNWKHVLQRPKCDNGRYAFSDRTWELITRLIADPINRLKSFEHVKRMRYFSEIDFNTLRTIHPPFIPQLDNEEDVGYFDDFTNEEHMARYVDVFKRQD

SEQ ID NO: 52599 - protein, 275 aa, Arabidopsis thaliana
  misc_feature (36)..(36): Xaa can be any naturally occurring amino acid
  misc_feature (95)..(95): Xaa can be any naturally occurring amino acid
MFGAQSSDSLPEISRPTATECQEVKSDEALTEPNPXWALVLVKDPSPPLIIEVEDETLPSIDSVQNPKPKDPEATPSQPSVASRLRKRKSSAADXRIKRMKQGKGVTGSSSFDGIRFVSTEAEKRYAQFSQRNFIEEVELSRKTNEAAREFIKQAGLIRTVTKFNPFTQNLVFEFWANLPTMKVDTYMVKVLVRNREYELSPGKINEMYGLPSVDARQQRMDIAGLVDEQVAEFLTGGKVSVLSKLQVSAFTPTSLELFKLCCSNSSPTSNAGGR

SEQ ID NO: 52600 - protein, 474 aa, Microbispora rosea subsp. aerata
MSRRAKIVCTLGPATSSPERLRELIKAGMNVARFNLSHGSHELHKEVFDRVRAAADELGCAVGVLADLQGPKIRVGRFASGPVRLGYGDVFTITTEDVPGDRDIVSTTYEGLPGDVKPGDTILVDDGRLNLEVTAVDGPRVVTKVVIGGMISDNKGLNLPGVAVSAPALTEKDEEDLRWALRTGFDMIALSFVRCPDALVRAIMEEEGVRLPLLAKIEKPQAVERLEEIVDTFDGVMVARGDLGVELPLEQVPIVQRRIIDLCREKAHPVIVATQMLDSMMSSPRPTRAEASDVAYAVMDGADAVMLSGETSVGNYPVEAVSTMARIASPRRATRCRPPTPWTACPRPPAAHRPRGAEVGAIVGAKALVAYTMSGETARRLARYRSPIPLLAFTSNPLVRGQLALTWGVETFEVPFVHHTDDMVRQVEASLLSLGICEKGDKVVVVAGSPPGNHGSTNSLRVHTIGSAVAHPAV

SEQ ID NO: 52601 - protein, 316 aa, Haemophilus influenzae R2846
MTIYADNSYSIGNTPLVRLKHFGHNGNVVVKIEGRNPSYSVKCRIGANMVWQAEKDGTLTKGKEIVDATSGNTGIALAYVAAARGYKITLTMPETMSLERKRLLCGLGVNLVLTEGAKGMKGAIAKAEEIVASDPSRYVMLKQFENPANPQIHRETTGPEIWKDTDGKVDVVVAGVGTGGSITGISRAIKLDFGKQITSVAVEPVESPVISQTLAGEEVKPGPHKIQGIGAGFIPKNLDLSIIDRVETVDSDTALATARRLMAEEGILAGISSGAAVAAADRLAKLPEFADKLIVVILPSASERYLSTALFEGIEG

SEQ ID NO: 52602 - protein, 499 aa, Triticum aestivum
  misc_feature (124)..(124): Xaa can be any naturally occurring amino acid
MYRAAGSHLRSLKNHGASRFASTSVVKQSSGGLFSWLLGGGSSQLPPLDVPLPGITIPPPLPDFVEQSKTKITTLPNGIKIASETSPGAAASVGLYIDCGSIYETPASSGASHLLERMAFRSTXNRSHLRLVREVEAIGGNVSASASREQMSYTYDALKSYAPEMVEVLVDSVRNPAFLEWEVKEQLQKIKSEISEVSSNPQGLLLEALHSAGYSGALAKPLMATESAIRRLDISTLEEFIHENYTAPRMVLAASGLEHDELVSIAEPLLSDLPGVKRHEEPKSVYVGGDYRCQADSPNTHIALAFEVPGGWRQEKTAMIVTVLQMLMGGGGSFSVGGPGKGMHSRLYLRVLNKYDQIESFSAFNSIYNDSGLFGIHAATSPDFASTAVDLAAGELLEVATPGKVTQEQLDRAKEATKAAVLMNLESRIVASEDIGRQVLTYGQRKPVEYFVRAVEATTLNDISTVAQKIISSPLTLASWGDVIHVPSYESVSRKFLSK

SEQ ID NO: 52603 - protein, 232 aa, Saussurea medusa
MAPPPSSTSIQVESIVFPPSVKPPGATTTLFLGGAGVRGMEIQGNFVKFTGIGVYLEDKAIPSLAVKWKGKTAAELTDSVQFYRDIVTGPFEKFSQVTMILPLTGKQYSEKVSEMCIGVWKAQGTYTDADTATIEKFLEVFKDENFLPGSSILFTTSPTGSLTISFSKDGNIPEAATVVLENRKLAQTVIESVIGEHGVSPEAKQSLASRLSDFMTQFDEKATANVESQIGL

SEQ ID NO: 52604 - protein, 471 aa, Actinobacillus pleuropneumoniae serovar 1 str. 4074
MSNKKIGLLSLTALVLSSMIGSGIFSLPQNMAAVAGGEALILGWIITGIGIIFLGLSFFFISRLRPDLDGGIYTYAREGFGDLVGFLSAWGYWLCATIGIVGYLVVAFEGIGSFTDTESNIIFGQGNTLASFIGASIIVWLVHALVASGVKEAATVNLIATFVKVFPLVLFIGLAIWYFKGETFNQDLQGTALNNSVSEQVKNTMLITLWVFTGVEGASVLSAHAKKKSDVGLATVLGILIALVLYIAITVLSLGILPRETIAEMSNPSMAGLLETMIGSSGKILITFCLIVSVLASYVSWTMYSAEVPYRGAKNGAFPKILDKLNANEVPINSLWFTGFVVQFCLFLVLLTGKSYNALLLISTSMILVPYFLIGAYLLKLSFQQNSARYIKLTGFIASIYGLWIVYAAGLDYLLLSVLLYAPGIGLFLYSRYQHQGKALNLSTFEKTLLVLIGFLFIWAVYNSFTNVDWS

SEQ ID NO: 52605 - protein, 506 aa, Ralstonia solanacearum GMI1000
MRYAHPGTPGAVVSFQSRYGNYIGGRFVPPVKGQYFTNTTPVTGEAIAEFPRSTAEDIDRALDAAHAAADAWGRTSAQDRSLILLKIADRIEQNLERLAVTETWDNGKPIRETLNADIPLAADHFRYFAGCIRAQEGAAAEINEHTVAYHIHEPLGVVGQIIPWNFPLLMAAWKLAPALAAGNCIVLKPAEQTPLGICVLLELIGDLLPPGVLNVVHGFGKEAGEALATSKRIAKIAFTGSTPVGSHILKCAAENIIPSTVELGGKSPNIYFEDIMQAESSFIEKAAEGLVLGFFNQGEVCTCPSRALVQESIYGSFMDAVMAKVAAIKRGDPLDTETMVGAQASEQQFNKIRTYLEIAREEGAECLAGGEAEAMSGKLANGYYIKPTLLKGHNNMRVFQEEIFGPVIAVTTFQDEAQAIQIANDTEYGLGAGVWTRDINRAYRVGRAIKAGRVWTNCYHLYPAHAAFGGYKKSGVGRETHKMMLDHYQQTKNLLVSYDTRPLGFF

SEQ ID NO: 52606 - protein, 507 aa, Aspergillus nidulans FGSC A4
MGIAKKTKKFAQMKRTIKARDERLKKPEPPKKKPDEIVRHVQTAPTNLFFAANTALGPPYRVLVDTNFVSHAIRAKLDLLPAMMDLLYAKCIPTFTDCTIAELEKLGDKYRLALRVAKDPRWERVKCSHKGTYADDCLVDRVTKHRIYLVATNDKDLCRRLRKIPGTDLPSAGVIGLSTALHLQQFISPSQQILIVARDWPSTTSVNYASPWAGAHYRPVPGSSPQALREEKQARRTYDHFKHEAKVPGSGVEWTEGIEHLESPPPEYLTENALENYTHLDGFRQLQPSELPEGVKWGVRYNTFTINSPVYCAYMLRRFVLKGGLVKEYSLANVQEAFYLAENVRTVVNCSGLGFGDPKSFIIRGQTCLVRNSCSVTLTRQNSDGSWSFCVPRPLEGGTIIGGTKQPHDWDPNPSLETRETLLRNASKWFPFTPASGGKFDVIRDIVGRRPARQGGMRIEVEKVGDGKTIVHGYGAAGRGYEISWGVAEDVVKLIREEGLVPERASL

SEQ ID NO: 52607 - protein, 146 aa, Brassica rapa
DIFIFIKDEQGNPLLTADEIKPTIKELVMAAPDNPSNAVEWAMAEMVNKPEILHKAMEEIDRVVGKERLVQESDIPKLNYVKAILREAFRLHPVAAFNLPHVALSDATVAGYHIPKGSQVLLSRYGLGRNPKVWADPLSFKPERHL

SEQ ID NO: 52608 - protein, 293 aa, Brassica napus
  misc_feature (247)..(247): Xaa can be any naturally occurring amino acid
MGKKSATKVEAAPVAIKATKPLKKGKREAEDDVDAKVNLKKQKKDVIAAVKKEKAVKKVPKKVESSSDSSDSSDSEEEVKAKKVPAKKVESSSDSSDSSDSEEEVKAKKVPAKKAPAKADSSSEESSDDSSSDDEPVVAKKATNGKVAKKTKDDSSSEEESSDDEEVAVTKKPAAAAKNGSVKAKAESSSEEEDSSDEESSDEEPATKKPVAAKKPAAKAKDSSSSDDDDSSEDESEDEKPAAKNAXAPATKAASSSESSDEESEDEKPAPKKATTKAAKKDSSSDESESDES

SEQ ID NO: 52609 - protein, 215 aa, Mirabilis jalapa
GSSVGDAGGAADRVLNQLLTEMDGMSAKKTVFIIGATNRPDIIDPALLRPGRLDQLIYIPLPDEDSRHQIFKAALRKSPIAKDVDIRALAKYTQGFSGADITEICQRACKYAIRENIEKDIEREKRRSENPEAMEEDVEDEVAEIKAAHFEESMKFARRSVSDADIRKYQAFAQTLQQSRGFGTEFRFANTTADTTSTDAFAAADAGADDDDLYN

SEQ ID NO: 52610 - protein, 130 aa, Methanopyrus kandleri AV19
MPEFKVVVADPEKARSYQVEVKGEDAEKLIGKRIGDVIDGEIVGLPGYKLKITGGTDKDGFPMRPDIHGPVRVRLLLSGPPGFRPERKGERRRKTVRGNTISEDIVQVNTVIVEYGDKPVEELLGEGGEE

SEQ ID NO: 52611 - protein, 755 aa, Ehrlichia ruminantium str. Welgevonden
MGDLENNGFDAKKREALEFHCKGLKPGKVSLMPTKPLLTQRDLSLAYSPGVAVPCLEIAENPDLVYKYTARGNYVAVISNGTAVLGLGNIGPLASKPVMEGKAVLFKRFADIDAIDLEVDTSDVDEFVNAIKYLGLSWGGINLEDIRAPECFIIEEKLSKIMDIPVFHDDQHGTAIIVSAGLINALDITGKNIKDIKIVVNGAGAAGIACLEMIKLIGVPAENITLCDQNGVIYKDRQLGMNEWKAKHAIDTKNRSLKDALVMADVFLGLSVKDVLSENMLLSMNKDPIIFALANPDPEINPDIARKIRPDAIIATGRSDYNNQINNVMGFPYIFRGALDVQARCVNSAMKVAAANAIAMLAREYVSDEVSDAYGGRKMNYGKDYIIPTPFDPRLITVVAPAVAKSAIESGVARRNIENWDEYVKQLESRLSSTSNVLNMMYSSVKRDPKKVIFSEGEEEKIIQAAVQWRNQGYGVPILVGRIDKVHEGFERLGIKDMKGIEIANAAISENNNKYTDYLYKQLQREGYLYRSCVRDVKTDRNVFAACMLACGDGDILITGLTRGYTVSIHDVQKVIKPKGVMFGLSIIVMKERTIFIADTAIHESPTPEQVAEIAIQASMQARKMGHEPRVAFISSSNFGSHSQKDARRMRKAIEILDNCNVNFEYDGEMSIDVALNPELLTLYPFCRLTSSANVLIMPTLHSASISSKLLREATGVPVIGPILVGMEKPVQIVQMSSSVSEILNLTVLAPSINN

SEQ ID NO: 52612 - protein, 252 aa, Enterobacter cloacae
NDLLDAEYMAYMLKYDSTHGRFDGTVEVKDGHLVVNGKTIRVTAEKDPANLKWNEIGVDVVAEATGIFLTDETARKHITAGAKKVVLTGPSKDNTPMFVRGANFETYAGQDIVSNASCTTNCLAPLAKVINDNFGIVEGLMTTVHATTATQKTVDGPSHKDWRGGRGAAQNIIPSSTGAAKAVGKVLPELNGKLTGMAFRVPTPNVSVVDLTVRLEKAASYEEIKKAIKAASEGAMKGVLGYTEDDVVSTDF

SEQ ID NO: 52613 - protein, 525 aa, Corynebacterium diphtheriae NCTC 13129
MTTSNVVFDPQKSELLAGCFSDSNKPATLYINGTWQPADSGEVRTITNPADGSVVGVVSEAGEHDTERAIAVARETFDRGEWLAVPAVERGKILLKVGALLREHKDEFARAESADTGKRLAESELDMDDIANAFDYFGTLAQHEAGRVVDPGDPNVRSRIDVEPVGVCGLITPWNYPLLQVSWKVAPALAAGNTFVLKQAELTPHTAMMLMTLFERAGVPAGVANLITGAGANCGNPLSTSPLVDMVSFTGGLVTGRLIARNAAETVKRVALELGGKNPNVIFADADFDAAVDNALNGAFVHSGQVCSAGSRIVVEESIHDRFVEELTRRAAQIKLGGPLDTAAETGPLISLEHRDKVDAYVVAAKEQGATITTGGRVADASDNEGSHATGNTDLAAGAFYLPTIIDNCTRDMDCVHDEAFGPTVTVETFRTEEEAIAIANDTEYGLAGAVWTQDAGKAERVARKLRHGTIWINDFHPYLPQAEWGGMKQSGNGRELGPTGLAEYQEHKHVYQNIAPAVTGWFAG

SEQ ID NO: 52614 - protein, 176 aa, Methanopyrus kandleri AV19
MMNLWKDLEPGPNPPDVVYAVIEIPRGSRNKYEYDEERGFFKLDRVLYSPFHYPLDYGFIPRTLYDDGDPLDILVIMQDPTFPGCVIEARPIGLMKMLDDSDQDDKVLAVPTEDPRFKDVKDLDDVPKHLLDEIAHMFSEYKRLEGKETEVLGWEGADAAKEAIVHAIELYEEEHG

SEQ ID NO: 52615 - protein, 484 aa, Zea mays
MASRNHNAAAPQLHHHNRGGGRCFLRGILTLWSKRSLAPMILTTNISCHADLLLSLVRWSAGVPALGKTKAVPARPDALNRRPPLGDIGNLVSVRPATGNPQEQVNRPITRSFGAQLVKKAQAKAAIKNAAILPARHAPRQERKAPVKQHPPPEDIIVLSSDSEQSRAQSESSASSVRSRRKAINTLSSVLSARSKAACGIAGKPRQVVDDIDKLDVNNELAVVEYIEDIYTFYKIAQHERRPCDYIDAQLEINSKMRAILADWIIEVHHKFELMPETLYLTMYIIDQYLSLQPVLRKELQLVGVSSMLIACKYEEIWAPEVNDFILISDSAYSREQILSMEKGILNRLEWNLTVPTVYMFLVRFLKAATLGGKVEKEMENMVFFFAELALMQYDLVTRLPSLVAASAVYAARLTLKRAPLWTDTLKHHTGFRESEAELIECTKMLVIAHSTAPESKLRVVYKKYSSEQFGGVALRPPAEEICK

SEQ ID NO: 52616 - protein, 277 aa, Escherichia coli
EIVAINDLLDADYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDN

SEQ ID NO: 52617 - protein, 329 aa, Kluyveromyces lactis NRRL Y-1140
MTYLAETVTLNNGEKMPLVGLGCWKMPNDVCADQIYEAIKIGYRLFDGAQDYANEKEVGQGVNRAIKEGLVKREDLVVVSKLWNSFHHPDNVPRALERTLSDLQLDYVDIFYIHFPLAFKPVPFDEKYPPGFYTGKEDEAKGHIEEEQVPLLDTWRALEKLVDQGKIKSLGISNFSGALIQDLLRGARIKPVALQIEHHPYLTQERLIKYVKNAGIQVVAYSSFGPVSFLELENKKALNTPTLFEHDTIKSIASKHKVTPQQVLLRWATQNGIAIIPKSSKKERLLDNLRINDALTLTDDELKQISGLNQNIRFNDPWEWLDNEFPTFI

SEQ ID NO: 52618 - protein, 955 aa, Burkholderia thailandensis E264
MSRTGPLFDSTRETVATDTPAASATSLIRNAMTTEIDFSSGSVFTLNRGGGSEPRRMRRHRPRTGRSPILSALAAHFTRFPKIGERLTVKVVSISIRTFQRLIPGDAMPPLLTAELVRLGAKADSKHDAIGQAGALLVAAGVIEPGYVDSLLGRERVSNTYLGSGVAIPHGLQEDRHLIRRTGVAVLQLPDGVEWQGGERARLVVAIAAQSDEHIVLLQRLTRLIGDPAQLERLLAARDSRAIVDALNGARPANAAGGAPTAAAAVAATPADYAHKLDLILDYPHGLHARPASAWVATAKRYQAALRVRCGELAADPKNLVSLLQLGATAQARLVVSAQGVDAADALAALARTIGSLAAEEHARAAAAQARRQSAQPALWTPEDPAAAIEGVGAGPGLVTGPVRVLRATRVDVEDRPGDALDASHRLERALADTAAELDALARETASRLGAAEGEIFVAQRELLNDAALLGEVARLTVDGHGLAWAWHRATDAQAERLAALPDPLLAARAADLRDVARRVLRHLGETGGPARDAAGGAGARAPAILIAEDLTPSDTAQLDPAVTLGFCTVAGGPTSHTAILARTLGVPAAVACGATLMDVADGACAVLDGNAGRLYVGVSARDAERARQVEQRLADERRRASANRALPAATLDGHVIEIGANITRPAQVADALAQGADGVGLMRTEFLFLERRDAPDEDEQYACYRQMVDASGGRRLIIRTLDIGGDKQVPYLNLPHESNPFLGVRGLRLCLRRPDLFVPQLRALYRAAKAGPLWIMFPMVSTLDEAREALALAETVRAELDAPKVPLGIMVETPSAAALADHFAQLVDFFSIGTNDLTQYVLAIDREHPELARLAESLHPAVLRMIRQTVDGARRHRKWVGVCGGLAGDPLGASILAGLGVDELSMSARDVAAVKARLRGARLDALTALAARALDCADVDAVRALDSAEIRVAA

SEQ ID NO: 52619 - protein, 294 aa, Thermococcus kodakarensis KOD1
MKLDVIGIGNLNYDIIFTLERFPEFHEKINARGAHFGLGGAAANTISWLAHFGLKTGYIGAVGNDDVGEMHIKYFQGIGVDTGGIDVVEEPSGVAVAMVAGDDKRIVKYPGANLRRRFKPEYASRAKFLHLSSNPPELIEEAVNFASQRGIKVSLDIGEAPLPRELESKVDYLMMNEDEYRRKYGSLDPSLCRAKNLVVTLNGGGALVREGDNVFEVRGLSAKVVDSTGAGDSFDAGVIYGVLNGWSLLDSAKLGMLLAYLTVQKVGARSAIVPLEEVKRIAREVGLDLPFNRT

SEQ ID NO: 52620 - protein, 176 aa, Prochlorococcus marinus str. MIT 9313
MKHTLSVLVEDESGALSRIAGLFARRGFNIDSLAVGPAETPGQSRLTMVVEGDDHALQQMSKQLDKLVNVLQVLDLTRQPAVERELMLLKVSAPAHQRSSIFDLVQVFRAKVVDVADGALTLEVVGDPGKLVALESLLTPYGIIEIARTGKVALVRASGVNTELLKVSPSGSRIPA

SEQ ID NO: 52621 - protein, 227 aa, Thiobacillus denitrificans ATCC 25259
MTYRIAPSILSANFARLGEEVDNVLASGADIVHFDVMDNHYVPNLTIGPLVCEALRKHGVTAPIDVHLMVKPVDRIIPDFAKAGATYITFHPEASEHIDRTIGLIKENGCKAGLVFNPATPLDVLEYTLDKLDMVLLMSVNPGFGGQKFIPYVLDKARAVRKMIDDRGLDVSLEIDGGVGPANIAEVARAGVDTFVAGSAVFGAAKEGDPQRYNSIIAAMRAELAKV

SEQ ID NO: 52622 - protein, 589 aa, Oryza sativa Japonica Group
MEQYEVLEQIGKGAFGSALLVRHKVEKKKYVLKKIRLARQTDRTRRSAHQEMQLIATVRNPFIVEYKDSWVEKGCYVCIIIGYCEGGDMAEAIKRATGDHFSEEKLCKWLVQLLMALDYLHANHILHRDVKCSNIFLTRDQSIRLGDFGLAKILTSDDLASSVVGTPSYMCPELLADIPYGTKSDIWSLGCCIYEMTALRPAFKAFDMQALISKITKSIVSPLPTRYSGAFRGLIKSMLRKSPEHRPSAAELLKHPHLQPYVLQVHLKSSPARNIIPSHQSPIDKVKKMTFPTESMCRSKGRRNSLGNERIVTFSKPSPERKFTSSIQSIKDYSTTRSVKDLSIDVSLVEEVSSKTTFTTRTSSIVKTPKRTPSKTITTPQLEPPKLLSRTPVNRSARVIRRASLPLPLPSSETPKRGVSSISILEQLESPDVSVNSPRIDRIAEFPLASSEDPPFLKLHGRRSPTPTPQHCVIDQSITKDKCMVEAFHIIDVDDDDGRSDSSSGRNNAAAAASSRAGSSESTRQRRFDTSSYQQRAEALEGLLEFSAQLLQQERYDELGVLLKPFGPEKVSPRETAIWLTKSFKETGL

SEQ ID NO: 52623 - protein, 577 aa, Leptospira interrogans serovar Copenhageni str. Fiocruz L1-130
MKQITIRIFLILLLFSCRENSLLIEGKKISTDLLVVPSHQKTHTDYFSESKNLMISSDSPEATQAGIEVGALGGNVVDVVVATSFAISVTRPHSTGLGGGGFLILYLKEFPEPIAFDFRERAPNTSSRDMYKLKPKEDSLLGFRAVGVPGNVAGLVQIQRRFGKLPLKTVISPSIRLAENGFPVYPDLQSAIQKSSKDMSEEMKNIFLPKGKIPELNSILVQKDLANSLRLISETGDKEFYHGKIANSIVNAMKKNDGLITLQDLSGYKVIEKKTVHTTYHDYTIYTMPPPSSGVHLLTMLSMVETKPLKETYEKDPVLYYHFIVEAMRRGYADRAMLGGDPAFTKIPIERLVSKKYAEEKISNFNPKTASSSSSFLKTLNFGVESPQTTHISVMDREGNSVSTTQSINFRFGASVVAPGTGIVLNDTMDDFSRAPGEPNVYGLIGAEANSILPKKTPLSSMSPTIVFKNKEPFLVTGAPGGSYIVNAVLQSLIYNLDFNLTLYESVARGRIHHQFFPDAVFIEKSVNERNVFDGLSSKKHDLRIAPNFAKLFSVKRENGMLYGACDPRGEGATGGL

SEQ ID NO: 52624 - protein, 458 aa, Burkholderia vietnamiensis G4
MTQHFDAIVIGTGQAGPPLAARLAGAGMKVAIVERGRFGGTCVNTGCIPTKTLIASAYAAHLARRAHEYGVSAGPVSVDMKAVKARKDAIAGRSNHGVEQWVRGLDHTTVLQGHARFEQADTVRVGDALLQAERIFINVGGRAQIPPIPGLDTVPYLTNSTMMDVDFVPEHLVIVGGSYIGLEFGQMYRRFGARVTIVEKGPRLIQREDDDVSQAVQEILAGEGIDVQLGANCLRARRDGERVVVGLDCDGGGREVAGSHLLLAVGRVPNTDDLGLERAGVATDSRGYIAVDEQLRTNVPGIWALGDCNGRGAFTHTAYNDYEIVAANLLDDDPRKVSDRIPAYALYIDPPLGRVGMTLAQARQTGRRLLVGTRPMTRVGRAVEKGESLGFMKVIVDADDHALLGASILGVTGDEVVHGLLDVMAARAPYTTISRAMHIHPTVSELVPTLLQDLHPVE

SEQ ID NO: 52625 - protein, 337 aa, Zea mays
MGKIKIGINGFGRIGRLVARVALQSEDVELVAVNDPFITTDYMTYMFKYDTVHGQWKHSDITLKDSKTLLFGEKPVTVFGIRNPEEIPWGEAGAEYVVESTGVFTDKDKAAAHLKGGAKKVVISAPSKDAPMFVVGVNEDKYTSDVNIVSNASCTTNCLAPLAKVIHDNFGIIEGLMTTVHAITATQKTVDGPSAKDWRGGRAASFNIIPSSTGAAKAVGKVLPELNGKLTGMSFRVPTVDVSVVALPVRIEKGPSSEEIKKAIKAASEAPLKGIMGYVEEDLVSPDFPGDSRSSIFDAKAGIPLNAHFIKLVSWYANEWGYSTRVVALIPPMFKPQ

SEQ ID NO: 52626 - protein, 478 aa, Bacillus anthracis str. Sterne
MRKTMSQVNNTNNELKRTMKSRHLFMIALGGVIGTELFNGSGFIISQAGPGGSVLAFMAGGLLMYFVMLCLGELAVAMPVSGSFQEYATKFINPATGFTIGWLYWLSWANTTGLEFTTAGITMQRWFPDIPVWVWCLIFGVTIFMINALSARSYAETEFWFSSIKVSAIIAFIILGGAAMFGLIDLKGDEPAPLLSNFVNHGGLFPNGLAAILLTMVTVNYSFQGTELVGIAAGESEDPAKTLPRSIRNIIWRTMFFFVLAIFVLVALIPWEEAGLTKSPFVAVFDNISIPYAADIMNFVILTAVLSVANSGLYAATRMLWSLSKNEMAPAFLKKLSSRGIPLNALILTISISAFSLLTSVVAAETVYLWLISISGVITIIVWMSICVSQFFFRKHYVADGGRLEDLKFKTPLYPLVPILGFGLYGIILVSLIFIPDQRLGIYCTVPFIIFCYTYYHFKVKKRISTNTSSENKISETI

SEQ ID NO: 52627 - protein, 570 aa, Salmonella enterica subsp. enterica serovar Paratyphi A str.
MSEKHPGPLVVEGKLSDAERMKRESNFLRGTIAEDLNDGLTGGFHGDNFLLIRFHGMYQQDDRDIRAERAAQKLEPRHAMLLRCRLPGGVITTTQWKAIDKFAADNTIYGSIRLTNRQTFQFHGILKKNVKPVHQMLHSVGLDALATANDMNRNVLCTSNPYESQLHAEAYEWAKKISEHLLPRTRAYAEIWLDQEKVATTDEEPILGQTYLPRKFKTTVVIPPQNDIDLHANDMNLVAIAENGKLVGFNLLVGGGLSIEHGNKKTYARTASEFGYLPLEHTLAVAEAVVTTQRDWGNRTDRKNAKTKYTLERVGVDTFKEEVERRAGIKFEPIRPYEFTGRGDRIGWVKGIDNNWHLTLFIENGRILDYSGRPLKTGLLEIAKIHQGEFRITANQNLIIASVPESQKAKIETLARDHGLMNAVKPQRENSMACVSFPTCPLAMAEAERFLPSFTDKVEAILEKHGIPDEHIVMRVTGCPNGCGRAMLAEIGLVGKAPGRYNLHLGGNRIGTRIPRMYKENITEPDILASLGELIGRWAKEREAGEGFGDFTVRAGIIRPVLDPARDFWE

SEQ ID NO: 52628 - protein, 467 aa, Zea mays
MAREPSPEIDDELYNEVYGKAYSGPVASATNSVTPKGNAEKRPLTRDKSDDEDEAPDPNAVPTDFTSREAKVWEAKAKATERNWKKRKEEEMICKICGDPGHFTQGCPSTLGANKRNADFFERVPARDKQVRDLFNERVISQIEKDVGCKIRMDEKFLFVSGKDRLILSKGVSAVHKIIQEGKGKHSPSSPKHDRSRSPVRNTTEFRSKHSDSHRSPSPRNFDSQWSHSPRNASLSQSKGYYNERHRDGRLHNNMPKFSKGSPQAHANFGAKGRPAQSKSPRHTSYLDELPRTHGENNQFAASRVPNDWGIERHGADASSSLRFDMPSHQQTLEELEMEFKKEATQLARARDQEEDEENYRHRESLRVIRENYMERVITLRNVHAKKWEEFLDTFKSQQQAQPSYIQTGYLGFEQRTAHISATHQPMDSKSTYPYASDSYSAPKAHAAYGEFQHERHDDLGRAYRRY

SEQ ID NO: 52629 - protein, 316 aa, Actinobacillus pleuropneumoniae serovar 1 str. 4074
MTIYADNSYTIGNTPIVRLKNFGQNGNLLVKIESRNPSFSVKCRIGANMVWQAEKDGILTKGKEIVDATSGNTGIALAYVAAARGYKITLTMPETMSTERKRLLRGLGVNLVLTEGSKGMKGAISKAEEIVASDPNRYVILKQFENPANPAIHQQTTGPEIWNATEGKVDVIVAGVGTGGTITGISRYIKQDQGKQIISVAVEPKESPVITQTLNGEEVKPGPHKIQGIGAGFIPKNLDLSLIDRVEQVSSEEAIATARRIMAEEGILVGISSGAAVAAADRLAKLPEFADKQIVAILPSASERYLSTLLFEGVEV

SEQ ID NO: 52630 - protein, 114 aa, Actinobacillus pleuropneumoniae serovar 1 str. 4074
MARQPFLIAPSILSADLARLGEDVAEVLKAGGDIIHFDVMDNHFVPNLTFGPAICKALRDYGITAEIDVHLMVKPVERLIPDFAKAGANYITFHPEATDHIDRTLQMYRVSGCK

SEQ ID NO: 52631 - protein, 139 aa, Arabidopsis thaliana
MADLVTVVKKTEEEWRAVLSPEQFRILRQKGTETPGTEEYDKFFEEGIFSCIGCKTPLYKSTTKFDAGCGWPAFFEGLPGAINRAPDPDGRRTEITCAVCDGHLGHVHKGEGYSTPTDERLCVNSVSINFNPAKPSSIT

SEQ ID NO: 52632 - protein, 215 aa, Arabidopsis thaliana
MESLKIDSGVSNFLENSRYSYRPYQEDMFSYALGYENRKSCRTVNFLRFVDYLLQRLKESVFGYEIYDFDLDSWTTLDVSPHWHIISCDLGITLKRNTYWHAREMNLEENIVDHIICFDFTRERFRPLLPLPVSVGVHDYEYLTLSRVREEKLAALFQHTESNPYELEIWITTKIEAEMVSWSKFLRMDTGPDILVTTICEGYFIDEEKKVAMGF

SEQ ID NO: 52633 - protein, 638 aa, unidentified eubacterium SCB49
MLNIHNLSVSFQGEYLFEKITFQLSGGTRVGLVGKNGAGKSTLLKIISGEQEYDEGSIAMDKEVSIGFLKQDIDFVKGRTVLEESYQAFIEIKKYEKQLEEINEQLATRTDYESEGYNQLMIDLNEVQHQYEIHGGYNYQGETERILQGLGFQREDFNKLTETFSGGWRMRIELAKLLLQSNDILLLDEPTNHLDIESILWLEEFLRNYAGAVVVVSHDKMFLDNVTNRTIEISLGKIYDYNKPYTQYLVQRKELREQQLASQKNQQKQIEHTEKLISKFKAKASKATMAQSLVKKLDKIDRIVVDEDDNSVMSLRFPVSVTPGKVVIEAKKVSKSYGDKKVLQDVDLMIERDAKVAFVGQNGQGKSTLAKIIVDEIPHGGVLELGHNVQIGYFAQNQAEYLDGTKTVEDTMLDAADERTRPLVRNILGSFLFRGDEVDKYVRVLSGGERNRLALAKLLLQPFNVLVMDEPTNHLDIKSKNVLKDACKNFEGTLLLVSHDRDFLQGLTDKVYEFKDHQIKEYLGDIDYFLEQRNIENLREAEKRTVVAKEAKADATGGKQSYEDQKKEKSLNNRLSKIEAKINKLEREVKAIDVELATNYDQTIAKEGFFDSYQAKKDEIVKLMSDWEDVTTQLERFS

SEQ ID NO: 52634 - protein, 220 aa, Escherichia coli
YDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEG

SEQ ID NO: 52635 - protein, 220 aa, Hafnia alvei
YDSTHGRFNGTVEVKDGHLVVNGKTIRVTAERDPANLKWNEVNVDVVAEATGLFLTDETARKHIAAGAKKVVLTGPSKDNTPMFVMGVNDKTYAGQDIVSNASCTTNCLAPLAKVLNDKFGIVEALMTTVHATTATQKTVDGPSHKDWRGGRGASQNIIPSSTGAAKAVGKVIPELNGKLTGMAFRVPTPNVSVVDLTARLEKPASYKDICAAMKAASEN

SEQ ID NO: 52636 - protein, 184 aa, Triticum aestivum
MGDYTIRISTSLIEQLARDDEKQVKRRTRKPKPRKVVEQPEEPQDNGRELPTEPKSSPAPAPGWALPPPMYLPVTPAPPPPSPAIQEVEAIRAVVAESEKVLEKLQKKEATMREELTKRAKELHDKEFKLPYQNPAPCTDERAGCAECYRSNVQDPLKCAEAVKRFEACVRMARRGGATMGAAQ

SEQ ID NO: 52637 - protein, 714 aa, Escherichia coli
MSRIIMLIPTGTSVGLTSVSLGVIRAMERKGVRLSVFKPIAQPRTGGDAPDQTTTIVRANSSTTTAAEPLKMSYVEGLLSSNQKDVLMEEIVANYHANTKDAEVVLVEGLVPTRKHQFAQSLNYEIAKTLNAEIVFVMSQGTDTPEQLKERIELTRNSFGGAKNTNITGVIVNKLNAPVDEQGRTRPDLSEIFDDSSKAKVNNVDPANVQESSPLPVLGAVPWSFDLIATRAIDMARHLNATIINEGDINTRRVKSVTFCARSIPHMLEHFRAGSLLVTSADRPDVLVAACLAAMNGVEIGALLLTGGYEMDARISKLCERAFATGLPVFMVNTNTWQTSLSLQSFNLEVPVDDHERIEKVQEYVANYINADWIESLTATSERSRRLSPPAFRYQLTELARKAGKRIVLPEGDEPRTVKAAAICAERGIATCVLLGNPAEINRVAASQGVELGAGIEIVDPEVVRESYVGRLVELRKNKGMTETVAREQLEDNVVLGTLMLEQDEVDGLVSGAVHTTANTIRPPLQLIKTAPGSSLVSSVFFMLLPEQVYVYGDCAINPDPTAEQLAEIAIQSADSAAAFGIEPRVAMLSYSTGTSGAGSDVEKVREATRLAQEKRPDLMIDGPLQYDAAVMADVAKSKAPNSPVAGRATVFIFPDLNTGNTTYKAVQRSADLISIGPMLQGMRKPVNDLSRGALVDDIVYTIALTAIQSAQQQ

SEQ ID NO: 52638 - protein, 190 aa, Prochlorococcus marinus str. MIT 9313
MPFPQNVPDVTFKTRVRDESVPGSNPFRWQDLTSAEIFKGRKVVVLALPGAFTPTCSSNHLPRYEELHAELVAQGVDQIVCLSVNDAFVMFQWSKHLGTKNIFMLPDGNGEFTRKMGMLVEKSNLGFGLRSWRYSMLVNDCNIEKMFVEPGFSDNADGDPFEVSDADTMLAYMKGVQSAGVSSPCREFQG

SEQ ID NO: 52639 - protein, 372 aa, Arabidopsis thaliana
MKKGGFSNNLKLAIPVAGEQSITKFLRKGFGSLCRTQSGTFKDGDLRVNKDGVRIISQLEPEVLSPIKPADDQLSLSDLDMVKVIGKGSSGVVQLVQHKWTGQFFALKVIQLNIDEAIRKAIAQELKINQSSQCPNLVTSYQSFYDNGAISLILEYMDGGSLADFLKSVKAIPDSYLSAIFRQVLQGLIYLHHDRHIIHRDLKPSNLLINHRGEVKITDFGVSTVMTNTAGLANTFVGTYNYMSPERIVGNKYGNKSDIWSLGLVVLECATGKFPYAPPNQEETWTSVFELMEAIVDQPPPALPSGNFSPELSSFISTCLQKDPNSRSSAKELMEHPFLNKYDYSGINLASYFTDAGSPLATLGNLSGTFSV

SEQ ID NO: 52640 - protein, 448 aa, Yarrowia lipolytica CLIB122
MPGTQIFGTLPAEGMTNTEVITEMSKYHDMKRTFWEKGRVSGAVYHGGKELTDLQSEAFSQFTVANQLHPDVFPGVRKMESEVVAMVLALFHGPEGSCGTSTSGGTESLLLTSLAAKMKAYNERGVTHPEIIAPITVHAGFDKAAYYFGMKLRHAPVDPKTMKVDLKAVRRMVTRNTVLLVGSAPNFPHGIIDDIEGLSDIALKHKIPLHVDACLGSFIVPYLERAGFDKILFDFRVPGVTSISCDTHKYGFAPKGSSIIMYRTPELRHYQYFVAPDWTGGIYGSPTLAGSRPGAIMVGCWATMLSVGDNGYLESCKEIVGAARKFRKAVDEEIPDLQIIGDPRASVIAFGSDSVNIYDLSDAMSKKGWHLSTLQNPPAAHVAFTKPAVAAVDDLVSDLKSCIIEMKKAGNTKVEDGTAAFYGVAGSIKTAGVADRLVCGFLDGLYKL

SEQ ID NO: 52641 - protein, 905 aa, Arabidopsis thaliana
MRLRHQGGQYLARGMEPVYWSNKVDSTHDLYDNYTLGSYQNNSYNILAHTGFGYDHEFQIYEINSNSWRIIDATLDFKLGYIGRGVSLKGKTYWIASGEEEKRLGKFLISFDYTTERFERLCLPNKYPCYATLALSVVREEKLSMLSQRGIKSKAEIWVTNKIGETQVVSWSMVLALDLQPKRCIGESGSFLVDEKKRVVVCCDNIRDQGKTTFDSNLPRYHRQKKKGRMIIVFDVESMRLPVTVKATKPSFLVIWIRYSSAASSPTVSLNPSGRLQQTLAGSVEVKGKSLHSGKFSTVKLNPEIAGAGRFFEFRSRFIPASIEFAQESPLCTTLLKDELKIRTVEHLLSALEAKGVDNCRIQIESESSDDREVEVPIFDGSAKEWVDAIQGVGINAAQNHDGESVEKMVAHVNKPVDSDHLWYRLPTGCQWFSWRPIHESSFAKDIASSRTFCVYEEVERMREAGLIKGGSLDNAIVCSAEHGWMNPPLRMRRRRCDLQPKRTRMCDLQPKRTSMCDLPPKLVGEKILTRIPITSLRAVRSTCKLWNALTKDRVLVRFHLRRSKEEEEDTMDLSIKQVDLLNQVEISRVYHCDGLLLCVAKDNSRVVVWNPYLGQTRWIRPRTESNIGDSYALGYDINRNHKILRMVQTRNVSVYRYEIYDLRSNSWRVLEVTPNGEMDPNHPLYGVSVKGNTYFFAHEDSSSGEIDEDGDIIDLEDFLLCFDFTTETFGLRLPLPFHSTIDATVTLSCVRDQQLAVLYHNEGLHSDDRFTTVEFWVTTSIEPNSVSWSKFLTVDMRPLALTGVRFDNDMGATFFIDEDEKVAVVFDLDGYLSTESARYHTAFISGKDGFFKPVTLGVAPNVGEPCPRTGHIPTTYRPPLVCSSTYLPSLVQVNQQRKRKERHV

SEQ ID NO: 52642 - protein, 514 aa, Prochlorococcus marinus str. NATL1A
MKLKNLLVKERIISPSRDVIAGLVVAFAMIPEAIAFSGIAGVDPRVGLFGAFLLSVTLAIFGGRMAMITSVTGSTALLMTGIVQQGENISPGLGLQYLLAAGLLTGVLQIAWGYLRLAHQMRFVPQPVMDGFVNGLAILIFLAQLPHLGIDIAHSEKVVTAVQLPAVWGLTILTLLIIYLLPKFTKLLPSALVAIFICTAISIVFKLNVPTVSNLGILPNGLPSFGIPKVPFNFETLGLILPTALAISLVGLMETFLTQDILDDMTDKSTNKNVEARGQGMGNIVSSLFGGMAGCALVGQSVMNVGYGGRTRLSTLSSGVCLIAMILAAKDWVNQIPMATLVGVMIMIAINTANWGSIKDIRRIPRSDSSVMILTVFVTVITHNLALGLLSGVGLAAILFSRKVAKVIKVESSLNGKDHRIYKVSGQLFFVSSIYFRQGFELHEHPKKITIDMAEAHIWDQSGVTVLDQVIRRIKIGGSEVEVINLNDESLNLFSRIGQASEAGGRGGEFKSAH

SEQ ID NO: 52643 - protein, 584 aa, Cryptococcus neoformans var. neoformans B-3501A
MVTLVEHRAFLNSILDRQAERRRLIDPEAVFPTQPVIRGRIPRAIHHRTPGDDEGERDGWISKENVANYVKEEETIRNDYCEWYGATGECGSNFIMGAEGEDICSEYPALKKLMNLKAQLVSSNSHPPLYFPLSHEPLRDSLLSTFSNFRFDVIRINPLLDWADIAELPIKQISSDPAIVFLWVGRGDQEGLERGRECFARWGFRRAEDIVWVKTNRNKNSGERAAANGALFANQKEHCLMGIKGTIKRSVDVRFAHCNVDTDIIVWEDSGDPEGPRYPPYLYTLIENFCLGTRRLEIFGRPNLARRGWVTAGLEPFSSSSSTADQNNVQLFDPQSYPSLVPESDGKPILPFSPEIDQLRPKSPVRKPPRYNNPSGGNPNNLAGGGIGNSGSRNQGGLAVGGRPSPAPRFAQNGGTSGSGTPMGNRPNLVMPNQPSPIDYSQTQGRMSPVNPMMMQGPTMEQMVAANMGMGGIGVGMNGPMGMPMGMPIGNQYAYGMGINGGQPGFGPPFGAGMGMPVGMGVGMGMPMGMDMGMGHMGNMGFDGMMPGQGQGFGQQQLPQMFGNPQMGPRFGGWHGQGGQGQWQ

SEQ ID NO: 52644 - protein, 508 aa, Shewanella sp. MR-7
MQNHSNLNDIGVIGLGVMGKNLALNIADNQYRVSAFDLDPVKVNGVLQQEKQERVGQDLRITGCANLSEMLASLAQPRILVLSVPAGAPVDGVCHALISAGIEADDIVIDTGNSLWTDTVEREKRYQGKFIFFSSAVSGGEVGARFGPSLMPSGDLGAWQHVAPIWKAIAAKVDPQTGLPIERFEPGNPVTEGEPCTTYIGPAGAGHYVKMVHNGIEYADMQLICEAYQLMHDGLGMSASQVGEVFERWNKGSLNSYLMGISAEVLKQADPLTGLPLVEMILDKAGQKGTGLWTAVSSLQIGCPAPTIAEAVYARAVSTQKSLRVELSKKLAGPVSVAMDDAQKAVLIDALESALYCAKVCCYAQGFQLMAMTAQEQKWQLDFAEIAKIWRAGCIIRATFLQSITQAYQADADLSCLLMAGTFATTLSEKQTEWRSAVAAAVMQGIPVPCISSALAYYDSYRSETLPANLLQGQRDFFGAHTFERLDKPAGEKYHLDWSAPNRVLIKL

SEQ ID NO: 52645 - protein, 449 aa, Triticum aestivum
MSSLAAAAAAAVAAASTWVKSLSRIIPSSTPAVKPPKRNPKTTTDAGSIPDQKLPKPLGAHPAGEAESDAGHKLGKPLGGVLKALIRERDPDKLVSKFVEASSASSRFRDGRRAYDVAVSRLTSLGRKDGIEAIIEAQKPFLETSSEGFATRLIRLYGSASMPSHAAATFHLLPARHKSTRTFNAVLAAYAEAGDVAALTAAFQEIPAAHPSIVPDLYSYNALIRTLCQKSNLSAALYAVHLMKKHGVSPDIITFNSLLDGFHNSGRNDEAEKVWQMIKERNLEPDAKCYNAKLRGLVAQGRIDDAASVLERLEKDGPKPNIVSYNELIRGYCKAGRFQEAKKVYDNLMKNECVPNKGTYEILVPHLLQAGELDCALSYCYDIFASKKCCGVEWGVLQDVVNALVDASRVVEATKLVELDWQKYYHRKGLRMPPSAGTDEEESISGEKE

SEQ ID NO: 52646 - protein, 127 aa, Alteromonadales bacterium TW-7
MAYSDKVIDHVENPRNVGALDKNDPSVATGMVGAPACGDVMKLQIKVSDTGVIEDAKFKTYGCGSAIASSSLVTEWVKGKTLDEAATIKNTDISAELELPPVKIHCSILAEDAIQAAIADYKSKQAK

SEQ ID NO: 52647 - protein, 397 aa, Kluyveromyces lactis NRRL Y-1140
MSIYSASTTAPVNIATLKYWGKRDKVLNLPTNSSISVTLSQEDLRTLTTATTSPDFAKDQLWLNGKEESLASERTQHCLQDLRQLRRELEEKDSSLPTFSQWKLHIASENNFPTAAGLASSAAGFAALIKAIAKLYELPQSESELSKIARKGSGSACRSLFGGYVAWEMGKLEDGSDSKAVEIGSLNHWPEMKAAILVVSADKKDTPSTSGMQLTVKTSDLFQERINNVVPKRFEQMKKSILEKDFPTFAELTMKDSNSFHATCLDSYPPIFYLNDTSKKVIKLCHAINEFYNETVVAYTFDAGPNAVLYYLEQSEDKLFAFLYHLFQNVSGWESKFTKEQLSQFNAKFDEIKDDVSFYLDSELHQGVTRVILTRVGPGPQDTDLSLIDSATGLPSN

SEQ ID NO: 52648 - protein, 1177 aa, Oryza sativa Japonica Group
MAAARGQKAVAALPHLVKSLRSEPVSNAPRLRHLPSLRGTFSLYDQINLIDSVPEDQLRFQSYDDTGFNINKVKYEGSLLIVENKIMTWAPKSFAEITAESLSIFKVVHPIPEILILGCGRHIQPISPELRKFIRSTGMKLEAVDSNIAENTADATSQVVSANSRRKTKIVCTIGPSTNTREMIWKLAETGMNVARMNMSHGDHQSHQKVIDLVKEYNAKNTDGNVIAIMLDTKQMSCDDRTSVMQGPEVRSGDVPEPIMLEEGGMMSLAVKSKTADTVKCEVVDGGELKSRRHLNVRGKSATLPSITEKDWEDIKFGVENGVDFYAVSFVKDAKVIHELKDYLKSANADIHVIPKIESADSIPNLQSIIAASDGAMVARGDLGAELPIEEVPLLQEEIVRTCRSMQKPVIVATNMLESMIDHPTPTRAEVSDIAIAVREGSDAIMLSGETAHGKFPLKAVKVMHTVAQRTESSLYNPTTSPSLVAHPQALLNEEFSQSQLSKMFGSHATMMANTLCTPIIVFTRTGSMAVLLSHYRPSSTIFAFTNEERVKQRLALYQGVVPIYMKFSDDAEETFSRAISSLLNAQFVKEGDYVTLVQSGVKSIWREESTHHIQAAPELSRKDQQMKHVGHELPYLNPTNKPRIGGDANQNLKASEAQCCQLDDAKGYRMWNLNPTQRKKAAFFMSKCVLLRLCRRRAANGGADFAAADGGGDDKDAAKRAVPVFREFGLAELRAATKGFSADLIVSESGEKAPNVVYRGRLDGGSLIAVKRFSRLSWPDPQQFLAEAAGVGKVRHKRLVNLIGCCAEGDERLLVAEYMPNDTLSKHLFHWDKQPLPWEMRLRVAYYIAQALDHCNAENRKIYHDLNAYRVLFDEEGDPRLSSFGLMKNSRDGKSYSTNLAYTPPEFLRTGRVIAESVIYSYGTVLLDLLSGKHIPPSHALDLIRGKNILLLMDSSLEGQYANEDASKLVDLASKCLQFEARDRPNIKYLLSSVGPLQKQKEVASHVLMGITKATAVLPTILSPLGKACSGMDLTAVHDILLKTGYKDEEGAENELSFQEWTQQVQEMLNTKKFGDIAFRDKDFKTAIDYYSKLVGMMSVPSATVFARRSFSYLMNGQSELALRDAMQAQVCMPEWPTAFYLQALALSKLGMETDAQDMLNDGATFEAKKQNSWRG

SEQ ID NO: 52649 - protein, 475 aa, Alteromonadales bacterium TW-7
MSNLIFCDSFIDGEFYKTNEHFSVNDPATQQSIIEVSDIDEQGVNSAITAAQGAFVKLKNTNATERSETLMRWYELVIKHKKTLAELMTKEQGKPLKESLGEIDYGAGFIKWFAEEAKRSYGDVIPPTDNNHRLTSFKQPVGVVAGITPWNFPVAMVTRKVAPAYAAGCSFILKPSEHTPLCAIALAYLADQAGFVKGAFNVLVSQDAKTVGKMLTDSHIVRKFTFTGSTGVGSQLLKQCADTVKRTSMELGGNAPFIIFDNADLDDAIDGLMAAKFRNSGQACVAANRIFIQRSILDEVLSKITPKVASLKVANGFEEDVDIGPLIYPKAKEKVQQLVQDALDKGADLIGDNSSLGGSFQNPLIVTNVTTEMDIYHEEVFGPVLTVIPFDEEAEVLSLANDVPYGLAAYFYSQDLKQVYRISEGLEFGMIGVNEGVISNPVAPFGGVKQSGLGREGGHQGLNEYLEEKYVCIKI

SEQ ID NO: 52650 - protein, 438 aa, Synechococcus sp. CC9311
MATHDIFMPALSSTMTEGKIVEWLKQPGDKVARGESVLVVESDKADMDVESFQEGYLAAVLMPAGSTAPVGETIGLIVETEAEIADVKAKAPSSAPAAPAAAAPPAAPAPPTPVSAPAAVSAPAPVTAPVAASVSNGRLIVSPRARKLASQMGVDLAGLRGTGPNGRIQAEDVEKAAGRPVTPPRVGEGTSAAAVVGDTVSASPSAPSGNSFGAPGDTVAFNTLQAAVNRNMEASLAVPCFRVGYTITTDKLDAFYKQVKLKGVTMTALLAKAVAVTLARHPQVNAATTASGMSYPAEVNVAVAVAMEDGGLITPVLRNADRTDLYELSRQWGDLVKRSRSKQLQPEEYSTGTFTLSNLGMFGVDRFDAILPPGTGAILAVAASRPTVVAGKDGSIAVKRQMQVNLTADHRVIYGADGAAFLKDLAELIDTRPESLAL

SEQ ID NO: 52651 - protein, 469 aa, Ehrlichia ruminantium str. Welgevonden
MNKHEFLIIGSGPGGYIAAIRAAQLGYNVAIIEKENTLGGVCLNWGCIPTKSLLHSALIYHNIKKADVFGINVTNVTCNFTKIIERSRNVVEKLSNGISGLMKKNNIKVYSGTAKLLGEGTVEVLDNNNDKINITSKHIIIATGSHPRNLPNINFDNNIIWNAKNAMTPNILPKSLAIIGTGAIGIEFASFYNTFGTQVTMIELRDNILPLEDHEVSKSMHQILNQKGIKIYTKSSVTKLEKSNNNARIQISNTIDLEVDKVILAVGIQPNTDNLGLDNTKIQIDQAGFIITDKYCCTSESGVYAIGDVAGPPCLAHKASHEAILCVENIAAQEKKITDRNIHHINKENIPSCIFSIPQIASIGLTEHQAKSMGYDIKIGKFNANCSGKAIAIDETEGFVKVIINKTTGELLGAHMIGAEVTEMINGYIIGKQLEATDRDIISSIFPHPTLSEMIHEAVLASNNESLNS

SEQ ID NO: 52652 - protein, 762 aa, Bordetella bronchiseptica RB50
MKDTDRQAALDYHAYPHPGKISVTATKPLVTQRDLSLAYSPGVAAACEEIVEDPANVFRYTGRGNLVGVITNGTAVLGLGNIGALASKPVMEGKAVLFKKFAGLDVFDIEINETDPDKLVEIIAGLEATFGGINLEDIKAPECFTVERKLRERMKIPVFHDDQHGTAITVCAAVVNGLAVAGKRIEDVKLVTSGAGAAALACLDLLVDLGLPLEHIWVTDIEGVVYEGRKKLMDADKERFARKTKARTLAEVIEGADVFLGLSAGNVLKPEMVATMAANPLILALANPNPEILPEAAHAVRDDIIMATGRSDYPNQVNNVLCFPYIFRGALDVGATTITREMEKAAVLAIANLAREEQNEVVAAAYGTYDISFGRDYLIPKPFDPRLIVRIAPAVAKAAMEGGVATRPIADLDAYAEQLQQFVYHSGAFMKPLFSQAKQIVRDGGRARIVFTEGEDERVLRAVQVIVDEKVAKPILVGRPQVLLSRIEKFGLRLRLGQDVEVCNPEYDERFHQYWTTYWDMMCRNGITKEMARVEMRRRLTLIGAMMVHLGDADGMICGAVSGFHDHLRFIDQVIGRKPGATTYAAMNILLLDERTVALVDTHVNEDPSAEQIAEYTVAAAEEMQRLGLAPKVALLSRSNFGSGSSASGAKMRHALELVNRQAPGLEIDGEMHGDCALDESLRLRLLPDSPLKGSANLLVCPNVDSGNIAYNLLKTVAGKNVAVGPILLGANAPVHIVTSSATVRRIINMAALCVLDANRPQ

SEQ ID NO: 52653 - protein, 220 aa, Hafnia alvei
YDSTHGRFNGTVEVKDGHLVVNGKTIRVTAERDPANLKWNEVNVDVVAEATGLFLTDETARKHIAAGAKKVVLTGPSKDNTPMFVMGVNDKTYAGQDIVSNASCTTNCLAPLVKVLNDKFGIVEALMTTVHATTATQKTVDGPSHKDWRGGRGASQNIIPSSTGAAKAVGKVIPELNGKLTGMAFRVPTPNVSVVDLTARLEKPASYKDICAAMKAASEN

SEQ ID NO: 52654 - protein, 277 aa, Klebsiella oxytoca
EIVAINDLLDADYMAYMLKYDSTHGRFNGTVEVKDGHLIVNGKKIRVTAERDPANLKWDEVGVDVVAEATGIFLTDETARKHITAGAKKVVLTGPSKDNTPMFVKGANFDKYEGQDIVSNASCTTNCLAPLAKVINDNFGIIEGLMTTVHATTATQKTVDGPSHKDWRGGRGAAQNIIPSSTGAAKAVGKVLPELNGKLTGMAFRVPTPNVSVVDLTVRLEKAASYEEIKKAIKAASEGAMKGVLGYTEDDVVSTDFNGEVCTSVFDAKAGIALNDN

SEQ ID NO: 52655 - protein, 357 aa, Arabidopsis thaliana
MMSDISQDLLEEILSRVPITSLRAVKSTCKRWKDLLNDPSFSKKYGGKRDNEFLAIMTSGSRASLMSVNLHGPRDNKDLEDPFIKQIGELNQDQIFKVFHCDGLLLCITNEDNTRLVVWNPYLAQTRCIQPIDKFYIYDWYCLGYDKDKNHKILVVYSPMFGRIEYEIYSFLSKSWIVLSFPTDWQISRDECLSLKGNTYFIAYKKMEVEEVGFQEFLLCFDFTNERFGPLLPLPFQCYNQTSLVLSTVQEEQLAVLCKRCDAYETKIWITTKIEPNAVSWSYFLKFDFKVDISGGSFFVDVEEKVAVLFCINREKEKGINNKTYMIGEDGYYKEVDLGESNWCPSMCSYVPSCVQV

SEQ ID NO: 52656 - protein, 276 aa, Schizosaccharomyces pombe
  misc_feature (93)..(93): Xaa can be any naturally occurring amino acid
MKPFSPSQTNFEKEQLCFGVYQLKDCYQQVIEALSLGIRVIDSAITYRNEKECEQAIQDFCHQNVNIKREDITLITKIPDSLQGFERTWKAVXQSLRRTGRPKLDVVLIHSPKWPVRRIESWRALLQHQKEGRINKIGVSNYNIHHLEEIISLGLPLPAINQVEFSAFNNRPTFLSYCFNHGILVQAFSPLTRGYRLSDIRLLDLSLKYNKTPANILLRYCLQKGVSPISKASSFVHIHENVKAEQFMLDPSDMDVMDTWDEEFVSKPTWNPIILP

SEQ ID NO: 52657 - protein, 195 aa, Bacillus cereus G9241
MIVLIDNYDSFTYNLYQLLGEYEEDIVVVRNDQITIEQLEEMKPKGIVLSPGPGKPEDAGICIEVIRHFYKNVPILGICLGHQAIIATFGGDIVRAERIKHGKTSRVKHNGTSIFSYATQPLTAMRYHSLVAEQTSLPECFDILATAMDDGEIMAVRHNYYPLFGLQFHPESIATEEGGKLIRAFLIEVKEEERV

SEQ ID NO: 52658 - protein, 268 aa, Ehrlichia ruminantium str. Welgevonden
MLEYTLNYLTNNLNITPVIGIELEFYFDHISLDNLKLVINNIKNKLSCFNCNIIQEKSKLQYEIQTSYTTNISRLISEINTIKEILHNTAQNHKGTINFSAKPYLDKPGSAFHVHINLLDKNANNLFFQQNNEVSTYLLYSIGGLCTLMKKHMIFFAPYSDSYLRYIHADIDTPTTISWGGNNRSTAIRIPNTTNNPNRCRIEHRVAGSDCNHKQVITSILQGLIHGIQNKIQPIPRTYGIASDLQYNLEKLPLSLDESIKYFITDLQ

SEQ ID NO: 52659 - protein, 603 aa, Leptospira interrogans serovar Copenhageni str. Fiocruz L1-130
MVIHKKIAVVDFGGQYAHLIASRIRRLGAYTEILSNEEPISNYQKYSGIILSGGPESVYEPNSPTVTTRIFDLGIPILGICYGHQLIMKLLGGVVERSGTGEYGPASLQLHGTNGNSILKNFVGGEQVWMNHADEVVKLPEGFSKIAFSKDCGYAVVANSSKKIFGIQFHAEVSHSEKGSVLLDNFIQICGVSKTWGIDQFLKEKIKEIQETVKQEQKIFMLVSGGVDSTVSYLLLCKALGAERVLGFLIDTGFMRKDEVVSLQKKLTFQNIHLTVRDESSLFYKSLKDKSDPEEKRKIVGNLFLEARDRAVKDLDLEYGDWLLGQGTIYPDTIESGGTKHSHTIKTHHNRVEAIQKLIEQGKVIEPIRDLYKDEVRDLGVLLGLESEWVGRHPFPGPGLVVRMLAVEKKGTDKDQLEIDSYLSTQDGLSGKILPIASVGVKGDRRSYANCVVLNDIETDWNTLDRVATHLSNRFSFINRVVLLPFESDLKKWNFQFTGMQLDKKCSDLLREADFTVESVIRKLGLYNKIWQMPVVLLPIGEKENEKSIVLRPVESQEAMTANFFRMERSVLQEIKIEVLKIPEIRYLFFDLTNKPPGTIEWE

SEQ ID NO: 52660 - protein, 374 aa, Streptomyces noursei ATCC 11455
MRRDIGAPRRRFNGDPDGTRLSSATKGTEVMSTVHTGVTQSGLTAELASLHAELVRRNPGEAEFHQAALEVLETLAPVLTARPEFADAKVLERIVEPERQIMFRVPWQDDSGTIRVNRGFRVEFNSALGPYKGGLRFHASVNLGIVKFLGFEQIFKNALTGLNIGGGKGGSDFDPHGRSDAEVMRFCQSFMTELHRHLGEHTDVPAGDIGVGGREIGYLFGQYRRITNRWEAGVLTGKGLAWGGSKARTEATGYGNVLFTEEMLKQRGEELDGQQVVVSGSGNVAIYTIEKAQALGANVLTVSDSGGYVVDEKGIDLALLKQVKEVERGRVGDYAQRRGSSAKYVAGGSVWDVACDVALPSATQNELDADAARI

SEQ ID NO: 52661 - protein, 463 aa, Listeria innocua Clip11262
MNSLFRRKPIEDLMHNKSGSTHLKQTLGPLDLTLLGVGAIVGTGIFILPGTVAAKNAGPAIIFSFVIAAIVCAIAAMCYSEFASSVPVAGSAYTYGYVVFGELIGWLLGWALILEYGLAVASVASGWSSYLNALLSGFHISIPEAVSGPFNPEVGTFINLPAIIIVLVIAFLLTLGIKESTRVNTIMVAIKVGVILLFLVVGVFYVKPDNWQPFMPFGISGVMNGAALVFFAYLGFDAVSSAAEEVKNPQRTMPIGIIGSLLICTILYVAVSAVLTGMVPYTDLNVTDPVAYALQVINQDWVAGIVSLGAVVGMITVILVMSYGATRLIFAMGRDGLLPKVLAEINQKYQTPVKNTWIFAFIVAIISGLVPLDRLAELVNIGTLLAFMMVSIGIIFLRKNKSIQQSGFKVPFYPVLPIISFLLCAFLISRLSVHTWILCGIWFVIGLIVYFAYGRKNSELLKK

SEQ ID NO: 52662 - protein, 401 aa, Haemophilus ducreyi 35000HP
MFQFSTVDEALAAIAAGKIILVSDDENRENEGDFICALEFATPENINFMATYGKGLICTPISQALADKLSFHPMVTNNTDNHETAFTVSVDHINTGTGISAFERSLTALKMLEQNAQAADFRRPGHMFPLIAKEGGVLVRNGHTEATVDLARLAGLKPAGLCCEIMADDGTMMTMPQLQALAVKHNMPFITIAQLQEYRRKYDSLVKLVSVVKMPTKYGEFMAHSFVEVISGKEHIALVKGEIGDGQAVLARIHSECLTGDAFGSQRCDCGQQFAAAMTQIEKEGRGVVLYLRQEGRGIGLINKLRAYELQDKGMDTVEANLALGFKEDEREYYIGAQIFQALGVKSTRLLTNNPAKISGLKQQGLNIIAREPIIVEPNQNDIDYLKVKQIKMGHMFNFEQ

SEQ ID NO: 52663 - protein, 520 aa, Glycine max
MEPFSSTKQNHNNNNTLTKPSLHVESPPLEPSPLRKIIVVASIAAGVQFGWALQLSLLTPYVQLLGIPHTWAAYIWLCGPISGMLVQPIVGYHSDRCTSRFGRRRPFIAAGSFAVAIAVFLIGYAADLGHSFGDDLSKKVRPRAIGIFVVGFWILDVANNMLQGPCRALLGDLCAGNHQKTRNANAFFSFFMAVGNVLGYAAGAYSKLYHVFPFTKTTACDVYCANLKSCFFLSIALLTTLATAALVYVKEVPLSPEKAVIDSDDNGGMPCFGQLFGAFRELKRPMWILLLVTCLNWIAWFPFLLFDTDWMGREVYEGTVGEGKAYDRGVRAGALGLMLNSVVLGATSLGVEVLARGVGGVKRLWGIVNFLLAVCLAMTVLVTKMAQHSRQYTLLPNAHQEPLPPPAAVKAGALALFSLLGIPLAITYSIPFALASIFSSTSGAGQGLSLGVLNLAIVIPQMVVSVISGPWDALFGGGNLPAFVVGAVAAAASGILSIILLPSPPPDLAKAATAAGGGFH

SEQ ID NO: 52664 - protein, 153 aa, Haemophilus ducreyi 35000HP
MAKITGNLVATGLKFSIVTARFNDFINDKLLSGAVDTLVRHGAVESDIDTVWVPGAFEIPLVAKKMAESGKYDAVICLGTVIRGSTTHYDYVCNEVAKGIGAVALQTGVPIMFGVLTTESIEQAIERAGTKAGNKGAECALGAIEMVNVLKAL

SEQ ID NO: 52665 - protein, 139 aa, Kluyveromyces lactis NRRL Y-1140
MISRTALRTATASRATFVRPLAFSQVRFQSTAGGNTIKHLTNLHEFEVAMKADNLSLVDFFATWCGPCKAVAPHVQKLSEKYNNVKFYKVDVDESPDIAGALGISSMPTFVLFKNGKGLGKVVGADPRGVEEAIKHFNK

SEQ ID NO: 52666 - protein, 134 aa, Herminiimonas arsenicoxydans
MAYSDKVLDHYENPRNVGAFDKGDETIGTGMVGAPACGDVMKLQIKVGADGVIEDAKFKTYGCGSAIASSSLVTEWVKGKTLDQALSIKNTQIAEELALPPVKIHCSILAEDAIKAAVLDYKTKHGVAEAEKAV

SEQ ID NO: 52667 - protein, 384 aa, Roseovarius nubinhibens ISM
MIIAALIVAAGRGSRAETPLPKQWQPLGPARVADVTLARFATHPRIGPICMVLHPDDMALAPDHPGLILAPGGSTRAASVRNGLDALAEHAPDLVLIHDVARPCVSSSVIDGVIAALAHGPAAAPALPVTDALWRGAEARVTGTEDRTGLFRAQTPQGFHFAAIRDAHAKAQNDAQTQGTADAADDVAIARAAGLDVIITRGDEANIKITWPEDFARAQRILGSEMKIRLGNGYDVHRFGPGDAVVLCGVTIPHDRGLQGHSDADVGMHALTDAIYGALAEGDIGRHFPPSDMQWKGADSRIFLRHAVGLAADKGYKINNLDVTLVCEYPKIGPQAEAMRAALAELCQTPLDAVSVKATTSERLGFTGRGEGIAALATVTLTGL

SEQ ID NO: 52668 - protein, 117 aa, Zea mays
  misc_feature (75)..(75): Xaa can be any naturally occurring amino acid
MAPSRKFFVGGDWEKNGRKHSLGELIGTLNAVKVPADTDVERAQHTAYIDLVRQKLDPKNAEAAQNCYKVTNDAXTDEISPGMIKHCGATRAVLGHSERTHVFGESDELIGHKVRHA

SEQ ID NO: 52669 - protein, 347 aa, Escherichia coli
GSHKIRVGDALLGRLIDGIGRPMESNIVAPYLPFERSLYAEPPDPLLRQVIDQPFILGVRAIDGLLTCGIGQRIGIFAGSGVGKSTLLGMICNGASADIIVLALIGERGREVNEFLALLPQSTLSKCVLVVTTSDRPALERMKAAFTATTIAEYFRDQGKNVLLMMDSVTRYARAARDVGLASGEPDVRGGFPPSVFSSLPKLLERAGPAPKGSITAIYTVLLESDNVNDPIGDEVRSILDGHIVLTRELAEENHFPAIDIGLSASRVMHNVVTSEHLRAAAECKKLIATYKNPELLIRIGEYTMGQDPEADKAIKNRKLIQNFIQQSTKDISSYEKTIESLFKVVA

SEQ ID NO: 52670 - protein, 274 aa, Zea mays
MADSSDQVPPAARKLDGKVALITGGASGIGECTARLFVKHGARVVVADIQDEPGSRLCAELGADAASYVHCDVTVEDDVAAAVDHAVARFGALDIMFNNAGIGGAACHNIRENTKEDFERVLSVNLVGPFLGTKHAARVMVPAGRGGCIIGTSSLASAVAGAASHAYTCAKRALVALTENAAAELGRHGIRVNCVSPAAAATPLATGYVGLEGESFEQAMEAVANLKGVRLRVADISAAVLYLASDDARYISGHNLLLDGGFSIVNPSFGIFKD

SEQ ID NO: 52671 - protein, 386 aa, Ehrlichia ruminantium str. Welgevonden
MNIHEYQAKQILKRFGISVPEGVIVHSLNEVNDAINKINSKVIVVKAQIHAGGRGKAGGVIVSRTLDEAKTAIKNMLGSTLVTHQTSKDGQKVRKVYLEEGCDIKKEYYISAIVNRKHGQISIIFSTEGGVDIEEVAANSPEKVVTCNIDPIFGFQGFHGRNLCFDSNLSVDQTRKITSIAEKIYKTMLETDASQIEINPLIETSSGDFIALDAKMNFDDNAIYRHPEILELRDYDEEIPEEIEASKHGLSYIKMDGNIGCMVNGAGLAMATMDIIKYYGAEPANFLDVGGGASQQTVTEAFKIILSDNVDGILVNIFGGIMRCDIIANGIIAAIQEIGINVPLVVRLSGTNFELGKKLLDNSKLNIITAHDLSEAAYNIVNIVKK

SEQ ID NO: 52672 - protein, 188 aa, Picea sitchensis
MERRNSYMGRASFYSLSSSINTQIENPAEEFEEEEIWAVVPSEPNTRDPRFKSQEIKKVREIASTSRRLPTASRMIPRNLANEENANNVSRIRHQSAPMNIPDWSRVQRRENQRRITVIEDDFGINEDDRVEEDEEDERIPPHELIARQLARSQITSFSVFEGAGRTLKGRDLSRVRNAVLTRTGFLE

SEQ ID NO: 52673 - protein, 103 aa, Microcystis aeruginosa PCC 7806
MAKKTKTTTYKVTLKTPDGDHKIDVPDNEYILEAAEEQGLDLPFSCRAGACSACAGQIASGSVDQSDQSFLDDDQIKAGYVLTCVAYPTSDCVIVTHKEEDLY

SEQ ID NO: 52674 - protein, 577 aa, Corynebacterium diphtheriae NCTC 13129
MATMTTKSHCTFNPDYYQDVWQRFGEEEYDVVVIGGGSVGAGAGLDAAIRGLKVAVVESRDFAAGTSSRSSKMFHGGLRYLAMLDFKLVAESLHERELNMSTLAPHLVKPLKFLFPLTHHVWERVMMFGGFTLYDLMGGAKSVPMQKHYSRKGTLAMAPGLKDDAVVGSVRYFDTLVDDARHTMTVLRTAGELGADVRPSTQVVGFEKDGQRVVGAILQDTDTGEQTTIRGKVFINATGVWNDHIEKLAGGNGPFSVHASKGVHIVVPKNVFDADAAMCFVTEKSVLFVIPWGEYWIIGTTDTDWDLNRADPAPTAADINYILDEVNQRVRRPIQHSDIVGVYSGLRPLLSGKSDTTTKLSRNHAVAKVMPGLVSVAGGKYTTYRVIGKDAVDLATEDLDFRVPASESERTPILGADGYHALQNQAPRIARTFGTTEDVVEHLLGRYGSLVHEVLEPSVDKPELLEPIPGAPGYIKAEAVYAVTHEGALHVEDIVERRLRAGIEYADRGVAAAPAIAELVADYLGWDAERTAAEVTAFTDRVSAEIAAEKELTDKAANEHIVAGSAVRSYVDVSGDN

SEQ ID NO: 52675 - protein, 277 aa, Klebsiella pneumoniae
EIVAINDLLDAEYMAYMLKYDSTHGRFDGTVEVKDGHLVVNGKKIRVTAERDPANLKWDEVGVDVVAEATGIFLTDETARKHITAGAKKVVLTGPSKDNTPMFVRGANFDTYAGQDIVSNASCTTNCLAPLAKVINDNFGIVEGLMTTVHATTATQKTVDGPSHKDWRGGRGAAQNIIPSSTGAAKAVGKVLPELNGKLTGMAFRVPTPNVSVVDLTVRLEKAASYEEIKKAIKAASEGAMKGVLGYTEDDVVSTDFNGEVCTSVFDAKAGIALNDN

SEQ ID NO: 52676 - protein, 330 aa, Oryza sativa Indica Group
MAFSCIAALVRCEGSSGGIVRTLQLLEKCVDALQADEHPDMLTLHGTALFIRPSAYQEVKSSPKHAIVPHNNLLGCSAFYNPVEGHHVQKPHIVPSCKVNFTRASQYLYRSLSERTTRHWLHRFHVNASSDEDFRSSRNIAISLFKRYKNVIDRGGGDNLKEFVSAGVNAYALSCTEEGLRKELMDIEDSGLEIEALRSNGGGTSLTFKVHSFEMKSTKSHWQDMKLYVRECILWLSIVFITILCTPQPTIIRWSTTPPVSADVLHQWKGFCALIANAYYTKGMAWLPVKTLQLEQMAVTGSSEEPSVVASRMQLVFSTLEVVSPQWPRV

SEQ ID NO: 52677 - protein, 277 aa, Klebsiella pneumoniae
EIVAINDLLDAEYMAYMLKYDSTHGRFDGTVEVKDGHLVVNGKKIRVTAERDPANLKWDEVGVDVVAEATGIFLTDETARKHITAGAKKVVLTGPSKDNTPMFVRGANFDAYAGQDIVSNASCTTNCLAPLAKVINDNFGIVEGLMTTVHATTATQKTVDGPSHKDWRGGRGAAQNIIPSSTGAAKAVGKVLPELNGKLTGMAFRVPTPNVSVVDLTVRLEKAASYEEIKKAIKAASEGAMKGVLGYTEDDVVSTDFNGEVCTSVFDAKAGIALNDN

SEQ ID NO: 52678 - protein, 309 aa, Rhodospirillum rubrum ATCC 11170
MSGRIAVVGSNMVDLITYVTRMPDKGETIEAPNFALGCGGKGANQAIAAARLGADVLMVTRVGDDIFADNTIANFKANGIDTRFVRKVPGTPSGVAPIFVEQNGENSILIVKGANAHLSPADVEEAGEALKGCALILMQLEVPLETIYATVAFGAAHGIPTLLNPAPAVPELDVERLRTLSFLTPNETELAILSGMPVASETEVEAAARSLIAKGVRTVIVTMGARGALLVEEKGATRIAPVRVTPKDTTGAGDAFIGSFAHYYTQNGDIAAALRKAVRYAADSITRNGTQSSYATLAEFEAFCATIDA

SEQ ID NO: 52679 - protein, 196 aa, Glycine max
  misc_feature (157)..(157): Xaa can be any naturally occurring amino acid
MAKGRKLTTSRSERFLGTYAYSQGSAAVNPSELREEDVWGAGDDAGEREWDPHFAAMSNGGGSRRRIPRDTDVHRRVGGLSLAFEAPASGASPRIVHQFRAREEMASTPRVRHMATSAPMNVPDWSKILRVDSVDSLNDDYNDEDESEMVPPHEYLXARSQTMVANSVFEGVGRTLKGRDLSRVRDAVWSQTGFDG

SEQ ID NO: 52680 - protein, 277 aa, Klebsiella pneumoniae
EIVAINDLLDAEYMAYMLKYDSTHGRFDGTVEVKDGHLVVNGKKIRVTAERDPANLKWDEVGVDVVAEATGIFLTDETARKHITAGAKKVVLTGPSKDNTPMFVRGANFDTYAGQDIVSNASCTTNCLAPLAKVINDNFGIVEGLMTTVHATTATQKTVDGPSHKDWRGGRGAAQNNIPSSTGAAKAVGKVLPELNGKLTGMAFRVPTPNVSVVDLTVRLEKAASYEEIKKAIKAASEGAMKGVLGYTEDDVVSTDFNGEVCTSVFDAKAGIALNDN

SEQ ID NO: 52681 - protein, 532 aa, Zea mays
  misc_feature (226)..(226): Xaa can be any naturally occurring amino acid
  misc_feature (237)..(237): Xaa can be any naturally occurring amino acid
  misc_feature (250)..(250): Xaa can be any naturally occurring amino acid
  misc_feature (252)..(252): Xaa can be any naturally occurring amino acid
MSGSLPSLNPSRRRRPTPPQPPPMSRRPACSLLPLLRSRRCLYDATTARPFTSVSVPPDVISSTWPPHSPSPLHPPPDPAGTWCSASCSSTSPALPPFTASHLRAAVSLLATSLTALPGPDPDPVSALHDHSFPTLLAVSPLASLELLSLLRSRPRLGLAVFSFRRVLSPVPSISEFALAISLAGRAGDHDAAAALFADGTAIHSPNLGLYNALMSAYMHSGLLEXCIEVFHALERXPRCVPPNVDSYTXLXALFGRSILVDHMERTLQSLDASGQPRTIGTYNAIISGYLTAWMWDKMEASFQEMVSFHVAPDATTHKLMLRGYAHAGMICKMEQAYERACKLGIKVDILHIRAMLCAYCKFYHVGRIQKIEDLLKKLGPDDYRPWLNVLLIKVYAQEGLTEGMELYISEALERNTIVTAVKVMRSIICNYFQYDAVDRLALFVRRAEDAGWKLCRSLYHCKMVMYGKHYRLEEMHGVLDEMECLKFDRTKKTFWIMYKAYVSCGRRTEANTIIGMMWKHGFAVRDDMSDQ

SEQ ID NO: 52682 - protein, 241 aa, Brassica napus
MIVNREEMAMATCTQLSSSSSPLFHLQITKKPFLLPSPATISVHGFSTLRPKSLSLSHRSSVSASAASSTVDVTEQKKSTRTLPFRVGHGFDLHRLEPGYPLIIGGIDIPHDRGCEAHSDGDVLLHCVVDAILGALGLPDIGQIFPDSDPKWKGAASSVFIKEAVRLMDEAGYEIGNLDATLILQRPKISPHKETIRSNLSKLLGADPSVVNLKAKTHEKVDSLGENRSIAAHTVILLMKK

SEQ ID NO: 52683 - protein, 486 aa, Blastopirellula marina DSM 3645
MKTTNMSHTIVIFGASGDLTSRKLIPALYLLYRKGRLPDSTRVVGVSRTEYSHDAWRADLEKTTKQFTGDSFEPKMWAEFAALVFYQPGDLQDSADMDRLATFLNELEGGESTRIYYLSTMPKLYPIAVEMLGAAGLADQSAGPRRVVIEKPFGTDLTTAEQLNTRVHKVFAEDHVYRIDHYLGKETVQNLLVLRFGNSIFEPLWNRNYIDHVQITVAEEVVVGRRGGYYDTSGVMRDMVQNHLLQLMMITAMESPVRFDADMVRGEKVKVLEAVRPMTGADFAQNTLRGQYYGYLNEEGVPANSQTATFTALKLWIDNWRWQGVPFYLRSGKAMSCRTTQIVIQYKEPPLTLFDHCESMEGNRLVIQIQPAEGLQMHIQSKVPDAGMRTRTTDLDFRFRRQFAGDLPDAYQRLLLDAIQGDASLFARSDEVELAWGIVDPILAAWNSPAAPELVKYEAGGWGPDSSTDWMMKQGRQWFDVCPILH

SEQ ID NO: 52684 - protein, 417 aa, Herminiimonas arsenicoxydans
MNAPLDKSLLDTIKAPHFPIYMDYSATTPIDPRVADKMIPYLREQFGNPASRSHMYGWTAEKAVEDAREQVAKLVNADPREIIWTSGATEGNNLALKGAAQFYKTKGKHIITVKTEHKAVLDTVRELERQGFEATYLQPQDNGLITIEQLAEAIRPDTILVSVMLVNNEIGVIQPIDEIGELCRSKGIIFHCDAAQATGKVKIDLEKSKVDLMTFTAHKTYGPKGIGALYVRRKPRIRIEAQMHGGGHERGLRSGTLATHQIVGMGEAFRIAREEMDEEIVRITALRDRLAKGLMDMEEVYINGDMDHRVPHNLNVSFNYVEGESLIMAIKDLAVSSGSACTSASLEPSYVLRALGRSDELAHSSIRFTFGRFTTEEDVDFTIKLIKEKVAKLRELSPLWDMYKDGIDISTIQWAAH

SEQ ID NO: 52685 - protein, 372 aa, Campylobacter jejuni subsp. jejuni NCTC 11168
MKAYIYLENDIFLSAKAFGKSGTFFGELVFNTSLTGYQEIISDPSYAGQFIVFSMPEIGIVGTNENDNESKEIFASGVLMRELSSSFSNFRAKESLQDYLEKHGKIGIYELDTRYLVKMIRNNGNLRAVISTEISNKEDLKIALEKSAKIDEVNFVKEVSTKKNYSHKQGVWNASFQKFNDAKRSEKKVAVIDYGVKTNILNELVEVGFEVEVYPYNVKADELITLYKKGEIQGVFLSNGPGEPRILKQEIAEIKKLAEAKIPMLGICLGHQLLSNAFGYETYKMKFGQHGANHPVINLDTKTVEITAQNHNYNVPEELAQVAHITHRNLFGDNVEGVRYKDYPIISVQHHPESSSGPHESKYIFKEFMNLM

SEQ ID NO: 52686 - protein, 194 aa, Triticum aestivum
GRVGSVTRASIKPTRIASRAFVSTWNSVPQGPPDAILGVTEAYKRDTSPNKMNLGVGAYRDDGGKPYVLTSVKKAEKVMMEKNLDKEYAGITGVPAFTKAAGELAYGEDSSVIKDNRLVISQSISGTGALRIGAEFLKAWYPHAKNIIVPNPTWGNHIPIMKNAGLSLEKYTYFDKNTNGLNIDGMLEDLHKAP

SEQ ID NO: 52687 - protein, 589 aa, Prochlorococcus marinus str. NATL1A
MTNKNPHEDSSCPVEQDVLEESTEEILEESEQNSENGFSEFNFSEELIQTISDKGYSSPTPIQKAAIPELLLGRDLVGQAQTGTGKTAAFALPILERLKKNVGHPQVLVLAPTRELAMQVAESFRTYSAGHPHFKVLAIYGGSDFRNQINTLRRGVDVVVGTPGRVMDHMRQKTLNTSHLSCLVLDEADEMLRMGFIDDVEWILEQLPEERQLVLFSATMPSEIRRLSKKYLNSPAEITIKATELKERLIRQRYISVQNVYKVNALQRVLEAVSEEGVIIFARTKAITIVVAEKLESYGYNVAVLNGDIPQNQRERTVERLRQGSINILVATDVAARGLDVDRIGLVINYDMPFDREAYVHRIGRTGRAGRNGEAILFVNPRERSFLSNLERAVGQPIEKMDIPDNDLINNNRIKKLQAKLIKAASTERDNPEEANILEELIKNVEKELDIDPKDLTLAALNLAVGFNALLENGNEDWIRQSAQRNTRNDRRDNNKFKQRRRGDFDNNRLEDEMDRFRVEVGHRDRVKPGNLVGAIANEAGLKGRSIGRIRIFENYSLVDLPKQMPDKVFQALKKVKVMNRELQINRAD

SEQ ID NO: 52688 - protein, 480 aa, Blastopirellula marina DSM 3645
MSEQCDFGLIGLAVMGENLALNVESRGYSVAVYNRTTEKTDEFISGRAAGKKFVGCHTLEDLVKSLKAPRKVMMLVKAGPAVDSIIDQLIPLMDKGDIIIDGGNTLYSDTERRTKYVEEQGLLYSGTGVSGGEEGALKGPSLMPGGSEAAWPELKEIFQAIAAKVGPNDDIPCCEWVGPRGAGHYVKMVHNGIEYGDMQMICEAYFLLKHGIGLTNEELYDVFDEWNRGFLQSYLIEITRDIFSVKDEKTGDFLVDKVLDAAGAKGTGKWMSQLALDLGVPSTLVTTAVYARSLSAVKEARVRASKVLAGPKESYTGDKKQFIEHVRDALYASKIISYAQGFVQLQAAAAEHDWPLNYGDCALLWRGGCIIRAQFLDRIKEAFDADPNLENLLLAPYFTDAIDKAQAGWRNVVTTAATLGVPAPAFAGALAYYDGYRRADLPANLLQSQRDYFGAHTFKRNDMEGTFHAEWLKLRKEPKA

SEQ ID NO: 52689 - protein, 700 aa, Yarrowia lipolytica CLIB122
MSIQVAAKAANVGYAAVLLGAQKNIKIEIIDDKVVSKETPADVVYDGVSGTKAVVEKLAVTVSTEDQEWIDFAFTNLLSKDFKAVTPSLEKLEAHLNFRSFINGYTPSLSDLVVWGVLRSNLVVGTSLKSGVFINLGRWYNYLLAFEYGPVVETFTKDLNEVRKSAKSGQKKVASKASFEIGLVNAKEGEVVTRFPPEPSGYLHIGHAKAAVLNEYFARQYKGKLIIRFDDTNPSKEKEEFQDSILEDLELLGIKGDVISYSSDYFQEMYDLCIKMIKEGKAYADDTTQEVMREQRMDGIASARRDRPVEESLDVFENQMAKGTEEGLKNCIRAKISVDAGNKTLRDPVIYRCNLTPHHRTGDKWKVYPTYDFCCPIVDSIEGVTHALRTIEYRDRNAQYDWMLKALGLRKVHIWDFARVNFVRTLLSKRKLQWFVDQDKVESWSDPRFPTVRGVRRRGMTVEGLRNFIISQGPSKNIINLDWSLIWAINKKVIDPVAPRHSAVVKKDVVEISFADAAPETVEDRPKHKKNPDLGTKKTVFGGKKVLIDQDDAQTLKDGEELTLMDWGNIIVEKIHKNGDLVTGIDAKLHLEGDFKKTEHKVSWLAESDATPCELVDFDHLITKDKIEEGENFEDWLTPETVFKTEALADSNIKNMKVGDIIQFERKGYYRLDQPWSEDKPAVFFTIPDGKVVQKYGAKK

SEQ ID NO: 52690 - protein, 579 aa, Arabidopsis thaliana
MAQVVATRSIQGSMLSPNGGSVSTRSEKLLKPASFAVKVLGNEAKRSGRVSVRSRRVVDTTVRSARVETEVIPVSPEDVPNREEQLERLLEMQQFGDTSVGMWSKPTVRRKTKIVCTVGPSTNTREMIWKLAEAGMNVARMNMSHGDHASHKKVIDLVKEYNAQTKDNTIAIMLDTKGPEVRSGDLPQPIMLDPGQEFTFTIERGVSTPSCVSVNYDDFVNDVEAGDMLLVDGGMMSFMVKSKTKDSVKCEVVDGGELKSRRHLNVRGKSATLPSITEKDWEDIKFGVENKVDFYAVSFVKDAQVVHELKKYLQNSGADIHVIVKIESADSIPNLHSIITAPDGAMVARGDLGAELPIEEVPILQEEIINLCRSMGKAVIVATNMLESMIVHPTPTRAEVSDIAIAVREGADAVMLSGETAHGKFPLKAAGVMHTVALRTEATITSGEMPPNLGQAFKNHMSEMFAYHATMMSNTLGTSTVVFTRTGFMAILLSHYRPSGTIYAFTNEKKIQQRLALYQGVCPIYMEFTDDAEETFANALATLLKQGMVKKGEEIAIVQSGTQPIWRSQSTHNIQVRKV

SEQ ID NO: 52691 - protein, 339 aa, Desulfotalea psychrophila LSv54
MSNLTPSIAVIGAGSWGTSLAILLAGKGYPVRLWGHNKEHIDRLISDGENSRYLPGISLPESLYPTPSLEKAVLGAQLVLMVVPSHVFRTVFRDLIPFLPIDCQIVSAVKGIENSTLSTMHMVMAQELAAYPALALIELGVISGPSFAKEVAQKQPTAVTVGFASADTAKKVQDIFSTDYFRVYTSTDIDGLEISGAFKNVMAIAAGISDGLSYGSNARAALITRGLAEMQRLGAAMNADPATFAGLSGLGDLLLTCTGDLSRNRNVGLQLGKGHSIEHIESEMFMVAEGVKTTKSFYDLARKLDVETPILDEVYHIIYEGKDCSQAVQDLLGRKLKPE

SEQ ID NO: 52692 - protein, 373 aa, Coccidioides immitis RS
MAESTGRPRVYFDISIGNRQEGRVVFELFNDVVPKTAENFRALCTGEKGMGKQGKPLSYNGSIFHRVIKQFMIQGGDFTEFNGTGGESIYGEKFDDENFDLKHDRPFLLSMANSGPGTNGSQFFVTTVPTPHLDGKHVVFGEVINGRSIVRKIESQKTNPNDKPLMDVKVTDCGELTGDDYKNATQRSVDTTGDTYEDYPEDITEELSLAQYYKIAVDLKEFGNKAFKAGDVELGLEKYQKGIRYLNEAPEPSDSDAKELPSQIAALRFTLNSNSALLANKLKRFADGRSWAGYAINTAKDADAKDADKAKAHYRRAIASCGLKEEEEAIKDLQEALELAPNDAAIINEIARVKKHIAEQDRKQRAAVKKFFS

SEQ ID NO: 52693 - protein, 711 aa, Aspergillus nidulans FGSC A4
MSAETSTTPAPAENTNGTPDNAPAPEVTAVEAPATTSQPHSASLYVGELDPSVTEAMLYELFSSIGQVASIRVCRDAVTRRSLGYAYVNYNDTAHGERALDELNYTLIKGKPCRIMWSQRDPALRKTGQGNVFIKNLDSAIDNKALHDTFAAFGNILSCKVAQDEFGVSKGYGFVHYETAEAANNAIKHVNGMLLNDKKVFVGHHISKKDRQSKFEEMKANFTNIYIKNIDPEVEDEEFRKLFEKFGEITSATLSRDSEGKSRGFGFVNFSTHESAQAAVEEMNDKEVRSQKLYVGRAQKKHEREEELRKQYEAARMEKASKYQGVNLYVKNLTDDVDDDKLRELFGPYGTITSAKVMRDTAPVETATPESETKESANKENEKAAEGEKEPAAEEKEKEEKKEAEQKPEKKPLGKSKGFGFVCFSSPDEASKAVTEMNQRMVNGKPLYVALAQRKDVRRSQLEASIQARNNIRQQQAAAAAGMGQAYMAPAVFYGPGQQGFIPGAQRGGMFPPQPGMMMGMPGRPGQYPGPFPGQQGGRGVGPNQQIPPNFQGLPMGAMQGPGIPNGMGYPMVQGQFGGGRGRGQVPGMGGPMRGGYGGGRGGVPLGGQMRPGQGGRGQAVGQPGPETPVGVLTAQALSAAPPQQQKQMLGEALYPKIQATQPELAGKITGMLLEMDNTELLGLANEYTVSRMTRLCAPRSTKPLAFMTST

SEQ ID NO: 52694 - protein, 377 aa, Zea mays
  misc_feature (44)..(44): Xaa can be any naturally occurring amino acid
RCLHSPLRRLGPAGGELKSPYPLRHRRLSSLIVGSKPSHLAVRXSALPCAAVRSPLSESASACPPSLSPPLPSPPLPSCRVRSPLVLLVCSWYLCSPLLVFLPSFPSPPPLRLPACSVRAHSPAAPCSYDPLLSVCLTPRESSAPMSSAVEPVSCSKVDVPAAGPDPEDAAAPAGHGEAAPCCHEEEEEEEEEKAPQAIDLGPMVSIKEQLEKDKDDESLRRWKEQLLGGVDLNSVGETLEPDVRITSLSILSPGRRDIVLPLPVDATKGVWFTLKEGSPYRLKFTFSVSSNIVSGLRYTNTVWKTGLKVDRAKEMLGTFSPQPEPYTYVTPEDTTPSGMFARGSYSARTKFLDDDRKCYLEINYAFDIRREWPSAS

SEQ ID NO: 52695 - protein, 249 aa, Desulfotalea psychrophila LSv54
MQKTILITGATSGFGKATAKLFAAHNWQLILCGRRQDRLETIQKELENVPVHIAQFDISVRDEVEDFVSNIPQQFSQIDILVNNAGLALGLEGSDKADLDHWQTMINTNISGLLYMTRLILPQMMKNRTGHIINIGSVAGSYPYPGGNTYGASKAFVAQFSRNLRCDVAGTGIRVTNIEPGLAETEFSAVRFSGDEKRASSVYAGHENLSATDIAETIFWSASRPAHVNINSIEIMPVCQSWAALAIDK

SEQ ID NO: 52696 - protein, 364 aa, Zea mays
  misc_feature (326)..(326): Xaa can be any naturally occurring amino acid
  misc_feature (353)..(353): Xaa can be any naturally occurring amino acid
AAAAALSAEDRAGLVNALKDKLQSLAGQHADVLETLSPNVRKRVEFLREIQSQHDEIEAKFFEERAALEAKYQKLYEPLYTKRYGIVNGEVEVDGVCDEPASENTVEGKEPDAKGVPDFWLTAMKTNEVLSEEIQERDEAALKYLKDIKWSRIEDPKGFKLDFFFDTNPFFKNSVLTKTYHMVDEDDPILEKAIGTEIEWYPGKNLTQKILKKKPKKGSKNTKPITKTEDCESFFNFFNPPQVPEDDDDIDEDTADELQSQMEHDYDIGTTIRDKIIPHAVSWFTGEAVQGEDFGELGDDDEDDDDEDDDEDDEDEEEDDDEEEDXDEEESKPARKSGSGRRHKVPQKVSQGXNAEQPAECKQQ

SEQ ID NO: 52697 - protein, 177 aa, Triticum aestivum
  misc_feature (88)..(88): Xaa can be any naturally occurring amino acid
  misc_feature (98)..(98): Xaa can be any naturally occurring amino acid
MAAAGDAGEKKMITLKSSDGEEFEVEEAVAMESQTIRHMIEDDCADNGIPLPNVNSKILSKVIEYCNKHVQAKPADGAAAGAGAGASXDAAPAAPAEXDLKNWDAEFVKVDQATLFDLILAANYLNIKGLLDLTCQTVADMIKGKTPEEIRKTFNIKNDFTPEEEEEIRRENQWAFE

SEQ ID NO: 52698 - protein, 318 aa, Betula pendula
EVAPPQVGEVRLKILYTALCHTDVFFWEAKGQNPLFPRILGHEAGGIVESVGEGVTDLKAGDHVLPVFTGECKECRHCKSEGSNLCELLRINTDRGVMLSDGKSRFSIKGKPIFHFVGTSTFSEYTVVHRGCAVKINPLAPLDKVCILSCGISTGLGATLNVAKPKKGSSVAVFGLGAVGLAAAEGARIAGASRIIGVDLHPDRIKEGRKFGVTELVNPKDHKKPIQEVIADMTDGGVDRSVECTGNVDCMISAFECVHDGWGVAVIVGVPQKDAVFKTNPMNFLNGRTLKGTFFGNYKPRSDLPGVVEQYMNKELEV

SEQ ID NO: 52699 - protein, 84 aa, Staphylococcus haemolyticus
MSDIIFLNGMRFYGYHGALHAENELGQIFIVDVTLKVDLTEAGKTDNVKDTVHYGEVFEDVKNIVEGPSCQLIEHLAERIAKRI

SEQ ID NO: 52700 - protein, 186 aa, Oceanicola granulosus HTCC2516
MFIQTESTPNPATLKFLPGEAVLDAGTADFASPEAANTSPLARRIFSVQGVTGVFFGTDFVTVTKDEATEWDHVKPAILGAIMEHYQSGAPVVEGAEGATGHAEHTGEDGEIVAQIKELLDTRVRPAVAQDGGDITFHGFDRGVVYLHMQGACAGCPSSTLTLKMGIENLLRHYIPEVVEVRPVAA

SEQ ID NO: 52701 - protein, 450 aa, Triticum aestivum
  misc_feature (51)..(51): Xaa can be any naturally occurring amino acid
MASPSISAAAVASPVTPVALDPSPVASRLPAATAPVRKRPVLLLDSISPEXPHRFPPKVDSTAAAAAAAAAPLSQARRKRGLSSSGRPRWQTALSVAAKNAALLAVLLYLGDQAWRWAHPAPLAQPDDAALAGYTARVNDVEASLARAFGALKVQLEAVDRKIDGEVGAARGELAALLEEKRLAIEGQLNLLDARTDELNDALGGLRRMEFLRKDQFEAFLDEFKESLGSNSGTEVDLDQVRALAREIVMREIEKHAADGVGRVDYAVGSAGGRVVRYSEAYDAGKRGGLLSALPFGGGDNGDQSQKILQPSFGEPGQCFPLKGSSGFVEIQLRKGIIPEAITLEHVSKDVAYDMSTAPKDCRLSGWYQGTHTETPPNHAAEMYALTEFTYDLAKNNIQTFDITAPDVGVVNMVRLDFTSNHGSSALTCIYRIRVHGHEPVTPVIASPLP

SEQ ID NO: 52702 - protein, 175 aa, Brassica napus
  misc_feature (143)..(143): Xaa can be any naturally occurring amino acid
  misc_feature (163)..(163): Xaa can be any naturally occurring amino acid
MGKANVNNTGSDTKRNVVSSVFDPAFSRFVGLSQKLQARVKSQLKNLTADKHGREDNEISSNSIQMDLEKQLDSWRGNPSWTDQPPVVKVSIPKGSLCNLKAEVNVGLPPDAVYNIVIDPDNRRVFKNIKEVLSRKVVVDEGXEAVVEVEQAALWRFLWWSGXISVHVLVDQNRA

SEQ ID NO: 52703 - protein, 277 aa, Klebsiella pneumoniae
EIVAINDLLDAEYMAYMLKYDSTHGRFDGTVEVKDGHLVVNGKKIRVTAERDPANLKWDEVGVDVVAEATGIFLTDETARKHITAGAKKVVLTGPSKDNTPMFVRGANFETYAGQDIVSNASCTTNCLAPLAKVINDNFGIVEGLMTTVHATTATQKTVDGPSHKDWRGGRGAAQNIIPSSTGAAKAVGKVLPELNGKLTGMAFRVPTPNVSVVDLTVRLEKAASYEEIKKAIKAASEGAMKGVLGYTEDDVVSTDFNGEVCTSVFDAKAGIALNDN

SEQ ID NO: 52704 - protein, 368 aa, Escherichia coli
MSYQVLARKWRPQTFADVVGQEHVLTALANGLSLGRIHHAYLFSGTRGVGKTSIARLLAKGLNCETGITATPCGVCDNCREIEQGRFVDLIEIDAASRTKVEDTRDLLDNVQYAPARGRFKVYLIDEVHMLSRHSFNALLKTLEEPPEHVKFLLATTDPQKLPVTILSRCLQFHLKALDVEQIRHQLEHILNEEHIAHEPRALQLLARAAEGSLRDALSLTDQAIASGDGQVSTQAVSAMLGTLDDDQALSLVEAMVEANGERVMALINEAAARGIEWEALLVEMLGLLHRIAMVQLSPAALGNDMAAIELRMRELARTIPPTDIQLYYQTLLIGRKELPYAPDRRMGVEMTLLRALAFHPRMPLPEP

SEQ ID NO: 52705 - protein, 87 aa, Picea sitchensis
MSGGKVSFKITLTSDPKLPFKVFNVPEEAPFTAVLKFAAEEFKVPPQTSAIITDDGVGINPQQSAGNIFLKHGSELRLIPRDRVGGI

SEQ ID NO: 52706 - protein, 573 aa, Prochlorococcus marinus str. MIT 9313
MALIHGFHLRNVRGDLLGGLTAAVVALPLALAFGNAALGDGGAIYGLYGAVIVGFFAALFGGTPSQVSGPTGPMSVTVAGVVAALAAVGISTALPTVDGPGELLPLVMAAVVVGGLFQILFGVLRLGRYITLVPYSVVSGFMSGIGVIILILQIGPLFGISTKGGVIACLTQLSANFQPNWGAVAVAVMTLAIVFLAPRRLTEVVPSPLLALLIVTPLSVVLFNDANLSARGIDELPRIGTIPEGGLGFSLPSWDPAFLPLIIKSGLVLAVLGAIDSLLTSLVADNITQTRHNSDRELIGQGIGNSLAGLFNGLPGAGATMRTVINVKSGGSTPLSGMVHSIVLLIVLYGAGQFAALIPTALLAGILVKVGLDIIDWSFLLRAHRLSIKTAVVMYGVLLMTVFWDLISAVLVGVFVANLLTIDSLTQAQLEGMDADNRLMDGDFDNKSTGAAANTEEPSLPPSEQALLDRCGGQVMLFRLRGPLSFGAASGITERMALVRNYKVLILDITEVPRLGITATLAIEQMVQEAKNHSRKAYVVAANERVRNRLEKFDVQGLMTNRTQALEAALADL

SEQ ID NO: 52707 - protein, 108 aa, Bacillus cereus ATCC 10987
MLKEINLTELEQQISVISKPILLKFTAEWCPGCRQLAPVVESVSEQFGNQIVFFDVNVDKEIDLAKKFGVMSIPTLVLLKNGKEVDRVTAPAPNEDVIVSFIKNNYNA

SEQ ID NO: 52708 - protein, 912 aa, Acidobacteria bacterium Ellin345
MATTLEPIEASMATPETSVKYVYSFGGGKAEGNGKMKDVLGGKGAGLAEMTNVGLPVPPGFTIQTEACREYMKGGKTSTAVQKEMLAALKQLEELRGKKLGAPSDPLLVSVRSGAKFSMPGMMDTILNLGLNDQSVKGLAERSHNERFAYDSYRRLIQMFGNVVLDIEKSEFEEVFDGKKHQRKVKLDTDLTAKDLQEVIEGYKKLVKKHTKRDFPQDAVEQLSMARDAVFRSWNNDRAKHYRRMNNIDDAIGTAVNVQSMVFGNLGDTSGTGVGFTRNPATGAKEFYGEFLMNAQGEDVVSGIRTPVPIIGLQEIMPHVYEQLRAITTKMENHYRDMQDFEFTIEDGQLFMLQTRNGKRTGRAAVRVAIQMVEEGLISKEDAVMRVEAIQLNDFLVPSLEEKGVKIEVLSKGLPASPGAAVGQIVFSADEAVAKVQKDKAAQVILVRGETTPEDIHGMEVAAGILTSRGGMTSHAAVVTRGMGKCCVAGAGEIEVDEKKREMRVKGKVLKAGDWISLDGISGRVINGKLNTNPARTDDPELMKFMSWAEPFRKMGVRANADIPRDAKQAAAFGAEGIGLCRTEHMFFAEDRIGHMREMILADNEKDRRAALKKLLPMQRSDFAGLFTALDGYPITIRTIDPPLHEFLPKREDLMVQIAQLEITKPKSPKLKELRHLLSRVEQLHEQNPMLGHRGCRLGITYPEITEMQARAIFEAAVQVTKKGIKAKPEVMIPLTTSLKEMKNQADIVRRVAAEVFEEKGVKVEYMVGTMIELPRAAVVADEIAKEAEFFSFGTNDLTQTTFGFSRDDVGKILPTYFELGILKQDPFAQLDQEGVGQLVKMACEKGRSTRPKLKLGICGEHGGDPSSVEFCARVGLNYVSCSPFRVLIARLAAAQAGLAEKTGSAEAGRSK

SEQ ID NO: 52709 - protein, 182 aa, Picea sitchensis
MSASVDGDARVQGIFDAIRVVPDFPKPGIMFQDITTLLLDHKAFRDCIDIFVERYKDKNISVVAGIEARGFIFGPPIALAIGAKFVPIRKPKKLPGEVISEEYALEYGTDRIEMHVGAVQPGDRTLVVDDLIATGGTLSAAMRLLERVGAEVVECACVIELPELKGRERLGGKPLFILVESA

SEQ ID NO: 52710 - protein, 419 aa, Bacillus cereus G9241
MIEIKVPELAESITEGTISQWLINVGDKVEKGGSVVELETDKVNVEIIAEDSGIVSKLLGEPGDTVEVGATIAILDANGAPVAVSTPAPAAEQPKQETAEAPKAAAPSAEQAATLQGLPNTNRPIASPAARKMARELGIDLNDVRSTDPLGRVRPHDVQAHAAAPKEAPAAPKSPAPASVAKTEFEKPVERVKMSRRRQTIAKRLVEVQQTSAMLTTFNEVDMTAIMELRKERKDAFEKKHDVRLGFMSFFTKAVVAALKQFPLLNAEIQGDELIIKKFYDIGIAVAAPDGLVVPVVRDANQLNFAEIESEIRELGKKARDNKLSLKELQGGTFTITNGGVFGSLMSTPILNSPQVGILGMHKIQVRPVAIDNERMENRPMMYIALSYDHRIVDGKEAVSFLVAVKDMLEDPKSLLLEG

SEQ ID NO: 52711 - protein, 470 aa, Kluyveromyces lactis NRRL Y-1140
MTVENENNSYVFQGYITKKLPHVKRGEGCRIVVEKDGKLHEDVFDGITGAAVGALGWGDEDIHGIMTEAAKNHTYTFPSLIGNSQSEELAKFYIENSPKGAFESALWCCSGSEANENAMKIIRQYQLERGQPKRTKIISRESSYHGFTLGALSISSNPRAEQFKEILMDQKELCLKMPVCYPYRFMKKGETEEEYCARLIHSLEQLILDNDPETISVVLVETLPGSSLGTTPPPKGYLSGIRRICNKYDVVFMLDEVMCGTGRSNPNGKLNCWENFLTAEEAPDIQSVGKTLGSGYVTIAGVLVGPKIKKAYAEGSNCMIGSHTYASHGFNCAVALGVQKKILDNDLTKNIFEKGNLMGQKLKKSLLAYDNIVGDVRGIGGFWSLEFVKDRETKEPFPYKLDVGHRFQDVCFENGITVMGMQGNIDGVSGDIALLAPSFIITEDDVSTIVERVTKSVDDMTVLLKAEGHF

SEQ ID NO: 52712 - protein, 491 aa, Musa acuminata
GTRRDRERERERERERERERERERERERERERERERVHLLGSSSLHRSLWELSKKHGPLMHLKFGRVPVVVVSSPEMAKEVLKTHDLECCSRPSLLSFSKFSYGLSDVAFIPYGERWRQLRKLCTVELLSTRKINSFRDIRKEEMERVTKLICSHVRASSMVNLSELLLSLSCNMTCRSAFGSGFDDGGDIQLHDMLREAQEELSGLFLSDYLPLLGWVDRLSGMRSRLERAFLKLDSIYQRRIDYHQDRLRQQGKEDGDVLDALLRMQKDEEGLTEDHIKGVLMDIFIAGTDTSSATVEWAMAELIRQPELMKRAQDEVRRCVGSKGEVEESDLHQLHFFKCVIKETMRLHPPAPLLLPRETMQHFKLNGYDILPKTWMYVNAWAIGRDPNSWGRPHVFDPERFMHDSTEASGQDFKLIPFGEGRRICPGKNLGMLMVELVLANLLYSFDWHLPPGMVKEDISMEEAPGVPVHREYALCLMATKYDATTA

SEQ ID NO: 52713 - protein, 507 aa, Musa acuminata
MALPPLLLSPLPSLLVVLALLSSLLLAGRKARGGSATWKLPPGPPKLPVIGHLHLLGSSLLHRSLWELSKKHGPLMHLKFGRVPVVVVSSPEMAKEVLKTHDLECCSRPSLLSFSKFSYGLSDVAFIPYGERWRQLRKLCTVELLSTRKINSFRDIRKEEMERVTKLICSHVRASSMVNLSELLLSLSCNMTCRSAFGSGFDDGGDIQLHDMLREAQEELSGLFLSDYLPLLGWVDRLSGMRSRLERAFLKLDSIYQRRIDYHQDRLRQQGKEDGDVLDALLRMQKDEEGLTEDHIKGVLMDIFIAGTDTSSATVEWAMAELIRQPELMKRAQDEVRRCVGSKGEVEESDLHQLHFFKCVIKETMRLHPPAPLLLPRETMQHFKLNGYDILPKTWMYVNAWAIGRDPNSWGRPHVFDPERFMHDSTEASGQDFKLIPFGEGRRICPGKNLGMLMVELVLANLLYSFDWHLPPGMVKEDISMEEAPGVTVHREYALCLMATKYDATTA

SEQ ID NO: 52714 - protein, 275 aa, Musa acuminata
HEVDWLRGMRSRLERAYVKLDSIYQRLIDYHQDRFRLQGKEDEDILDALLRMQKDEEGVTEDHIKGVLMNIIIAGTDTSTATVLWTMAELIRQPELMKRAQDEVRGCVRSKGEVEESDLDQLHFLKCVIKETMRLHPPVPLLLPRETMQHFKLNGYDILPKTWMYVNAWAIGRDPNSWARPHVFDPERFMHDSTEASGQDFKLIPFGEGRRICPGKNLGMLMVELVLANLIYSFDWHLPPGMVKEDISMEEAAGFTMNREYALCLMATKYDSPTA

SEQ ID NO: 52715 - protein, 389 aa, Escherichia coli
MKIAVAGVGYVGISIAILLSQKHDIIALDIDPKKVQLINKKISPICDPEIQKFLSNRKLNLYATTEKYEAYRDADYVIIATPTNYDPINNNFDTLSVESVACDVLSINPNATIIIKSTVPVGFTERLKRDLNTNNIIFSPEFLREGKALYDNLYPSRIVVGESSERARKFAELLSEGAIKKDIPILLTDSPEAEAIKLFANTYLAMRIAYFNELDTYASVHGLDTKQIIEGVSLDPRIGQHYNNPSFGYGGYCLPKDTKQSLANYRDVPQNLIQAIVDANTTRKDFVAEDILSRKPKVVGIYRLIMKAGSDNFRASSIQGVMKRLKAKGIEIVVYEPVLKEPYFFGSYVERDINSFKERVDVIVANRRTSELEDVSEKVYTRDLFGVDS

SEQ ID NO: 52716 - protein, 351 aa, Aspergillus nidulans FGSC A4
MHKIASIPGDGIGPEVVSATIQVVNKLASKLGFQIEFTHLPWGTKYYKEHGQFMSDDALDILRKFDAGLFGAVGDPDVPDHISLWGLLLKIRSPLQLYANVRPVRTFPGTKSPLTTAKNGIDWVLVRENSEGEYCGQGGRSHIGHPWEAATEVAVFTRVAIERIMRFAFETARSRPRKKLTVVTKSNAMRHGMVLWDEVAAEVAKDFPDVDWDKMLVDAITIRMVAEPDSLDTIVGTNLHMDILSDLAAGLAGSIGVAPSSNLDPTRKNPSLFEPVHGSAFDITGKGVANPVATFWSSAEMLSWLGEKDAADKLMGCVERVCEAGILTADLGGNAKTQDVVDAVCAEIDRL

SEQ ID NO: 52717 - protein, 339 aa, Escherichia coli
MNILVTGGAGYIGSHTSLCLLNKGYNVVIIDNLINSSCESIRRIELIAKKKVTFYELNINNEKEVNQILKKHKFDCIMHFAGAKSVAESLIKPIFYYDNNVSGTLQLINCAIKNDVANFIFSSSATVYGESKIMPVTEDCHIGGTLNPYGTSKYISELMIRDIAKKYSDTNFLCLRYFNPTGAHESGMIGESPADIPSNLVPYILQVAMGKLEKLMVFGGDYPTKDGTGVRDYIHVMDLAEGHVAALSYLFRDNNTNYHVFNLGTGKGYSVLELVSTFEKISGVRIPYEIVSRRDGDIAESWSSPEKANKYLNWKAKRELETMLEDAWRWQMKNPNGYI

SEQ ID NO: 52718 - protein, 452 aa, Coccidioides immitis RS
MVLLFSLLFLIFHARSVLSSCAHGTFLHPRAAGGIGELPNFDYGPVRGPTNWHSISRENILCAVGLQQSPINLNGRIPIEPVGFVRSSIPRQDILFENLGTTAEVVLNGTTLVRGAGEFRLKQFHFHTPSEHRILGQHFPVELHLVHTSVANPSQIAVIALFFQLTSRGGFSDLERIITHVPRISSPGQTVGLRGFDFGILSRTISSMPMFRYVGSLTTPPCTEGVTFLVGTQPLFMNVEIFNLLKGVTRFNSRFIQADIPGRQNVLLSGLHNIGLTNQQCRRLVSGRELIGKPGRRNGNNRGGRKGKNRQKEVVSTIASGNSTQVVTSTVQQTVTSSNLVTETTRNDQVTTTISSVVASQTAMEDYQRDRDDDRRDDRRDDDDRRDDDDRRDDDDRRDDDDRRDDDDRRDDDRQRQEQDQGRQTVQTTANTATASAAFIQRRNYMPFGRQA

SEQ ID NO: 52719 - protein, 391 aa, Bordetella bronchiseptica RB50
MSAQISSLNAGAAPESFGIASVPEIIAELRAGRIVILVDEEDRENEGDLVMAAEFVTPEAINFMVTHGRGLVCLTLTEERCRQLDLPLMASRNGTRYGTNFTQSIEAAEGVETGISAADRARTIQVAVARDAQPSDLVQPGHIFPVRAVPGGVLVRAGHTEAGCDLTAMGGLTPAAVICEILKPDGTMARLPDLVEFAREHKLKIGTIADLIQYRSEHESIIARMGERMMQTPWGDFRCIAYRDDATRSPHLALVHGNIDPERETLVRVHEPASLLDVLDTGASPHSWSVGQALHAIAASPAGVLVLMNCQSSTEHLFGQIANWAGPAERAAAQEGDRFGLRTYGIGAQILRDLNVGRMKLLARPRKMPSMAGFALTITGYDCAPPNLRND

SEQ ID NO: 52720 - protein, 2151 aa, Arabidopsis thaliana
MYYHSLSSYSILFFLFSLFHHLPCASSNQGLGWCESLFQCGNITADFPFWGGNRHKPCGHPLLELHCNNNNITSLYISNQEFYVRQINQTSNTLTLARSDLLGSFCSSYAYNTTTLPPEIFELSPTYKSLTVLYHCDPKLSYRSSYTCPALGTFSMSQSVDYQYSCQNSFTVNVPTSFHPEERGLNLTNLESALRKGFEVKLVIDEIPCQQCSSTRGICSFNGTTQSCCNATSPSGGVSCVPYQHSADEVYRRCSESFSCGSQRDLNYPLWKPGREECGHPNFKLNCSGGFAEINIASVKFRILDSYRSLIRLARSDYIGDLCPANPLTAPFIEKFLPVLELTGETELLTLYYGCRFNSSDIPANIYVGELGCDEGRSYYVTRNLSSPLLDSSRGVLNNLREMCKRNVSVPASGPALFDLQTRPNQDNLKMALDQGFRMLITSDCERCRGSGGACGYNQTSSGFGCYCKDGKCGYEYDALGALTGVVIVFLVLLCPCFRVQIFRKRKTSDEVRLQKLKALIPLKHYTYAEVKKMTKSFTEVVGRGGFGIVYSGTLSDSSMVAVKVLKDSKGTDGEDFINEVASMSQTSHVNIVSLLGFCCEGSRRAIIYEFLGNGSLDKFISDKSSVNLDLKTLYGIALGVARGLEYLHYGCKTRIVHFDIKPQNVLLDDNLCPKVSDFGLAKLCEKKESILSLLDTRGTIGYIAPEMISRLYGSVSHKSDVYSYGMLVLEMIGARKKERFDQNSRSDGSSIYFPEWIYKDLEKANIKDIEKTENGGLIENGISSEEEEIARKMTLVGLWCIQSSPSDRPPMNKVVEMMEGSLDALEVPPRPVLQQISASSVSDSFWNSEESSSASDILVFSTNSKLESSNLYFSPVITLPTLNSTNNILQREETVKTENKSQESIPEVKTPIIVSWNETERLSQRLASFCPKVSEFGLAKLCEEKESILSMLDTRGTVGYIAPEMISRVYGNVSDKSDAYSYGMLVLEIIGARNKEKANQACASNTIQCTFLNGHIEDGINSEENELAKKMTLLFAAQVDAQRSTSPWQTLSGDAPLVIARGGFSGLFPDSSLAAYQFAMVLTKDGHGICFPDLNLANASNSEEVYPNRQKSYPVNGVTTKGWFPIDFSLTELQKVLFSLIRGILSRSGKFDENGYSISTVQNVATQMKPALFWLNVQHDEFYEQHNLSMSSFLLSTSRTVSIDFISSPEVNFFRKIAGGFGNNGPSFVFQFMGKEDFEPTTNRTYGSILSNLSFVKTFASGILVPKSYILPLDDKQYLLPHTSLVQDAHKAGLKLYASGFANDVDIAYNYSWDPVSEYLSFVDNGNFSVDGMLSDFPLTASASVDCFSHIGRNATKQEQKHYHLPMVRASVDFLVISKNGASGEYPGCTKLAYEKAIKDGSDVIDCPVQMSSDGIPFCSSSIDLVNSTTVGQTHLRNRSIIVPEISSVAGIFTFSLTWHEIQSLTPAISNPFRENGMSRNPNERNSGNLISLYEFLNLAKNSTSLSGILISLENVVYLREKKGLDVVKVVLNRLTETGYIVGTLKVMIQSTTRLVLVDFKNQSTYKTVYKIKETIGNITDSAIEDIKKFANAVVINKASVFPNSDSFLTGQTTNVLERLQKFQLPVYVELFQNEFVSQPFDFFADETVEINAYIFGAGINGTITEFPYTAARYKRNRCLGREEVPPYMLPVNPGGVLTLISTSSLPPAQDPNPIFTHDDVTEPPLPPVIAKSPTSTLGTPSTIAKPLSLFITFLLLLDQVWFHSDNFFLLNGCTGNFLKVIRIVSWSVAGVVLFLVLLTLVFCFHRKRETRLRQQKLKALIPLEHYTYAQVKRITKSFAEVVGRGGFGIVYKGTLSDGRVVAVKVLKDTKGNGEDFINEVATMSRTSHLNIVSLLGFCSEGSKRAIIYEFLENGSLDKFILGKTSVNMDWTALYRIALGVAHGLEYLHHSCKTRIVHFDIKPQNVLLDDSFCPKVSDFGLAKLCEKKESILSMLDTRGTIGYIAPEMISRVYGNVSHKSDVYSYGMLVLEIIGARNKEKANQACASNTSSMYFPEWVYRDLESCKSGRHIEDGINSEEDELAKKMTLVGLWCIQPSPVDRPAMNRVVEMMEGSLEALEVPPRPVLQQIPISNLHESSILSEDVSVYTEG

SEQ ID NO: 52721 - protein, 209 aa, Brassica napus
  misc_feature (191)..(191): Xaa can be any naturally occurring amino acid
  misc_feature (201)..(201): Xaa can be any naturally occurring amino acid
MGSVSLKIGDGTARFRRTSVYSSAVNLLMLFSVVTTNLFALYAFSSHSQSSSHPLHHSNNISLVSQHLSLILREIDSSQRKLAQMEKQILGYESIDLSRPNIVPELKLFLHRHQLPLGKDSRTGITEMVSAVGHSCERSPDLLSQYMSYKVFDRCPDDWSLGQKLILRGCEPLPRRRCLAKTVAKQDLKPXPDSLWRPVSXKSVNWSGL

SEQ ID NO: 52722 - protein, 330 aa, Oryza sativa Japonica Group
MGNSRRPAAAATAPSPSPPASDLEVGFAKLQGEDFEYYMQTYSIVLGRHSRRRNQPVGVGVGVGVGGGGGGGGDAAADDVDVDLGILGGGMNVSRRHARIFYDFPRRRFALEVLGKNGCLVEGVLHEPGGEPVKLDSQDLLQMGDAQFYFLLPTRSVFATDAARRASAAARRAVPPPPSSSSDGDDGEEEREAAVAKRPRNGDAGSLAGRKSEKGSKGYRQSDNLQLLQLEEKDVISSTATVLSDLCGPQEWVPMDRLHEVMFEKYGDLWHHNRVRKYLTSEDWPKSETDGRPWHGLSLLLRKYPEHFVINIRMSGGRSIEFVSLVSLQP

SEQ ID NO: 52723 - protein, 70 aa, Vitis vinifera
MVNATKGLFISCDIPMAQFIINMNASMPASQKFIIHVLDSTHLFVQPHVAEMIRSAISEFREQNSYEKPA

SEQ ID NO: 52724 - protein, 171 aa, Acidobacteria bacterium Ellin345
MIRSYKGKSPVVPGTCYVDVSAQLIGDVELGEHASIWMNTVLRGDVHSIRVGANSNIQDNSVLHGMLGKWPVIVGDWVSVGHSVTLHGCVVEDRCLIGMGSIILNGARIGAGSIIAAGTLIPEGAVVEPGSLWMGLPGKMRRKLVDEDQQTILQYAKNYLGYKENYLSELK

SEQ ID NO: 52725 - protein, 345 aa, Synechococcus sp. WH 7803
MTIRIGINGFGRIGRLAFRQAMACPDVEVVGVNDLIAVDYLAYLLRYDSTHRQFQGEIRVEDGALVVNGQRIRITAERDPSQLRWNEIGADYVLESTGFFLTGPLAQAHLDAGAKRVVMSAPSKDDTPMFVMGVNHTSYAGQSIVSNASCTTNCLAPLAKVVHDNFGIVSGLMTTVHATTATQKPVDSPSLKDWRGGRGAGQSIIPSSTGAAKAVGRVIPELNGKLTGMAFRVPTPDVSVVDLTVNLDQPTSYENLKQTIKQASQNGLSGILGYTEDPIVSNDLLGESCTSVFDAGAGMALNDRFMKLVAWYDNEWAYSCKCIDLIRHMAQYPEKFIASSKPTNQ

SEQ ID NO: 52726 - protein, 345 aa, Prochlorococcus marinus str. MIT 9313
MFGLIGHSTSFEDARKTALQIGYDHLDGDLDVWCSAPPQFLEQIEVESLTGKKIEGAYIDSCFVPEMLSRFKTARRKVLNAMEMAQKRGIQISALGGFTSIIFENFNLLKHQHVRNTTLEWERFTTGNTHTAWVICRQLENNAPLLGIDLSKARVAVVGATGDIGSAVCRWLSARTGVAELLLVARQQQPLIDLQTELAGGRILSLEEALPEADVVVWVASMPRTLEIDMESLRKPCLMIDGGYPKNLDAKFAGSGVHVLKGGIVEFCNDISWDVGWIAEMDKPARQMFACFAEAMLLEFENCHTNFSWGRNQITLEKMDFIGMASLRHGFSSLNLNHQLQAAAA

SEQ ID NO: 52727 - protein, 358 aa, Haemophilus influenzae R2846
MQSYNIAVLAGDGIGPEVMAEAIKVLNKVQEKFGFKLNFNEFFVGGAAIDHCGYPLPAETLKGCDEADAILFGSVGGPKWTNLPPDQQPERGALLPLRKHFKLFCNLRLATLYKGLEKFCPLRADIAAKGFDMVVVRELTGGIYFGQPKGREGESSQTKAFDTEVYYKYEIERIARAAFEAAMKRNKKVTSVDKANVLQSSILWRETVTEIAKDYPEVTLEHIYIDNATMQLIKAPESFDVLLCSNIFGDIISDEAAMITGSMGMLPSASLNEEGFGLYEPAGGSAPDIAGKGIANPIAQILSAAMMLRYSFNLNEAADAIESAVQKVLANGHRTADLADDSTPVSTSEMGTLIAQAI

SEQ ID NO: 52728 - protein, 476 aa, Cryptococcus neoformans var. neoformans B-3501A
MPSFEPAVSSHIAPLPSASKPLPLTTSTEGLQALADKHITKGLGRLRDHVFKEGKGLRVLTTENQKLLDFTSGIGVTSLGHAHPDVTAAIISQAQSIIHVQCAIGLSEPYVQLVESLLTMMPDPSLDSFFFWNSGSEAIEAAIKVSRTKTKRNNIVVMQGGYHGRTSGAAALTRSKTSFFRGTGPLMPCVYTTPFPYWHAMGLPKDTPEEVLTEQAILGIENLLQQQTAPEDTAAIFLEPVIGEGGYIPAPTAYVKHLRKLCDKYGIMLVIDEIQTGFGRTGKTFAIEHTGVTPDIMVYAKGFANGMPISGIVTRKEIMDVMAPGSLGGTYSGNVVACAAALATTRYMRTHDILGNVQARSEQLFKGLREIQEDEANGGWMIEEVRGKGLMIAIEFKDPNSKLTSSHNRGDISLPGNLNKLVQDACYDRGLLVLTTSIYPVLRLIPALVLSEEEVDEALKIIKESVKEVASVIEGN

SEQ ID NO: 52729 - protein, 359 aa, Cryptococcus neoformans var. neoformans B-3501A
MPSNSRQHNIAVIPGDGIGIEVTASTLKVLRAVQKKVGGFELSFDELDYGSARYKAQGSYTPAGWLDHLRKSDAIFFGAVGDPDVPDHISLWELILPMRQTFQQYVNIRPSSILPGIPSRIVGTKPGDLDWIIVRENTEGEYAGQGGRTHVGTEWEVATELAVFTRKGVERVMRFAFETAQSRPKKLLTVVSKSNAQRYGLLLWDEVAEIVSKDFPDVKWDKMLVDAMTVRMVAKPTSLDTIVTTNLHGDILSDLAAGLSGSIGIAHSASLDPTRTSPSLFEPVHGAAFDIMGKDLANPIAAIMSAAEMLRWLGENEAADLVEKACKQSIADGQTTGDLGGKLKTSQVTEAVCKILETL

SEQ ID NO: 52730 - protein, 326 aa, Zea mays
  misc_feature (14)..(14): Xaa can be any naturally occurring amino acid
  misc_feature (151)..(151): Xaa can be any naturally occurring amino acid
QVAERLEKFKTTIXTQMSMLAIKHGAINLGQGFPNFDGPDFVKEAAIQAINAGKNQYARGFGVPELNSAIAERFLKDSGLQVDPDKEVTVTSGCTEAIAATILGLINPGDEVILFAPFYDSYEATLSMAGANVKAITLRAPDFAVPLEELXAAVSKDTKAIMINTPHNPTGKMFTREELESIAALCKENDVLLFSDEVYDKLVFEADHISMASIPGMYERTVTMNSLGKTFSLTGWKIGWAIAPPHLTWGLRQAHSFLTFATCTPMQAAVWAALRAPDSYYDELKRDYSAKKAILLEGLEAASPSAKDEGTLRAAVERLKAKLRRK

SEQ ID NO: 52731 - protein, 552 aa, Sarcina ventriculi
MKITIAEYLLKRLKEVNVEHMFGVPGDYNLGFLDYVEDSKDIEWVGSCNELNAGYAADGYARLRGFGVILTTYGVGSLSAINATTGSFAENVPVLHISGVPSALVQQNRKLVHHSTARGEFDTFERMFREITEFQSIISEYNAAEEIDRVIESIYKYQLPGYIELPVDIVSKEIEIDEMKPLNLTMRSNEKTLEKFVNDVKEMVASSKGQHILADYEVLRAKAEKELEGFINEAKIPVNTLSIGKTAVSESNPYFAGLFSGETSSDLVKELCKASDIVLLFGVKFIDTTTAGFRYINKDVKMIEIGLTDCRIGETIYTGLYIKDVIKALTDAKIKFHNDVKVEREAVEKFVPTDAKLTQDRYFKQMEAFLKPNDVLVGETGTSYSGACNMRFPEGSSFVGQGSWMSIGYATPAVLGTHLADKSRRNILLSGDGSFQLTVQEVSTMIRQKLNTVLFVVNNDGYTIERLIHGPEREYNHIQMWQYAELVKTLATERDIQPTCFKVTTEKELAAAMEEINKGTEGIAFVEVVMDKMDAPKSLRQEASLFSSQNNY

SEQ ID NO: 52732 - protein, 500 aa, Cryptococcus neoformans var. neoformans B-3501A
MPSLTQTKDLASLLSDASHFKQKGYINGEWVSASDGATFPLYNPATGAKLADMPHMPRSQVAEAINAAKAAFPAWAALTAYQRQNYLLKLFKEMEEHSEDLAIILCTENGKPLAESRVEISYGASFLTWNAAEALRTYGQTIPSPFPGTRNTVIKQPIGVCGLITPWNFPNAMITRKMAPALAAGCTVVIKAPAETPLSALAMCVLCERVGIPPGVVNVVTMDKGQREMAAGLELCENVKVSKISFTGSTPVGRLLMKQSSGTLKKLSFELGGNAAFIIFDDADLDLAVNGVILSKFRAAGQTCICANRIFVHSKIYDDFARRLVERVKAFKVGNGIEEGVTIGPLVSQRGVEKVERHVQDAVGLGAKVLVGGKRIDKGEGSCFYEPTVLVDVPRQCAVSNEETFGPLAPLFKFDDEDDVVERANSSEVGLAAYFFTKDLARTHRVAEKLEVGMVAVNTGAIAQACVPFGGVKQSGFGREGGPSGIDEFMVEKLITIGGL

SEQ ID NO: 52733 - protein, 713 aa, Cryptococcus neoformans var. neoformans B-3501A
MTSSKPLHQLPFAARTLQSSVPQLPLSSQPSAQRRSTIFKSSTPGIWARVNPMWAPWPIRVSKEEAEDLGINVEKGEKIDAEDIMKSWEPCEVLEQGAENGLDVKSSKRRVKLDPVILGISPSALKDSLPHLDVGDLLEICKTGEQPTNGDPAREIFIDVLSGRKVLASDSYGPWATRYSGHQFGGWAGQLGDGRAVSVLETESEQGGRQEIQLKGAGRTPFSRADDGLAHLRSGVREFLGCEAVAALGIPTTRALTLLTIPLPYLPVFREGTIHPSSLLTRVAPSFIRVGHFEALNPPSSAAGGKQFFVGGGGWVDDQTDEEGEDEGNGNFEGLRDLGEWMKEIMEVKEGWKSWVDEVIKKNAEMVAKWQVYGYMNGVINTDNVTLMGITIDYGPYAFMDVFDQKHISNQSDPTGMYAYRNQVSRVQFALSKFIDSVSPLLGYESIHGDIPKGWSEGKTKEDIREWSEKGKEVMKGWEKSFEEYEEESEMNGWYQRFGLKTKQQFDQRDIKYDFLNYLQLHNLDFHTAFRGLCEFSPTKASQESGDKYIKEFVPHWVKSAVDESASDDSLKLVEGDFVQWFGMYAKRANLEDEKFAWGTTDDWEPARAANMRKKNPTFVLRQWILEELLGKMEEALTDPYKAAQSKDDVDKQKVEEGVRTARRELWKILEMATKPFENWGQGEGSREELEAQRRLCGVGAKEMFGYQCGCSS

SEQ ID NO: 52734 - protein, 154 aa, Vibrio vulnificus
MHKKSSTLIRKREISDVTKESKVVLKSDQQWREQLSEQEYHVCREQGTEPPFSGKLLHNKDSGEYACTCCHAPLFSSVNKYDSGCGWPSFDAPINETAVLYLDDFSHGMKRVEIRCARCDSHLGHVFPDGPKTTGERFCVNSVSLIFNKIETNE

SEQ ID NO: 52735 - protein, 509 aa, Vitis vinifera
  misc_feature (500)..(500): Xaa can be any naturally occurring amino acid
MGTHVESFWIFALVSKCEALSLASIAWVVFFAWFLLSMIFWAYPGGPAWGKYRWRKASPSASMGKPIPGPRGFPVVGSMKLMASLAHHRIAAAAEACGAKRLMAFSLGETRVIVTCNPDVAKDILNSSVFADRSGEGVGLQSDVQQSNWIKASEAQRAEIAAEMAAMFGENTEPFRVRDVLKRASLSSMMCSVFGRKYQLDSSNNEAHELRTLVEEGYDLLGTLNWSDHLPFLGDFDPQKIRMRCSNLVPKVNRFVTRIIAEHRARTTEKIRDFVDVLLSLQGPDKLSDSDMIAVLWEMIFRGTDTVAVLIEWILARLVLHPDVQSRVHDELDRVVGESRAVAESDITAMEYLPAVVKEVIRLHPPGPLLSWARLATTDTTVDGHHVPAGTTAMVNMWAITRDPNVWSDPLEFKPDRFSGMGADTDISVFGSDLRLAPFGSGRRVCPGKTLGLTTVTFWVASLLHEFEWKPLDGNNNVDLSEVLKLSCEMEKPLTVKVHXRRSTSTSSP

SEQ ID NO: 52736 - protein, 214 aa, Hordeum vulgare subsp. vulgare
MDHCGVGLYGEYATVTSAPPKRPAGRTKFRETRHPVYRGVRRRGAAGRWVCEVREPNKKSRIWLGTFATPEAAARAHDVAALALRGRAACLNFADSAALLRVDPATLRTPEDIRAAAMALAQAACPHDAASSSAPALKAASAPAPAMVMVQEAAAAPYDSYATALYGDLTDLDMHSYYCYDGMSGGGDWQSISRMDGADEDGIYGAGDVALWSY

SEQ ID NO: 52737 - protein, 547 aa, Microcystis aeruginosa PCC 7806
MITIGEYLFQRLHNLGVNHIFGVPGDYVLDLMDVLVESPIELVCTCNELNAGYAADAYARVKGMGAVCVTYGVGGFSLVNAVVGAYAERVPLVVISGASDRSIRRDNLLLHHTTGDYNLQFSIMEKVTVASVILTNSAQAASQIDQALAACLHHKRPVYIEIPRDLVYRPCIPSENPIYLTDNLTDTAALEEAIEEAVLLLEKAEKPIILAGVEFHRFKLQDKLLKLLEVTGYPLATTILGKSSISEMQPQFIGTYVGALSREYVSQRVENADCVLCLGAIMSDMNLGGFTANLNPNNLINANSEKVKIKHHFYQPVFLGDFIDGLIDKLSHKEAATLEIKPAAELKDLEFIAVPEQKLTNARFYERMNHFIAQESFVISDTGDAIIATIDLLMPQQTDFIGQAFYLSIGYSIPACLGVALAAPNTRPIVFVGDGAFQMTAQELSTIIRHHLNPMIFLINNDGYTIERVIQDNIYNDLQPWKYHQLPAVFNGESWSCQVRTEGELEKALSIAQGNIDRLSFIEVHLDRFDCSPGLIRLGQAVRSPHA

SEQ ID NO: 52738 - protein, 271 aa, Frankia sp. EAN1pec
MRTIVLVGATSGLGRHAAHILKEAGHRLVLVGRDPKRAAQLAHDLPTATVIAADISTAAGIDLVAEKVHAVVDRVDTLVNNAGVMLPTRRTTSEGIELNLAVHHLAPYSTTARLLPLLRHGDGRIINVNSEGHRAPMRGAGPVHLDLTDLNSERRYDPFLTYSRTKLANLLFTYELQRRHPELTVAAVHPGMVRTNLGRHFPRLRVALLLPFMMSPRQGARPVIHLASAPTISAGRYYDRLRPVSSSPASYDTNTARRLWEITSDIRGPFG

SEQ ID NO: 52739 - protein, 309 aa, Acidobacteria bacterium Ellin345
MIKNLRMLRLAKNKAEFQQLKEFFSQLGLRDGEHWEARSNSGHVFLVEDGGIELGVGEGFPEADLVFEVNDADGVYELLKKKGWKKLGKPEDQPFGARLFTAEVGGQNVAFYNYLPENQHHVAKEREATLNARGKRFALVVSRFNSFITERLLDGALLALRHAGVEKQDMQVVRVPGAFEIPGAARALAESGKFDGIITLGCLLRGGTLHYEVIANEVTRGVGQSAQETGVPHGFGVLTCDTLEQAIDRAGLKAGNKGYEAAMAAIEMVNLKLSAERKLSKPEPKAKAKDLMKTRALTPVRAVKRQGEK

SEQ ID NO: 52740 - protein, 180 aa, Brassica napus
  misc_feature (162)..(162): Xaa can be any naturally occurring amino acid
MANAWKRDKNQKLLAPKSLIITLLVLSIIFLSSLFFFSSSSSYLQNTNPNPTISTKFPIPPFDCFKCPQSKPVIANVVENLKYPFLYSLADLGNLPEKPHKNIVRLLKGKPFRKPDISATIQEVLERMKAEGKRDGFVVDVGANVGMASFAAAAMGFKVLAXEPVFENLQRICDGICFNR

SEQ ID NO: 52741 - protein, 274 aa, Saccharum officinarum
MAEASTYPLDAVKTRLQLHRNPGGSGGRGVVRVAAELVRDGGVYRGFSPAVLRHLMYTPLRIVGYEHLRSTLASEGREVGLFEKAIAGGLSGVAAQVVSSPADLMKVRMQADSRMLNQGIQPRYTGIADAFTKIIRAEGFRGLWKGVVPNAQRAFLVNMGELTCYDQAKRLIIRKQICDDNLYAHTLASIASGLSATTLSCPADVIKTRMMNQGKEGKAMYRSSYDCLVKTVRHEGVTALLKGFLLTWARLGPCQFVFWVSYEKLRQASGISSF

SEQ ID NO: 52742 - protein, 194 aa, Picea sitchensis
MASAIMSSAAAMAAVAAPLKTSNGNGSSSSGNVVSAFTGLKSTAQFPSSMKTNNAGAEWERKTTSNGGRVRCMQVWPPYNNPKFETLSYLPRLTQEQLLKEVEYLLKNKWVPCLEFDEDGIIKRKYGSTPGYYDGRYWVMWKLPMFGCTEASQVLNEVNECAKAYPKAFIRVIGFDNVRQVQCISFIVHKPEYN

SEQ ID NO: 52743 - protein, 256 aa, Physcomitrella patens subsp. patens
MVMAKVEVGAAPSLNVAERADGRSASQLRPLSLSRGLLTRAHGSATWSQENTTVLAAVYGPKPAAMKKENAERAIIEVVWRAKSGLSGSYEKDAEVVVRRSLEYIILTALHPNTAISVILQVINDDGSLLACAMNAACAALVDAGIPLNGLLSAVSCGVTHDGQVFLDPTKPEEQKCKAYVSFVFPSRRLSAVPELPADVDGEPVEYGILTSVTRGAMEVEEYFSCVENCRAAAAKVSEFSRSSIEQSLKGNRDGC

SEQ ID NO: 52744 - protein, 768 aa, Coccidioides immitis RS
MSAETATNPPVDTTPGAAPESATNGSNANVAADTTAGEASQTTSSTTPTAQPHSASLYVGELDPSVTEAMLFELFSSIGQVASIRVCRDAVTRRSLGYAYVNYNNTADGERALEDLNYTLIKGRPCRIMWSQRDPALRKTGQGNVFIKNLDTAIDNKALHDTFAAFGNILSCKVAQDEFGNSKGYGFVHYETAEAAQNAIKHVNGMLLNDKKVFVGHHIAKKDRQSKFEEMKANFTNVYVKNIDQDTTEEEFRDLFEKFGEITSATLARDAESGKSRGFGFVNFTSHDNAAAAVEALNDKDFKGQKLYVGRAQKKHEREEELRKQYEAARIEKASKYQGVNLYIKNLSDDIDDEKLRELFSSYGTITSAKVMRDFAPESTSDSEKEAKKDSKEPETKEEEPKDEAGDNAENKDNKENKAESKKSEKKPLGKSKGFGFVCFSSPDEASKAVTEMNQRMVHGKPLYVALAQRKDVRRSQLEASIQARNTIRQQQAAAAAGMPQPFMQPAVFYGPGQQNFIPNQRGGMPFQQPGMVIPGMPGGRHGQFGGFPGQQGGRGMNPNQQIPPNAYGIGAQGLPMGMQGAGIPNGLNYPQMGQVQAPFGRGRGQAPSGQGMPPNVQGMGPGGQYGRGMPVQQGMGRPGQAGRGQGAPAQAVGQRDENASPNGLTLQVLNAAPPAQQKQMLGEAIYPKIQAQQPELAGKITGMLLEMDNAELLALVDDDAALKAKVDEALTVYDEYVKNKGGDSGEPAADANKSKDASQETAEETKS

SEQ ID NO: 52745 - protein, 299 aa, Glycine max
MTSSRPPPSKSVDLDLTIVSAKHLKNVNWKNGNLKPYVVFWVDPERRLATKSDDSGNTSPVWNERFALPLPLPLHDSFLTLEIFHSKPSDTPKPLVATLRLPLKDLHDLHDSTRLRKFPLSRPSGRPHGKIHLKLGLLGRPQFDYASPNPNPNPNPSPNFVCYRGYTPSPSHSHSHSPSPPPSPYTSYTDSYSGYYPGYYSGAPPPPPPRPFFDRYAGSSGPSAPLDYSSTYDSKPKAPKMGLGAGLAVGAVAGALGGLALEEGLNYEEDKIAERVENDVTAANVAAARDNYSDYRVDY

SEQ ID NO: 52746 - protein, 396 aa, Pyrococcus horikoshii
  misc_feature (1)..(1): Xaa can be any naturally occurring amino acid
  misc_feature (19)..(19): Xaa can be any naturally occurring amino acid
  misc_feature (61)..(61): Xaa can be any naturally occurring amino acid
  misc_feature (101)..(101): Xaa can be any naturally occurring amino acid
  misc_feature (130)..(130): Xaa can be any naturally occurring amino acid
  misc_feature (142)..(142): Xaa can be any naturally occurring amino acid
  misc_feature (193)..(193): Xaa can be any naturally occurring amino acid
  misc_feature (269)..(269): Xaa can be any naturally occurring amino acid
  misc_feature (280)..(280): Xaa can be any naturally occurring amino acid
  misc_feature (344)..(344): Xaa can be any naturally occurring amino acid
  misc_feature (348)..(348): Xaa can be any naturally occurring amino acid
  misc_feature (362)..(362): Xaa can be any naturally occurring amino acid
  misc_feature (377)..(377): Xaa can be any naturally occurring amino acid
  misc_feature (395)..(395): Xaa can be any naturally occurring amino acid
XARVVVDAQAARAIGKGAXIVFKKGVVRVEGDIKPGDIVEVYTRGGKFLGKGFANPNSNIXVRIVTKDKDVEINKDLFKRRIKKANEYRKKVLKYTNVYRXVYGEADYLPGLIVDRFNDIASLQISSAGXERFKLDVAEAIXEVEPGIETVFEKNTGRSRRREGLPEIERVLLGKEKYRTIIQEGRAKFIVDXRGQKTGFFLDQRENRLALEKWVQPGDRVLDVFTYTGGFAIHAAIAGADEVIGIDKSPRAIETAKENAKLNGVEDRXKFIVGSAFEEXEKLQKKGEKFDIVVLDPPAFVQHEKDLKAGLRAYFNVNFAGLNLVKDGGILVTCSCSQHVDLQXFKDXIIAAGAKAGKFLKXLEPYRTQAPDHPILXASKDTEYLKCLFLYVEDXR

SEQ ID NO: 52747 - protein, 372 aa, Oryza sativa Japonica Group
MASSISVMASAGRNRGVGFAKLQGEDFEYFMQTYSIILGRDSKREKVDLDISGGDLTISRHHAHIFYDFECKRFSLLVLGKCGCTVEGVLHLPGGSPIKLDSQDLLQIGHKKFYFLLPTRSIFGTSSNQHGPSASAAFQPANNGTAADEHNLTASAAAQPAHIGTAAPPPHIGTAQPGQIGIVTLPPAHIQNNAENENIAGIETQEEFMNQNKMPFGELDTCSSHHITIEPTLAPGGQPVNNLAIRPADNNKDQQEVLLKEEEYVLASIGIVISDLCGLKKMIPIEKLHSELVACYSATWPQRQVQMHLAPEAGSSAAGTECKPWLKLMYLLRKYPERFTVMNSSCDEEGRQHRCVCTLYGDGTVCVFLKRT

SEQ ID NO: 52748 - protein, 732 aa, Kluyveromyces lactis NRRL Y-1140
MESQTGGSRGGSITEWDRKPWLKQVTLRSTIIGLIIGSLVLVSNFQFGLQTGWVSMMSLPSALLACAVFKQVWPLVFPNDSQFSDVENVYVQSIAVAVGTGPLAYGFVGVVPAIEKFLTDEESGGTRHMGEAFSFNELLMWSAALAFFGIFFAVPIRKQVIVREKLPFPSGSATATLISVLNGSEILQEVTTQELVEMKERRLREYGEVLCSDDETNCEISPLLRNGNSNAPNSYTSADSNGSNETNVNHLVPSTSKGVPTYRENVSVLMKTFSASALYTVTSYFVPAVKSIPMFGNYASDVYLWNIEPSPAYVGQGIIMGLPTVSYMLFGCILGWGILAPLARYNRWVDPEANVHDWENGVQGWIIWTSLSIMVVDSVVGFIVFTIRSIVKFILLDDKMEMFNSVLDDSIQSMLLEEERVLNDSRGRHENTVKLVSTEIDHEVDSKHLVAYTTVLSGLAISFILCVTVMIYLFGIDIIPLYSIVSALVIASFLSILAVRALGETDLNPVSGIGKLSQLLFALIIPNSQNGSVLLNLVAGGVAEAGAQQAGDLMQDLKTGHLLGASPKAQFIAQSIGAAWSIVLSSIVYKLYNKIYDIPNQQFRIPTAVVWIDCARLVTGKSLPDKALECSLVLGSIFAVLSLIKNCLRDRGYKWVLWIPSGVAVGVGIYNSPSFTIERFAGGMLAHIWLRTNRGNPDAKTKMIVFSSGLVLGEGIFSIVNMFFTGIGVPHF

SEQ ID NO: 52749 - protein, 917 aa, Botryotinia fuckeliana
MPSLHGLWSHINVTLANLTNNRDEDGDHIDSDTPRSGVATPQPDPSDKRTPGILHSFYGQVGLGSSSSQNSAKHISRTSQNPNTSALEGHYTSPRQRFEAEGALLKATPSSLDERRIDGGVEKENSLLPPHELLGSSQISKQQYPYPTPPVSHPSSLHKVKLSDASFEDIGNNVQKTAAPTDRDCISESIPSHARRASSMTPLSNIVTPSNVHAAHFSNPSDTPSEHKLSTPPLSRLNSEFHKSPSYDRLKKLTCDGLKSIPSTPTRALSNQTSKSDQSVMSTNSEHVAQNGKSGASERPAVTPRTDSSMGGTVVPPKGKLTVKINEARGLRRSVDPYVVAVFQRNELVSKGPQSEEDDEDDGNSHSPGGIPIGGIPIGGIPITRSGSDSGRSMAIPMKSRQSSNTSLSEYRDFKNKGRKMFTHPKWDAEAVFDVVGSDTRVNITIYDRAQQAEEFLGHVDLQANLVENVDAPVSGWFQLRGKDMTSNAGNVGEVHVEISFQRTEKRHYGPDDFQILKLIGKGTFGQVYQVRKKDTKRIYAMKVLQKKVIVQKKEVAHTVGERNILVRTATADSPFIVGLKFSFQTPTDLYLVTDYMSGGELFWHLQKEGRFDEQRAKFYIAELILALEHLHKHDIVYRDLKPENILLDANGHIALCDFGLSKANLTKNATTNTFCGTTEYLAPEVLLDEAGYTKMVDFWSLGVLVFEMCCGWSPFYAEDTQQMYKNIAFGKVRFPRDTLTTEGRNFVKGLLNRNPKHRLGATDDAEELKRHPFFQDIDWHALTQKLITPPFKPKLKSETDTSNFDPEFTNALNGASSLNARAAALAAGMATSTPLSPGMQANFKGFTFVDESSIEENMKDRIKDEYEDRMDQDNNDPERDWEDTFDIPDKSRMDRMSGVVRNHNEDERMFNGDDFH

SEQ ID NO: 52750 - protein, 328 aa, Kluyveromyces lactis NRRL Y-1140
MPASSDKLQPKDQQTIELEQKLAVQSIRVFLQSKTSYDVLPVSYRLIVLDTSLLVKKSLNILLQNNVVSAPLWDAQTSKFAGLLTSSDFINVIQYYFHNPDKFELVDKLQLNGLKDIERAIGIQPYDTRSIHPFRPLYEACVKMIESRSRRIPLIDQDEETQREIVVSVLTQYRILKFVALNCKEIRYLKRPLRELDIISTNNIMSCQMSTPVIDVIQLLTLAGGVSSVPIVDEQGKLVNVYEAVDVLGLIKGGIYNDLSLSVGEALMRRSDDFEGVFTCTENDKLSSILDTVRKSRVHRFFVVDSNGFLTGVLTLSDILKYILFAES

SEQ ID NO: 52751 - protein, 132 aa, Leptospira interrogans
MMNYEVNKSDEDWKKELTPEQYRILRQKGTEMAFTGALYKNQDKGTYVCAACGAVLFSSDTKYESGSGWPSFYQPVKDGVVDKQKDSSHGMERTEILCSKCGGHLGHVFNDGPRPTGLRYCINSASLKFQKE

SEQ ID NO: 52752 - protein, 510 aa, Roseovarius nubinhibens ISM
MKDILQTLEDRRGQARLGGGQKRIDAQHGRGKLTARERIDLLLDEGSFEEFDMFMTHRCTDFGMEENQPYGDGVVTGWGTINGRQVYVFSQDFTVLGGSVSATHAQKICKIMDMAVQNGAPIIGINDSGGARIQEGVDSLAGYGEVFQRNIMASGVVPQISVIMGPCAGGAVYSPAMTDFIFMVKDSSYMFVTGPDVVKTVTNEQVSAEELGGASTHTKKSSVADAAFENDVEALAEVRRLVDFLPLNNRQKPPKRPFFDAPDRVEPSLDTLVPDNPNTPYDMKELILKLADEGDFYEIQEDFAKNMITGFIRLEGRTVGVVANQPMVLAGVLDIDSARKAARFVRFCDCFDIPILTLVDVPGFLPGTSQEYNGVIKHGAKLLFAYGEATVPKVTVITRKAYGGAYVVMSSKHLRGDFNYAWPTAEVAVMGAKGATEIIHRADLGDPEKIAAHTKNYEDRFANPFVAAERGFIDEVIMPRSTRVRVSRAIASLRNKAHDMPWKKHDNIPL

SEQ ID NO: 52753 - protein, 243 aa, Vibrio kanaloae
EGGNLIVNGKTVRVTAERNPEDLKWDAIDVDVVAEATGLFLTDETARKHITAGAKKVVLTGPSKDATPMFVMGVNQASYAGQDIVSNASCTTNCLAPIAKVLNDKWGIESGLMTTVHATTATQKTVDGPSAKDWRGGRGASQNIIPSSTGAAKAVGVVLPELNGLLTGMAFRVPTANVSVVDLTVNLKEAASYEEICAAMKEASEGEMAGVLGYTEDQVVSQDFIGETQTSVFDAKAGVALTD

SEQ ID NO: 52754 - protein, 461 aa, Agrobacterium tumefaciens str. C58
MFFMRMICNCINSISMKAQKMDKPVFGWRRNGDDLSLSDVHSSIRIKPDASTFRRAMAFFGPGYLVAVGYMDPGNWATSLAGGSKFGYTLLAVALVSNIMAIVLQSLCARLAIASGRDLAQACRDAYPKPVAMVLWLLAEIAIIATDIAEVIGTAIGLNLIFGIPLELGVLITALDVFLILYLQKLGFRWVEALVITLLGVIAVCFAIQLALADPDWGQVILGFAPTTEIVTNPDMLYLALGILGATVMPHNLYLHSGIVQTREIGPTIAEKREALKFATLDSTIALMFALLINASILILAAATFNKTGQTNVAELGEAHSLLAPLLGLAIAPTLFGVALLCCGINSTVTATLAGQIVMEGFLKMRLAPWLRRLITRAIAIVPAAGVTIFYGDSGTGQLLILTQVVLSLQLSFAVFPLVMFTSDKAKMGELRSPLWLSAIAWLIAVVIAALNVKLLMDFMG

SEQ ID NO: 52755 - protein, 187 aa, Opitutaceae bacterium TAV2
MLLVIDNYDSFTYNLVQYFGQLGVEQRVYRNNEITPAEALALNPERVLISPGPCSPAEAGVSLDMIAAFAGKKPIFGVCLGHQSIGHYFGGRVIRADRLMHGKTSPILHRDTDVFRGLPQGFAATRYHSLLVERATLPDCLAITAETAEGEIMGLAHKTLPIWGVQFHPESIATEGGMKILENFLSL

SEQ ID NO: 52756 - protein, 240 aa, Hordeum vulgare subsp. vulgare
MDMGEVSSSPPSSSNENASGRSSTAKRPAGRTKFRETRHPVYRGVRRRGNAERWVCEVRVPGKRGARLWLGTYATAEIAARANDAAMLALGVRSAARLNFPDSAWLLAVPSAHSDLADVRRAAVEAVADLQRREAAGGSITATVGEEASRGAPAESSSESEDAGSSETSKPSAGGDLAVPVGMDVEMFRLDFFPEMEFGSYYASLAEALLMDPPPVANSTGAYWDNGEFGEVATEFALWS

SEQ ID NO: 52757 - protein, 388 aa, Alteromonadales bacterium TW-7
MKIAVVGTGYVGLSNAMLLSQHNEVVALDIDEQKIALLNNKQSPIVDTEISEFLTRNDLNFTATTDKVAAYENADYVIIATPTDYDVENNYFNTSSVEAVIKDAMAHNPNAVMVIKSTIPVGFTADIKKQLNAGNLIFSPEFLREGKALYDNLHPSRIVVGEQSERATIFANLLKQGAIKQDVEVLFTDSTEAEAIKLFSNTYLAMRVAYFNELDSYAEAHGLNSKQIIQGVGLDPRIGNHYNNPSFGYGGYCLPKDTKQLRANYQDVPNNIIGAIVDANTTRKDFIADSIIKRSPKIVGVYRLVMKTGSDNFRASAIQGIMKRIKAKGIEVVVYEPVLEESEFYHSRVIKDLNEFKQMSDVVVSNRMVEELSDIADKVYTRDLFGSD

SEQ ID NO: 52758 - protein, 334 aa, Alteromonadales bacterium TW-7
MKYLVTGAAGFIGAATCQKLLAAGHVVIGIDNLNDYYDVNLKLARLAQFENHENFTFIKLDISERAVMSELFVAQQFDKVIHLAAQAGVRYSIENPDAYADSNLVGHLNVLEGCRHNNVKHLVYASSSSVYGLNEKTPFETTDSVDHPVSFYAATKKANELMAHSYSHLYSLPTTGLRFFTVYGPWGRPDMAPYIFTKKILDGDTIDINNNGDMWRDFTYIDDIVEGVLRAADVIPTANPDWRVESGSPATSSAPYAVYNIGHGSPINLMKFIEAIEGELGTEASKNFREMQAGDVYKTYADTQELFNATGYKAQVGVERGVSELIKWYKSFYK

SEQ ID NO: 52759 - protein, 143 aa, Sordaria macrospora
LAHVRAERDILAESDSPWVVKLYTTFQDANFLYMLMEFLPGGDLMTMLIKYEIFSEDITRFYIAEIVLAIEAVHKLGFIHRGGHVKLTDFGLSTGFHKPHDNNYYTQLLQGKSNKPRDNRNSIAIDQINLTVSNRAQINDWRR

SEQ ID NO: 52760 - protein, 249 aa, Sorghum bicolor
MEYGVADDYGYGYGGYDDQQDLPSSSSVDGDEYATVLSAPPKRPAGRTKFRETRHPVYRGVRRRGPAGRWVCEVREPNKKSRIWLGTFATAEAAARAHDVAALALRGRAACLNFADSARLLRVDPATLATPDDIRRAAIQLAEDSSSSTPDASAAAAAVAVASSASVGQATPSSSAYQAGDDATGAAMYGAEYAAAAMYGAGMDFDHSYYYDGMVGGNEWQSAGSSGWHSNVDAGDDEGAGDMSLWSYY

SEQ ID NO: 52761 - protein, 397 aa, Oceanicola granulosus HTCC2516
MNIHEYQAKALLRSYGAPVSDGRAVFRAEEAKSAAGELDGPLWVVKAQIHAGGRGKGSFQEADAGDKGGVRLAKSVEEAAEEAKRMLGRTLVTHQTGPAGKQVNRVYIEDGSDIERELYLALLVDRQTSRVSFVASTEGGMDIEEVAASTPEKILSFSVDPATGYQPFHGRRIGFALGLEGAALKQCVKLMGTLYKMFVERDMEMLEINPLIVTDKGDLKCLDAKIGFDGNALYRQPDILSLRDETEEDAKELAASKYDLNYIALDGEIGCMVNGAGLAMATMDIIKLYGAEPANFLDVGGGATKEKVTEAFKIITSDPQVKGILVNIFGGIMRCDVIAEGVIAAVKEVGLEVPLVVRLEGTNVEKGKEIIAQSGLNVIAADDLKDGAEKIVKAVKG

SEQ ID NO: 52762 - protein, 406 aa, Campylobacter jejuni subsp. jejuni NCTC 11168
MLNNTLFFKQSEIHTISSYANRINDEVKSGDIGYYHLIDTSLNLIDESLQFIQDKEYVKNIVLVGMGGSSCGVKALRDMLFNEKSNQRELFILDNTSSHSFNKTLEKIKLEESLFLIISKTGSTIEVVSLFKLLIEHFKLDMQELKKYFVFITDKDSKLHQEGENLGIKCFFIPANVGGRFSILSAVGIVPLCFCGYNAKALLEGAKACFEDFFTHKKDEILQKAYHYCTHKNANINVLFSYSDAFKGFNEWYIQLIAESLGKKQGYKRIGLTPIALIGARDQHSFLQLIMDGPKNKTVTFLKIKDAQKAPIIPDIHFKFLDSLSNKVNLHELLNAQCDATMHALIAENLSVDVIELEKLDAWHAGYLMYYYELFTSTCGVMLGINTYDQPGVEVGKLILKNILNS

SEQ ID NO: 52763 - protein, 540 aa, Oceanicola granulosus HTCC2516
MSVEVRVPALGESVTEATVATWFKKPGDAVEADEMLCELETDKVTVEVPSPAAGKLDEIVAAEGETVGVDALLANIAEAGHAGSSTDIKPREGKSANPEPAEPDAGTEGKSGADGSGDGGGGGEEIEITVPALGESVTEATVSTWFKKPGDSFEADEMLCELETDKVSVEVPAPAAGTLSKLLAEEGATVEAGGKLALMTTGKAAASAKAEGTPATTTSQTPEGDRGGYGDRGTPDTPPTTESRGDIEDAPSAKKMMAEKNLSADAVTGTGKGGRIMKEDVLNALNKPQQAEAPKPQAARAPSTPADADREERVKMTRLRQTIARRLKEAQNNAAMLTTYNEVDMGGIMDLRNEYKDLFLKKHGVKLGFMSFFVKACCHALNEVPDVNAEIDGTDVVYKNYVNMGIAVGTPNGLVVPVVRDAHEKGFAQIEKEIAELGAKGRDGKLSMADMQGGSFTISNGGVYGSLMSSPILNPPQSGILGMHKIQERPMVVKGQIVARPMMYLALSYDHRIVDGKGAVTFLVRVKEALEDPRRLLMDL

SEQ ID NO: 52764 - protein, 274 aa, Campylobacter jejuni subsp. jejuni NCTC 11168
MLQTCIFPAAGYGTRFLPATKTLPKEMLPILTKPLIHYGVDEALEAGMENMGFVTGRGKRALEDYFDISYELEHQISGTKKEYLLDEIRSLINRCTFTFTRQNQMKGLGDAVLKGRPLVGDEAFGVILADDLCVNEEGLNVMAQMVKIYEKYRCTIIAVMEVPKEQVSNYGVISGNFVEENLIMVNSMIEKPSPDEAPSNLAIIGRYILTPDIFGILENTKAGKNGEIQLTDALLTQATNGMVLAYKFQGKRFDCGSVEGFVEATNYFYEKSKC

SEQ ID NO: 52765 - protein, 558 aa, Oryza sativa Japonica Group
MQQRRKSVFASAPFAMKQAALGAGVAARRNGAPLSLAAVVFALFVFATFLYNEDIKSIADFPFGAGALRAKSPDLHVLQETVGAAHLAAGSIAKRGEEVIVRVLDAPASTAMAAAAGSSSNNSTIEVAKANANANANAADAGVKVDEGQERERDVTLPSVKEGGADEARRREDEEAAEKESSAKAAAATAALRTVVSVPDTCDLYRGNWVYDEVNAPVYKESQCEFLTEQVTCMRNGRRDDSYQKWRWQPTDCDLPRFDARLLLERLRNKRLMFVGDSLNRNQWESMVCLVQSVIPKGKKTLTKFVNGGNSNIFYAHEYNATVEFYWAPFLVESNSDNPQVHSVPDRVIQWHSIAKHAHNWLGVDYLIFNTYIWWLNTLDMKVLKGSFDQGATEYVEVDRPVAYKEVLKTWAKWVDRNIDPNRTTVFFMSMSPNHITPEAWGNYGGIKCAMETLPITNRTTSLDVGTDWRLYAGAQEVLQTFRRVPVHLVDITALSELRKDAHTSVHTLRQGKLLTPEQQSDPKTYADCIHWCLPGLPDTWNQFLYARIASAPWSSDQ

SEQ ID NO: 52766 - protein, 364 aa, Photobacterium leiognathi
MALSSAKEIIDDIRQGRMVILMDDESRENEGDLIIASEMVTPEAINFMATHGRGLICLTLSKARCKTLNLPLMVQGNNDNFSTPFTISIEAAKYVTTGISASDRAKTVLAAVAPNAKSTDIVMPGHIFPLMAQDGGVLIRAGHTEAGCDVARLAGLEPSSVIVEILNEDGSMARRPQLEIFAEKHGLKLGTIADLIEYRTQQESHIERISEYELNTEYGIFTLVTYRDTIDNQAHFALCKGEIQAKAATLVRVHVKDTLKDILQVGLSQWSLEAAMQRIQTEDGVLVIISQQESPKTLFEKLDMYAKEQPNSPHSGIVQSRNIGLGSQILADLGVKKIRLLSNSNQGYRALSGFGLEVVEYIYD

SEQ ID NO: 52767 - protein, 205 aa, Oryza sativa Japonica Group
MAAAAAAKIAPSMLSSDFANLAAEADRMVRLGADWLHMDIMDGHFVPNLTIGAPVIQSLRKHTKAYLDCHLMVTNPSDYVEPLAKAGASGFTFHIEVSRDNWQELIQSIKAKGMRPGVSLRPGTPVEEVFPLFMPEMMEKVRALRKKYPSLDIEVDGGLGPSTIDVAASAGANCIVAGSSIFGAAEPGEVISALRKSVEGSQNKS

SEQ ID NO: 52768 - protein, 239 aa, Vibrio kanaloae
NLIVNGKTVRVTAERNPEDLKWDAIDVDVVAEATGLFLTDETARKHITAGAKKVVLTGPSKDATPMFVMGVNQASYAGQDIVSNASCTTNCLAPIAKVLNDKWGIESGLMTTVHATTATQKTVDGPSAKDWRGGRGASQNIIPSSTGAAKAVGVVLPELNGLLTGMAFRVPTANVSVVDLTVNLKEAASYEEICAAMKEASEGEMAGVLGYTEDQVVSQDFIGETQTSVFDAKAGVALT

SEQ ID NO: 52769 - protein, 480 aa, Opitutaceae bacterium TAV2
MFSQQTDASIRRTKIVFTLGPATESEEMLEKLIRAGADVARLNMAHANHEWTRMIIRRIREVSKRVGREIAIMMDIKGPEIRTGDVSSPIELKAGEIFDFTIRPGAAQDSSEEVRSVDVNYKDLVNDIRVGDTVLVDNGLIRLEVLEKQNTRIRCRVLIPGELKSRRHINLPGVKVNLPSLTEKDKTDLAVGLIEGIDFVALSFVREAADIQLLRDVLHRYKSRAGIIAKIEDQSAIANLDEIVRTTDALMVARGDLGIECPFEELPIIQRRAVRMCFDYGKPVIIATHMLESMIASPMPTRAEITDVANAVYEKADCVMLSGETTIGRYPLECVQILDKIARRIESEGPFELLDPETLEGDKMRLLQSAVHLAHDLEGAALLTFTRRGYMAAGLAAMRPAWAPIYAMTNSPETLRNLRLVRGVEPFMLELAADPNETIDQAITLLTTKGRVKPGDKLIVVTDILSHERLVDSIQLRTIR

SEQ ID NO: 52770 - protein, 235 aa, Sorghum bicolor
MCPIKKEMTGESSSPCSSASTSSEHHQTVWTSRPKRPAGRTKFRETRHPVFRGVRRRGNAGRWVCEVRVPGRRGCRLWLGTFDTADAAARAHDAAMLAIAGAGACLNFADSAWLLAVPASYASLAEVRHAVAEAVEEFLLREVVQEDDALSATSSTPPSSPSSSDDGSTSDGGESSESDSSPAATGASPFELDVFNDMSWDLYYASLAQGMLVEPPSAVTAFMDEGFADVPLWSY

SEQ ID NO: 52771 - protein, 115 aa, Oryza sativa
MATYLGNTWDNKYAEELKATAKAIAAPGKGILAADESTGTIGKRLSSIGCPNEEQYRRDLREMLFTAPDVATHISGVILFEETLYQNANDGTPFVKILQNQGIIPGIKVDKGVVA

SEQ ID NO: 52772 - protein, 206 aa, Brassica napus
  misc_feature (196)..(196): Xaa can be any naturally occurring amino acid
FTHKGNMCFNVSIYKTDCVEILRPKRSATIASSNRNKREEVNNVLEEERESLSASNYPVSETAESTVGGRLKQKRQLINLGKKQVKKAEKANKCKKRKMDTESDDSEAGTSSLVSEFTLTIKKSYVLFLGVPKRFAEMHMPKEETVFKIHDPKGKKSWEVTYVVSKIQSRFSRGWPRLVKDFGLEVGDVCTFELIXPTEMILTVSK

SEQ ID NO: 52773 - protein, 461 aa, Oceanicola granulosus HTCC2516
MADYDVIVIGSGPGGYVCAIRCAQLGLKTACVEARDTLGGTCLNIGCIPSKALLHATEMLHEAEHNFAEMGLKGKSPSVDWKQMLAYKDKTISQNTGGIEFLFKKNKIDWLKGWGSIPEAGKVKVGDETHNARHIVIASGSEPSALKGVEVDEKTVVTSTGALELGKVPRKMVVIGAGVIGLELGSVYRRLGAEVTVVEFLDQITPTMDGEVAKQFKRMLGKQGFEFVLGAAVQSVETKGGKATVHYKLRKDDSDASLEADTVLVSTGRRPFTDKLGLDALGVELERGMIKTDDHFRTNVAGIYAIGDAIKGPMLAHKAEDEGMACAEGIAGQHPHVNYGVIPSVIYTHPEVAAVGFTEEELKEQGRAYKVGKFPFMGNARAKANFAGEGFVKLLADAETDRILGAHIIGPMAGDLIHEICVAMEFGAAAEDIARTCHAHPTYSEAVREAALACGDGAIHV

SEQ ID NO: 52774 - protein, 226 aa, Oceanicola granulosus HTCC2516
MSERRVAIAPSILAADFADFGREVRAVEDQGADMIHVDVMDGHFVPNLTFGPQMVKALRPHVKTVMDVHLMIAPVDPYIDAYAEAGADILSAHYEAGPHIHRTLQAIRGHGMKAGLALNPGTPVEVAGPVLDLCDTVLVMTVNPGFGGQSFLESQLEQIRRLRAMIGDRPITIGIDGGVDTRTAPLAAAAGGDMLVAGSAIFKHGSADDPAPYGEAITALREAARP

SEQ ID NO: 52775 - protein, 268 aa, Glycine max
MVTKLVQPPMTDSHVSPLIYRTMNVMKLQNFVPARNHPRINTSRFGERPLWFRPITIIKVAEHNSGSGLVELEALAQKKRELYQAVEGINRGIFGIPSTKKSEIESLVKQLESLNPTPFPTLELEKVAGCWRLVYSTISILGSKRTKLGLRDFISLDDFFQSIDISKSKAVNVIKFSARGLSLLSGQLSIEASFRISSSTRVDINFENSTITPDRLMNVFRKNYDLLLGVFNPEGWLEITYVDETMRIGRDDKSNIFVLERFDDNNNM

SEQ ID NO: 52776 - protein, 367 aa, Glycine max
MGGVTSSMAAKLAFFPPHPASYKVVKDELTGLLLLSPFPHRENVEILKLPTRRGTEIVSMYVRHPMAASTVLYSHGNATDLGQMYELFIQLSIHLRVNLIGYDYSGYGQSSGKPSEQNTYADIEAVYKCLEESYGTKQEDIILYGQSVGSGPTLDLAARLPQLRAVVLHSPILSGLRVMYPVKRSYWFDIYKNIDKIPLVNCPVLIIHGTSDEVVDCSHGKQLWELCKEKYEPLWLKGGNHCDLEQFPEYIRHLKKFIATVEKSPSQRYSFRRSMEQFEQPRKSTDIFEVIRKSTDRREKPRLITDRPEKLKNLSNNADKLEKLRVTFDHMDRSRRSVDCLEKSRKSIDHQLEKARKSVDRLERIRT

SEQ ID NO: 52777 - protein, 164 aa, Clostridium perfringens ATCC 13124
LEDAQSIDEAVKLVEELKPLVKDAKCEVVVCPTFVCLDAVKKAVEGTNIKVGAQNMHFEEKGAFTGEIAPRMLEAMNIDYVIIGHSERREYFNETDETCNKKVKAAFAHNLTPILCCGETLEQRENGTTNDVIKAQITADLEGLTKEQAEKVVIAYEPIWAYRN

SEQ ID NO: 52778 - protein, 164 aa, Brassica napus
  misc_feature (22)..(22): Xaa can be any naturally occurring amino acid
ILLDSSFTPYISDFGLTRLITXTAPSGEPSSSSGTGGFLGGALPYTSIKPSDRSNGYKAPEARLPGSKPAQKWDVYSFGVVLMEILTGKSPDSSPLSSSSSSTGVAEVTDLVKWVRKGFEEETPLSDMVDPMLLQEVHAKQQVLSVFHLALACTESDPEVRPRM

SEQ ID NO: 52779 - protein, 117 aa, Zea mays
HGSPLSARRDSPPSAARPANARPNALGLAALMARSERVRCNYSKEGGGGSTNGAGVSLLAGAGAATTLLGSALALVDDRMSTEGTRLSLWLRNNLLGRILVGGSDLICFFYTIYTSD

SEQ ID NO: 52780 - protein, 316 aa, Nicotiana attenuata
METFPVVNMELLNTEQRAATMETIKDACENWGFFEVVNHGISHELLDTVEKLTKGHYKKCMEERFKEMVASKGLEAVQTEIKDLDWESTFFLKHLPVSNISEVPDLEDEYRKIMKEFAEKLEKLAEQLLDLLCENLGLEQGYLKKAFYGSKGPTFGTKVSNYPPCPKPDLIKGLRAHTDAGGIILLFQDDKVSGLQLLKDDKWIDVPPMRHSIVINLGDQLEVITNGKYKSVEHRVIAQPDGNRMSIASFYNPGSDAVIYPAPELLEKENKAIYPKFVFEDYMKLYAGLKFQAKEPRFEAMKAVETTVNSAPIATV

SEQ ID NO: 52781 - protein, 214 aa, Desulfotalea psychrophila LSv54
MGQSLLSSFGDAQQRVEKSLQALRQGEGVLLVDDEDRENEGDLIYSAEHLTAKQMALMIREGSGIVCLCLTGEKVDELKLPQMVTNNNSRHGTGFTISIEARDGVTTGVSAADRTQTVKAAIAEGAVAEDLCQPGHVFPLRARDNGVLDRRGHTEGTVDLMKLSGLAPAGLLCELTNVDGTMARLPEIVDFARKRDMQVLSIEDIAQYRQGHNL

SEQ ID NO: 52782 - protein, 122 aa, Glycine max
  misc_feature (111)..(111): Xaa can be any naturally occurring amino acid
MASKLQKLQSAACQASQFVSSRGTNYYRQLLEQNKQHIQEPPTVEKCNLLAKQLFYTRLASIPGRNESFWKELDYVKNLWKNRKELKVEDAGIAALFGLECFAWYCGGEIXGRGFTFTGYYV

SEQ ID NO: 52783 - protein, 271 aa, Brassica napus
MSKEVSEEGHTQSHGKDYVDPPPAPFLYRALIAEFIATLLFLYVTVATVIGHKKQTGPCDGVGLLGIAWAFGGMIFVLVYCTAGVSGGHINPAVTFGLFLARKVSLVRAVGYMIAQCLGAICGVGFVKAFMKTPYNTLGGGANTVAPGYSKGTALGAEIIGTFVLVYTVFSATDPKRSARDSHIPVLAPLPIGFAVFMVHLATIPITGTGINPARSFGAAVIYNNEKAWDDHWIFWVGPFVGALAAAAYHQYILRAAAVKALASFRSSATN

SEQ ID NO: 52784 - protein, 213 aa, Zea mays
MEGLSWRTVCCLSVLCAVLFLRPAEGIRFVIDREECFSHNVEYEGDTVHVSFVVIKADTPWHYSEEGVDLVVKDPNGAQVRDSRDKTSDKFEFIVQKRGVHRFCFTNKSPYHETIDFDVHVGHFSYFEQHAKDEHFAPLFDQIGKLDEALYNIQFEQHWLEAQTDRQAILNENMSRRAVHKALFESAALIAASVIQVYLLRRLFERKLGTSRV

SEQ ID NO: 52785 - protein, 336 aa, Flavobacteria bacterium BBFL7
MARKNQTLGEFIIENQSEFQYSSGELSRLINSIRLAAKMVNHEVNKAGLVDITGSAGEINTQGEDQQKLDVLANDTFIRTLTNREIVCGIASEENDDFITIEGHKENHSNKYVVLMDPLDGSSNIDVNVSVGTIFSIYRRVTPVGTPVQLEDFLQPGNLQVAAGYIVYGTSTMLVYTTGHGVNGFTLNPALGTYYLSHPNMTFSEDGNIYSVNEGNYNHFPQGVKDYIKYCQQEEGDRPYTSRYIGSLVSDIHRNMIKGGIYMYPQSAKASNGKLRLLYECNPMAFIAEQAGGTASDGHTRIMDLKPTELHQRVPFFCGSKNMVAKLEEFIQKHDK

SEQ ID NO: 52786 - protein, 376 aa, Roseovarius nubinhibens ISM
MSEIVQVSEAARAMRDAGHDVIALSTGEPDFPTPPHVVEAAHRAAVNGDTNYTPTGGTAKLRATVAEGAGVEPANVVISTGAKQSIANAMLATLDPGDEVVMPVPFWTSYADIVRMAGGVPVLVDCPMEAGFRLTPAQLETAITSRTRWLMLNAPSNPSGAVYSAEDYAGLAEVLERHPHVWIMADEIYEHLSFVPFVSFRETVPGLRDRTLVINGVSKAYSMTGWRVGWGIGPAPLIKAMTAVQGQVTSGGSSISQAAAVAALTGDQSLLAERNAAMKARRDRVVAALDAMPGVSCLVPDGAFYAFPNIEGAIKAGGFDEDGVFCKALLEAEALALVPGRAFGMPGHLRLSFAYADALLDEGLARMGRFVAGLGA

SEQ ID NO: 52787 - protein, 454 aa, Roseovarius nubinhibens ISM
MSLWRYARLFRQDILSAQPARLYRAWMAEFRTPFFRSYLCNQPDLVDLILKGRPDDFPKSDRIREGLTPLLGQSVFVTNGETWKRQRRIIDPAFEGGRLRDTFPAMYAAGEAAVARLAPQADGAPKDIEFHTSHAAADVIFRTLFSLPIEDETASEVFAAFRDHQRTQPVLNLGAFLPLPRWFPRFHRRRTRETARHIRALITDLTARRRAEIEAGTAPDDLATKIMTTPDPVTGKRFETEEMVDQVAIFFLAGHETSASALAWALYLLALYPDWQERLAEEATGAMTGTSTGAFGMSDMAKLRLSRDVFREALRLYPPVPMMVREASGTEVFRDREVRKGSQIVLSAWHLHRHERLWERPDAFDPDRFATDNGRSCLREAFMPFSAGQRVCPGAGFAMIEGPLLLSMLLRNYRFEVVADRPAMPVAHLTVRGRDGIWLRITPRGDAAPDVATN

SEQ ID NO: 52788 - protein, 441 aa, Bacillus anthracis str. Ames
MKITIIGTGYVGLITGVGLAVLGHSVTCFDINDEKIERIKQGDLPIYEAGLYELIHDACENNRLTFTTSKEEAFKDAEFIFIAVGTPSLLDGTADLTYIQNACVDIGTYATKDIIVVTKSTVPVGTNGAMRGWIEETLQNRHELHIVSNPEFLREGSGIYDFFQGDRIVIGADNEEAARKVENLYSELHLKTYVTDIKSAEMIKYASNAFLATKISFINEISNICEKVGANVLDVAKGMGMDKRIGASFLNAGIGYGGSCFPKDTKALVQIAGNVAHDFRLLKAVIEVNNKQQLLLIEKAKKVINMNKKRIAVLGAAFKPNTDDIRDAPSLIMIQELINLGADIVLYDPKAIQNMKNIFGETIQYSECIDESIRGASAAFIMTEWEDIRTYPLENYVQLMREPILFDGRNCYTNEDVKKQGIDYYSVGRESIYKRDFSVIR

SEQ ID NO: 52789 - protein, 396 aa, Hyphomonas neptunium ATCC 15444
MSHFSPLSTLPPDALLGLMTAYRADERSEKFDLGVGVYKDENGETPILSAVRKAEAKMLAAQTTKVYEGPRGNTDFCAHIEKFVFGKDHPALAENRVLSFTSPGGCGALFLGVGLMRRMGTRRVWVSRPTWPNHPNVVKSLGLDVKEYTYSRDGAFYRLGALADLSTAERGDGIIIQGPCHNPTGIDPSTEDWRELGKLCKDKGIIALLDVAYHGFASGLDRDMDGVRAFIDEAGEALISYSCSKNFGLYRERTGCFLAVGAEAEGIAAATTHVADMGRATWSMPPSHGAGIVATILDDPDLRAEWETELSAMRTRMIGLREALSDALVSHSGSNLLAALKTQNGMFSQLPISAEDTAKAREADGIYMPSSGRINIAGLHPSDIPRLAEILAGYLV

SEQ ID NO: 52790 - protein, 834 aa, Oceanicola granulosus HTCC2516
MDIVLITAVIASLFLVIAAAEPLAARLRLPYSVILAVLGMMIGVAALFFLRTELTDALNPVAEAILGLPIRSNVFLYVFLPTLLFQATLGMNLRRMLDDWVPILVLAVVAVVVATLSVGYALAWVSPLPLVACLLIGAIVSTTDPSAVVSIFRSISAPRRLARIIEGESLLNDAAAIALFGLFMGFVMRGVPDPEIGPALARFPILIGGGAAAGWLAARVGLWVMALFGRHELAVISVSVALPYLAYIGAEQSIGASGVIAVVAAGLTLNLAGPGRLPPQAWLNLREVWDLLAHWAGALIFILAALLIPRLLEGTRPGDFLLIGVVILAAIAARAVILFGLLPLLTLLRASPVVERPYRTAILWGGLRGAVTLALALAVTESFRVPVEVKRLVGILATGFTLFTLLVQGTTLRMVIGWLGLDRLSSIDEAISRQVVAVALQTVREDVARTTEAYALSRDIVRSEAKAFGERLELAVKAAEDTTDILERDRITLGLIALAGFERETILDRVRERTISGAMAEPILSDADRLIEATRVGGRNGYQRAARRSVAYGGAFRLAVLLHNRLRLSAPLVRMTSDRFERLLSQRLILRDLGAFVDTRIRRIHGPRVADLLHELLARRIDIVETALEGLRLQYPGHAEELERRFIRRTALRMEEREYTAMREDGLIGAEVYTALMQDLAGRRALAEARPRLDLAVQRAVLVRQFPFFADLDEAALRRLSRSLRTRYVDAGRVIVRKDTPLRSVYFIASGAVELERAGQTWRLGRGEMFGQMAILSDRTRRTEVRTIAPSTLLVLDETRFRSLLKRSAPLRNAVRASAEKRGIELSSLEEMEL

SEQ ID NO: 52791 - protein, 181 aa, Glycine max
  misc_feature (8)..(8): Xaa can be any naturally occurring amino acid
KYEYFYGXLRDFPDLRFTINGGISRVDEVSAAREAGAHGVMVGRAAYNYPWQILGHVDAAIYGTPSCDLTRRHVLERYLVYGDSVLGKYGHRPTLRDIVKPLLHLFHSEPGNGLWKRKADAAFKNCTTMESFFEETLVAIPDSVLDSPVAEPPPGRDLFANMHNLLPAPYRTREATVIICA

SEQ ID NO: 52792 - protein, 477 aa, Hyphomonas neptunium ATCC 15444
MSELRTLKADLAVIGAGSAGLSAAAGAAMLGLKVVLFEKHEMGGDCLNFGCVPSKALISAAKIAHVPEEAVRYGISLPPAVVNWDAVKAHVRGAIETIAPIDSQERFEGLGCTVIREAARFEDKNTLVSDSVRVKARRIIISTGSRAIIPPVPGLEDVPYFTNETIFSAPDFPHELIILGGGPIGLELAQAFSRLGSKVTVVEMGRALPRSDAAHAKIAVDAVRAEGVTILEGHKATRISGGPGNISVKAEGPEGDVMIAGSHILIATGRQAVTDGLDLEKGGVDFTNKGVTVSDTLRSKSNPRVWALGDIAGHGQFTHLAGWHSSVFVRRAFFKQGSKASSLPLPAVTYTSPEVAQVGLTEAEAREKFGDAVKTSAFPFHDNDRAIAEAKTLGEAKLVIHKGKLVGASIVGEGAGDIIQMVGLAMSNGLKLTALTNFISPYPTRTEVVKRAASAYFTPSVFGAPARTLVGILQKIP

SEQ ID NO: 52793 - protein, 152 aa, Clostridium innocuum
KNWKMHKTMKETKEFMEAVDAAAASENAVFGIGAPYTALSAAVAGAKNLVIAAENCHWEDSGAFTGEISVPMLQEVGVTHCIIGHSERREMFNDTDETVNKKAKRLIDAGITPILCIGETEAQYDAGDSEKVIRDQLTGSLADMCPKCVGNM

SEQ ID NO: 52794 - protein, 132 aa, Sordaria macrospora
EYCSGGEFFRALQTRPGKCIPEDDARFYAAEVTAALEYLHLMGFIYRDLKPENILLHQSGHIMLSDFDLSKQSDPGGKPTMIIGKNGTSTSSLPTIDTKSCIANFRTNSFVGTEEYIAPEVIKGSGHTSAIK

SEQ ID NO: 52795 - protein, 641 aa, Staphylococcus hyicus
MKETKHQHTFSIRKSAYGAASVMVASCIFVIGGGVAEANDSTTQTTTPLEVAQTSQQETHTHQTPVTSLHTATPEHVDDSKEATPLPEKAESPKTEVTVQPSSHTQEVPALHKKTQQQPAYKDKTVPESTIASKSVESNKATENEMSPVEHHASNVEKREDRLETNETTPPSVDREFSHKIINNTHVNPKTDGQTNVNVDTKTIDTVSPKDDRIDTAQPKQVDVPKENTTAQNKFTSQASDKKPTVKAAPEAVQNPENPKNKDPFVFVHGFTGFVGEVAAKGENHWGGTKANLRNHLRKAGYETYEASVSALASNHERAVELYYYLKGGRVDYGAAHSEKYGHERYGKTYEGVLKDWKPGHPVHFIGHSMGGQTIRLLEHYLRFGDKAEIAYQQQHGGIISELFKGGQDNMVTSITTIATPHNGTHASDDIGNTPTIRNILYSFAQMSSHLGTIDFGMDHWGFKRKDGESLTDYNKRIAESKIWDSEDTGLYDLTREGAEKINQKTELNPNIYYKTYTGVATHETQLGKHIADLGMEFTKILTGNYIGSVDDILWRPNDGLVSEISSQHPSDEKNISVDENSELHKGTWQVMPTMKGWDHSDFIGNDALDTKHSAIELTNFYHSISDYLMRIEKAESTKNA

SEQ ID NO: 52796 - protein, 149 aa, Clostridium difficile
WKMHKTIKEALEFVNEVKDKVNSDKVEAVICAPFTLLKDLKEATKGTNIKIGAQNMHFEEKGAFTGEVSPLMLKEIDMDYVVIGHSERRQYFNETDETVNKKVLKALEVGIDPILCVGETLEQREAGKTKDVCKVQVEKALENVLKDDL

SEQ ID NO: 52797 - protein, 228 aa, Hyphomonas neptunium ATCC 15444
MTKKKSFLIAMSGGSGSGKSTLAEALLEHLGPGKAVMFGEDAYYHPMRFYGTPQTVAEREALVAGINYDDPKSKEVDHLVSDLKALKAGEAVEQPIYDYERHDRSTNTRRIESAPVLILEGIHALSMPKIRNFIDLSVYVDTPDDLRLARRIRRDVIERGRTVDSVLAQYMSTVRSAHYRWTHPAKFDADLVIADEGLPAYGNVKPTGEAIERMIAPVLARLQTAGVI

SEQ ID NO: 52798 - protein, 427 aa, Oryza sativa Japonica Group
MAGVSAASAAGKIGSFLSKRPYAPPSWASHLSPAPSQTFSLGHFPTPIHKWNLPNLPNGTEVWIKGRVVCLWSLASDTRVWGKLQRDDISGMQLSGNKVRKLEFLMADAVAQGADCVITVGGIQSNHCRATAVAAKYINLDCYLILRTSKLLVDKDPGLVGNLLVERLVGAHIDLVSKEEYGKIGSVALADLLKKKLLEEGRKPYVIPVGGSNSLGTWGYIEAIREIEHQIQISGDVQFDDIVVACGSGGTIAGLALGSKLSSLKAKVHAFSVCDDPGYFHSYVQDLIDGLHSDLRSHDLVNIENAKGLGYAMNTAEELKFVKDIATATGIVLDPVYSGKAAYGMLKDMGANPAKWEGRKILFVHTGGLLGLYDKVDELSSLSGSWRRMDLEESVPRKDGTEVSDISLSKKSIRLNLYDKIQSRWLM

SEQ ID NO: 52799 - protein, 307 aa, Physcomitrella patens subsp. patens
MKGPTHFLHLDDFDKDTLLHILDRAVEVKARLKSGDKSYQPLKGMSMAMIFTKPSMRTRVSFETGFYQLGGHAIYLGPNDIQLGKREETRDIARVLSGYNDVIMARLFGHKDLLDLAEYSKIPVINGLTDYNHPCQIMADVLTINEFIGNIEGLKIVYVGDGNNMVHSWLRLAAVLPFHFICACPRGYEPDAATVERARRAGVSKIEIRHDPVEAVKGANVVYADVWASMGQKEDADNRKSVFQGFQVNEALMKAAGPQAYFMHCLPAERGVEITDGVIEGPKSIVFPQAENRMHAQNAIMLHCLGF

SEQ ID NO: 52800 - protein, 425 aa, Hyphomonas neptunium ATCC 15444
MADPKDWFTAGLEHIWLPYAQMRTLPAPVAIARTEGSRLYLADGRELVDGVGSWWTSIHGYNRPELLDAARDQMAKMPHIMLGGLAHEPAYRLATRLAEITPGDLSRVFFTESGSVAVEVAMKIAIQYFRNTAGVTRTKFVSFLGGYHGDTLATMSVCDPDEGMHHMFRGALAEQYVVALPETRDQIRALETLLSTDKKIAAVMIEPLIQGAGGMRMHSPQVLKTLRRLCDQAGVLLIFDEIFTGFGRTGEMFAAARAGVTPDIMCLGKAITGGITPLAATLASSKVYAAFHSENPDHALMHGPTYTGHALACAVANAGLDLFADGSLIKRVKKLEASLTSALAPAKDMDSVVDVRVLGAVAAVELADPFPIEAARKWFIDEGTFIRPLGRTVYLSPAYGISDDDLARLTGAILKFAKTGISDIG

SEQ ID NO: 52801 - protein, 250 aa, Acidobacteria bacterium Ellin345
MAIICKSGAEIEKMRRSGRIVRQVLETVRALVAPGVSTMDLERAAEKKIRELGAKPAFKGYYDYPCVLCTSVNDEIVHGIPSEKRVLKTGDIVSIDTGVVLDGYYGDSAITVPVGEAITSELQKLLTITEQSLYKAIDAVKVGNTLGDIGSAVQQHVEAAGFSVVREFVGHGIGTRLHEDPQVPNFGAAGAGSRLREGMVLAIEPMVNVGKPATRTLDDHWTAVTADGSFSAHFEHCVAVTRDGPVILTE

SEQ ID NO: 52802 - protein, 152 aa, Clostridium butyricum
KMHKTVDEAVKMIEELKALVKDATCDVVVCPTFVCLDAVKKAVAGSNIKVAAQNMHFEESGAFTGEVAPGMLEAMGIDYVVLGHSERREYFNETDEALNKKVKAAFAHNITPILCCGETLEQRENGTTNAVVGAQIKADLEGLSKDLAEGVV

SEQ ID NO: 52803 - protein, 175 aa, Brassica napus
RPTRPVARWIAYAYTCGFLFGWHVHEKASLHFTIPLAIVAVQSLEDAKHYFLVSIVSCYSLFPLLYEPREYPIKVLLLLLHSMVMWLGFSAQYTDVKGLKEKKKEGGEIKRSKFEIGCVEKSYLMGLVIVEIVSQFLLPYFLGDRYAFMPLMLISTYCAVGIMYSWIWQLRKILT

SEQ ID NO: 52804 - protein, 150 aa, Clostridium sporogenes
NWKMHKTVKEAVELVKELKPLVKDAKCDVVVCPTYVCLPAVLEEVKGSNIKVGAQNMHFEESGAYTGEIAPKMLEELGVHYVIIGHSERRQYFNETDETVNKKVKKAFEHNLIPIVCCGESLEEREGNITEKVLEGQIKVGLKELNKEQV

SEQ ID NO: 52805 - protein, 128 aa, Clostridium clostridioforme
DVDVVFCVPAIDIIPAMEAAKGTNIYIGAENMYYEEKGAYTGEISPNMLVDAGVKYVIIGHSERREYFAETDETVNKKVLKAFEHGITPIVCCGETLTQREQGITIDWIRQQIKIAFLNVTADQAKTA

SEQ ID NO: 52806 - protein, 466 aa, Synechococcus sp. WH 5701
MASKPDLQSERHSSDDDIYASGDLSTGMPKRTFPAKEKDPRAVYAAIHDELMLDGNSRQNLATFCQTWLEPEVHQLMNECINKNMEDKDEYPQTAEIESRCARMLADLWNAPSIDGAIGCTTLGSSEAAMLGGMAMKRRWEASRRQQGKPTDRPNLVTGPVQICWHKFTRYWDIEHREIPMESGCLMMTPEQVLKHCDENTIGVVPTLGVTFTGQYEPVQQVAEALDAYEQQTGLDIPIHVDGASGGFLAPFCSPDLIWDFRLPRVKSINASGHKFGLAPLGVGWVLWREAKDLPEEMVFWVNYLGGNMRDITLNFSKPGGQVVCQYYNFIRLGKEGYRKVHNACYATAQHLAKEIETLGPFEIIYGGDPDTGIPALCWRIKDGVDPGFNLFDLADRLRVRGWQVPAYTLPAHCSDQAIQRILVRHGVSRDLADLLLEDIRSAIDHLQLHPVSTSLSSREASGFHH

SEQ ID NO: 52807 - protein, 251 aa, Glycine max
MSSSNCPSPLPTVTKLQVDSVTFPPSVISPASSNPLFLGGAGVRGLDIQGKFVIFTVIGVYLDPVSVPSLSVKWKGKTTEELTESVPFFREIVTGSFEKFIKVTMKLPLTGQQYSEKVTENCVAIWKSLGIYTDSEAKAVERFLEVFKDETFPPGASILFALASKGSLTVAFSKDDSIPETGKAVIENKLLAEAVLESIIGKNGVSPGARLSVAERLAQLMNSDKVEEDATKTDQEEANNLPLGDKLAKEN

SEQ ID NO: 52808 - protein, 215 aa, Schizosaccharomyces pombe 972h-
MSDINNNEPAENIEQPKQEPEDGNNSMSVDEQPETSSTNLPTGDNLAPMSVESPAHLNNEDSPKSDDSRERHGSNYVIEPHLELRDMAKDKTLENFLAQMDDYSPLIPDVLLDYYLSLSGFKCVDPRLKKLLGLTAQKFISDVAQDAYQYSKIRTGSSNASSTTFGAQNFGAGGASGIGSSGRRGDRGKTVLTVDDLSAALNEYGINLKRPDFFR

SEQ ID NO: 52809 - protein, 699 aa, Physcomitrella patens subsp. patens
MIVLAVEVLSVIGLNADGIALLEFKKAITSDPHSALKNWNDSDATPCRWNGIRCARIQGTMEERVLNITLPGKELGGTLSPSLGDLVHLGLLNLHTNKLTGQIPSKLFAALNLSRLYLSNNYLTGDIPAEIRNLGNQLRVLEIRSNIITGLPAEIVQCSRLRRLILSTNNITGIVPAGIGSNLTRLERLDLSSNHFIGTIPENFANLTELQGTLNLSNNRFSGSIPQSLSILRNVFIDFSNNNLSGPIPSGSYFQSLGLEAFDGNPALCGPPLEINCAPSPSNTAPPPFVNSTASGSSTSHKKSLNKTAVIVIAVISGSAALLMATVGFYFFVRKLSLAKKTVSFPSSPRTYNVNGLRGCLCPRRDSAGGASEEDAGDLVHLSGAFFFNLEELLRASAYVLGKRGARVVYKAVLDDGTIVAVRRLGGGGEHRHKEFEAEVKIFAQVRHPHIVNLHSFYWTADEKLLVYDYVSNGSLETALHGRSEGLKRSLTWKSRLRIARGAAQGIAHIHEFSPKRYVHGDIKPSNILLDAYLEARIADFGLQRLLAFVEPEPVKEFGSIRSETGRASAVRTSTPFVVAPFLADVYLAPEATSGKGFTQKSDVYSFGVVLLELLTGRSPFKQLAGGELDLVSWIRQALQENRNLSEIFDPRLQKADDNEHSQMIETLQVALACIAVDPDDRPRMKQIAVLFEKLQTSR

SEQ ID NO: 52810 - protein, 473 aa, Agrobacterium tumefaciens str. C58
MTMPESMLSESKLSGWAISPKLAQLASLAGHYADPEFSVAHGGHVRTIAAGHYTVSGLSRHVRLGEFVAHRSATGIHLGEVVRVEPDICYVCPIEPGEPIGIHDTVIRKGAFRVSPDESWCGRTINALGEPIDGQGPLASGIVRRSISNNAPPSMTRKRVETPFKTGVRAIDIFSPLCLGQRLGIFAGSGVGKSTLLSMLAKADAFDKVVIALVGERGREVREFIEDTMGDNMSKSVAVVATSDESPMLRKMAPLSAVTIAEHFRDQGDNVLLIIDSVTRFAHAIREVAVASGEPPVARGYPASVFTELPRLLERAGPGAEGTGTITAIVSILVDGDNHNDPIADSTRGILDGHIVLDRSLAEEGRYPPINPLASISRLAKKAWTPDQEKLVSRLKALVHRFEETRDLRLIGGYRPGTDPDLDMAVKQVPIIYETLKQLPDEPAAQDAYADLATALRGGAQNGQPQVNPRMRG

SEQ ID NO: 52811 - protein, 433 aa, Listeria innocua Clip11262
MNWSPETEAWQELKNTVPYIQKGKIHTVQEQVYISKGPQVKIGDTVMVGENKVLCEVISIEKENNMLLPFNQSDKVAYGDWVYVTDTKITIPADEFLLGKVLNASGDILNEEAGTAKFKQKMPLEAPPIHAFNRAEITETLETGIKAIDGMLTIGIGQKIGIFAGSGVGKSTLLGMIARNAKADINIIGLVGERGREVKDFLRKDLGEEGLRKSVIVAATSDESHLMQLRAAKLATSIAEHFRDQGKTVLLMMDSVTRFADARRSVDIAVKDLPIGGKTLLMESYMKKLLERSGKTKNGSITGIYTVLVDGDDMNGPVPDLARGILDGHIVLTRELATKNHYPAIDVLGSVSRVMEEIVPESQWKSASKIREWMSIYQENELYFKLGTIEQTSDNAAIFTSKEKSYFIHQFLKQLRDESVTLEETSKMMETLV

SEQ ID NO: 52812 - protein, 577 aa, Sinorhizobium meliloti 1021
MTRTEILDGLRQSPKVDVCVLGGGINGLSVFRELALQGVRVLLVEKHDYCSGASAALSRMVHGGLRYLENGEFTLVKESLVERDRLLRNAPHLVSPLATTVPVFDIFSGLANGIVRFLGLSRRPSRRGAIAIKAGLSIYDLLTRKRALMPRHRFRGRRATLAKWPALNPKIRSSATYYDAWVSHPERIGMELLQDGLSASTEAAALNYAELRRNEAGTYIIADDVEGVSVEIEPSLIVNATGGWIDITNGALLPPDHRSAPLMGGTKGSHLIIDNVHLRDALGDHMIYYENEDGRICILFPYFGKVLVGSTDIRVDDPGTVRCEEEERDYILQSLAFVLPGIEIGPEEIVYKFSGVRPLPASSDSFTGRIPRDHFCTMIESAGTPVLCMIGGKWTTFRSFGELAADTVLERLGLPRRTSTADRAIGGGRRFPADRESWIAALAARCGLPPPHVAELFSRYGTEAEALAAFIGQGSDAAIPGAGHTMRELLFLIRNEAVEHLDDLLLRRTTLAISGTLSLAILDAALELLTGEKGWSEARSLSERNRCLALLRDRHGVDEKALAARMPPPLAKAVAAG

SEQ ID NO: 52813 - protein, 414 aa, Opitutaceae bacterium TAV2
MPDIPAPSPPVISAAFVTAAASAVNLTTADFARYSRQLSLAGFGPGAQLALKRARVLVIGAGGLGCPALLYLTAAGVGHITLLDPDRVDTSNLQRQVIFTTDDTGQPKAEVAARRLRALNPLVTIEPHTERFTRDNALALVAAHDVVIDGSDNFATRYLVNDACVIGRRPFVYGAIQGFGGQVSVFNFPPPPPPPASSTSPATSPTYRCLFPEPPAPGDAPSCAEAGVLGVLPGIVGTLQATETLKILTGIGHPLAGRLLLVDALTMEMRTLAITADPQNQRLRELPAEDFGQTCATMTQITAANGTDAASPDEITIDELRALRAGGVHRQLIDVREDWERALAAIEPSVHVPLDQLGTPAAEAALAALDPLQPTIVYCARGRRSLKALPALRGHHGFANILSLQGGITAWGQN

SEQ ID NO: 52814 - protein, 582 aa, Cryptococcus neoformans var. neoformans JEC21
MSGGSSLDEKTSSLDHGYKASTLAIVNSSSAAEKAGRPHFFIEESSSHGAFVGEQGGNGAQVTIQDVWGAPVETSSLLKSLGSIGLTLIYWPIGLLISLAGISVYLEFTSYFPSRSGAEVVYLEQAYRKPRFFFPVAFAVQTVILSFVSSNAIVLIGPYYEVVAEYIFKMTDHTPSDWESKGVGIAALTIIILPVFFSTNISLRLSNILGIAKIITLLIIIIPGFVALGGHFKVVPDPTANFHNAFEGTTNNGYNLSNALVNIIFSYGGYTNSFNVANEIKNPIRTIKYTANTAVIFVAVLYMLTNIAYFAVLTQEEIKGSTQVTATLFWEKLWGSKVSKGLTILPVLSASSNILNTIVGHSRMIREIGRQGVLPYPKFWVTTWPIGTPTGALFAIWFVSLIVIVVVPAGNAFNFIVALQNYPSSFFLVLMTLGLFIVRRDRRRLSLPRPEYRSWTIVVLFFLAANTFLIIMPWVPPTGGVNNSSFGFFYAASSLTGLGIVFLCGFYYVLWSKLLPKWKGYKLRQTVITLADGALTHKMVKVKNEDVDAWDVTHDPSGRLLNEDEDLVEINEEHASLRDLKE

SEQ ID NO: 52815 - protein, 366 aa, Roseovarius nubinhibens ISM
MEDMRAPDFPELVNGLLEDVKKVYRMSSGRVFVFPSSGTGAWESAITNTLDRGDRVLMSRFGQFSLLWVDMAQRMGLEVELCEVDWGKGVPLEAYRAALAADKDHSIKAVFATQNETATGVTSDIEGVRRVLDETGHPALLFVDGVSSIASIPFEMEKWGVDLAVSGSQKGFMLPAGLGILGVSDKALEVNRRRNKAGMERCYFSFEDMIALNDTGYFPYTPATQLLRGLRAALDMLLAEGMEQVWARHAYHAEGVRRAVAAWDGCELVAAGPEWASDTVSAIYTPEGVDARDVIAGAYKKYQTSLGTGLNKLAGRAFRIGHLGSLNPVMLCGALSAAEMALIDAGAKITPGAGVAAAQDHYRTGR

SEQ ID NO: 52816 - protein, 301 aa, Mycobacterium leprae TN
MTVLMNRTGDDETLSTQVKAEVLAEALPWLKQLHGKVVVVKYSGNAMTDDMLRRAFAADMAFLRNCGIHPVVVHGGGPQITAMLRRLGIADDFKGGFRVTTPEVLDVARMVLFGQVGRELVNLINAHGPYAVGITGEDAQLFTAGRRSATVDGMATDIGLVGDVDQVNIAAVLDLISAHRIPVVSTLAPDRDGVVHNINADTAAAALAETLGAEKLLMLTNVEGLYTRWPERDSLVNEIDSAALAQLLPTLEAGMIPKVEACLRAVTGGVPSAHVIDGRVKHCVLVELLTNEGTGTKVVSA

SEQ ID NO: 52817 - protein, 441 aa, Mycobacterium avium subsp. paratuberculosis K-10
MRCTVFGTGYLGATHAVGMAELGHDVLGVDIDPGKVAKLAGGDIPFYEPGLRKLLNENLAAGRLRFTTDYDMAAGFADVHFLGVGTPQKKGEYGADLRHVYAVIDELVPRLTTSAVLVGKSTVPVGTAAELNQRAAALAPRGVDVEIAWNPEFLREGYAVQDTLRPDRIVLGIKQDSPRAQAAVRELYGPLLDAGVPFLVTDLQTAELVKVSANAFLATKISFINAISEVCEAAGADVSLLADALGYDPRIGRQFLNAGLGFGGGCLPKDIRAFMARAGELGADQALTFLREVDSINMRRRTRMVELASAACGGSLLGANVAVLGAAFKPESDDVRDSPALNVAGQLQLNGAAVNVYDPKALDNAQRLFPTLNYAVSVEEACERADAVLVLTEWRQFVEMDPDDLADRVRARVVVDGRNCLDVTRWQRAGWRVYRLGAPRP

SEQ ID NO: 52818 - protein, 404 aa, Mycobacterium leprae TN
MTPTQTNTATMQQRWETVMMNNYGTPPIVLASGNGAVVTDVDSNTYLDLLGGIAVNVLGHRHPAVIEAVTHQITTLGHTSNLYATEPSITLAEELVALLGADTQTRVFFCNSGTEANELAFKLSRLTGRTKLVAAQAAFHGRTMGSLALTGQPAKQAAFEPLPGHVTHVPYGQVDALAAAVDNDTAAVFLEPIMGESGVIVPPEGYLAAARDITTRHGALLVIDEVQTGIGRTGAFFAHQHDSITPDVVTLAKGLGGGLPIGAFLATGPAAELLTLGLHGSTFGGNPVCTAAALAVLRVLATQGLVRRAEVLGDSMRIGIESLSHPLIDQVRGRGLLLGIVLTAPRAKDIEKAARDAGFLVNATAPEVIRLAPPLIITESQIDSFITALPGILDASIAELGKKA

SEQ ID NO: 52819 - protein, 240 aa, Prochlorococcus marinus str. MIT 9312
MTFTKYQFNNFCYWPSKPKKIVEFIGGSYLASKPDLTYRRFIESLIHKNYAVHAYKYTPQFDHQQLAIKAWKDFKNCRMSLYKRIGSSIPSIRIGHSLGCKLHLISPDGGRNCEKFISISFNNFSANKSIPLLKQIAQKLEFSSEFSPSPERTLRIIEKTYNQKNNFLIKFNSDELDQTDKLFSCLKARKEDNSKGIILKGTHTIIASAGLRENFLGDWADDDFKRNTIKRISNLIDNPD

SEQ ID NO: 52820 - protein, 357 aa, Glycine max
MSAFVGKYADELIKNAKYIATPGKGILAADESTGTIGKRLASINVENIEANRQALRELLFTAPNALQYLSGVILFEETLYQKTSDGKPFVEVLQENNVIPGIKVDKGVVELAGTNGETTTQGFDSLGARCQQYYKAGARFAKWRAVLKIGPTEPSELSIQQNAQGLARYAIICQENGLVPIVEPEILTDGAHDIAKCAAVTETVLAACYKALNEQHVLLEGTLLKPNMVTPGSDSPKVPPEVIAEYTVNALRRTVPAAVPGVVFLSGGQSEEEATLNLNAMNKLEVLKPWTLSFSFGRALQQSTLKTWGGKKENVAKAQEAFLARCKANSDATLGKYVGGSGSGLTSESLYVKNYKY

SEQ ID NO: 52821 - protein, 396 aa, Roseovarius nubinhibens ISM
MDIHEYQAKELLKRFGVNVPRGGIAYSPEQAVYRAQELSGDKCVVKAQIHSGARGKAGGVRVCSSDEEIADAASWMLGRKLVTHQTGPQGKLVGRLYVEEATDIRQEIYLGFVMDRTEERVVVVASAQGGMEIEDISANEPDSIIRSVVDPAVGMQAFQAREIAFQLGLDPSLIAQASKTITGAYKMMDQLDASMLEINPLVVTGSGEIVALDCKVSFDDNALFRHPEISELRDKSQEDARETYAGDRGLNYIGLEGEIGCIVNGAGLAMATLDMIKMAGGEPANFLDVGGGASPERVLMSFKAVLNDPNVEAVLVNIFAGINRCDWIAEGVVRAVQELDLKLPLVVRLSGTNVEEGRKILAESDLNITTAETLAEAAEKVVSAWRMAEAKNGRAA

SEQ ID NO: 52822 - protein, 256 aa, Zea mays
MDEWIRQAEVWVRQSESWIRQQPPEQIYVAATVVAVTILLLIVASYLKSSKPSTIVLSGLSGSGKTTIFYQLRDGSSHQGTVTSMEENSDTFVLHSEQERKGKVKPVHIVDVPGHARLKPKLDEVLPKAAGVVFIGDAQDFLSSMQAAAEYLYDILTKASVVKKRIPVLIFCNGTDKVTAHSKEFIKKQLEKELNKLRESRNAISSADISDEVQLGVPGEAFNFSQCQNKVAIAEGAGSTGNVLAVEQFIREHVRA

SEQ ID NO: 52823 - protein, 140 aa, Roseovarius nubinhibens ISM
MAVERTLSIIKPDATKRNLTGKINAKFEDAGLRIVAQKRIQLTPAQAGKFYEVHAERPFYGELCDFMASEPVVVQVLEGEGAIAKNREVMGATNPADAAPGTIRAEFAESVGENSVHGSDAPETAAQEIAFFFSGLELVG

SEQ ID NO: 52824 - protein, 418 aa, Zea mays
MHASGKKSDLALLRKVPCAPLRRLLDNLQEVLLATKLALLFPAVLLAIAARIFHFGQEWVFVLSLIGLVPLAERLSFLTEQVAFYIGPTVGGLLNATFGNVTEVIIAIFALYQGKVVVVKCSLLGSVLSNLLLVLGTSLFFGGLANLGTEQLYDKMQVDVNTGLLILGVLCHSLPLMLRYAVSSGEHAESSWDSGLELSRACSIVMLLAYVAYLFFQLKTHRQLFEPQPQEVEDDGDDSVSQDEAVLGFSSAMIWLGVMTLMTALLSEFVVSTIEAASESWELSVSFISVILIPIVGNAAEHAGAVIFAFKNNLDITLGVSLGSATQISMFVVPLSVLVAWIMGVPMDLDFNLLETGCLFLAILVTAFTLQDGSSHYLKGLLLVFCYIVISLCFFVLRQHGNGSNDDQVGVASKPWRI

SEQ ID NO: 52825 - protein, 526 aa, Yarrowia lipolytica CLIB122
MIQSVFLALAILIAYLGFAEWFSRFQHRRISKKKGCGMPPMANGGFLGWYGLYKTYQITSERTYPHSMRMGLEAFGHTFVYPVPGTDMLQTIHPDNIKAILATQFKDFSLGTRHKIMLPTLGDGIFTLDGEGWTHSRALLRPQFARDQVSHVASLERHIQVLFKTIKKENKECDPAKGFDIQELFFMLTLDTATEFLCGDSVDSLTDYLADPTAPQLDHSGIDENVRRAFPEAFNTAQWFCSIRAKLMKLYFFAGTVFYRKKYADANKIVHDFTDFYVSKALAARKEKFQELDQEGKYIFLYELAKETRNPKVLRDQMLNILLAGRDTTASLLSWVMFRMARQPETWKKLRQAVINDFGDTPDELSFESLKRCEYLRYVLNEGLRLYPSVPMNFRVATRDTTLPKGGGPDLDQPIFIPKGGIVVYSVYHTHRAEEYWGKDTEEFIPERWDPAEGYQIARGWEYLPFNGGPRICLGQQFALTEAGYVLARLAQEFETVTSCDDKPLPPKYNTHLTMSHDDGVWLKME

SEQ ID NO: 52826 - protein, 292 aa, Oceanicola granulosus HTCC2516
MDRDWIATARTLSEALPYLQRYSGAIVVVKFGGNAMGGVEEMADFARDIVLMRQVGLNPVVVHGGGPMINDLLKRLGIESRFVRGKRVTDQATVEVVEMVLTGLVNKRIVQAIMDEGGRAVGLSGKDDDLMVCEADDPELGFVGRPIEMNVQVLRDLFAAGIIPVIAPVATGMDPNETFNVNGDTAAGAIAGALKADRLLLLTDVQGVKDKDGNVVTQLSPEDVRAMIADGTIAGGMIPKVETALKALDEGVRGAVICDGRLPNATLLELFTEYGAGSIIRSTEPRVKPRGA

SEQ ID NO: 52827 - protein, 148 aa, Clostridium bifermentans
TIAEAVEFVNEIKGKVNNTDVEAVICAPFTLLKDLKEATKGTPIKIGAQNMHYADNGAFTGEISAPMLKELDIDYVVLGHSERRQYFNETNETVNKKVLKALEAGIDPILCIGETLEEREADKTKDVCKVQTEKALENVTAEYMKKVV

SEQ ID NO: 52828 - protein, 278 aa, Citrus aurantium
EACEKWGFFELVNHGIEPEFMDTVERLTKAHYRKCMEQRFKELVASRALEGIQTEVNDMDWESTFYVRHLPQSTINEVPDLDEEYRKVMKEFALKLEKLAEELLDLLCENLGLEKGYLKKVFHGANGPTFGTKVSNYPPCPKPGLIKGLRAHTDAGGIILLFQDDKVSGLQLLKDGQWIDVPPLRHSIVVNLGDQIEVITNGKYKSVEHRVISQTDGEGRMSLASFYNPGGDAVIYPAPALLEKEAEKKQVYPKFVFEEYMKLYVPLKFQAKEPRFEA

SEQ ID NO: 52829 - protein, 153 aa, Clostridium sordellii
WKMHKTIAEAVEFVEEIKGKVNNTDVEAVICAPFTLLKDLKEATKGTDIKIGAQNMHYADNGAFTGEVSAPMLNELNIDYVVLGHSERRQYFNETNETVNKKVLKALEAGIDPILCIGETLEEREADKTKDKCRLQVEKALENVSKDDMKSCY

SEQ ID NO: 52830 - protein, 153 aa, Clostridium septicum
NWKMHNTPEEAVKVITELKPLVKDANCDVVICPTFVCLDAALKAAAGSNIKIGAQNMHFEEKGAFTGEVAPGMLEAMGVDYVVLGHSERREYFNETDEALNKKVKVAFAHNLTPILCCGETLEQRENGTTNAVVGAQIKADLEGLSKELAEKL

SEQ ID NO: 52831 - protein, 154 aa, Clostridium cadaveris
NWKMHNTVDETVKVINELKPLVKDAKVDVVLCVPFTSLDAALKAVKGSNIKIGAQNMHFEEKGAFTGEIAPGMLEAMGVDYVVLGHSERRQYFNETDEALNKKVKAAFAHNLLPILCCGETLEERENGTTNAVVGAQIKADLEGLSKELAEKVV

SEQ ID NO: 52832 - protein, 175 aa, Frankia sp. EAN1pec
MAEELYATVRTTQGDIEIRLFPDHAPKTVKNFVGLATGSREWTDPATGEKKTGVPLYSGTIFHRVIPNFMIQGGDPLGSGRGGPGYQFVDEFHPDLRFDRPYLLAMANAGPGTNGSQFFITTAATDWLNRKHTIFGEVTRGTDVVDKIGKTPTGAQDRPKTDVVVQEIVVERRPA

SEQ ID NO: 52833 - protein, 139 aa, Clostridium tertium
KVIEELKPLVKDATCDVVVCPTFVCLDAVLKAVEGSNIKVAAQNMHFEEKGAFTGEVAPGMLEAMGVNYVVLGHSERREYFNETDEALNKKVKAAFAHNLTPILCCGESLEQRENGTTNEVVGAQIKADLEGLSNELAE

SEQ ID NO: 52834 - protein, 176 aa, Triticum aestivum
  misc_feature (42)..(42): Xaa can be any naturally occurring amino acid
  misc_feature (58)..(58): Xaa can be any naturally occurring amino acid
ENPLRIFADLCTHYVVGVSSDLETLTHSNAETFHNDITSVLXKQELSSMCTRDTQRVXQTYLSLSLEDTSTSVHIITPKENERHVFRRREEGEIHAPIYQRGGTVTSKEDIEHYISIEMGERTDSFIQRVRGLCTKMSSLDQSISCDHTHLRKRHRGRERARFSYEISDSVSHTYF

SEQ ID NO: 52835 - protein, 404 aa, Synechococcus sp. WH 5701
MIDSPDIPPLSAAAPASASTTEPASGSPAANEAVLVLADGTLLRGTAFGARGTAIGEVVFNTGMTGYQEVMTDPSYSGQLVTFTYPELGNTGVNPEDQEAEAPHVRGVIARQLAPAPSSWRSRGDLPSWLASHGVVGIAGVDTRALVRHLRERGAMNGVISSDGTAPRELLELVRRSPSMEGLNLAARVTAPSAYLWQQLCATGFDQRLQPSPERPYRVVAIDFGIKRAILERLTAHGCTVTVLPASSTIAEVLALEPEGVFLSNGPGDPAAVAEGIALARDLLGQADLPVFGICLGHQILGLALGGSTFKLGYGHRGLNHPCGGEGLVEITSQNHGFAIEASSLPEDLVEVTHYNLNDRTVAALRHRLQPVFGVQYHPEASPGPHDADHHFGRFVRLMAERRP

SEQ ID NO: 52836 - protein, 225 aa, Streptomyces avermitilis MA-4680
MRDSRNATASSDSRNPTGLSATTVRTRVTVPLRFGDGCTVTADLATFHHLADGQEHVAVILGEPAAGRPPLVRLHSECLTGDVFGSARCDCGPQLREALERIADRGGVLLYLRQEGRGIGLYNKLDAYALQDQGLDTYEANTTLGLPEDARDYTAAAQMLAALGIFELDLLSNNPDKAAQLRTLGLTVTQHVPTGVFTTAHNIRYLRTKVVRTQHTLPLTELTVG

SEQ ID NO: 52837 - protein, 567 aa, Streptococcus pneumoniae TIGR4
MALEVIMPKAGVDMTEGQIVQWNKKVGEFVKEGEILLEIMTDKVSMELEAEEDGYLIAILKGDGETVPVTEVIGYLGEERENIPTAGAASPEASPVPVASTSNDDGKSDDAFDIVVIGGGPAGYVAAIKAAQFGGKVALVEKSELGGTCLNRGCIPTKTYLHNAEIIENIGHAANRGIVIENPNFTVDMEKLLETKSKVVNTLVGGVAGLLRSYGVTVHKGIGTITKDKNVLVNGSELLETKKIILAGGSKVNKINVPGMESPLVMTSDDILEMNEVPESLVIIGGGVVGIELGQAFMTFGSKVTVIEMMDRIVPAMDVEVSKNLRLILERKGMTILTGTKLQEIIEENGQLRIKVEGKDDIIASKALLSIGRMPDLEGIGEVEFELDRGCIKVTEYMETSVPGIYAPGDINGTKMLAHAAFRMGEVSAENALKGNHAVAKLNLTPAAIYTLPEVAAVGLTEEQAREKYDVAIGKFNFAANGRAIASDAAQGFVKVIADKKYGEILGVHIIGPAAAELINEASSIIEMEITVEEMLKTIHGHPTYSEVMYEAFADVLGMAIHSPKKK

SEQ ID NO: 52838 - protein, 645 aa, Schizosaccharomyces pombe 972h-
MLLRDGRIPQYSIYPLPVPPMNSKTPTLGIVCSEGTISLSLEEGFEFVGVPLSGEGLKLRVEALAPSERLQEFLDDEVAYHPEENVHKVVGLSSAWLELDSEDTLIADRSEEVLLKEASYASYCGLSSIILNGPTSPMNVMRYARAVSSALNSTMNLKFLVQLAIESGHEDYFETWKMWDTIRSACGYHPRLKVALELPPACSPPIELVNRWYAEPIEMITMSCMAFVPNPNGYPVLGRKLRAIYALYLRLNPRILLWDNDAPEKIGDSPDYSIYMKHLFDSQPPAPLVEDLADSYKDYLQVPLQPLSYNLENITYEIFERDPVKYAQYEQAIFSALMDRDESSVTRIAVVGAGRGPLVDCALRAAISSSRTVDMIALEKNPNAFSMLLMRNRQDWAGKVTLVFGDMRTWNPDYKIDILVSELLGSMGDNELSPECLDGVQHVLDEETGICIPSSYISYVTPIMSPKLWSEARNMNDPNAFERQYVVLMNSFDFLAADDEFRFQSLWSFHHPNKDSEVYTKNLHNKRFASVRFQASSPGILHGFAGYFEATLYKDISLSIMPATMEAKSPDMFSWFPIYMPIKKPMYVPENSQLEFHMWRLTDGMRVWFEWCANAYLVLRNGSQIKLSSTEVHNISGKAFSCNMY

SEQ ID NO: 52839 - protein, 320 aa, Mycobacterium leprae TN
MGGASRLRGRGAAQLTRHFLRDDDLSPTEQADILALAADLKKAPFSRRPLAGPRGVAVIFDKNSTRTRFSFDIGIAQLGGHAVVVDGLSTQLGRDETLQDTARVLSGYVDAIVWRTFGQHRLDAMAATATVPVVNALSDEFHPCQVLADLQTIAERKGSLNGLRLSYFGDGANNMAHSLMLGAVTAGVHVTVATPVGFTPDPSVLAAAKKRAEATGASVTVTVDADTAAAGADVLVTDTWTSMGQENDGLDRVKPFWPFQVNARLVGLADSEAIVLHCLPAHRGDEITNEVMDGPTSAIWDEAENRLHAQKALLVWLLER

SEQ ID NO: 52840 - protein, 441 aa, Oryza sativa Japonica Group
MYVPPSRGGGGGAAGGGEQPRVYQVWRGSNEFFLQGRFIFGPDVRSLFLTIFLILAPVLVFCIFVARHLINDFPDHWGVSVMVVVVVFTIYDLTLLLLTSGRDPGIVPRNTHPPEPESIDGGSDMGNGQTPQQLRLPRTKDVFVNGVIVKVKYCDTCMLYRPPRCSHCSICNNCVERFDHHCPWVGQCIGRRNYRFFYMFVFSTTLLCLYVFGFCWVYIVKIRDAENSTIWKAMLKTPASIVLIIYCFICVWFVGGLSVFHFYLMSTNQTTYENFRYRYDRRANPYNRGMVNNFLEIFCTAIPPSKNNFRARVPVDQGLQQTRTPARGFMSPNMGKPVGDLELGRKPVSWDEPRSAADIRDLEVGLGGLLDEKEGRIAHASPDLSLPGELVEGRAGMHSRRSSWGHRSGTSESMDSIAVQMGTEANWGSISSGHGTTSSTH

SEQ ID NO: 52841 - protein, 547 aa, Cryptococcus neoformans var. neoformans JEC21
MTLVTRSAIRLSRRGGQQLKNARANAALFNTAANQAKNIVPKLAASSSRVTLPAKAANAARTYATPAGLQTGSIKTVIGAVVDVHFDSDNLPPILNALDVQFGEGQTAPEGGRLVLEVAQHLGENTVRCIAMDGTDGLVRGQKVVDTGAPIKIPVGPAALGRIMNVIGQPIDQRGPIKGVREAPIHADAPPFVDQSTQAEVLETGIKVVDLLAPYARGGKIGLFGGAGVGKTVLIQELINNIAKAHGGYSVFTGVGERTREGNDLYHEMRETGVINLEGDSKVALVFGQMNEPPGARARVALTGLTIAEYFRDEEGQDVLLFIDNIFRFTQAGSEVSALLGRIPSAVGYQPTLSTDMGGMQERITTTKKGSITSVQAVYVPADDLTDPAPATTFAHLDATTVLSRSIAELGIYPAVDPLDSKSRMLDPRVVGQRHYDIATKTQQILQSYKSLQDIIAILGMDELSEEDKLTVERARKIQRFMSQPFAVAQVFTGIEGRLVPLKETVNAFEEILDGKHDHISENSFYMVGGIEDVKAKHEKSLKEQGA

SEQ ID NO: 52842 - protein, 619 aa, Roseovarius nubinhibens ISM
MLKIENISYAVAGRPLLEEASAVIPEGHKVGIVGRNGTGKTTLFRLIRGELALEGGQITLPSRARIGGVAQEVPGNEVSLIDTVLAADTERAALLAEAETASDPARIADVQTRLSDIDAWGAEARAATILRGLGFTPEEQLMPCSAFSGGWRMRVALAAVLFSAPDLLLLDEPTNYLDLEGALWLESYLAKYPHTVLVISHDRGLLNRAVGAILHLEDRKLTLYQGGYDRFAETRAARLAVAEAELRKQDARRAHLQSFVDRFRYKASKAKQAQSRLKMIEKMKVITTPQEAALRAFSFPEPEELSPPIINLESASVGYGEKPVLGQMTLRIDQDDRIALLGRNGEGKSTLSKLLAGKLDPMGGRVTRATKLRVGFFAQHQVEELHLDETPIDHVRRLRPTEPIAKLRARLGGFGIGAEQAETEVGRLSGGQKARLSLMLATIDAPHLLILDEPTNHLDIESREALVEALTAYSGAVILVSHDMHLLSLVADRLWLVKDGRVKPYEDDLETYRQMLVSPEKSSRPKSDKAKAAAKPKRPSRDALLALRAEVRKCESRVEKLQEMSEKLATKLADPALYDEDRVDEAAVWQRKYSEVCDGLERAEALWMRALEKLEAAEA

SEQ ID NO: 52843 - protein, 456 aa, Xanthomonas campestris pv. campestris
MAIHSSVLELIGNTPIVKAQRLDTGVCELFLKLEASNPGGSIKDRIGLSMIEAAEQRGDLRPGATLVEGTAGNTGLGLALVAQQKGYRLILVVPDKMSREKIFNLKAMGADVVLTRSDVAKGHPEYYQDLAAKIASETPGAYFINQFGNPDNPAAHEFGTGPEILAQMDGQLDAIVFGCGSSGTMTGLSRAFATASPQTELVLADPVGSILTQYIEEGTVSEKSGSWLVEGIGEDFLPDISDFSRVKKAYSISDAESFHTARELLAKEGILGGSSTGTLLAAALKYCREQTTPKRVLVFVCDTGNKYLSKMYNDYWMLDNGFLEREQHGDLRDLILRPYNKRDTVVVGPKDLLTTAYQRMKLYDVSQLPVIDDGELVGIVDESDVLLHVYGDEARFRDPISTAMVSKLDRLDVASPIEALLPVFDRGQVAIVMDGNQFLGLITRIDLLNYLRRRVQ

SEQ ID NO: 52844 - protein, 476 aa, Mycobacterium avium subsp. paratuberculosis K-10
MRDDDSANRWSGVREAPTAPSRQLTGAVVIIALVAAISGMLYGYDTGVISWALLQLTQDFNITEGWQQVIAASILLGAVAGALTCSWLSDLRGRRGTLLMLAVVFIVGALWCADAADSVMLSLGRLVLGFAVGGATQTAPMYVAELAPPAYRGRLVLCFQIAIGVGILTATLVGAGGSISWRGPIGLACVPAAIMLWLLLRLPESPRWLVKKDNRDAARAVLEHVRPEGYDVAAELDEATELARVERTAATRGWRGLRDAWVRPALVLGCGIAVFTQLSGIEMIIYYSPTILTDDGVYRSVALQVSVCLGAAYLIAQLVGLAIIDRVGRRRLTLIMVPGAAVSLFALGLLFITSDSGRDVIPYIMICLIAFMLFNGGGLQLMGWLTGSETYPLAVRPAATALQSATLWGTNLVITLTMLSLIKAIGVGPLMWLYALFNVAAWIFVFFRMPDLTGKTLEEIEYQLSEGKFRPSDFGR

SEQ ID NO: 52845 - protein, 410 aa, Streptococcus agalactiae A909
MTLLDSYKLKQDFPILNQLVNDEPLIYLDNAATTQKPNQVLETLRDYYQNDNANVHRGVHTLAERATAQYETAREKARQFLNAKSSKEILFTRGTTTGLNWVAKFAESILERGDEVLISIMEHHSNIIPWQQACERTGAKLVYAYLKDGSLDLEDFYNKLSSKTKFVSLAHISNVLGCITPVKAIAERVHQVGAYMVVDGAQSAPHMAIDVQDLDCDFFALSGHKMLGPTGIGVLYGKESILDKMPPVEFGGEMIDFVYEHSATWKELPWKFEAGTPNIAGAIAFGEALDYLTDVGMDEIHQYEQSLVSYVLPKLQAIDGLTIYGPSDAESHVGVIAFNLEGLHPHDVATAMDYEGVAVRAGHHCAQPLINHLGIHSAVRASFYFYNTKEDCDKLVDAIQKTKEFFNGTL

SEQ ID NO: 52846 - protein, 313 aa, Flavobacteria bacterium BBFL7
MTNIMTEAKLFGCRQSMDLAKAVAEKYGASLGQVNFSTFSDGEFQPSFEESIRGRRIFIIGSTHPSSDNLMELLLMLDAAKRASARHITAVIPYFGWARQDRKDKPRVPIGAKMIAKILESAGATRIITMDLHADQIQGFFEKPVDHLFGSALFIPYLKSLNLSDLTIASPDMGGSKRAYAYAKTLESDVVVCYKQRQKANVISHMELIGDVTGKNVVLVDDMVDTAGTLTKAADVMMERGAKSVRAICTHAILSGQAYERIENSQLEELIVTDSIPLRKESKKIKVLTCAGLFAEVMTSVQNNESISSNFIM

SEQ ID NO: 52847 - protein, 502 aa, Roseovarius nubinhibens ISM
MSDLLTREEYGAIAKGLTLPVNAFIDGSFRPARSGATFETVNPATGAKLADVAACDTKDVDFAVEKARDAFEDGRWSRLHPSARKDVLIRLCKLLTRNAHELAVMESLDSGKTIYDCETVDIPETIHCLKWHAELIDKIYDQVSPASDDHIAMVLREPVGVVGLVLPWNFPLLMLAWKIGPALAAGCSVVVKPAEETPLTALRLAELAHEAGVPAGVLNIVTGDGPGVGEPLGRHPDVDMVSFTGSTETGRRFLHYSADSNLKEVVLEMGGKNPCVVLDDAENLDSVAAHVVNGAFWNMGENCSASSRLIVHASVKDDLLARVEAHAREWITGDPLDPQVRVGALVSRAHFDKVCSYLDEVQKGRVVIGGTHSGGAFVDPTVVEISGNDARLAREEIFGPVLSVITVTSTEEAISIANDTPYGLAASVFSANGKRAIRAARAIKAGTVTVNSFGEGDITTPFGGYKHSGFGGRDNGIHAHDQYTQLKTIWIDLSDDSDDQIG

SEQ ID NO: 52848 - protein, 306 aa, Rhodobacter sphaeroides 2.4.1
MILCCGEALIDMLPRETTAGEAAFAPYAGGAVFNTAIALGRLGAPAGFFSGLSTDLFGVQLAETLAASQVETDLCARSDRPTTLAFVRLTNGQASYAFYDENTAGRLLAPADLPALPDRVSTLFFGGISLVNEPAAATYEALMAREAPRRVTMLDPNIRPGFIADAAAYRARIGRMIALADILKLSDEDLHWLEGPGQILSLARGLLARGPKLVLVTEGAVGARAVTATEDRFCAATPVQVADTVGAGDTFNAGVLAALHEAGALSRSAVASLSPETLAAALALGTRAAAVTVSRPGANPPWVDEL

SEQ ID NO: 52849 - protein, 305 aa, Oryza sativa Japonica Group
MAMATTSVTSLAMAMAAAASADATQAPHKLSALPFHHLLFSRAPPLLRASRRLPLAPLVASSDAAAAAEAGVEWSETEEADEGSQEEEEEEVVEEQAEAEEEVVASVEEEEEEAVEEEFAAEPPEEAKVYVGNLPYDVDSEGLAQLFEQAGVVEVAEVIYNRETGQSRGFGFVTMSTIEEADKAIEMLNRYDINGRLLNVNRAAPRGSRVERPPRQFAPAFRAYVGNLPWQVDDSRLLQLFSEHGEVVNASVVYDRESGRSRGFGFVSMASKEELDDAISALDGQELDGRPLRVNVAAERPQRGF

SEQ ID NO: 52850 - protein, 520 aa, Trametes versicolor
MSRFHSLFAFVVASLTAVAHAGIGPVADLTITNAAVSPDGFSRQAVVVNGGTPGPLITGNMGDRFQLNVIDNLTNHTMLKSTSIHWHGFFQKGTNWADGPAFINQCPISSGHSFLYDFQVPDQAGTFWYHSHLSTQYCDGLRGPFVVYDPNDPAADLYDVDNDDTVITLVDWYHVAAKLGPAFPLGADATLINGKGRSPSTTTADLSVISVTPGKRYRFRLVSLSCDPNYTFSIDGHNMTIIETDSINTAPLVVDSIQIFAAQRYSFVLEANQAVDNYWIRANPNFGNVGFTGGINSAILRYDGAAAVEPTTTQTTSTAPLNEVNLHPLVATAVPGSPVAGGVDLAINMAFNFNGTNFFINGASFTPPTVPVLLQIISGAQNAQDLLPSGSVYSLPSNADIEISFPATAAAPGAPHPFHLHGHAFAVVRSAGSTVYNYDNPIFRDVVSTGTPAAGDNVTIRFRTDNPGPWFLHCHIDFHLEAGFAVVFAEDIPDVASANPVPQAWSDLCPTYDARDPSDQ

SEQ ID NO: 52851 - protein, 135 aa, Brassica napus
MVKICCIGAGYVGGPTMAVIALKCPSVEVAVVDISVPRINAWNSDQLPIYEPGLDDVVKQCRGKNLFFSTDVEKHVREADIVFVSVNTPTKTRGLGAGKAADLTYWESAARMIADVSVSDKIVVEKSTVPVKTAE

SEQ ID NO: 52852 - protein, 107 aa, Physcomitrella patens subsp. patens
TNLWMQLLKKSGWKEGTGLGVVEQGRLDPVESYLKQDRRGIGADLKKNKSTMSSENRQNRKNAVKPADGKKEKVLSKKAKKALAIAEREREHALAAAFYREFWPENV

SEQ ID NO: 52853 - protein, 618 aa, Schizosaccharomyces pombe 972h-
MSSKSASKLKREAKKAERLAAKGESVKPSKKNGTKNGKDKEVDGVTKDLSELSTSDPIFERSASGVLTSQPMSRDIKIDSYTLSFHGRLLIENATIELNHGQRYGLLGDNGSGKSTFLESVAARDVEYPEHIDSYLLNAEAEPSDVNAVDYIIQSAKDKVQKLEAEIEELSTADDVDDVLLESKYEELDDMDPSTFEAKAAMILHGLGFTQEMMAKPTKDMSGGWRMRVALSRALFIKPSLLLLDEPTNHLDLEAVVWLENYLAKYDKILVVTSHSQDFLNNVCTNIIDLTSKKQLVYYGGNFDIYMRTKEENETNQMKAYLKQQEEIAHIKKFIASAGTYANLVRQAKSKQKIIDKMEAAGLVEKPEPPRQFSFEFDEVRKLPPPIIAFNDVAFSYDGNLDHALYRDLSFGIDMDSRVAIVGKNGTGKSTLLNLITGLLIPIEGNVSRYSGLKMAKYSQHSADQLPYDKSPLEYIMDTYKPKFPERELQQWRSVLGKFGLSGLHQTSEIRTLSDGLKSRVVFAALALEQPHILLLDEPTNHLDITSIDALAKAINVWTGGVVLVSHDFRLIGQVSKELWEVKDKKVVKLDCSIEEYKKSMAKEVQSRDTTAKVKHLI

SEQ ID NO: 52854 - protein, 431 aa, Escherichia coli
SKIVKIIGREIIDSRGNPTVEAEVHLEGGFVGMAAAPSGASTGSREALELRDGDKSRFLGKGVTKAVAAVNGPIAQALIGKDAKDQAGIDKIMIDLDGTENKSKFGANAILAVSLANAKAAAAAKGMPLYEHIAELNGTPGKYSMPVPMMNIINGGEHADNNVDIQEFMIQPVGAKTVKEAIRMGSEVFHHLAKVLKAKGMNTAVGDEGGYAPNLGSNAEALAVIAEAVKAAGYELGKDITLAMDCAASEFYKDGKYVLAGEGNKAFTSEEFTHFLEELTKQYPIVSIEDGLDESDWDGFAYQTKVLGDKIQLVGDDLFVTNTKILKEGIEKGIANSILIKFNQIGSLTETLAAIKMAKDAGYTAVISHRSGETEDATIADLAVGTAAGQIKTGSMSRSDRVAKYNQLIRIEEALGEKAPYNGRKEIKGQA

SEQ ID NO: 52855 - protein, 263 aa, Zea mays
MAPGGSGERWSLAGATALVTGGSKGIGQAVVEELARLGARVHTCARSAADLEECRRRWAEKGLRVTVSVCDVAVRADRERLVLDTVSAAFDGKLDILVNNAALLLLKPAAEWAAEDYARIMATNLESCLHISQLAHPLLLNASVAGGASIVNVSSIASVLGFPQEVMYSVTKGGLNQMTRSLAVEWACDRIRVNCVAPGVIMTDMGKELPAALVEQERSRIPLRRTGEPEEVASLVSFLCMPAASYVTGQVIFVDGGRTISGA

SEQ ID NO: 52856 - protein, 171 aa, Cryptomeria japonica
MANPRVFFEMAVGGAPAGRIVMELYADVTPKTAENFRALCTGEKGTGKSGKPLHFKGSSFHRVIPGFMCQGGDFTAGNGTGGESIYGSKFPDENFQKRHTGPGILSMANAGKNTNGSQFFICTAKTEWLDGKHVVFGQIVDGMDVVRAIERVGSSSGRTSKPVVIQDCGQL

SEQ ID NO: 52857 - protein, 257 aa, Bacillus halodurans C-125
MKNQTIIVTGGSNGMGKAMAARFASLGANVVITGRDQERLETAKSEVAQDSGRVLTVQMDVRNPDDVERMVKDTLSEFGAIDGLVNNAAGNFLCAAEDLSLNGWKSVIDIVLNGTWHCTQAVGKEWIKDGRKGHILNMVATYAWTAGAGVVHSASAKAGVLAMTRTLAVEWGTKYGIRLNAIAPGPIEGTGGAEKLILNETFQKAVLQTVPLKRFGTLEEIAGLAAYLFSEEATYMNGECISLDGGQWLRGTLFPFS

SEQ ID NO: 52858 - protein, 65 aa, Staphylococcus aureus
DIIVDRLGVDADKVTEDASFKDDLGADSLDIAELVMELEDEFGTEIPDEEAEKINTVGDAVKFIN

SEQ ID NO: 52859 - protein, 489 aa, Vitis vinifera
MGKSVLVLVLTLVVLSGGVSSASATASPAKIVTGFVSDAVPVVMKWLWSLKATTKTAISSRSMMKFESGYTVETVFDGSKLGIEPYSIEVLGSGELLILDSANSNLYKISSSLSQYTRPKLVTGSAEGYSGHVDGRLREARMNHPKGLTVDDRGNIYVADTLNMAIRKISDAGVTTIAGGKLGRGGGHVDGPSEDAKFSNDFDVVYIGSSCSLLVIDRGNQAIREIQLHFDDCAYQYGSGFPLGIAVLIAAGFFGYMLALLQRRVGTIVSSENVSTHLVLYTYQKPLKSVRPPLIPTEDEMERQEEGFFGSLGKLFVYAGACIAEIFGGMIPGLKKKPHSYQYQNQQNYQQPQKHSNAWPLQESFVIPDEDEPPSIDTRTPTPRKTYPFMSKDAEKMHQIRQSRAFVSGWDGDFQQQQKQHHHRHYSSTPHTYYEQNCEKTNEIVFGAVQEQQVRREPVDIKPVNYGDPIYDHHNIRSRIHSKGYTQGY

SEQ ID NO: 52860 - protein, 424 aa, Treponema denticola ATCC 35405
MSKVLSIILGGGKGTRLYPLTMHRSKPAVPFGGKHRIIDIPLSNCINSGFRNIYIVTQFNSASLHIHIAKAYTFDTFSNGFVEILAAEQTFDNTGWYEGTADSIRKNLHHFRHQNPSHYLILAGDQLYRMDLKKFLNFHKESESDITVACTPVTREDASGFGIMKVNSDSLITEFMEKPGADKNIDDWKIPEKSLIKPNDPNKQYLASMGIYIFSAKIMEECLDSDHTDFGKEVIPAAINGKYKVSAFPHNGYWSDIGTIKSFYDATLDLTEITPKFDFYDAERPIYTHNRNLPPSKVNYAHLSRSICSEGCVITNSTINHSVIGVRSIIETGSFVEDSICMGADYYETHEEKETRLKEGSPGLGIGNHCRIRSAIIDKNVRIGNNVSIGMDQTPPDGDYGFYHVVGGIYVIVKNSVIPDNTSI

SEQ ID NO: 52861 - protein, 387 aa, Ostreococcus tauri
  misc_feature (1)..(1): Xaa can be any naturally occurring amino acid
XGHFSTCWLVEDVGSGREMNGKVTYRALKIQKSSGSYTEAAKDEIEILTQCKDQAASAEERELGSDNVVRLHDHFTHQGPNGTHVCMVFDVLGDNLLTLIKRYEYLGVPLLGVKALTRAMLRGLRYLHDVKNIIHTDLKPENVLLTLALPEKKRGRKSKNKVVDPRKDVKAGTPTLVDQIERLDVASSKRESGQVENDTSKETNSEDDIDCVDLLPYSLLKRLDAKICDLGNACWVDRQFTQDIQTRQYRAPEVILGAKYDTSADIWSLACIVFELATGDVLFDPRSGKDYDRDEDHLALMMELVGRMPKHLALSGKYSKEFFNRSGELRHIRSLKFWPCERVLIEKYNMPEKDAKDLSDFLVPMLDFNPSKRATAEKMLEHRWLQF

SEQ ID NO: 52862 - protein, 394 aa, Mycobacterium avium subsp. paratuberculosis K-10
MTSTLPDARPAVAALNPLEDYLAACKQACDREIVRLYGSGERGSNGLYQLILDYPLRGGKALRPALSIATCLGLGGHLEAILPTAATLELYHNAFLIHDDIEDESWWRRGKPTLHIDYGVPVAVNVGDAMLSLSLQPLLDNVERVGLGPALRILRAVATMTRKTVDGQALELDWVHSNTWRLDDADYLEMVELKTSWYSFITPLQAGTVAAGATPDRMAPLESLGRHLGAAFQITDDLLNLRADPQEYGKEIGGDLWEGKRTLMLLHTLRHAEPGDQQRAVQILSRRRPSPDAEFDLTELLDRLTAGGQLSVSGRTEIDARLRRHHHSEVKSLNDIRWLYELMHRVGSLNHARDVAVRQARQAAAVLAGLDWFPRSRHRDMLAALVDYVHGRAR

SEQ ID NO: 52863 - protein, 630 aa, Oryza sativa Japonica Group
MAVAGAFRRSTSTALQALTALSVLAALLQVEGQMYGPEEAAQTAQCPPFSWGHLKNVSPPFRRHGDPPDCGYKSHELVCSDTKATIRINNATYYVTRIIHWSLFVVVDTDLLNSHNSSCPLPRRQHQPPHERISMAPTSDGVQVIELAPFTNRWAAFVNCSKEITRNVRYKPVACLSTSHSFVYVLTGSESETVYVESLEPSCGYLGMTPLDDRGASINASLSYADVLKYMRKGFAIGISSSSGTYHFDFRACLAESVRFLLAPLVVLTFLSHKYWKARITIDAVEKFLRMQEMLSPMRYGYTDIIAITSHFRDRLGQGSYGTVYKGVLLPGNIHVAVKMLNGNSNCNGEEFISEVSTIGRIHHVNVVRLVGFCSEEMRRALVYEYMPRGSLDKYIFSSDKSFSRDKLNEIALGIARGINYLHQGCDLQILHFDIKPHNILLDKNFVPKVADFGLARLYPRDKSFVPVSAARGTVGYIAPEMISRSFGVISSKSDVYSFGMLLLEMAGGRRNADPNAENSSQAYYPSRVYRQLTRQETGEITAAADMHELEKKLCIVGLWCIQMRSCDRPMMSEVIEMLEGGVDCLQIPPRPFFCDDDYIPAMESLYLSSELELAAISEEKDEESITELN

SEQ ID NO: 52864 - protein, 168 aa, Rumex obtusifolius
MDAEVEYRCFVGGLAWATDDQSLERAFSNYGQVLESKIINDRETGRSRGFGFVTFSSEQAMRDAIEGMNGQDLDGRNITVNEAQSRGSGGGGGGYRGGGGGGYGGRREGGYNRGGGGGYGGGGGGYGGGGGGYGGGGGGYGGGRREGGYGGGGGDRYARGNSDSDWRN

SEQ ID NO: 52865 - protein, 521 aa, Prochlorococcus marinus str. MIT 9312
MSNFSRYLSKNWLDDPKSNILSGLVVAFAMIPEAIAFSGIAGVDPKVGLFGAFCLSITIAIVGGRRGMITSATGSTALLMTGLVAYGESQAPGLGVPYLIAAGILTGIFQILWGYLRLAYQMRFVPTGVLSGFVNALALLIFQAQLPQLGIGIKESKELVEQTLSQYPVNSQIPVVWILVILGLVIIYGLPKITKVIPSQLIAIVVITLISIFFNLDVPTVSDLGKLPDGLPSISLPFGSIENGKVPFSLETLGIILPTALAISLVGLMETFLTQDILDDVTDTSSNKNKEARGQGIANIVASLFGGMAGCALVGQSVMNTENGGKSRLSTLSSGISLLIMIILLKSWIGAIPMAALVAIMITIAISTADINGLKNISKIPKSDTAVMLMTFAVTMLTKPHNLALGVIAGVALAAILFSRKVAKVITVSRAKENNLTTYKVKGQLFFVSKIYFLQGFDIHEHPENIVIDMSLAHIWDQSGVVALEQIIRKFQNGGSKVEILGLNKESLNLFERLGGLESAH

SEQ ID NO: 52866 - protein, 105 aa, Microcystis aeruginosa PCC 7806
MVLDGAQSVSHIPIDVQQLGCDWFVFSGHKVFGPTGIGVLYGQEDLLNATVPWQSGGNMIVDVTFERTVYQAAPTRFEAGTGNIADAVGLGTALDYVQQIPLEKN

SEQ ID NO: 52867 - protein, 905 aa, Hyphomonas neptunium ATCC 15444
MGNAAVKNADETWVYAFGGGTSDGDASMRNLLGGKGANLAEMAKLGLPVPPGFTISTAVCVAYYDTGRVYPATLDAQVSDALAALEGKTGKGFGDPENPLLVSVRSGARASMPGMMDTVLNLGLNEAVAAGLAGKAGDRFAYDSYRRFIQMYSNVVLGMGHDEFEHILDDYKEREGLDLDTELTADNWKQVIVRYKEAVQKELGRPFPEDPREQLWGAISAVFDSWMSDRAIIYRKLNDIPANWGTAVNVQSMVFGNLGDTSATGVAFTRDPSNGSPIFYGEYLINAQGEDVVAGIRTPAPISRERANTLGSSDAPLEEAMPPVYKQLVDVANTLERHYKDMQDIEFTVEDGTLYMLQTRNGKRTAAAAVKIAVDMVREGLITEEEALLRIDPTALDQLLHPRIPSDDENKKAGNAAYDVAFKGLPASPGAAVGRVVFDSEEAFALAAKGEDVILVRVETSPDDIKGMHAARAIVTARGGMTSHAAVVARGMGRPCVCGASDLRINTAKGEFTARGRTFKKGDMITVDGVNGRVIAGAVSLINPDLSGDFGEFMGWADKRRTLKVRANAETPLDTRTAVEFGAEGVGLCRTEHMFFDEERIPAVRTMILSNDETGRREALAKLLPMQRSDFEEIFRILGDRPATIRLLDPPLHEFLPHTDEDIAGVAKASGLSAEELRRRAADLHESNPMLGHRGCRLGITYPEIYEMQARAIFEAAVNIFKEGKLKPVPEVMIPLVATHRELDILKKLVDETAQKVFAETGVTLDYMVGTMIELPRAALAAGEIAQAAEFFSFGTNDLTQTTLGISRDDAGKFLPIYSEKGIYEKDPFVTLDQEGVGELVKIAAERGRKTRPDIKLGICGEHGGDPASVEFCHRAGLDYVSCSPYRVPIARLAAAQAAIRGAKK

SEQ ID NO: 52868 - protein, 139 aa, Melampsora medusae f. sp. deltoidis
  misc_feature (138)..(138): Xaa can be any naturally occurring amino acid
QQASHLSQNYYPETMGKFYIINAPYLFSTVWSLVKPWLDEVTVKKISILDSSYHKTLLEQIPAESLPKTLKGTCDCPGGCSMSDAGPWKDAEAVTKAKKLKAGEPAKVEAAPEGEKKPEETAATGAPATEAAPAETTXA

SEQ ID NO: 52869 - protein, 392 aa, Bacillus cereus ATCC 14579
MKLFQPSEIVTSLPTQFFASLVAKVNKVVAAGHDVINLGQGNPDQPTPQHIVKALQDAAEKTIHHKYPPFRGHESLKEAVATFYKREYGVELNPKTEVAILFGGKAGLVELPICFTNPGDTILVPDPGYPDYLSGVALAKAHFERMPLIAENNFLPDYTNIDASIAERAKLMFLNYPNNPTGATASKDFFDETIYFANKHNILVVHDFAYGAIGFDGQKPVSFLQADGAKDIGIEIYTLSKTFNMAGWRIAFAVGNESVIETINLLQDHMYVSIFGAVQDAAREALLSSQSCVIDLVNSYESRRNALISACHSIGWNVDIPTGSFFAWLPVPKGYTSEQFSDILLEKAHVAVAPGVGFGEHGEGYVRVGLLHTEDRLREAINRIDKLNFFKK

SEQ ID NO: 52870 - protein, 283 aa, Pseudomonas syringae pv. syringae B728a
MTDNARLLNQHSFIELGARQRARALLDAGSFRELLGPFDRVMSPWLAMQGVVPQADDGVVVGKGTVDGRPVVIAAIEGSFQGGSMGEVGGAKMAGALELAAEDNRNGIPTAAIVLLETGGVRLQEANLGLAAIAEIHAAIVDLRQYQPVIGVVAGSVGCFGGMSIAAGLCSYLLVTQEARLGLNGPQVIEQEAGIEEYDSRDRPFIWSLTGGEQRFASALVDGFAADDVADVRQQVSGWLKQGVPDTHRSSQYPLFLQRLASLDTEPQIDPQSVRTLYQGARS

SEQ ID NO: 52871 - protein, 139 aa, Melampsora medusae f. sp. deltoidis
LSQNYYPETMGKFYIINAPYLFSTVWSLVKPWLDEVTVKKISILDSSYHKTLLEQIPAESLPKTLKGTCDCPGGCSMSDAGPWKDAEAVTKAKKLKAGEPAKVEAAPEGEKKPEETAATGAPATEAPATEAAPAETTTA

SEQ ID NO: 52872 - protein, 107 aa, Physcomitrella patens subsp. patens
WSTGLFDCCADVPMCCVTMFLPCFAFGWNVEALDESKDSCWTAAAMWWVLQHTIALGCLYSSSYRGKLRSKYNIPEEPVSDCVIHCLCWPCAFCQEHREIHYRSFGP

SEQ ID NO: 52873 - protein, 260 aa, Synechococcus sp. WH 7803
MSTRIAIEQLAAFAEAPFEGNPAAVCCLDAWLPDALMQAIATENNLSETAFLVGGGGRYQLRWFTPTCEVDLCGHATLAAAAVVFRQEPQRDTLLFQSRSGPLRVQREGDRICLDFPVQRAHPCLPPAGLGEAIGATPKSCLQGVDLIAVFADENTIRSLHPDPERVAALPGRGLIVTAPGQHVDVVSRFFAPGCGIPEDPVTGSAHCSLTPYWCEALGKTVLSARQLSARGGSLRCTLQGERVLISGRVIPYLSGTIQV

SEQ ID NO: 52874 - protein, 210 aa, Zea mays
MRLVQQIIDAILVLDIDDPPCAIAAGALLFVLASDPVSKVLCKLRRLEQGGPCELEVLGKKGMVQLNGRESLAYAKIKPAVNQIETHPYFQRDSLVKFCQKHGICVTAHTPLGGSTANAEWFGTVSCLDDPVIKSLAEKYGKTPAQLVLRWGLQRDTVVIPKTSKVERLQENFDVFGFDISGEDMERMKAIDRKYRTNQPAKLWGIDLYA

SEQ ID NO: 52875 - protein, 577 aa, Ostreococcus tauri
MCNRARVATVVRALEEPETFTDDDLDNIVFADLSEEAAISNKSGAGETMAAPDWMTQLNRLWGGASEIPVADAKLEDITGLLGGGLFQPLFKWMLEAGPVYLLPTGPVTSYVVVSDAACIKQVLFNYGSKYIKGTIAEAGEFLFGLGVALQELEPWKVRRKAVAPSLHRKYVEAMVDRCFALCADRMTTILEEEAANGAVGSVNLESRFSKTALDIIGISVFNYDFKALTTAAPVIQATYTALKEVETRSMDLLPTWRLPEQFLRIVSPRQRNAQDAVTVIRDVTQRLVDDCKRMVEEEEKVGGAEEWARDYLNESNPSVLRYLIAAREEVSSTQLRDDLLSLLVAGHETTASVLTWGTYELLKPENAEQLRLLRAELDEVLGTRPYPTFADLAKMPYLERCFHESMRLYPQPPVYTRRAVVEDVLPNGMTVPKNQDLLVSIYNLHRSPANWGPTSQQFEPMRFGPLANGQPNELNTDYRYVPFSAGPRRCPGDKFAVRLDLELKAGHDVIMTSGATIHTKSGLLATVKKREVREVPEAERVDWANLMPAKELGGDEWYAPWNQPAPAASGKCPMGH

SEQ ID NO: 52876 - protein, 145 aa, Melampsora medusae f. sp. deltoidis
  misc_feature (144)..(144): Xaa can be any naturally occurring amino acid
VQQASHLSQNYYPETMGKFYIINAPYLFSTVWSLVKPWLDEVTVKKISILDSSYHKTLLEQIPAESLPKTLKGTCDCPGGCSMSDAGPWKDAEAVTKAKKLKAGEPAKVEAAPEGEKKPEETAATGAPATEAPATEAAPAETTXA

SEQ ID NO: 52877 - protein, 216 aa, Arabidopsis thaliana
MGRPDQTPSPRMNNNFNPVFHAQSEQPVDEKRVLQAEQIYPNNGGVVNQPNQVPMRPGPPTYINQSATFNQPYGVSMAGPVHTQPSNWTSGLFDCMNDGENALITCCFPFVTFGQIAEVIDEGATSCGTAGMLYGLICCLFAIPCVYTCTFRTKLRSKYGLPDAPAPDWITHCFCEYCALCQEYRELKNRGLDPSIDKLVNEKSNKLRTPLSLFSV

SEQ ID NO: 52878 - protein, 422 aa, Kluyveromyces lactis NRRL Y-1140
MLSQAYKLRSCLHKSSSVVRQQVRNLSIHEYRSAELLRQYGVGTPKGAAAHTVDEATKIAKELGGKNLVVKAQALTGGRGKGHFDNGMQSGIHMIDSVQDATEVSGKMLGYHLITKQSGIKGKLVSGVYIVERVNAKHEAYLSILMDRKTKKPLIICSSEGGMNIEDVAKTNPDAIKKFYVEDSVGLTPETAAEIAASLGFSKEAEADAKDAVLKLYKIFKEKDATQIEINPLSEVLDQDKKVMCMDAKFGFDDNASFRQKDVYSWRDLTQEDPDEVTAKKSDLNFVKLKGNIGCLVNGAGLAMATMDVIKLYGGDPANFLDCGGGATPETIETAFKLILSNDNVDAIFVNIFGGIVRCDFVAQGLVAATKNLSVKVPIVARLQGTNLEQGRRIIAESGLKIYSFDELDPAAEKVVELTNSK

SEQ ID NO: 52879 - protein, 305 aa, Saccharomyces cerevisiae
MSSSSQFKQLEKLGNGTYATVYKGLNKTTGVYVALKEVKLDSEEGTPSTAIREISLMKELKHENIVRLYDVIHTENKLTLVFEFMDNDLKKYMDSRTVGNTPRGLELNLVKYFQWQLLQGLAFCHENKILHRDLKPQNLLINKRGQLKLGDFGLARAFGIPVNTFSSEVVTLWYRAPDVLMGSRTYSTSIDIWSCGCILAEMITGKPLFPGTNDEEQLKLIFDIMGTPNESLWPSVTKLPKYNPNIQQRPPRDLRQVLQPHTKEPLDGNLMDFLHGLLQLNPDMRLSAKQALHHPWFAEYYHHAS

SEQ ID NO: 52880 - protein, 228 aa, Schizosaccharomyces pombe 972h-
MAANYWASSQLTQLFLSTDLESLEPTCLSKDTIYQWKVVQTFGDRLRLRQRVLATAIVLLRRYMLKKNEEKGFSLEALVATCIYLSCKVEECPVHIRTICNEANDLWSLKVKLSRSNISEIEFEIISVLDAFLIVHHPYTSLEQAFHDGIINQKQLEFAWSIVNDSYASSLCLMAHPHQLAYAALLISCCNDENTIPKLLDLIKSTDAFKVILCVQRIISIYYFEDIE

SEQ ID NO: 52881 - protein, 396 aa, Rubrobacter xylanophilus DSM 9941
MHKLHLPRLGQTMERGTILRWARREGEPFEVGDILYEVESEKAVNEIEAKLPGTLARITVEEGQECPVGTLLAVVADPGETLSEEEIEAAIAEEGGREAPAASGGGTGVRAPSSARAQRRVRAMPKARALARELGVELAAVEGTGQGGAITVEDVRRAAGAAPGEGPRVRERRPLGDVGRTMARVVTRSWHEVPQFVQMVQLDASALVGRRRELAGQIKRSHGVDLSYTDLLLEAVAGAAGEEPLANSSLVDGEILLYEDVNVSVAVATGSGLLVPVVRWAQALELGELAARLREVLERARSGRLSAEDTAGGTITLSNLGMYGIEGGTPLVTHPQAAVVFAGAIVERPWAVSGRVEVRPTLTLSVGFDHRILDGVAAARFTTALRRRLESPNQEG

SEQ ID NO: 52882 - protein, 195 aa, Pediococcus pentosaceus ATCC 25745
MEVHNVELQISAVRPDQYPEQGYPEIALVGRSNVGKSSLTNTLINRKSYARTSSQPGKTQTLNFYRVEDQLFFVDVPGYGYAKVSQKEREKWGKMIEKYITSRKELKGVISLVDARHEPTDDDITMYQYLRYYDIPVLVVATKSDKIARGKWNQHESKIKKALDFDGSSAFQMFSAQTKMGKEEVWKWIEDRMGE

SEQ ID NO: 52883 - protein, 357 aa, Rubrobacter xylanophilus DSM 9941
MPEKKMMRAAVYRGPRELRVEPVPVPEIGPSDVLVRVHSCGICGSDLHSYKAGMYIRPGQIMGHEFMGTVAAAGEDVEGVEEGDRVTGFSIGVCGSCYWCSRQQYILCPELFRNSTGYGLPGGFAEYVPIRNAVVGQSIHPVPSELDDETAATTEPVSVGVGAIEAAGVRPGDRVVVLGAGMIGNACMQAARAAGAGQVAVIDVSPVRLEAARSLGADAVFDARTGDALSWVKELWGVGRYHFNEGGMADVVVEAAGAPVTVQQAFEMVRSGGAIVFVGLPEEPAPIDVTKIVHKQPRIVGSLGGDFARAIELMASGSIRTKELITHRFPLEDAAEAFETQLRTGEAMKVMIQPREG

SEQ ID NO: 52884 - protein, 233 aa, Crocosphaera watsonii WH 8501
MIQSTKSTVISPSILSADFSRLGAEIKAVDQAGADWIHVDVMDGRFVPNITIGPLIVDAIRPYTQKPLDVHLMIVEPEKYVADFAKAGADIISVHAEHNASPHLHRTLGQIRELGKQAGVVLNPSTPLDLIEYVLELCDLVLIMSVNPGFGGQSFIPEMVSKIRKLRQMCDEKGLDPWIEVDGGLKPNNTWQVLEAGANAIVAGSAVFKAADYAEAIEGIRNSKRPERELAAV

SEQ ID NO: 52885 - protein, 486 aa, Flavobacteria bacterium BBFL7
MQKPKLGFWNIWNMSFGFLGIQFGFALQGSTMSRIFETLGANKDEIPLLWIAAPLAGLIVQPIIGYLSDNTWHKNLGRRRPFFLIGAILSSIALLFMPYSSEVWMAAGLLLVLDASINISMEPFRALVADKLPESQRSYGFVVQTLIIGVGTWVASNLPKWVNDTLEISNEAPSGVVPDSVKVAFGVGAFVFITAILVTIFTTKEYSPEELAQFDDAEKEPEEKKGMWETISGTYALMPLIMKKLGVVQFFSWFAFFAMWTLANPALTSHIYNAPKPDVIEFAKTTTDDNGELITMRDANDEVVFLNDAKALEYKQQDKSYNEASDDVGSKMGIYGLTSMLFALGLTFYTAYNSINRKYIHMASLILGGLGFLYMFFIPGEPDKLLVSFSLIGIAWGSILSMPYAMLSSSVESHKMGLMMGVFNMFIVIPQIIAAIGGVVFLQKLIGEESIHAMTIAGIFLIIAAFSNLLIINKKAITYQPSIDNE

SEQ ID NO: 52886 - protein, 543 aa, Candida tropicalis
MSSSPSIAQEFLATITPYVEYCQENYTKWYYFIPLVILSLNLISMLHTKYLERKFKAKPLAVYVQDYTFGLITPLVLIYYKSKGTVMQFACDLWDKKLIVSDPKAKTIGLKILGIPLIETKDPENVKAILATQFNDFSLGTRHDFLYSLLGDGIFTLDGAGWKHSRTMLRPQFAREQVSHVKLLEPHMQVLFKHIRKHHGQTFDIQELFFRLTVDSATEFLLGESAESLRDESVGLTPTTKDFDGRNEFADAFNYSQTNQAYRFLLQQMYWILNGSEFRKSIAIVHKFADHYVQKALELTDEDLEKKEGYVFLFELAKQTRDPKVLRDQLLNILVAGRDTTAGLLSFLFFELSRNPEIFAKLREEIENKFGLGQDARVEEISFETLKSCEYLKAVINETLRIYPSVPHNFRVATRNTTLPRGGGEGGLSPIAIKKGQVVMYTILATHRDKDIYGEDAYVFRPERWFEPETRKLGWAYVPFNGGPRICLGQQFALTEASYVTVRLLQEFGNLKQDPNTEYPPKLQNTLTLSLFEGAEVQMYLIL

SEQ ID NO: 52887 - protein, 2212 aa, Chlamydomonas reinhardtii
MAVFSRPVIALGADFGLSAEQADKMAPFRLSCPVPGRARWVTTTIYRFDPAVDWPSDLNCELAWNQQLSSYDGVPVELVLLVLVVLVSARPFAYRGLSPPSQVCPSSWSCSIPASVRLATRPNSMWVAGVRSARAAALTDGLWDAMTGFPDETLPEVPPDGTNCASPAGRGTTPCPGRWARPSRSPLAACAPSSCLSWILRASAPAVAASHAEFYMSNGRMYNVHLRGVLGPPARTVPLPPELRTRPKYQGSQPVSTNIQVLLNSSLSLSVVRAAGSSSSSSGGGGGNTLTAWLLDGSSASANGLSRPRPCGLMHHRRRGTVSGGGRAGADTERFIQRVVGRALHLPTGPLQAVLEVDAPPWAAPNASALRINLTAASYIGASVEGAELTLTWRTAKTSDVVKLVTDASGRAHTVLDLAALPESNRSEPYDSLALDAEWIGPTRERITQSRQITAHRTPELRLDRETYSVGEWAQLRLQVPWPGARLLLVWGNEGGVRRTVVGLAAQVGSTSSDKATAELKPNSLAVLSIGPLGQECVGGCSLVGVLDVPRASPSDMQLPEQVPISRLFDPRAPHSLSLGPLRLNQEVVLRLAAAVAAYGPSAYRLAPGAVQAVFAKLMSRLTGQDPWLPTDTFVGQPQDSGLAPRLFRGGGGYPGGGYPGGSGGSGGPMYAVDANDTEYLSRFSSVISLMPPHAYGWGRWGRRQRRYPDDGDRQRRGRRRHGSGRHGCPAAARDGGAPTYRRHHDQYGSGEAKLAVRRALSLTPSVPRFVRVGDQFEAGVVVTVGSAPASVAVSLKLENAADSPLTLNGVTSKTVTFAAGGGLQQEVRFSFTAVAIASATLVFDAVDSAAGGGSDSLSLEVPVYGQQGDVWVATSFALKALPASDSDVVQWQEGLALPDAVPGSGGLSLTAGVGYLPALVAAYDALLQQEETSPEQQQEVAAAYVDLQDLSSGTAVGLVWRNAFPNSRCDTYLNARALFLAGAQPQADPPNDTVGLLSATWAAALGGQLVADAEMSRRQQYGGRPYGDMDTLAWARLVLGANWDPRRAGAGDQVASDLSLAILVSKAGLVDKGGANWGLQTRVALALLLQSLPEDQRPHGGTAALAGALTGVTSSLRVQGRTAYVAAWEGATAAAPLDTQALALLLLLRSGATHQLLPKLAAYVADPSGSGSGPATTASMSYWATPRLSYIDQALVTAALAEYDRAVGSAQPAVNVTAVAAGVTVLRANFRTGGNTRPVTNTTAWHTICASERKSAGVHKSSNTSSSANVTAHGTLNMKAVGTGEVSVAASLHFVPSALLSFPSYRGLYVEAALQQVDPRTGGPTGGRLAAVPLGSVVALTVQLTTPDDLGAVTLSVMMPGGLEPIDPNVPGGASGGGSGVGGMATRPMPGRSYGAATGNAYGIAPYGTCAAGLLTDLPWASYGAWGFMFPVCPTQETRPSVVTFSYWALRAGTSSVTIRAVAATAGDFVIPPIRAWAEAQPELMGMSAAGQALGLPEPSKLRILVVDSKAVSRQTTTQLLRECAYQVTAVKTAREGLQKLIEAEHGANFDLVLKEHEPPSANACRLLKRMAKTEGLTRTPVVVTSSQDERETVMSCLSLGAIDYLIKPLRQNELRHIWTRVWWWRKSQGSGPHGAGPPPIAAAHGTRHYGAFRGPSSANRQYDQATSSDSKQTKCQEEEEPTSKEGSAPDNGNGHGSKGNGSNGSKEGNGTSRVDAKPHCDIKDTGHGSNGNGHGSNNGNGHGSNGNGSNGSSDNKNGGNGNSATKGDGNGNGSNGNGASTTLAVDRHYQALVNTAEGKMPPNLLLGGSGSGHDGLPGSAAKGGTIGRSSAFAQYTGPSSSSRKRAATSEAVPPGARDRPDTMLTDRDRERDRDRDLIGLRASGGSGLPHGHVLSRMAHPGLRFGPGAGNGHGGNPQAAGAPLDPATQLQSMFHFPSAEMVALAAAASEAHAHAAARSHGHGPHGPGGLQPAMLGGTRPTAPGMPEPKRRRALALDKYRKKRKNLRFSKTIRYESRKQLAQQRPRPQQSRPLGSMDAAPLLQEAKASRSVGSQGSLSRDRGYSRGHSRGHSRGHSHGHSHSQQQQQQVVAQQQTGGLGAAGGPTSQGISHGRNIIMPQPTGAPSLSAHLQSQLLQAAAPAAPSAHSSPTNSQAALAAVTGQAPSSAPQQAQMLVASAAAAGGVAGSVGGGLQAPGAGLQHPPGSLGCGLA

SEQ ID NO: 52888 - protein, 433 aa, Yarrowia lipolytica CLIB122
MLRTIARTHAVAATKVVRASTFSATPAASFVRFQSVWAKVPQGPPDAILGITEAFKKDAFEQKINLGVGAYRDDGGKPFVLPSVREAEKEVVNKALDKEYAPITGVPAFTKAAAELAYGADSPAVLEDRIAITQTISGTGALRIGAEFLNKFYSSKKILLPQPSWANHKAVFTAAGLEPATYRYYDPKNIALDFEGLLADLEAAPNGTAVLLHACAHNPTGVDPTPEQWRKIEEVVKAKGHFPFFDMAYQGFATGDVNRDAYPIRYFVEQGHEVALCQSFAKNMGLYGERVGAFSLVCQDTAEKNRVDSQLKIIIRPFYSNPPVHGARIAATILNNPELKKQWLGEVKQMADRMIKMRALLKENLERLGSQQNWDHVTSQIGMFCYTGLSPEQVERLAKEFSVYGTKDGRISIAGITSQNVGRLAQAIYEVTK

SEQ ID NO: 52889 - protein, 247 aa, Triticum aestivum
MDAAISAAHEAPPAVVLVSAGASHSVALLAGNVLCTWGRGEDGQLGHGDAEDRLVPTVISGFDAPGITSVICGADHTTAYSEDEHQVYSWGWGDFGRLGHGNSTDVFTPQPVKALQGIKIKQLACGDSHCLAVTMAGEVLSWGRNQNGQLGLGTTEDSLLPQTIQAFEGISVNMIAAGAEHTAAVTEDGEIYGWGWGRYGNLGLGDRNDRFVPEKVSSVSLAPSPPPAAISMYQASLLRPRSSKPRV

SEQ ID NO: 52890 - protein, 400 aa, Treponema denticola ATCC 35405
MYKNDFPLLMQNPNIHYLDSAATAQRPMPVIEGIKEYFLQSNGNAGRGSHSLAIASSILVEETRKKTAEFIGADKIESIIFTKNSTEALNIIAYCYGLSNLKTGDEILLAVSNHHANLVPWQFVAKQTGAAVKFIYLNKNGTLDINDFKAKLSSKTKVVAISSVVNATGIINPVEEVIKLSHESGAVVVVDAAQAIAHYKQDVSALDCDFLVFSGHKIFSDFGVGVLYGKKELLDKMPPFLYGGDMINFVTEESSEFKEAPYKYEGGTHDTAAIVSLKHAIEYIEKIGYANIEKTVKELDSYALSELKKLDFVETYGTDAEKRAGIIAFNVKDVHSHDTSYILNEYGVMVRSGHHCTQPLMAYLNINSCCRASFSIFNTKEDIDVMITALKKVKSVFLKD

SEQ ID NO: 52891 - protein, 468 aa, Pseudomonas syringae pv. syringae B728a
MGLNDQWMQRDLKVLWHPCTQMKDHENLPLIPIKRGEGVWLEDFEGKRYLDAVSSWWVNVFGHANPRINQRIKDQVDQLEHVILAGFSHQPVIELSERLVKLTPDGLTRCFYADNGSSCIEVALKMSFHYWLNRGQPDKKRFVTLTNSYHGETMAAMSVGDVPLFTETYKALLLDTIKVPSPDCYHRPDGMSWEEHSRNMFVAMEQTLAEHHASVAAVIVEPLIQGAGGMRMYHPIYLKLLRDACDRYGVHLIHDEIAVGFGRTGTMFACEQAGIRPDFLCLSKALTGGYLPLAACLTTDDVYDAFYDDYPTLRAFLHSHSYTGNPLACAAALATLDIFEQDNVIENNKALAQRMATATAHLVDHPHVAEVRQTGMAIAIEMVQDKATKTAYPWQERRGMKVFQHALERGALLRPLGSVVYFLPPYVITPEQIDFLAEVASEGIDIATRSSVSVAVRENFHPDFRDPG

SEQ ID NO: 52892 - protein, 432 aa, Amycolatopsis mediterranei
MTMTVQKAPSQLLAAKLQIPPIPYSHAAGSWVYASDGTRYLDGASGIVNVNIGHAHPTVVAALRDQVGICTYASPGTFAPDLMEQLAAAAARAVHRPDDRVMFTPTGTHATESAIALARLVQRARGEEGRHKILTSTLGYHGNSAFVLALSGHRSRRPHEDDSFGLAPAFNPPYPGQHLGCPFDACRVECVRAVRDAIVAAGPESVAAVLMEPVNGTTGGGYVPPAGYLRALREVCDEFGVLVIHDEVLTGLGRCGLPLASHHTPGSAADIVTLSKGLGAGYVPLAATMLSPDLAEDIMTSGKWLPLMGTMSATPLQGRAGLAVLSVLEELGALDRDEVRGAALGRLVADAVRGRQVVTDVRGLGYFYGIELAPGTLGDVMRITRSRGLLLYPYVGFRPDRTGEGLLVAPRSTRPTAISASSARRWARHWTS

SEQ ID NO: 52893 - protein, 570 aa, Bacillus cereus ATCC 14579
MTLNIQGIAASSGIAIAKAFRLENPEFNIEKKSITNEAAEIARLDAALEKAKTELEAIKDHAFAELGADKAAIFEAHLLVLNDPELVNPVKDKVNSEKVNAEFAMDEVASMFISMFENMDNEYMKERAADIRDVTKRVLAHLLGINFSNPGTISEEVIIIAEDLTPSDTAQLNRKYAKGFTTDIGGRTSHSAIMARSMEIPAVVGTKVVMEKIQNGDIVIIDGLDGEVIVNPSEETLRSFEEKKAKFEEQKAEWAKLKDQATVTSDGHHVELVANIGTPNDVQGIIDNGGEGVGLYRTEFLYMGRDNLPTEEEQFEAYKAVLEGVKEGQPVVVRTLDIGGDKELPYLHLPKEMNPFLGYRAIRLCLDEQDVFRTQLRALLRASVYGNLKIMFPMIATLDEFRQAKAILLEEKAKLVEAGTTVSDSIEVGMMVEIPASAVLADQFAKEVDFFSIGTNDLIQYTMAADRMNEQVSYLYQPYNPSILRLVKMVIDAAHKEGKWAGMCGEMAGDSLAIPLLLGLGLDEFSMSATSILPARTQLSKLSKAEMETLAEKALMMSTAEEVVELVKSI

SEQ ID NO: 52894 - protein, 629 aa, Pseudomonas syringae pv. syringae B728a
MSFASLGLSEALVRAIEAAGYTQPTPVQQRAIPAVLQGRDLMVAAQTGTGKTGGFALPILERLFPNGVPDKSQRHGPRQPRVLVLTPTRELAAQVHESFKLYARDLKFVSACIFGGVGMNPQVQAMSRGVDVLVACPGRLLDLAGQGSVDLSHVEILVLDEADRMLDMGFVHDVKKVLARLPAKRQNLLFSATFSNDITSLAGKLLHNPERIEVTPPNTTVERIEQRVFRLAANHKRSLLAHLITVGAWEQVLVFTRTKHGANRLAEYLDKHGLAAVAIHGNKSQNARTKALADFKAGDVRIMVATDIAARGLDIDQLPHVVNFELPNVDEDYVHRIGRTGRAGRSGEAISLVAPDEEKLLKSIERMTKQKIADGDLMGFDITAVEAEKPEVRERPDVRNSRGARPARGDGDKNNGGRRDKGKDKGKEKPAAASATGERPARQPREKKPREGTPRSEQRASQPATPRPAADRAPDEFRDDEVDNFGNRADYVSPYQGKGQNRGRRPAAAPGAAAPAAGGAARPANPGRPAGGARNGSGSGAPKRNGSGSSAPRSRDGQPRGRRPAREDQPLPREGQEPAARAPRDGQPQPKIVHKESKIDRFPSAEQLDQLPSRPRGEKPALLTRNRDS

SEQ ID NO: 52895 - protein, 319 aa, Oryza glumipatula
KLSPAIAQLQHLTKLSISMNSISGSLPPDLGSLKNLELLDIKMNTFNGSIPATFGNLSCLLHFDASQNNLTGSIFPGITSLTNLLTLDLSSNSFEGTIPREIGQLENLELLILGKNDLTGRIPQEIGSLKQLKLLHLEECQFTGKIPWSISGLSSLTELDISDNNFDAELPSSMGELGNLTQLIAKNAGLSGNMPKELGNCKKLTVINLSFNALIGPIPEEFADLEAIVSFFVEGNKLSGRVPDWIQKWKNARSIRLGQNKFSGPLPVLPLQHLLSFAAESNLLSGSIPSHICQANSLHSLLLHHNNLTGTIDEALKGA

SEQ ID NO: 52896 - protein, 238 aa, Synechococcus sp. WH 7805
MSELQNQMKQAVADAAVEQFQDGMVVGLGSGSTAALMIKGLGERLAAGQLNDIVGVTTSFQGEVLAAELGIPLRSLNAVDRIDLAIDGADEVDPSFQLIKGGGACHVQEKLVAARADRFIVVVDSTKLVERLNLGFLLPVEVLPGAWVQIRQQLNAMGGEAELRMATRKAGPVVTDQGNLVLDVRFEGGIADPVSLEKDINNIPGVLENGLFVNLADEVLVGQVDDGVASARSLERAR

SEQ ID NO: 52897 - protein, 493 aa, Oryza sativa Japonica Group
MGGERAVDAVIAWGVRAMILLPSWAPGRPGFSHEHHSQASPLSTSSFAMGAASTPRHHLPLPKRIFAYALYALLPLAALHYLLLSPPPPPLATTSTSTTPPVAAVAVARKAAPRCDYSEGEWVRSASAPRYNGTSCGSTIKGGQNCMAHGRPDTGYLHWRWRPRGGGGCALPPFAPGEFLELVRGRHVAFVGDSLARNQCESLVCLLASGFPAELVRGGNGGDGGDGDEARKFRRWVFPSHNATVSVFWSPFLVNGTEKSSSSAAAAGAGGLDHNRLYLDQPDERWAGELDGIDVVVLSAGHWFLHPAMYYERGEVIGCHHCPEPNRTETGFFGVFRLAVKNALREVITRAARSPSQQQKLAVVTTFSPAHFEGEWDARDACARSEPYAPGEKEVGYMDREMGRAEAEEVAAAAADARVRAPGRVEVEALEVTAMAALRGDGHPGPYMNAFPFAGGERARVPNDCVHWCLPGPIDTWNEILLQLVKRWRDSSK

SEQ ID NO: 52898 - protein, 319 aa, Oryza nivara
QLSPAIAQLQHLTKLSISMNSISGSLPPDLGSLKNLELLDIKMNTFNGSIPATFGNLSCLLHFDASQNNLTGSIFPGITSLTNLLTLDLSSNSFEGTIPREIGQLENLELLILGKNDLTGRIPQEIGSLKQLKLLHLEECQFTGKIPWSISGLSSLTELDISDNNFDAELPSSMGELGNLTQLIAKNAGLSGNMPKELGNCKKLTVINLSFNALIGPIPEEFADLEAIVSFFVEGNKLSGRVPDWIQKWKNARSIRLGQNKFSGPLPVLPLQHLLSFAAESNLLSGSIPSHICQANSLHSLLLHHNDLTGTIDEALKGA

SEQ ID NO: 52899 - protein, 614 aa, Staphylococcus aureus subsp. aureus Mu50
MEFLSLVIVVLAAFLTPIIVNRLNINFLPVVVAEILMGIVIGNSFLNIVERDSILNILSTLGFIFLMFLSGLEIDFKAFKKDKRARQGQNDDESSIPGHLNLALTVFAFIMIISILLAYVFKWLGLVDDVLLMVIIISTISLGVVVPTLKEMNIMRTTIGQFILLVAVLADLVTMILLTVYGAINGQGGSTIWLIGILVVFTAISYILGVQFKRMSFLQKLMDGTTQIGIRAVFALIILLVALAEGVGAENILGAFLAGVVVSLLNPDEEMVEKLDSFGYGFFIPIFFIMVGVDLNIPSLIKEPKLLIIIPILIVAFIISKLIPVMFIRRWFDMKTTIASAFLLTSTLSLVIAAAKISERLNAISAETSGILILSAVITCVFVPIIFKKLFPVPDEFNRKIEVSLIGKNQLTIPIAQNLTSQLYDVTLYYRKDLSDRRQLSDDITMIEIADYEQDVLERLGLFDRDIVVCATNDDDINRKVAKLAKAHQVERVICRLESTTDDTELVDSGIEIFSSYLSNKILLKGLIETPNMLNLLSNVETSLYEIQMLNYKYENIQLRNFPFGGDIIFVRIIRNNESIVPHGDTQLRYGDRLIVTGAKEYVDELKQELEFYF

SEQ ID NO: 52900 - protein, 407 aa, Schizosaccharomyces pombe 972h-
MGCMSSKYADTSGGEVIQKKLSDTQTSNSSTTGSQNARVPVLENWLNIVLRGKPQNVESSGVRVKGNSTSGGNDIKVLLLGAGDSGKTTIMKQMRLLYSPGFSQVVRKQYRVMIFENIISSLCLLLEAMDNSNVSLLPENEKYRAVILRKHTSQPNEPFSPEIYEAVHALTLDTKLRTVQSCGTNLSLLDNFYYYQDHIDRIFDPQYIPSDQDILHCRIKTTGISEETFLLNRHHYRFFDVGGQRSERRKWIHCFENVTALLFLVSLAGYDQCLVEDNSGNQMQEALLLWDSICNSSWFSESAMILFLNKLDLFKRKVHISPIQKHFPDYQEVGSTPTFVQTQCPLADNAVRSGMYYFYLKFESLNRIASRSCYCHFTTATDTSLLQRVMVSVQDTIMSNNLQSLMF

SEQ ID NO: 52901 - protein, 549 aa, Synechocystis sp. PCC 6803
MTLISLTPHHGIDPGSGRKNTPMGLLETQVHHLLKAQQRQQTIPPWPHSLTMGRLVSRALRLRRSALIQTGCLPPTYGPSYLLPCLLSDQPIRLVTTPKRKQDLETAILPALQMALQSNDPDLVITWPEIVTPDQWLQENLGPLPHIAPALTAIEQVEHLEDWTRDFLSHHLDWNTLQPLFAQTPQGQDQVLTHWSRLSQSLFARPINPHGFYPLDGEELKELNQAVTEQLTISQGENAIKQENIQKIQQFWQFWQEQTDNHLLWAEVDRQQGRISLHVSPVNVQPWLQPIWQSSDQGQGDFIDGGQDSDQAAFVLIGSFLDAEKTAPTYCKTLGLGNLLCLKFSPHRLQDALTIYLPDRLPLPNTPAFQTTLLTEIERILTEIMAVQPDTFVVILLDDLPLKAQLGSQLAAKLGSGVKVEPTPNFAPGILVAGWQYWCAQREKFPPPALLILGTLPIPSLENPLVAKRVQHHKRHHQDWFRDYLLPVALKDLQQAVLPLRESGGWLAILDDRVNSRSYGREVLKALAPYGKRNYFDPQDLPQVTTAQK

SEQ ID NO: 52902 - protein, 319 aa, Oryza rufipogon
QLSPAIAQLQHLTKISISMNSISGSLPPDLGSLKNLELLDIKMNTFNGSIPATFGNLSCLLHFDASQNNLTGSIFPGITSLTNLLTLDLSSNSFEGTIPREIGQLENLELLILGKNDLTGRIPQEIGSLKQLKLLHLEECQFTGKIPWSISGLSSLTELDISDNNFDAELPSSMGELGNLTQLIAKNAGLSGNMPKELGNCKKLTVINLSFNALIGPIPEEFADLEAIVSFFVEGNKLSGRVPDWIQKWKNARSIRLGQNKFSGPLPVLPLQHLLSFAAESNLLSGSIPSHICQANSLHSLLLHHNNLTGTIDEALKGA

SEQ ID NO: 52903 - protein, 276 aa, Bacillus halodurans C-125
MANNLQATTTLHNGVKMPWFGLGVFKVSEGDEVIQSVKDAIRAGYKSIDTAAVYGNEEGVGKAIAESGVPREELFITSKVWNADQGFDSTISAFNTSLKKLGLDYLDLYLVHWPVKGKYVETWKALEKLYQDGLVRAIGVSNFQVHHLKDVLEAGSIVPMVNQVEYHPHLTQTELHDFCKQNKIQLEAWSPLKQGQLLNDPTIVAIAEAHQKTPAQIILRWDLQNEVVTIPKSVKKDRIISNADIFDFQLTEEDMQKINELNKNERVGPDPDNFDF

SEQ ID NO: 52904 - protein, 379 aa, Rhodobacter capsulatus
MTVAVIIVAAGRGTRAGEGLPKQWRDLAGRPVLAQTVAAFAGLGRILVVLHPDDMGLGMDLLGGSVVLVAGGSTRSESVKNALEALEGSDVTRVLIHDGARPLVPASVTAAVLAALETTPGAAPALAVTDALWRGEAGLVAGTQDREGLYRAQTPQGFRFPEILAAHRAHPGGAADDVEVARHAGLSVAIVPGHEDNLKITYAPDFARAEAILRERKGLTMDVRLGNGYDVHAFCEGDHVVLCGVKVPHVKALLGHSDADVGMHALTDAIYGALAEGDIGRHFPPSDPQWKGAASWIFLDHAAKLAKSRGFRIGNADVTLICERPKVGPHAVAMAAELARIMEIEPSRVSVKATTSERLGFTGREEGIASIATVTLIGA

SEQ ID NO: 52905 - protein, 369 aa, Zea mays
  misc_feature (300)..(300): Xaa can be any naturally occurring amino acid
MAERWRSRARRDPDLDEDASPPSRQPRHSGGDEEDDELGNEDLSLEIVARAQRKRRGESAGGVPVFADLLSVSSADEEGAVVELDEADEPRRKQKKKQRRKQRKKHRKETTEAAAGAAVEVDENAVCSTEEGPIGTAESVLTENGADAPASDNMVLRKLLRIPRYFDPGETLLETCFNCSEEGHVAANCPLEKRKKPCFVCGLFGHNAKQCTQGQDCFICKKGGHMAKDCPDKHRRNDHHSTLCIKCGKTGHDMFGCANDYPPNDIEQIKCYACNQKAHLCCSDFFDNSLEQAIYIGTSXQGCAKQRRKASAVTTPTLCFKCGEEGHFARGCTKNAKSDGPKGWSSPHTQRKGRWKNDGKSPSHLRRKE

SEQ ID NO: 52906 - protein, 136 aa, Mycobacterium leprae TN
MTERTLVLIKPDAVERQLIGEIISRIERKGLTIAALELRQVGEELASQHYAEHESKPFFGSLLEFITSGPVMAAIVEGPRAVAAVRQLTGGTDPVEKAAPGTIRGDLALETQFNLVHGSDSTASAQREIALWFPGI

SEQ ID NO: 52907 - protein, 352 aa, Pyrenophora teres
MPPAGSGSSRKISFNVSEQYDIQDVVGEGAYGVVCSALHKPSGQKVAIKKITPFDHSMFCLRTLREMKLLRYFNHENIISILDIQKPRNYETFTEVYLIQELMETDMHRVIRTQELSDDHCQYFIYQTLRALKAMHSANVLHRDLKPSNLLLNANCDLKVCDFGLARSAASTEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKIPWKAMFPKTNDLALDLLERLLAFNPVKRITVEEALKHPYLEPYHDPDDEPTADPIPEEFFDFDKNKDNLTKEQLKLLIYQEIMR

SEQ ID NO: 52908 - protein, 566 aa, Physcomitrella patens subsp. patens
MVVLLLLAVPAWSTFVVEESALMVTSPESLKGKHQSAIGNFGVPQYGGTLSGTVSYPSVNSKACEAFPTDQFKSVPGQRPVFALVDRGDCYFATKVWYAQQAGAAAVLVADNKQEKLITMDSPEEDPAASQFIQNITIPSALITKDLGDSLKKALSDKEMVSIKLDWRESLPHPDKRVEYEFWTNSNDECGPKCDAQVEFVRNYKGVAQMLEQGGYTQFTPHYITWYCPQAFIESKQCKSQCINNGRYCAPDPEQDFSVGYDGKQVVIENLRQLCVFKVTNDTGKPWKWWDFVTDFQIRCPMKEKKYGPECAEEVIKSLSIDVGAVQKCMGDPNADQDHPILKHEQDAQIGVRRIVVHLVRGRGRAGLSGAGEQARWNVEGCDDTFRGRVCQCPLVKGVQFEGDGYTHCEAKGPGRCKIGNGECWQENRDGVTKSACQDDNAGCKCPVGFEGDGKNTTNGCVDINECTRRTKCQCPDCTCTNTWGGYDCQCGGDLLYIGEHDTCISGVGKGTDLGVCWPVCVQVGAYVVYKYRLRSYMDSEIRAIMAQYMPLDSQNESQNHMADEI

SEQ ID NO: 52909 - protein, 279 aa, Thermoplasma acidophilum DSM 1728
MIKIPQAGRDLETIAVIGAGTIGSAISISLAKAGYHVISTRRRPDLNAGLKAYGITVTSDNVQAVTSADMVILTLKPADLVSEMKKLSQILEGKIVVSMAAAVPIRVIRHILPRSFIVRSMTNIAAEVNAGYTPFCTLEEDEGKISFVSRVLGVFGETERVDEKYMDALTALSGSGPAYILTIIEAMMYGGLKVGLPRSIALKASYQTVMGSAKLLAMSGDHPSAIKEKVITPGGVTIDGIYELENGKIRTSIMKAIESSTLKARKISKDLFPEESDKN

SEQ ID NO: 52910 - protein, 214 aa, Mycobacterium leprae TN
MKLQNSQLQPQARYILPSFIEHSSFGVKESNPYNKLFEERIIFLGVQVDDASANDIMAQLLVLESLDPDRDITMYINSPGGGFTSLMAIYDTMQYVRADIQTVCLGQAASAAAVLLAAGTPGKRMALPNARVLIHQPSLAGVIQGQFSDLEIQAAEIERMRTLMETTLSRHTGKDAAVIRKDTDRDKILTAEEAKDYGIIDTVLEYRKLSAQTV

SEQ ID NO: 52911 - protein, 563 aa, Thermoplasma acidophilum DSM 1728
MGEQSSIPSDANISYAENQDKKLRKALSTWDLLMLSVGGIIGSGWLFAAYAASVLSGPASILAWVLGGIIVIFIALVYAELGSMIPRSGAIVRYGHLSHGSFAGFLFGWAYFLSAVSVPAIEAEAVVTYAASYVTKPALIANGIMTGLGTLIAMILMIGFFFLNYAGVHIMGKTNQGLTWVKVIIPVITILVLIFVHFNPSEIIPSNGFMPYGWAPVFAAISSTGIVFSYFGFRQAIDYGGEARNPQRSIPIATIGSVLIGMLIYSLLQVVFVGGIDWSKVGLLPGQWQQLSSLASSSNAATAYPYAYDLMNAPFATVALSAGLVWLTYTLYASAYLAPSGTLNVYMGTSARTLYGMAVNGHLPKTFAKIEERNRIPLIPLITTLLVGFLFFLPFPSWYKMVGFISGATVFTYIVGGAALMNLRKQAPELKRPFRLPAADVFAPIAFILASEAVYWTGWPTTLYLAIGIFAGLVLYGILAALHKIEQSFNSTNVKAGLWVPFFIIVLTVLSYLGEYGGIDVIKFPLDLIVVAIVSALFYFWAIRSGIKTEEIAAMVANEDQYV

SEQ ID NO: 52912 - protein, 261 aa, Pediococcus pentosaceus ATCC 25745
MKNIDKDFLLQLDAKIVEFLVKDRQFIFEKMGKHLEVDEKQNRRDLVTEVDRGNQAHIIEALSQLLPDAKILAEESENDLTDAKGLMWVIDPIDGTMNFVKQREDFAVMIALYEDGKPLLGYIYDVMRDVLLHGGPGIGVVYKNQDVINPPANLALEESLIGLSGPMLVNNAYHFQDVEKRTLGARVIGSAGIEFIRVLLGKQIGYVSSLKPWDFAAGNALAAVFGLKVGYVDGEAINVLKSGVVLVATKKAYSAIMSIVK

SEQ ID NO: 52913 - protein, 298 aa, Salmonella enterica subsp. enterica serovar Typhi str. CT18
MVRIACVGITVMDRIYYVEGLPTEGGKYVAKRYTEVGGGPAATAAVAAAKLGAQVDFIGRVGDDDTGNSLLAELESLGVNTRYTRRYTQAMSSQSAIMVDAKGERIIVNYPSPDLLPDADWLNDIDFSQWDVVLADVRWHDGAKQAFTLARQAGVMTVLDGDITPQDISELVALSDHAAFSEPGLARLTGMSEAIDALKKAQMLTNGHVYVTRGSEGCNWLEKAAVRHQPGFTVEVVDTTGAGDVFHGALAFGLASGYAIEEAVRFASGVAALKCTRPGGRAGIPDCEQTRSFLSLFV

SEQ ID NO: 52914 - protein, 185 aa, Ostreococcus tauri
MSSCNSANKRGFFVVSSATRRLRAMSARVPLRGIRALTRSLSSASASTSKPSPSDVIVMRDMEFFARHGALEPERALGQKFLVNVEIACDLRRVGVSDNLRDTIDYAQAWGIVREIVERGTTRTTIEAVAHETATTLLQTFDGAASVRVGIDKPHVAIEGGLRSLGVRIFRDRGDAGDGTVRRDA

SEQ ID NO: 52915 - protein, 323 aa, Zea mays
MAAGRELVVSFGEMLIDFVPTVAGVSLAEAPAFLKAPGGAPANVAIAVSRLGGGAAFVGKLGDDEFGRMLAAILRDNGVDDGGVVFDSGARTALAFVTLRADGEREFMFYRNPSADMLLTADELNVELIKRAAVFHYGSISLIAEPCRTAHLRAMEIAKEAGALLSYDPNLREALWPSREEARTQILSIWDQADIVKVSEVELEFLTGIDSVEDDVVMKLWRPTMKLLLVTLGDQGCKYYARDFHGAVPSFKVQQVDTTGAGDAFVGALLQRIVKDPSSLQDEKKLVESIKFANACGAITTTKKGAIPSLPTEAEVLQLIEKA

SEQ ID NO: 52916 - protein, 182 aa, Magnaporthe grisea 70-15
MLTVWVGSGLAWHTEEGTLRQKFEEYGVVEEAVVVKDRDTGRSRGFGFVRYTNEDDAQKAITAMNNVEFDGRTIRVDKASDTGPRGGGGGFRGGYGGRGGYASPQMHPMPYGMHPQQQYGAPQMYPQPYGRGGYPQQMPGYGAPPAQTWQAAAGHPGYYPDPSGQIPPQQQMPPQNPQGGPY

SEQ ID NO: 52917 - protein, 499 aa, Saccharomyces cerevisiae
MGGEDEILSTMEDFAAVYDVLVIGCGPGGFTAAMQASQAGLLTACVDQRASLGGAYLVDGAVPSKTLLYESYLYRLLQQQELIEQRGTRLFPAKFDMQAAQSALKHNIEELGNVYKRELSKNNVTVYKGTAAFKDPHHVEIAQRGMKPFIVEAKYIVVATGSAVIQCPGVAIDNDKIISSDKALSLDYIPSRFTIMGGGTIGLEIACIFNNLGSRVTIVESQSEICQNMDNELASATKTLLQCQGIAFLLDTRVQLAEADAAGQLNITLLNKVSKKTYVHHCDVLMVSIGRRPLLKGLDISSIGLDERDFVENVDVQTQSLLKYPHIKPIGDVTLGPMLALKAEEQAIRAIQSIGCTGSDGTSNCGFPPNVLYCQPQIGWVGYTEEGLAKARIPYQKGRVLFSQNVRYNTLLPREENTTVSPFIKVLIDSRDMKILGVHMINDDANELLSQASMAVSLGLTAHDVCKVPFPHPSLSESFKQAVQLAMANGTSPGVHVRE

SEQ ID NO: 52918 - protein, 402 aa, Pseudomonas syringae pv. syringae B728a
MADQGSPRRFARIDRLPPYVFNITAELKMAARRRGEDIIDLSMGNPDGATPPHIVDKLITVAQREDTHGYSTSRGIPRLRRAISNWYKKRYEVDIDPESEAIVTIGSKEGLAHLMLATLDQGDTVLVPNPSYPIHIYGAVIAGAQVRSVPLVPGVDFFDELEKAIRGSIPKPKMMILGFPSNPTAQCVELDFFERVVALAKQYDVLVVHDLAYADIVYDGWKAPSIMQVPGAKDIAVEFFTLSKSYNMAGWRIGFMVGNPELVNALARIKSYHDYGTFTPLQVAAIAALEGDQQCVLDIAEQYRQRRNVLVKGLHELGWMVENPKASMYVWAKIPQAYAHLGSLEFAKKLLAEAKVCVSPGIGFGEYGDDHVRFALIENQDRIRQAVRGIRSMFRADDKLKS

SEQ ID NO: 52919 - protein, 247 aa, Arabidopsis thaliana
  misc_feature (13)..(13): Xaa can be any naturally occurring amino acid
MSSSNACASPSPXFPAVTKLHVDSVTFVPSVKSPASSNPLFLGGAGVRGLDIQGKFVIFTVIGVYLEGNAVPSLSVKWKGKTTEELTESIPFFREIVTGAFEKFIKVTMKLPLTGQQYSEKVTENCVAIWKQLGLYTDCEAKAVEKFLEIFKEETFPPGSSILFALSPTGSLTVAFSKDDSIPETGIAVIENKLLAEAVLESIIGKNGVSPGTRLSVAERLSQLMMKNKDEKEVSDHSVEEKLAKEN

SEQ ID NO: 52920 - protein, 145 aa, Bacillus cereus ATCC 14579
MKTLGYILMENGEKIDLEFFPEEAPKTVENFKKLAEQGFYDGVTFHRVIPGFVSQGGDPTGTGAGGPGYSIPCETDGNPHRHLVGSLSMAHAGRNTGGSQFFIVHEPQPHLDGVHTVFGKATSGIETVLKMRQGDVMKEVKVWEE

SEQ ID NO: 52921 - protein, 267 aa, Sinorhizobium meliloti
IAVPGPVYSSQAAALEDADIVLFAMPSQAHRDAARSYGTAIGGRAIVVTCAKGMEQSTGQLLTDVLEEELPGRRIGVLSGPGFAADIASGLPTAMVIAAPDTAIATELAEVLSGRTFRLYPSADRTGVQLGSALKNVLAIACGIVEGAGLGDSARAALISRGLAEMSRFIVARGGEADTVRGLSGLGDLVLTATSHQSRNLRFGIALGKDGRAAAGSSELVEGAFAASVAARVAGALGIEMPVTEAVAAIVDGKLDVRSALEQLMSR

SEQ ID NO: 52922 - protein, 314 aa, Streptococcus pyogenes M1 GAS
MDPNVITVTSYANIAIIKYWGKENQAKMIPSTSSISLTLENMFTTTSVSFLPDTATSDQFYINGILQNDEEHTKISAIIDQFRQPGQAFVKMETQNNMPTAAGLSSSSSGLSALVKACDQLFDTQLDQKALAQKAKFASGSSSRSFFGPVAAWDKDSGAIYKVETDLKMAMIMLVLNAAKKPISSREGMKLCRDTSTTFDQWVEQSAIDYQHMLTYLKTNNFEKVGQLTEANALAMHATTKTANPPFSYLTKESYQAMEAVKELRQEGFACYFTMDAGPNVKVLCLEKDLAQLAERLGKNYRIIVSKTKDLPDV

SEQ ID NO: 52923 - protein, 455 aa, Bacillus halodurans C-125
MKASQAESEKMLKWWELSLLGVGCIIGTGFFLGSSIAIQMAGPSVLLAFILAGIGTYIVFDALAQMTSADPEKGSFRSYAKKAYGRWAGFTSGWVYWASEMLIMGSQLTALSIFSRFWFPDVPLWIFASGFAVLGIIVILTGSKGFDRIENLFAVMKVAAIVMFIALAILALFGVFRAGPEGAGIPRTWNGLFPEGFLGLWPALIFGFYAFGGIEIMGLLANRLEEKGDAAKSGRAMLLLLTFLYVVSVGLALILVPLNRFNTETSPFITALKPYGLPIVSHLFNGVLIIAGFSTMVASLFAVTSILVTLAADKDAPNLFAKKVKNKIALPAIGLTAIGMALSVVLSLLIPGRIYEYFTTAAGLMLLYNWLFIIASSGKLIQYRLTKRWIGTLFILLAVIGTLFHRTSRPGFLFSLGFLVVIGIVTLMMKKRWKQEEGDGKKRPSIFVKLKPNSE

SEQ ID NO: 52924 - protein, 381 aa, Glycine max
MSSSTAGQVIKCKAAVSWEAGKPLVIEEVEVAPPQAGEVRLKILYTSLCHTDVYFWEAKGQTPLFPRIFGHEAGGIVESVGEGVTHLKPGDHALPVFTGECGECPHCKSEESNMCDLLRINTDRGVMIHDSQTRFSIKGQPIYHFVGTSTFSEYTVVHAGCVAKVNPAAPLDKICVLSCGICTGLGATINVAKPKPGSSVAIFGLGAVGLAAAEGARISGASRIIGVDLVSSRFEEAKKFGVNEFVNPKDHDKPVQEVIAAMTNGGVDRAVECTGSIQAMISAFECVHDGWGVAVLVGVPNKDDAFKTHPVNFLNERTLKGTFYGNYKPRTDLPSVVEKYMNGELELEKFITHTVPFSEINKAFDYMLKGESIRCIIRMGE

SEQ ID NO: 52925 - protein, 412 aa, Vitis vinifera
  misc_feature (168)..(168): Xaa can be any naturally occurring amino acid
  misc_feature (280)..(280): Xaa can be any naturally occurring amino acid
MSSSISALKSCNVAVIGAGPGGLVAARELRREGHKAVVFERQAQVGGTWEYQPSVEADPLASDPSRTIVHSSLYPSLRTNLPREVMGFRDYPFLSPGLAHRDSRRFPGHREVVYTGLGADGKWRLRSRRGNDEEVDEIFDAVVVCNGHHTEPRIAEIHGIDAWPGKQXHSHNYRIPEPFRDQVVILIGNAFSADDISRDIAQVAKEVHVASRSVDDSILGKTMQVESVHRDGTVIFQDGSGVLADVIMHCTGYEYYFPFLDTNGIVTVDDNRVGPLYKHXFPPALAPGLSFVGLPWMAPLFAVLELQSQWIAGVLSGRIGLPSQEEMMKDVEAFYLSLEASGTPKRYTHKIGDYEFVYIDWVAAACGLPRLEEWRKKMYHAVFVNKKVRPEAYRDEWDDEDLVLEAQKDFLK

SEQ ID NO: 52926 - protein, 464 aa, Pseudomonas aeruginosa PAO1
MASERNNGILIGGKRPEYVHSAQGTGLRRILGLPALVFFGLVYMVPLTMFTTYGVVTEITGGRTASAYLITLAAMLFTAFSYSFMVKKYPIAGSAYSYTSLSFGPCVGFLAGWSLLLDYLFLPMINYLLIGLFLNIAFPMVPAWVFVLAAIGLVTVLNVIGISSVAGMSNVIVGAQFVFAVVFVAMAVKHLAGIPSLDLSLPFVGDGSQPGFAPLMAGAAVLCLSFLGFDAVSTLAEETRDPQRDIPRAIVITTVGAGLLFTVLAVFSQLVFPGSVFQDAESAANEVMLAAGGKFLASFFTAAYVAGAAGSALASQASVSRILYSMGRDGILPRRVFGSLSERFKTPVIAILVVSVISLLAVVIDLTTLASMISFGALVAFSAVNLAVIRSYLLLDGRRAPRDLLRYGLVPAIGLGLTLWLWTSLSALTLVIGLTWFAAGLAYLALHTGGFRRKAPTVTFSEQN

SEQ ID NO: 52927 - protein, 259 aa, Triticum aestivum
  misc_feature (250)..(250): Xaa can be any naturally occurring amino acid
TSLYKKAGWYRSGIPGISSTHASDDQGGLEDEQGRVTQVGLMAVTQGCPDLEYWAVHVSDITNAALEAIGMFSKNLNDFRLVLLDREVHITELPLDNGVRALMRGCTKLRRFAFYVRPGALSDIGLSYVGEFSKTVRYMLLGNAGGSDDGLLAFARGCPSLQKLELRSCCFSERALAVAALQLKSLRYLWVQGYKASPTGTDLMAMVRPFWNIEFIEHLIMNEPCPEGQAQISGILLSWLGARTDCPQSXIPLYPSVGG

SEQ ID NO: 52928 - protein, 143 aa, Oryza sativa Indica Group
RGKSADGSWLWCTTDDSVYDAVKSMTQHNVGALVVVKPGQDKSIAGIVTERDYLRKIIVQGRSSKSTKVGDIMTEENQLITVKPDTRVLQAMQLMTEKRIRHIPVIDGTGMVGMVSIGDIVRAVVSEHREELNRLNAYIQGGY

SEQ ID NO: 52929 - protein, 496 aa, Mentha spicata
MELQISSAIIILVATFVASLLIKQWRKSESRQNLPPGPPKLPLVGHLHLLWGKLPQHAMADMAKKYGPVTHVQLGEVFSVVLSSREATKEAMKLLDPACADRFESIGTRIMWYDNDDIIFSPYSDHWRQMRKICVSELLSARNVRSFGFIRQDEMSRLLRHLQSSAGETVDMTERIATLTCSIICRAAFGAIINDHEELVELVKDSLSMASGFELADLFPSSKLLNLLCWNKSKLWRMRRRVDTILEAIVDEHKLKKSGEFGGEDIIDVLFRMQKDSQIKVPITTNAIKAFIFDTFSAGTETSSTTTLWVMAELMRNPAVMAKAQAEVRAALKGKTSVDVDDVQELKYMKSVVKETMRMHPPIPLIPRSCREECEVNGYKIPNKARIMINVWSMGRNPLYWEKPETFWPERFDQVSRDFMGSDFEFIPFGAGRRICPGLNFGLANVEVPLAQLLYHFDWKLAEGMKPSDMDMSEAEGLTGIRKNNLLLVPTLYKSP

SEQ ID NO: 52930 - protein, 526 aa, Thermoplasma acidophilum DSM 1728
MNSAELQIHTDTERVEEKYIREDRKLRKDLGIVDLFLIGITGVIGSGWLFAPLYAARVAGPASIISWAIGGVLVLLVGLTFSHLMGFRTEAGGMVRYPIYTHGKLAGSITGWALWLAYTMNPPSEASALVEYMSSYVPGVFHSGTLTPEGMGIALGFMFLFVLVNYYGVKIFARIINGLTALKLVVPTVTMLTLILLSFRFRNFTVSGFYPYGLSSVLAAIVSAGIVYSYLGFQAVINLAGESKRPARDGPTALILVIIFSLVFYIALEITFIGSVPSSFLRHGWSGLFLASPFADIALYFNLTWLYSLIIADSIYSPSGSSMAAVASNSRATYALAKDGFFPSFFVRIDGKTGIPRIALIFNFVISAIVLLTLKSWHSIIEALGVLLLISFIGPAASSGVIRRTSPENQILKGLYGVVQPAIFVMAGIIIFITPFTKIDIVIALFSIPAVLLILKEKNFRNVDLGYGIWLPVYLIIILSFSFLHTYYESLNILVPITAFVFLSLFVYIIAVRAGISFMKSGKQKE

SEQ ID NO: 52931 - protein, 367 aa, Mycobacterium leprae TN
MSPFGRVSATLPVFPWDTLADAKAVAESHPDGIVDLSVGTPVDPVAPLIQEALAAASSVAGYPTTAGTARLREAAVAALDRRYGITGLTEAAVLPVIGTKELIAWLPTLLGLRAGDVVVVPELAYPTYNVGARLAGARVLRADSLTQLGLQSPALFYLNSPSNPTGQVLAVNHLRKMVGWARNRGVVVVSDECYLGLGWDAEPFSVLHPLVCDGNHTGLLAVHSLSKSSSLAGYRAGFVAGDPDLVAELLAVRKHAGMMVPTPVQAAMVAALGDDAHEREQRDRYARRRDVLLPAVVSAGFTVDHSEAGLYLWASRGEPCRDSVEWFAQRGILVALGEFYGPGGCQHVRVALTASDERIAAVVARLS

SEQ ID NO: 52932 - protein, 224 aa, Streptococcus agalactiae A909
MMNLQENKTAIFDNVSKLALKAGRAHESVHIVAVTKYVNCQTTEALIRTGVNHIGENRVDKFLEKYQALKDEKLTWHLIGSLQRRKVKDVINYVDYFHALDSVKLAAEIQKRAQKPIKCFLQVNISREDSKHGFTIEQIDDALNLISRYDKIELIGIMTMAPLKATKEEISSIFEETESLRKRLQARNIERMPFTELSMGMSRDYDIAIQNGSTFVRIGTSFFK

SEQ ID NO: 52933 - protein, 174 aa, Thermoplasma acidophilum DSM 1728
MSLVNKAAPDFEANAFVNGQIKKVRLSSYRGKWVVLFFYPADFTFVCPTEVEGFAEDYEKFKKKNTEVISVSADTVYVHQAWVQHDERVAKAKFPMVEDRKGTIARAYDVYNEETGNAQRGLFIINPDGIVKYVVITDDNVGRSTDETLRVLEALQSGGLCPVNWHEGEPTIKV

SEQ ID NO: 52934 - protein, 363 aa, Zea mays
MEHLRWRPTVNERDFIECALQSDLRVDGRHSFDFRKLKITFGREDGSSEVQLGETHVMGYVTVQLVQPYRDRPNEGTLAIFTEFSPMADPSFEPGRPGELAIELGRVIDRGLRESRAVDMESLCVVAGKHVWSVRVDLHILDNGGNLIDAANIAALAALSTFRRPECTVGGDDGQQVTVHDPEVRDPLPLTIHHMPIAVTFAYFGEGNIVVLDPTYKEEAVMGGRMTAIVNSNGDVCAIQKAGGEGVMSSVIMQCLRIASVKAADITSKIKKAVDSYTTEKALKKVKRLPTSVPQKINVTNVTMDGKGDGELEKQSVQMHSDVQQISKGDENQQSIKRNSPLTRDRIAKHKQTSTFIGGPSNW

SEQ ID NO: 52935 - protein, 465 aa, Zea mays
DTIEQVCTKKQAGTGPEFPGSPPVHRHSSRKRQELKNMANRGLHLALFLVLLGLSSNLAAGQILFQGFNWESWKQNGGWYNFLMGKVDDIAEAGITHVWLPPASHSLAEQGYLPGRLYDLDASKYGNEAQLKSLIEAFHSKGVKVIADIVINHRTAEHQDGRGIYCIFEGGTPDSRLDWGPHMICSDDRAYSDGTGNPDTGADFGGAPDIDHLNPRVQQELTGWLNWLKTDVGFDAWRLDFAKGYSADVAKVYIDGTQPCFAVAEIWTSLAYGGDGKPFYDQNAHRQELVSWLDRVGGKASPATTFDFTTKGILNVAVDGELWRLRGADGKAPGLIGWWPAKAVTFVDNHDTGSTQHMWPFPADKVMQGYAYILTHPGNPSIFYDHFFDWGLKNEIAHLVSIRDRHGIQADSELRIIEADADLYLAEIDGKVIVKIGSRYDCGHLIPEGFQVVAHGDGYAVWEKN

SEQ ID NO: 52936 - protein, 325 aa, Pediococcus pentosaceus ATCC 25745
MEESKTKRRMKIFSLNSNHALSEKIAAEVGMPLGKAAIKQFSDGEIQVNIEESIRGDEVYVIQSISDPINDSLMELLIMVDALRRASASQINVVIPYYGYSRQDRKARSREPITAKLIANLLEDDAITRVLTLDLHAPQIQGFFDVPVDHLAAAPLLASYFSDGSFDVENMVVVSPDHASVSRARTMAELLGTPIAIIDNRNEESVESINEIPTEIIGNVKNKIALVVDDMIDTGTRLTISAEALHNAGATEVYGAATHAIFSNNAPKILQESKLSKIIVTDSIRIDADKKFDKLVELSVGPLLGNAIKMIYDNEPLAPLFKSQK

SEQ ID NO: 52937 - protein, 234 aa, Helicobacter pylori 26695
MTKIAMANFKSAMPIFKSHAYLKELEKTLKPQHFDRVFVFPDFFGLLPNSFLHFTLGVQNAYPRDCGAFTGEITSKHLEELKIHTLLIGHSERRTLLKESPSFLKEKFDFFKSKNFKIVYCIGEELTTREKGFKAVKEFLSEQLENIDLNYPNLVVAYEPIWAIGTKKSASLEDIYLTHGFLKQILNQKTPLLYGGSVNTQNAKEILGIDSVDGLLIGSASWELENFKTIISFL

SEQ ID NO: 52938 - protein, 534 aa, Arabidopsis thaliana
MSSSDSSSAESRLATAKTVLTTAASVAATAMLARSLVQDYLPDEVHHYISYGFRSIFGYFSSQMTIIIEEFEGFAHNEVFEAAEAYLATKISPSNKRIKVSKHEKENNYNVTVERDEEVVDTYNGVKFQWILHCRHVESKHFHNPRDLNSTLRSEVRSFELNFHKKFKDVALESYLPFMVKRATLMKQEKKTLKIFTLSPENMYGNYSDAWTSVTLDHPSTFKTLAMDSDVKTSVMEDLDKFVKRRDFYKRVGKAWKRGYLLYGPPGTGKSSLIAAMANHLNFDIYDLELTAVNNNSELRRLLIATANRSILIVEDIDCSLELKDRTSDEPPRESDDIEDPRYKKVTLSGLLNFIDGLWSSCGDERIIIFTTNYKEKLDAALLRPGRMDMHIHMSYCTPSTFKALALNYLEIKEHRLFSKIEEGIEATEVTPAEVAEQLMRNDSVDKVLEGLIEFLKVKKIENEQDKAKTEKQELENKKRTKEGTDSVVKKEVDEQLVRNDRVDKVLEGLVELLKAKKIEDDQDKAKHEEVEQH

SEQ ID NO: 52939 - protein, 272 aa, Yarrowia lipolytica CLIB122
MSLLPPPHTSDTMKQITRQTKNLHLYVSRGCPFAHRALIMRDLHKLDNISVDVVDPVLGDKGWVFSPSKEGCTKDTIYGLDTLRQVYEKVDPGYSGSITVPLLIDTHSNKLVSNESAQIAEMMDGEFDKRVKKSTDFVHKNITLAVYKVGFSKDQTAYNGAIKELFSALKKVEKDLRDSKYLAGDSLTAADVFLYTSIVRFDPVYVQRFKCNVGMIRHNFPWIHLWLRHLYWQVPAFRDTTDFSHIKQLYYDKGPESIIPAGPVPDIEKLEE

SEQ ID NO: 52940 - protein, 330 aa, Bacillus anthracis str. Ames
MNSILICGGAGYIGSHAVKKLVDEGLSVVVVDNLQTGHEDAITEGAKFYNGDLRDKAFLRDVFTQENIEAVMHFAADSLVGVSMEKPLQYYNNNVYGALCLLEVMDEFKVDKFIFSSTAATYGEVDVDLITEETMTNPTNTYGETKLAIEKMLHWYSQASNLRYKIFRYFNVAGATPNGIIGEDHRPETHLIPLVLQVALGQREKIMMFGDDYNTPDGTCIRDYIHVEDLVAAHFLGLKDLQNGGESDFYNLGNGNGFSVKEIVDAVREVTNHEIPAEVAPRRAGDPARLVASSQKAKEKLGWDPRYVNVKTIIEHAWNWHQKQPNGYEK

SEQ ID NO: 52941 - protein, 392 aa, Prochlorococcus marinus str. MIT 9312
MSQVNLSERALSIEPSLTLQISAKANQLSAEGVDICNLSAGEPDFNAPKEVIEATSKAIFDGFTKYGPAAGNLDLRKAIANKLRIQNNLNYEFENVMVTNGAKQAIYNLFQVLLNIGDEVIIPSPYWLSYPQMVRLAGGKPIFTNSSAEDGFKIDIKDLKSKISSKTKFIIINSPNNPTGRVMSKEELLQIADIVRENPNINILSDEIYELILKKEFKHYSISSQANDLKDRIFIINGFAKGWAMTGWRIGYLVGPKDVIKASSALQSQSTSNVCSFVQKGALEALKINNEFFSMINSHYDQRRSLLYEGLKNINGIYIEEPNGAFYAFPRLPNSSITSVDFCNKALQDYGLVVVPGKAFGADECIRISCATSEIKIKDGLERFKKAISKYF

SEQ ID NO: 52942 - protein, 253 aa, Yarrowia lipolytica CLIB122
MDTNVDLKTEFEKRSKALGIKVGGPLPNNNKENEHKPFISRFLTVNTPLTNHVRSVFQQFGSYVILAYTKNTLNVYFPDIRHAALAFSRFGGHRSCVYQPVDDTVVKALGKVGVRVHEGTVTCKPQEYNWYALVGEVNRIDTCPDTGDLMLEYYLSTRAYDALRIDTDLMKQSSTSRKDAQREKNIVTMAVVPRKNTIDLNRVANGLDTRTTLMIRNIPNKFTQKMLQDWVDETSKGTYDFLYLRMDFRNRCK

SEQ ID NO: 52943 - protein, 137 aa, Helicobacter pylori 26695
MKQRTLSIIKPDALKKKVVGKIIDRFESNGLEVVAMKRLHLSVKDAENFYAIHRERPFFKDLIEFMVSGPVVVMVLEGKDAVAKNRDLMGATDPKLAQKGTIRADFAESIDANAVHGSDSLENAHNEIAFFFAARDL

SEQ ID NO: 52944 - protein, 508 aa, Bordetella pertussis Tohama I
MANQTAQVAHWIGGQAAYGAEHGLQDINDPATGEVAAQVGLGGGDTVAQAVAAARAAQPAWAAKSPLHRARVLNRFLALLEDNKETLARMISREHGKVISDARGEVMRGIEVVEFACGAPELMKGAMSINVGGGIDNWVQREPLGVVAGITPFNFPVMVPLWMMPMALATGNAFVLKPSPLDASPSLALAEMLGQAGLPAGVASVVQGGVQAVNALIDHPDVKAVSFVGSTAVAHQIYERSAREGKRVQALGGAKNHLVVMPDADPEGAADALVGAAFGSAGERCMAISVAVFVGGAAEAVMPHILRKARALKVRRGMQEDAEMGAIVSAAARDRIAAYIASGVDEGASLLLDGREIAAADCGEGCGEGCGNGYWLGPTVFDRVQPSMRIYREEIFGPVLACVHVETLEQAIDLINGHDFANGVSLYTDSGTAARAFVQGIEVGMVGVNVPIPVPAAWQGFGGWKQSLFGDLHVYGEEGVRFYTRQKSVMQRWAAKAAGMSFAMPRSG

SEQ ID NO: 52945 - protein, 762 aa, Zea mays
MAILSALATEVLIPVAAVIGIAFAVVQWVVVSRVKLSPAASGGSGGKAGYADSLIEEEEGLNDHNVVVKCAEIQNAISEGATSFLFTEYQYVGIFMSIFAVVIFLFLGSVEGFSTKSQPCTYSKDKYCKPALFTALFSTVSFLLGAITSLVSGFLGMKIATYANARTTLEARKGVGKAFITAFRSGAVMGFLLASSGLVVLYITINVFKLYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGIDHDFTGMCYPLLVSSVGIIVCLITTLFATDFFEVKAVKEIEPALKKQLIISTVLMTFGIALISWLALPAKFTIYNFGTQKEVSNWGLFFCVSIGLWAGLIIGFVTEYYTSNAYSPVQDVADSCRTGAATNVIFGLALGYKSVIIPIFAIAVSIYVSFSIAAMYGIAVAALGMLSTIATGLAIDAYGPISDNAGGIAEMAGMSHRIRERTDALDAAGNTTAAIGKGFAIGSAALVSLALFGAFVSRAGVKVVDVLSPKVFIGLIVGAMLPYWFSAMTMKSVGSAALKMVEEVRRQFNTIPGLMEGTAKPDYATCVKISTDASIKEMIPPGALVMLTPLIVGTLFGVETLSGVLAGALVSGVQIAISASNTGGAWDNAKKYIEAGASEHARTLGPKGSDCHKAAVIGDTIGDPLKDTSGPSLNILIKLMAVESLVFAPFFATQGGLLFKYL

SEQ ID NO: 52946 - protein, 469 aa, Salmonella enterica subsp. enterica serovar Typhi str. CT18
MSAEHVLTMLNEHEVKFVDLRFTDTKGKEQHVTIPAHQVNAEFFEEGKMFDGSSIGGWKGINESDMVLMPDASTAVIDPFFADSTLIIRCDILEPGTLQGYDRDPRSIAKRAEDYLRATGIADTVLFGPEPEFFLFDDIRFGASISGSHVAIDDIEGAWNSSTKYEGGNKGHRPGVKGGYFPVPPVDSAQDIRSEMCLVMEQMGLVVEAHHHEVATAGQNEVATRFNTMTKKADEIQIYKYVVHNVAHRFGKTATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDLPPEEAKEIPQVAGSLEEALNALDLDREFLKAGGVFTDEAIDAYIALRREEDDRVRMTPHPVEFELYYSV

SEQ ID NO: 52947 - protein, 272 aa, Pseudomonas syringae pv. syringae B728a
MSKTRIAFVGAGNMAASLIGGLRAQGVEAALISASAPGAETRERIANDHGIQVFADNADAIKGVDVVVLAVKPQMMKTVCQALKSGLEPHQLIVSVAAGITCASLTQWLGEQPVVRCMPNTPSLLRQGASGLYATDNVTPEQREQAEALLAAVGIAVWVEQEKHMDAVTAVSGSGPAYFFLMMEAMTAAGVKLGLPEDIAKKLTLQTALGSALIATGSDAGAGELRRRVTSPGGTTEAAIKAFQAGGFEALVETALTAADHRAAELAEQLGK

SEQ ID NO: 52948 - protein, 228 aa, Pseudomonas syringae pv. syringae B728a
MSTIAANISTLEQRIRDAALAAERDPASVGLLAVSKTKPASDLREAYNAGLRDFGENYLQEALGKQLELSDLPLCWHFIGPIQSNKTRAIAENFDWVHSVDRLKIAQRLSEQRPEALEPLNICIQVNVSGEASKSGCTPQDLPALAATIIALPRLRLRGLMAIPEPTDDPAAQDASFAAVRALQEQLNLALDTLSMGMSHDLEAAIAQGATWVRIGTALFGARDYGQP

SEQ ID NO: 52949 - protein, 341 aa, Trifolium repens
QTISYMAERVVGHGSFGVVFQAKCLETGETVAIKKVLQDKRYKNRELQTMRLLDHPNVVSLKHCFFSTTEKDELYLNLVLEYVPETVHRVIKHYNKLNQRMPMIYVKLYTYQIFRALSYIHRCIGVCHRDIKPQNLLVNPHTHQVKLCDFGSAKVLVKGEPNISYICSRYYRAPELIFGATEYTTAIDVWSVGCVLAELLLGQPLFPGESGVDQLVEIIKVLGTPTREEIKCMNPNYTEFKFPQIKAHPWHKIFHKRMPPEAVDLVSRLLQYSPNLRCQALDALTHPFFDELRDPNARLPTGRFLPPLFNFKPHELKGIPVETLVKLVPEHARKQCPFLGL

SEQ ID NO: 52950 - protein, 428 aa, Synechococcus sp. WH 7805
MSRNHHPNLWPPFTSITTTPPLEQVVRGEGALLHRAEAEPLIDAISSWWVTLHGHAHPVVAAAIAEQAATLEQVIFAEFTHPQAERLAQRLAQHTGLDRVFFSDNGSTAVEVALKTAVQWWHNRGEPRQQLIAFDGAYHGDTFGAMAVGARSLFSEPFDQLLFPVARVPWPHTHWDDEAVDRREQNALTALEQALTTPTAAVILEPLVQGAGGMRMVRPGFLQAVEQLVREAGSLLIADEVLAGFGRCGTLLASQRAGIHPDLVALSKGLTAGFLPMGITMATEAIFEEFLGSDPTRTLWHGHSFTANPLGCAAANASLDLLEAEPEKYQQFQDRHQPRLEHLARHPKVQRPRLCGTIAAFDLVTDGSQGYLNPAGKILRGLVREHGVLIRPLGDVVYLLPPLCISDAQLDQCYEGIESGLDVLRAQA

SEQ ID NO: 52951 - protein, 146 aa, Alexandrium tamarense
SAAGKQKGSSSKKAGKPVQGEKKKHQSLSSKAGLVFPVQRFAKALRKGGYCKRLAAGGSIYLTAVIEYITAEILELAGNSAKEARKQRIIPRHIQLAIRNDEELNKYLSRVTITGGGVLPNIHTVLLPPKVMPAKEGASGSFSQEF

SEQ ID NO: 52952 - protein, 251 aa, Triticum aestivum
  misc_feature (95)..(95): Xaa can be any naturally occurring amino acid
MASATLLKSSFLPKKAEWGVARQVAAPRVSMVVRAGAYDDELVKTAKTIASPGRGILAMDESNATCGKRLDSIGLENTEANRQAFRTLLVSVPGXLGNHISGAILFEETLYQSTVDGKKIVDILVEQGIVPGIKVDKGLVPLTGSNDESWCQGLDGLASREAAYYQQGARFAKWRTVVSIPNPWHVSFSYARALQNTCLKTWGGRPENVKAAQEALLLRAKANSLAQLGKYTSDGEAAEAKEGMFVKNYSY

SEQ ID NO: 52953 - protein, 199 aa, Streptococcus pyogenes M1 GAS
MAEEQVLNTHNASILLSAANKSHYPQDDLPEIALAGRSNVGKSSFINTILGRKNLARTSSKPGKTQLLNFFNIDDKLRFVDVPGYGYAKVSKSERAKWGKMIEEYLTSRDNLRAVVSLVDLRHAPSKEDIQMYDFLKYYDIPVIVVATKADKIPRGKWNKHESVVKKALNFDKSDTFIVFSSVERIGIDDSWDAILEQV

SEQ ID NO: 52954 - protein, 708 aa, Zea mays
  misc_feature (183)..(183): Xaa can be any naturally occurring amino acid
MDPAPATPRWNLERPYLTGRFHQEAKAAAAAQGLGSKPFSLDSFSRGAGAGAGTGSVIGSYAVSVQELLVIDDLLSALVGIEGRYVSIKRVRGKEGYVVFQIDSSMDLALQELTRRIFPLCEDYVLVSQFVESRSHFKNGLVNHALAAALRAFLLDYQAMVAQLEHQFRLGRLSVQGLWFFCXRMMSSLNALAVLVEKATSNNTNGSATLNLLQSQAKAMGGDSAVRSLLEKMTEYASAAYLRMLERWVYEGVIDDPYGEFFIAENKSLQKESLTQDYDAKYWQQRYSLKEGIPSFLTNVAATILTTGKYLNVMRECGHNVQVSLSDNSKLMSFGSNHQYLECIKSAYDFASGELLTLMKDKYDLIGKLRSLKRYLLLDQGDFLVHFMDIAREELTKKPEEISAEKLQSLLDIALRSTAAASDPSHEELICCVERSSLLKKLATLKDLDPADKLAAADVDRSMQLSITGLETFCLSNKVQWPLSLVISRKALTKYQLIFRLLFHCKHVSRQLCAAWQIQQAFRSVKILGTPILRSSILCRSMLKFVNSLLHYLTFEVLEPNWHLMHDRLQTARSIDEVIQIHDFFLQKCLKECLLLSPELLVKVEKLKGLCLQYATSIQILMPSIDVANSENTSKSRKSRSRIDKSQDRDQQLKLASENVVMSESILKFEAAFNSELQSLAPTLSNSSQAEPYVTHLAQCILGVRIGQ

SEQ ID NO: 52955 - protein, 153 aa, Zea mays
MMNNNSGGGAGGPGGGMGTGVGGGGDGRHDDEAALTEFLSSLMDYTPTIPDELVEHYLGRSGFHCPDLRLTRLVAVATQKFLSDIASDSLQHCKARVAAPIKDNKSKQPKDRRLVLTMDDLSKALREHGVNLKHAEYFADSPSAGMAPSTREE

SEQ ID NO: 52956 - protein, 227 aa, Streptococcus pyogenes M1 GAS
MEALKKIAGVTAAQYVTDGMTIGLGTGSTAYYFVEEIGRRVKQEGLQVVGVTTSSVTSKQAEVLGIPLKSIDDIDSIDLTVDGADEVDKNFNGIKGGGAALLMEKIVATPTKEYIWVVDASKMVEHLGAFKLPVEVVQYGADRLFRVFEKAGYKPSFRMKGDSRLVTDMQNYIIDLDLGCIKDPVAFGHLLDGTVGVVEHGLFNGMVDKVIVASKDGVTVLEAPTAG

SEQ ID NO: 52957 - protein, 223 aa, Pseudomonas aeruginosa PAO1
MNQDQLKQAVAQAAVDHILPHLDSKSIVGVGTGSTANFFIDALARHKAEFDGAVASSEATAKRLKEHGIPVYELNTVSELEFYVDGADESNERLELIKGGGAALTREKIVAAVAKTFICIADASKLVPILGQFPLPVEVIPMARSHVARQLVKLGGDPVYREGVLTDNGNIILDVHNLRIDSPVELEEKINAIVGVVTNGLFAARPADLLLLGTADGVKTLKA

SEQ ID NO: 52958 - protein, 319 aa, Physcomitrella patens subsp. patens
MAEWQEKVQSMILGFVFAFMVMKLISVISSFRSANLRVTRAADEEGLVAGLGSVDEQNAPLVGTDEEVEADGGDEKEDHVDDSSSSESGTEDDAAPTSRPREVCTTDTAAVSEAESKDEEVKPKDDEEVEEIITPGAQSLKALRAGSTSSNSALASTGSFRFRKQIDLGAASEQVADDVGAELEEENETDDWEGVESTDLERLFGAASTYADNMVAMFGVKPSTDAMLQLQALYKIATEGPCSTSQPSAFQPSARAKWNAWQQLGSMSQEEAMEKYISVLTEINPAWYESYQKLSRTIPRIQLVSKRRLSNISLSMELL

SEQ ID NO: 52959 - protein, 504 aa, Pseudomonas aeruginosa PAO1
MLEQYVKKILTSRVYDVAVETPLQPARQLSERLGNQVLLKREDLQPVFSFKIRGAYNKVAQLTEEEKARGVIAASAGNHAQGLALAAKRQGIRAVIVMPKTTPEIKVQAVRAHGAKAVLHGDAFPEALAHALKLVDEKGYTFVHPYDDPDTIAGQGTVAMEILRQQPGRLDAIFVPVGGGGLVAGIAAYVKYLRPEIKVIGVEPDESNCLQAAMAAGERVVLGQVGLFADGVAVAQIGQHTFDICKDHVDEVITVSTDEICAAIKDIYDDTRSITEPAGALAVAGIKKYVERERAEGQTLVAIDSGANVNFDRLRHVAERAELGERREAIIAVTIPERPGSFKAFCEAVGKRQITEFNYRYHSGSEAHIFVGVQTHPENDPREALVAYLREKGFPVLDLTDNELAKLHIRHMVGGHAVKVSDEMVFRFEFPERPGALFNFLTKLGGRWNISMFHYRNHGAADGRVVAGLQVPEDERHLIPQTLEAIGYPYWDETANPAYQLFLG

SEQ ID NO: 52960 - protein, 366 aa, Rubrobacter xylanophilus DSM 9941
MPFSPVEEIIEEIRAGRMVIVCDDEDRENEGDLTVAAELVTPEHINFMAKYGRGLICLPMAQELIERLEIPEMVRHNSSRMGTAFTVSIEAREGISTGISAADRAHTCRVAVSDEAGPEDIVMPGHVFPLKARKGGVLQRPGQTEAAVDLARLAGLKPAGVICEVMKDDGTMARVPDLERFSAEHGIKMVTVAQIIEYRLASDPHVRCLGEEALPTRFGEFRLRSYAGVSTGLIHRALLAGEPGENGPPLVGVRAACPTGDALHSLRCDCGERLRDAMERVAAEGEGVILYLHPGPGAPLHPLPGGEDEDLAPYRAGVEILRDLGLGRVRLLMAGGEEPLDLESGPGPALAGRLLRAKAGVAAPSL

SEQ ID NO: 52961 - protein, 475 aa, Rhodobacter sphaeroides 2.4.1
MATASQGKVTQVIGAVVDVQFDGGLPPILNALETENNGKRLVLEVAQHLGESTVRTIAMDATEGLVRGARVTDTGSPISVPVGDATLGRILNVIGEPIDEKGDLGEASTRAIHQPAPTFAEQSTTSEILVTGIKVIDLLAPYSKGGKIGLFGGAGVGKTVLIMELINNIAKVHSGYSVFAGVGERTREGNDLYHEMIESGVIKIDNLSESKVALVYGQMNEPPGARARVALTGLTLAEQFRDQSGTDVLFFVDNIFRFTQAGSEVSALLGRIPSAVGYQPTLATDMGALQERITSTKAGSITSVQAIYVPADDLTDPAPATSFAHLDATTVLSRAISELGIYPAVDPLDSTSRILDPQIVGEEHYNVARAVQGILQRYKSLQDIIAILGMDELSEEDKLSVARARKIQRFLSQPFDVAKVFTGSDGVQVPLEKTIASFKAVVNGEYDHLPEAAFYMVGDIEDVIAKAQRLAAQAA

SEQ ID NO: 52962 - protein, 256 aa, Crocosphaera watsonii WH 8501
MAEAILTRLLESQLYQANTLLVSEPQTSRREFLAQTYGVNVTDSNQETLQATEALLLAIKPQILDKVISQLTLDGVENYPLVLSILAGTPLSRLETAFENFPVIRVMPNTPATVGVGMTAIAAGTRVKPSHLTLATSLFEAVGEVVEVPESLMDGVTGLSGSGPAFVALMIEALSDGGVASGLPRAIANKLAIQTVLGTATLVKDTGLHPGQLKDQVTSPGGTTIAGVAKLEEKGFRSAVIEAVKAAYRRSQDLGK

SEQ ID NO: 52963 - protein, 454 aa, Zea mays
MPSSPDLTSAKSRLVPVRNSNRLRRSQSPEAASLASRSGLVRLGALFAGGRKARGKPEDAEGGRGRRPQISLPPPARPAFGIERGRKERRCFNMKALILVGGFGTRLRPLTLSFPKPLVDFANKPMILHQIEALKEVGVTEVVLAINYRPEVMINFLKDFEDKLGITITCSQETEPLGTAGPLALARDKLADGSGEPFFVLNSDVISEYPFAELIKFHKSHGGEATIMVTKVDEPSKYGVVVMEEATGRVERFVEKPKIFVGNKINAGIYLLNPSVLDRIELRPTSIEKEVFPQIAADQQLYAMVLPGFWMDVGQPRDYITGLRLYLDSLRKKSAARLAAGAHVVGNVLVHESAKIGEGCLIGPDVAIGPGCVVEDGVRLSRCTVMRGVRIKKHACISNSIIGWHSTVGQWARIENMTILGEDVHVCDEVYSNGGVVLPHKEIKSSILKPEIVM

SEQ ID NO: 52964 - protein, 256 aa, Physcomitrella patens subsp. patens
MTGSGRFFVGGNWKCNGSTASIKQLVNELNSASIENDVDVVVAPPFLYIGQVIGSLTDRIEVSAQNCWVGKGGAFTGEISADQLVDVGVKWVIQGHSERRHVIGESNATIGKKSAYALSKGLGVIACVGEKLEEREASRTTAVVFEQLQAYADEISDWSKVVIAYEPVWAIGTGKVATPEQAQEVHAAIRSWLSEKISLEVALATRIIYGGSVNRSNCAELAKKEDIDGFLVGGASLKGPEFVSICNAVTAKKVAV

SEQ ID NO: 52965 - protein, 339 aa, Rhodobacter sphaeroides 2.4.1
MPAMNEPKLISGNANLTLAKSIARRMSVHRGMAVSLVDARVERFNDQEIFVEVYENVRGEDMYVIQPTSNPANDNLMELLIIADALRRSSADRITAVIPYFGYARQDRRAKARTPISAKLVANLIVEAGIDRVLTLDLHAAQIQGFFDIPVDNLYSAPVFALDIEHHFKGQLQDLMVVSPDVGGVARAREIAKRINAPLAIVDKRREKPGEIAEMTVIGNVAGKKCIIVDDICDTAGTLCKAAEVLIENGAVEVHSYITHGVLSGPAVERVTKSVMKSLVITDSIEPSAAVRGAPNIRIVPTAPMFAQAILNIWSGTSVSSLFETDTLVPIYEGMYQRG

SEQ ID NO: 52966 - protein, 397 aa, Cryptococcus neoformans var. neoformans JEC21
MSKPFVPTPNISRPATPSSLDYGKDEASSTLLRDMGERGDRERKDREERDKKEAMPSGQDQVLPILSYCAASIMMTVVNKYVVSGANFTMTFLLLAIQSSVCVLAVTTVKKLGFISFRDFDKNDAKAWWPISTLLVAVIYTGSKALQFLSIPVYTIFKNLTIILIAYGEVFMFNGAVSGLTLCSFALMVGSSIIAAWSDITSVWNKEPELDPITGLEITVGPVSTIGGLNAGYIWMALNCFVSAAYVLFMRKRIKVTGFKDWDSMYYNNLLSIPILVVFSLVIEDWGSESLALNFPASNRVLLLSAMAFSGAAAVFISYSTAWCVRITGSTTYSMVGALNKLPVAASGILFFGDPANFGNISAIAVGGVAGVVYAVAKTNQAKVEKARQARAAGGRP

SEQ ID NO: 52967 - protein, 342 aa, Agrobacterium tumefaciens str. C58
MTKTMKAAVVRAFGKPLTIEEVAIPDPGPGEILINYKATGVCHTDLHAATGDWPVKPNPPFIPGHEGAGYVAKIGAGVTGIKEGDRAGTPWLYTACGCCIPCRTGWETLCPSQKNSGYSVNGSFAEYGLADPKFVGRLPDNLDFGPAAPVLCAGVTVYKGLKETEVRPGEWVVISGIGGLGHMAVQYAKAMGMHVVAADIFDDKLALAKKLGADVVVNGRAPDAVEQVQKATGGVHGALVTAVSPKAMEQAYGFLRSKGTMALVGLPPGFISIPVFDTVLKRITVRGSIVGTRQDLEEALTFAGEGKVAAHFSWDKLENINDIFHRMEEGKIDGRIVVDLAA

SEQ ID NO: 52968 - protein, 389 aa, Kineococcus radiotolerans SRS30216
MSAPTQHPPRRRVGASLPDFPWDSLAAAKARAAAHPGGIVDLSVGTPVDATPAVVADALRSAADAPGYPQTHGTPALRETVASWFARRRGVPGLDPDGVLPTVGSKELVAWLPLLLGLGDGDVVAHPAVAYPTYDVGARLAGATPLGADTVEELDAAWEAGRRVRLLWLNSPSNPTGAVRSVGELAALVDWARARDVVVASDECYAELGWDAAHDTTRGGLVPSVLDPRVCGGDHTGLLVAYSTSKQSNLAGYRAAFLAGDVALVRELLELRKHAGMIVPWPVQVALRAALGDDEHVAAQRERYRARREVLRPALERAGFRVDASAAGLYLWSTRGEPCRTTIDLLAERGVLAAPGDFYGPPGARHVRIALTATDERIGEVPARLADLA

SEQ ID NO: 52969 - protein, 695 aa, Mycobacterium avium subsp. paratuberculosis K-10
MADISAIYVAAPEPETGKSTVALGLLHRLTATVAKVGVFRPITRDGQDRDYILELLLSRTTAGLSYQQCVGVTYQQLHADGDAAIATIVDAYHAMAELCDVVVIVGSDYSELGQAIRPAELSTNARIAVNLGAPILLTVSGKGRTAAEVATVVQVCLAELDAQHAHTAAVVVNRCEPAELDAVAEALRGFPQRCYVLPDEPLLSAPTVAELEKAVAGSPVSGEESLREREVTGILVAGMTADHVLERLADGMAVITPGDRSDVVLAVASAHAAEGFPSLSCIVLNGGFALHPSIAALVAGLRLRLPIVATALGTYDTASAAAAARGRVTATSQRKIDTALELMDRHVDIADLLEQLAIPIPTVTTPQMFIHQLTLQARADRKHIVLPEGDDDRILRAAGRVLQRRVADLTILGDEARIRQRSGELGVDLSDVKVIDPRTSALRPEFAQQYAQLRKAKGVTVEQAREIMRDATYFGTMLVYTSQVDGMVSGAAHTTAHTVRPAFEIIKTVPDVSTVSSIFLMCLPDRVLAYGDCAIIPNPTPEQLADIAISSARTAAQFGIEPRVAMLSYSTGDSGTGADVEKVRTATQLVRQRNPDLPVEGPIQYDAAIEPSVAATKLRDSPVAGRATVLIFPDLNTGNNTYKAVQRSAGALAIGPVLQGLRKPVNDLSRGALVEDIVNTIAITAIQAQGLPGGR

SEQ ID NO: 52970 - protein, 280 aa, Streptococcus agalactiae A909
MTDTMILNDNHKIPTLGLGTWMIDNDRVAQVVKDAIELGYRHINTAQAYNNEKGVGVGIKESGITRESLFVTTKIAAEHKDYESATKSIDQSLEALGLDCIDLMIIHSPQPWKEWRETDKHFDQGNLEAWRALEDAQKSGKVKSIGVSNFLEKDLKNGHVKPAVNQILAHIGNTPFDLIDYCQSKGIQVEAYSPIAHGQALKSDGIQKMAEKYGVSVAQLCIQYLLQLNLIVLPKASSKEHLQSNLDFDFVISDEDMSILKSLMFDDYGEFSNFPVFSEK

SEQ ID NO: 52971 - protein, 427 aa, Bacillus anthracis str. Ames
MKICTMGLGYIGLPTSAMFAKYGTEVVGVDIHQKVVDKLNNGEIHIEEPGLGEVVKEVVANGKFRASLTPEEADAFIISVPTPNHDDEHKSCDLSYVLTATEKVLPFVKKGNVIIVESTIAPRSMDDYVKPLVEEAGFTVGEDIYLVHCPERVLPGQILHELVHNNRIVGGVTPACAEAGARVYGVFVEGEIIKTNAKTAEMSKLMENTFRDVNIALANELTKVCNSLDINVLDVIEMANKHPRVNLHYPGPGVGGHCLAVDPYFIVAKAPELANIIKLSRETNVSMPHYVTEKVKELLAGVENPKVAAFGVTYKGNVDDMRESPAMDVIDLIRNEGITVSAHDPHVESDFFELHSAEEAVKDAHLILVLTDHDEFKTMNYDSLAPYMAKTVVFDTRNCVQAVSTGEMKIINFGTLYEALNKNVMMV

SEQ ID NO: 52972 - protein, 210 aa, Salmonella enterica subsp. enterica serovar Typhi str. CT18
MTNLNYQQTHFVMSAPDIRHLPSDCGIEVAFAGRSNAGKSSALNTLTNQKSLARTSKTPGRTQLINLFEVVDGKRLVDLPGYGYAEVPEEMKRKWQRALGEYLEKRQSLQGLVVLMDIRHPLKDLDQQMIQWAVESNIQVLVLLTKADKLASGARKAQLNMVREAVLAFNGDVQVEAFSSLKKQGVDKLRQKLDSWFSELAPVEEIQDGE

SEQ ID NO: 52973 - protein, 36 aa, Zea mays
MKTFDPWPVFFRREWKRNWPFLTGFAITGLIIIKMT

SEQ ID NO: 52974 - protein, 176 aa, Oryza sativa
  misc_feature (108)..(108): Xaa can be any naturally occurring amino acid
  misc_feature (129)..(129): Xaa can be any naturally occurring amino acid
MATKRSVGTLGEADLRGKKVFVRADLNVPLDDAQKITDDTRIRASVPTVKFLLEKGAKVILASHLGRPKGVTPKYSLKPLVPRLSELLGVDVVMANDCIGEEVEKLAXAALPEGGVLLLENVRFYKEEXKNDPEFAKKLAAVADLYVNDAFGTAHRAHASTEGVTKFLKPAVAGFL

SEQ ID NO: 52975 - protein, 94 aa, Glycine max
MAEKKEMIPQQFDIDAKWDACIDLTVRRFVYSATAGAFGGLLFFRSPVTRWASIAFGAGVGIGSAYAECSRLFDGPPTNLPLPKVSETATQDSD

SEQ ID NO: 52976 - protein, 122 aa, Emiliania huxleyi
MVKGGRGGSKKKATSRSAKAGLQFPVGRVHRHIKLGRYASRIGAGAPVYLAAVLEYMAAEVLELAGNAARDNKKSRIIPRHITLAVRNDEELNKFLGGVTVAQGGVLPNIHSVLLPKKSKKE

SEQ ID NO: 52977 - protein, 172 aa, Treponema denticola ATCC 35405
MENYYSILNISNNADEDQIKQAYRALAMKYHPDKNPDSKTAEEKFKRISEAYSVLSDPQKRRDYDLSMSSPFSSSGRTYTHDQNTNPFGDDIFSSNWWKNWRNIRSENAKKREKISRSEAFRILIRGIILTIVGLLLFKSIIFLGIFGFLLALSIVTEGVLRIRKGYMAIFD

SEQ ID NO: 52978 - protein, 429 aa, Bordetella pertussis Tohama I
MPKKFSNPADVHLAVVGLGYVGLPLAVEFGKKRPVIGFDINERRIAALKAGHDHTLEVEDDELARAAQLSYTAEREELGKANVFIVTVPTPIDEYKQPDLTPLVKASETIGAVLKRGDIVIYESTVYPGATEEDCVPVLERVSGLKFNQDFYAGYSPERINPGDKAHRVNTIKKVTSGSTPEVAELVDQLYNEIITAGTHKASSIRVAEAAKVIENTQRDVNIALINELALIFNKMGIDTEAVLQAAGTKWNFLPFRPGLVGGHCIGVDPYYLTHKAQAIGYHPEIILAGRRLNDSMGGYVVSQLVKAMAKRRIHVEGARVLLMGLTFKENCPDLRNTRVVDIVRELGEYHVDVDVYDPWVDPAEAEHEYGITPVAKPAAGAYDAIILAVSHHQFVEMGAEAIRKFGKAEHILYDLKYVLAPEQADLRL

SEQ ID NO: 52979 - protein, 341 aa, Bordetella pertussis Tohama I
MTNRFETTCAQLRAQPQKWLVTGCAGFIGSNLLETLLGLDQAVVGLDNFATGHQHNLDEVRAAVTPEQWARFTFIEGDIRDLAACQRAVQGVDRVLHQAALGSVPRSLKDPITTNEVNIGGFLNMLVAARDAQVQAFVYAASSSTYGDHPDLPKVEERIGNPLSPYAVTKYVNELYADVFARSYGFSSVGLRYFNVFGKRQDPDGAYAAVIPKWTAAMIKGEDVVINGDGQTSRDFCFVENAVQANLLAAMAAPEGANQVYNVAYNARTTLTELFEHLRRTLAGQGVSYEKAPVYAEFRAGDVRHSQADIGKAGKLLGYEPAYDILRGLEAAMPWYTQFLR

SEQ ID NO: 52980 - protein, 305 aa, Synechococcus sp. WH 7805
MGLERFTLFFPLWTLLAALLSLLQPDLFTWVAGPVIVWSLALIMLGMGLGLSPADFRRAMIPPRAALIGVGAQFLVMPALAASLAWALKLEPPLAVGLILVGCCPGGTASNVVALIARADVALSVVMTSLSTLLAVVVTPLLTSALAGRYVPVDGWTLLVNVLQVVLVPVTVGVAIKQGLPRLAARVQPVMPPLAVVAIALIVAGIVGSQREVLLRQGGLLVLATALLHGGGFLLGFLLPALLGEPRAVRRTISIEVGMQNSGLAVVLARSGGFASPLTALPGAISAVMHSLLGSLLAALWRKRP

SEQ ID NO: 52981 - protein, 754 aa, Saccharomyces cerevisiae
MTSNNSLLGRGRMSYSSTAPPRFKRSVDQRDTFSDNFDYDKDSSNRGRTYIAASNSTTGVPPPNNSRSGCTNNTNNTNNTSNTSNTNNNDSVDENTVFETLPYYLPCFSWLPEYTFNKLWGDVIAGISVASFQIPLALSYTTSIAHVPPLCGLYSLAISPFVYGILGSVPQMIVGPESAISLVVGQAVESITLHKENVSLIDISTVITFVSGTILLFSGISRFGFLGNVLSKALLRGFISSVGLVMIINSLISELKLDKFLVSLPQHYHTPFEKILFLIDYAPAQYHIPTAIFSGCCLIVLFLTRLLKRKLMKYHKSAIFFPDILLVVIVTILISMKFNLKHRYGISIIGDFSMDNFDELKNPLTRPRRKLIPDLFSASLIVAMLGFFESTTASKSLGTTYNLTVSSNRELVALGFMNIVISLFGALPAFGGYGRSKINALSGAQSVMSGVFMGVITLITMNLLLQFVHYIPNCVLSVITTIIGISLLEEVPGDIKFHLRCGGFSELFVFAVTFCTTIFYSIEAGICIGCVYSIINIIKHSAKSRIQILARVAGTSNFTNLDDYMMNMKRNSLDVEGTEEIEGCMIVRIPEPLTFTNSEDLKQRLDRIERYGSSKIHPGRKSLRSKDSIKYVIFDLGGMTSIDSSAAQVLEEIITSYKRRNVFIYLVNVSINDKVRRRLFKAGVAASVERAQANNNENNTSNTFSDAGETYSPYFDSIDAALYEIEKMKIKGNNVPNNDSESFMSNTLFNSSLV

SEQ ID NO: 52982 - protein, 329 aa, Burkholderia pseudomallei K96243
MQVPLDVVTYGEAMAMFVAAEPGPLDSATHFTRRIAGADLNVAIGLARLGFRVGWMSRVGADSFGRYVLDTLAREQVDASCVTVDARYPTGFQLKSRATDGADPSVEYFRKGSAASRLSLDDYVPDYVLGARHLHLTGVAPALSDSSRELAFHLACTTRAAGKTVSFDPNLRPTLWPSPEAMARTLNALAEHADWVLPGLAEGRQLTGLDTPADIARFYLERGARGVIVKLGAAGAYFRVADGREGEIAAERVEHVVDTVGAGDGFAVGVVSALLEGRAIDEAVARGNRIGALAIQVIGDSEGLPTRAALDRIENLSNARDRLEAPLAR

SEQ ID NO: 52983 - protein, 168 aa, Glycine max
SRVQSQLRLVIRHMYQSRPIHGASFVGAILKDWNLFQCWNIEFKVMFVCMISMRQVLFHALCFKGTPGDGSLIIMQIAMFSLCGLNSEQVSFMHIEFYIHMTSHGRISMVGLSSDFVPLVVDSIHAPVTPVVYNMLTTVFTMFPSPDRRTCHLFCLIIAYVLYAYVLF

SEQ ID NO: 52984 - protein, 759 aa, Pseudomonas aeruginosa PAO1
MLNTLRKIVQEVNSAKDLKAALGIIVQRVKEAMGTQVCSVYLLDTETQRFVLMATEGLNKRSIGKVSMAPSEGLVGLVGTREEPLNLENAAAHPRYRYFAETGEERYASFLGAPIIHHRRVMGVLVVQQKERRQFDEGEEAFLVTMSAQLAGVIAHAEATGSIRGLGKLGKGIQEAKFVGVPGAPGVGVGKAVVVLPPADLEVVPDKQVDDIDAEIALFKQALEGVRADMRALSSKLASQLRKEERALFDVYLMMLDDASIGNEVKRIIRTGQWAQGALRQVVMEHVQRFELMDDAYLRERASDVKDIGRRLLAYLQEERKQNLTYPEQTIIVSEELSPAMLGEVPEGRLVGLVSVLGSGNSHVAILARAMGIPTVMGAVDLPYSKVDGIDLIVDGYHGEVYTNPSAELVRQYSDVVAEERELSKGLAALRELPCETLDGHRMPLWVNTGLLADVARAQERGAEGVGLYRTEVPFMINDRFPSEKEQLAIYREQLSAFHPLPVTMRTLDIGGDKALSYFPIKEDNPFLGWRGIRVTLDHPEIFLVQTRAMLKASEGLDNLRILLPMISGTHELEEALHLIHRAWGEVRDEGVDIAMPPIGMMVEIPAAVYQTRELARQVDFLSVGSNDLTQYLLAVDRNNPRVADLYDYLHPAVLHALKKVVDDAHLEGKPVSICGEMAGDPAAAVLLMAMGFDSLSMNATNLPKVKWLLRQITLDKARDLLGQLLTFDNPQVIHSSLHLALRNLGLGRVINPAATVQP

SEQ ID NO: 52985 - protein, 326 aa, Saccharomyces cerevisiae
MAEVLTVLEQPNSIKDFLKQDSNIAFLAGGVAGAVSRTVVSPFERVKILLQVQSSTTSYNRGIFSSIRQVYHEEGTKGLFRGNGLNCIRIFPYSAVQFVVYEACKKKLFHVNGNNGQEQLTNTQRLFSGALCGGCSVVATYPLDLIKTRLSIQTANLSSLNRSKAKSISKPPGIWQLLSETYRLEGGLRGLYRGVWPTSLGVVPYVALNFAVYEQLREFGVNSSDAQPSWKSNLYKLTIGAISGGVAQTITYPFDLLRRRFQVLAMGGNELGFRYTSVWDALVTIGRAEGVSGYYKGLAANLFKVVPSTAVSWLVYEVVCDSVRNW

SEQ ID NO: 52986 - protein, 198 aa, Prorocentrum minimum
MAARDRSRSPKRGGNPTAKFETSMGDFEAEVYLDRVPITASSFIDLCKSGFYEGVHFHRVIPGFMNQFGCPHAKDPKSRRAGTGGPPDGTFKNLKTGGTEKRTGGGNIKDENISRDTNAAGTLSMANTGSPNSGGSQFFINVADNKNLDWFSPGQSKHPVFGKIISGMDVVIAISKVKTSNDNPVKPIRMNRITISGI

SEQ ID NO: 52987 - protein, 499 aa, Coccidioides immitis RS
MDKGDQNATLREILATLKSIQHDHLKLSSAVDAIGARVDRLAVGDEPKTPVEQPKDTTLRLPTSIPATPTQPSKPSVSSDDVSAKDSKRQTTTSRIILTTYPGQSGIDPVPMDWGNKDLLRRGPVVVSRHQNTVRRRNAIGAHGGSYAIYHALAVASKHLNLEHRPDFTNTEPAANIGPHPQWAEKKKIVSMDPLGHLAPWIFKDFITNENIDIRPTIAITKAHMKLPELEQSVRSGRLVPDGKICLNEMGELAVTKIAVEPVWYLPGVAERFEIDEGTLRRALFEVTGGSYPELITRGDIKLFLPPIGGLTVYCFGDPAKMSDPNVRLALRVHDECNGSDVFGSDICTCRPYLIFGVEEAVKEAQNGGSGVVIYFRKEGRALGEVTKYLVYNARKRGSDLASEYFKRTENIAGVKVLHWLGITKIDRMLSMSNMKHDAIVEQGIPIHERVPIPDELIPEDSRVEIDAKIHSGYFTTGHVMSMDELASVQGRAWDDVDH

SEQ ID NO: 52988 - protein, 119 aa, Oryza sativa
KKKLMSTVTRAYLDQKLALAKRCSREATLAGAKAAAVATVASAVPTLASVRMLPWAKANINPTGQALIICTAAGMAYFVAADKKILSLARRHSFENAPEHLKNTSFQGTGHPHPAFFRP

SEQ ID NO: 52989 - protein, 384 aa, Staphylococcus aureus subsp. aureus Mu50
MKLSLNSNSKYLRAPSIRQFSNRMNNLDDCVNLTIGQPDFPMPDVVKKAYIDAINNDKTSYSHNKGLLETREAISQYFKNRYHFSYDPEEIIVTNGASEAIDTTLRSIIEPGDEIIIPGPIYAGYIPLIEVLGGKPIYIDTTATQFKITPDALESHISPKTKAVLLNYPTNPTGVVLKRNEVLNIVNVLKKYPIFIISDEIYAENTFSGKHVSFAEFEDIRDQLILIGGLSKSHSATGIRIGFLLGPQYLIDKLTFMHAYNCICANVPAQIACITALNEGLEAPKYMNEAYVERRNYLVSELTKLGFEITAQPEGAFYIFPSIKHITDDDFEFCVDLLESTHLAIVPGSSFTEFGKGFVRISYAYEMDVLKEGMKRLAKYLNTK

SEQ ID NO: 52990 - protein, 403 aa, Bacillus halodurans C-125
MNERISKGSAYMIAKEIEQNLTQSSWIRKMFEEGQRLKSIHGTENVFDFSLGNPIIDPPASYFEQLRAYANAPIQGGHSYIPNQGLPEARQKVAEHMNGRFNTNITAQTVTMTSGAAGALNVALKSIMNPGDEVIIFTPYFAEYKFYVGNANGVAVYCPLAEDFTFDFNELEKAISPKTKAIILNNPHNPTGQLIPQSDLERLNQYLVAKEQEWGTEIHVLYDDPYSQLIYDGNVPNPFAAIERLFYISSFSKDLGLAGERLGYLAIRPDFPSVEQYMAAFVFANRTLGFGNATVTVQRMISKMDTLTQEQHEYKKRRDAMVQVLEDAGFEFVYPKGGFFIFPKSPIADDTKFCQVAAEEFQLLVVPGIGFGRAGHFRLSYSVSMEQIERSAPVLKKLKSYFS

SEQ ID NO: 52991 - protein, 322 aa, Staphylococcus aureus subsp. aureus COL
MKHLLVIHTGGTISMSQDQSNKVVTNDINPISMHQDVINQYAQIDELNPFNVPSPHMTIQHVKQLKDIILEAVTNKYYDGFVITHGTDTLEETAFLLDLILGIEQPVVITGAMRSSNEIGSDGLYNYISAIRVASDEKARHKGVMVVFNDEIHTARNVTKTHTSNTNTFQSPNHGPLGVLTKDRVQFHHMPYRQQALENVNDKLNVPLVKAYMGMPGDIFSFYSREGIDGMVIEALGQGNIPPSALEGIQQLVSLNIPIVLVSRSFNGIVSPTYAYDGGGYQLAQQGFIFSNGLNGPKARLKLLVALSNNLDKAEIKSYFEL

SEQ ID NO: 52992 - protein, 109 aa, Oryza sativa Indica Group
VPPQPNMVTPGSDAKKVSPEVIAEYTVRTLQRTVPAAVPAIVFLSGGQSEEEATLNLNAMNKLSTKKPWSLSFSFGRALQQSTLKAWSGKAENIEKARAAFLTRCKALA

SEQ ID NO: 52993 - protein, 401 aa, Magnetospirillum magnetotacticum MS-1
MKFGGTSVADIERIKNVANRVKREFDAGNEVAVVVSAMSGATNQLVAWCNQVAPLHDAREYDAVVATGEQVTIGLLAIALQELGVNARSWCGWQLPIRTDGVHGKARIMSIETDEMIARMGKGEVAVVAGFQGLGPDGRISTLGRGGSDTSAVALAAALHADRCDIYTDVDGVYTTDPRIVSVARKLDKITYEEMLELASVGAKVLQTRSVEMAMKHRVRVQVLSSFEDKPGTLVCDEDEIVEKELVSGIAYSRDEAKITLVRVADRPGVAASIFGPLADAAVNVDMIVQNVSEDGKSTDLTFTVGNADLERAKKVLEDAKANLGFEKLLADPNVVKVSVIGVGMRSHAGIAQKMFQTLASEGINIQVISTSEIKISVLIEEKYTELALRALHTAYGLDAA

SEQ ID NO: 52994 - protein, 272 aa, Rhodobacter sphaeroides 2.4.1
MTATLEFHDGSRIPQLGFGLWQVPEDRTAEVVREALELGYRLADGAAIYGNEEGLGHGLRTSGLPRDKVFVTTKVWNDAQGFESALRAVEESLKRLGLDRLDLCLIHWPAPKRNLYVETWRALIRLRDEGRITSIGVSNFDLDQIDRLTAETGVTPVLNQIELHPMLQQAELRAGHAERGIVTQSWSPLGRGMAFETPAIREIAERTGRSPAQVVLRWHIELGCAVIPRSTRRAGLAENLALFDFELTEADHAAISALDAGTRTGPDPQSFG

SEQ ID NO: 52995 - protein, 138 aa, Oryza sativa Indica Group
MAERELIDRDKLVLIDLQFHGFHGVKSEEKTLGQKFVVDVDAWMDLSVAGETDSISDTVSYTDIYGIAKDVVEGPSRNLLEAVAHRIASNALLKFPQISTIRVKVGKPHVAVHGIVDYFGVEILRHRKDVGGDRQELH

SEQ ID NO: 52996 - protein, 437 aa, Physcomitrella patens subsp. patens
MIIQQLHDHRVVLVNQDSFYRGLTSEEKAKVGDYNFDHPDAFDTEQLLECLETLKANQPINIPEYDFKRHQRCTDKFRKVNASDVIILEGILIFHDVRVREFMNMKIFVDTDADVRLARRIRRDTLERGRDVNGVIEQASYLCIYGKFVKPAFDDFVLPTKKYADVILPRGGDNHVAIDLIVQHIRTKLGQHDLRKIYPNVFVIQSTFQVRGMHTLIRDQDTKKHDFVFYSDRLIRLVVEHGLGHLPFTERQVITPTGSIYVGVDFCKQLCGVSIIRRYFSLLQVIINHYKIGKILIHREGDNGKQLIYEKLPRDIAERHVLLMDPILGTGNSAIQAILLLLQKGVPESHIIFLNLISAPEGIHAVCKKFPLLKIVTSEIDAGLNDEFRVVPGMGEFGDRYFGTDDDGPEQMYMFPIETKSSQAQSPALEILSNGKR

SEQ ID NO: 52997 - protein, 438 aa, Populus trichocarpa
MLDTVGPELQVINKKENPISLQEDSFVVLTPDLDKEATSCLLPINFTGLSSAVKKGDTIFIGQYLFTGNETTSVWLEVTEVNGEDVVCLVKNSATLSGLLYTLHVSQIHINLPTLTDKDKEVISSWGVRNNIDILSLSYTRHAEDVRHAREFLSKLGDLSQTQIFAKIENVEGLAHFDEILQEADGVILSRGNLGIDLPPEKVFLFQKTAVFKCNMAGKPAVVTRVVDSMTENLRPTRAEATDVANAVLDGSDAILLGAETLRGLYPVETISTVGRICAEAEKVFNYDLYYKRAVKYAGDSMSHLESITSTAVRAAIKVKASVILCFTSTGRAARFIAKYKPTTPVISVVIPRLKTNQLRWTFTGAFEARQSLIVRGIFPMLADARHQAESSNSTNESVLKVALDHGKAHGFIKPHDRVVVCQKLGDAYVVKILELED

SEQ ID NO: 52998 - protein, 357 aa, Treponema denticola ATCC 35405
MNDKIAIIGAGSWGTAVACSLGKNGHRVVLWSHTAGVADSINTEHINVKYLPKHKLPKTVSASTDMEEVCKDASFIFLASPSLYLTSAVEELLKFAPFSHDDGEMPYPTIAVLTKGFIPDENGEPQFIIDVLEKMLPDFYKNHLVYVAGPSHGEEVAEGKLTGLIAASQNPMCSIRCREILRSRSLLVYSSLDIIGVQVCAAAKNVVAVAFGVLDALTVTSDIFGDNTESLLLAAGLNEIQTIGRAMGATHPETFTSISGVGDLDVTCRSKYGRNRRFGNEIITKKILLSFENLDDLIKNIDKIGYLPEGVVACKYLNILAEKRNLKLPICSGLYKILNKELKPLDLIENLLQGDTK

SEQ ID NO: 52999 - protein, 309 aa, Salmonella enterica subsp. enterica serovar Typhi str. CT18
MKTAGNLIVLGSINADHILNLESFPTPGETVTGSHYQVAFGGKGANQAVAAGRSGANIAFIACTGDDDIGDSIRKQLVSDRIDIAPVSVIKGESTGVALIFVNGEGENVIGIHAGANAALSPALVDAQRERIAQADALLMQLESPLESVLAAAKIAHQHHTTVALNPAPARELPDELLALVDIITPNETEAEKLTGVRVENDDDVAKAAQVLHDKGIRTVLITLGSRGVWASVNGEGRRVPGFSVEAVDTIAAGDTFNGAFITAILEETPLPEAIRFAHAAAAIAVTRKGAQPSVPWREEIEAFLHQQG

SEQ ID NO: 53000 - protein, 549 aa, Physcomitrella patens subsp. patens
MGGFCSKTPVVEDRKKAPHRKDVNGREKEGANGNGERHPPAKKIDPAKRPVPERKQSRIPAEHLKNNQSHSQPLGKRTNFGYERDFKEKYTLGKLLGHGQFGYTYVAIEKSTGNKVAAKCIEKKQMTLPISVEDVKREVKILRTLSGHENVVQFYAAFEDDDLVYIVMELCEGGELLDRILAKKDSRYSEKDAAKIVRQMLNVAARCHLNGVVHRDMKPENFLFKSPKEDSPLKATDFGLSDYIKPGKRFGDVVGSAYYVAPEVLNRKSGPESDVWSIGVITYILLCGRRPFWDKTEAGIFNEVLKKKPDFREKPWPSITASAQDFVKKLLVKDPHMRLTAAQALSHPWVKEGGDASDMPLDISVLSNMREFVKYSRLKQLALRALASTLEPEEIRDLRDQFDAMDVDRNGTITLEEIRHALQKDRPWAVKESRVLEILQAMDSNADGIVDFDEFVAATLHVHQLEQSNTTKWQHRSKAAFSKFDVDGDGYITAEELKIATGIKGSVETLLEEADVDGDKRISLPEFQKLLHQASFGSRTNTDHNRHRT

SEQ ID NO: 53001 - protein, 247 aa, Yarrowia lipolytica CLIB122
MPKLILLRHGQSDWNEKNLFTGWVDVKLSELGHTEAKRAGTLLKESGLKPQILYTSELSRAIQTANIALDEADRLWIPTKRSWRLNERHYGALQGKDKAATLAEYGPEQFQLWRRSFDVPPPPIADDDKWSQYNDERYQDIPKDILPKTESLKLVIDRLLPYYNSDIVPDLKAGKTVLIAAHGNSLRALVKHLDGISDDDIAALNIPTGIPLVYDLDDNLKPTKAAEYLDPEAAAAGAAAVANQGKK

SEQ ID NO: 53002 - protein, 200 aa, Schizosaccharomyces pombe
MASHLASIYGTEQDKVNCSFYYKIGACRHGERCSRKHVKPNFSQTILCPNMYKNPIHEPNGKKFTQRELAEQFDAFYEDMFCEFSKYGEVEQLVVCDNVGDHLVGNVYVRFKYEESAQNAIDDLNSRWYSQRPVYAELSPVTDFREACCRQHETSECQRGGLCNFMHAKKPSPQSFTRFGTSTKKVFGLKCSRRNEKGAQ

SEQ ID NO: 53003 - protein, 217 aa, Hyphomonas neptunium ATCC 15444
MFSWLPNALTISRCVFAVLVLFAAFKATGIEALLADAGVTGLERQRYTTFQQLWHQFALLAFISGMLTDFLDGWAARAFKAESRFGVWLDPIADKLLVGAALIALSLALKTWLIYVPAALILARDVFMTWLRTRPEASGIVAPSRLAKWKTAAEMVAITGLMLPLALWPLPETPSGGGALHWSAVITGALVLALWVAAGLSLLTGGQYVKAVQSHRR

SEQ ID NO: 53004 - protein, 387 aa, Helicobacter pylori 26695
MLQRIYLDNNATTRIDPKVKEIMDPFLRDHYGNPSSLHQFGTETHPAIAEALDKLYKGINARDIDDVIITSCATESNNWVLKGVYFDECLKKGKNHIVTTVAEHPAVRSTCNFLESLGVEVTYLPINEHGSITAEQVKEAITEKTALVSVMWANNETGLIFPIEEIGAICKEKGVLFHTDAVQAIGKIPVDVLKANADFLSFSAHKFHGPKGIGGLYIRSGVGLTPLFHGGEHMNGRRSGTLNVPYIVGMGEAMKLAVEHLDYEKEVVGKLRDKLEEALLKIPDVMVVGDRIHRVPNTTLVSVRGIEGEAMLWDLNRSNIAASTGSACASEDLEANPVMVAIGASKELAHTAIRLSLSRFNTEAEIDKTIEVFSQAAVRLRNISSSY

SEQ ID NO: 53005 - protein, 487 aa, Pseudomonas syringae pv. syringae B728a
MKALDELIFDNRFARLGDAFSTSVLPEPIDAPQLVVASQSALALLDLAPEQADLPLFAEIFSGHKLWSEAEPRAMVYSGHQFGSYNPRLGDGRGLLLGEVYNDAGEHWDLHLKGAGRTPYSRMGDGRAVLRSSIREFLASEVLHALGIPSSRAGCVVSSSTPVWRETQEHAAMVLRLAQSHVRFGSLEYFFYTKQPEQLKTLAEHVLTMHYPHCQEQPEPYLAMFREIVERNAELIAKWQAYGFCHGVMNTDNMSILGITFDFGPFAFLDDFDEHFICNHSDHEGRYSFSNQVPIAQWNLSALAQALTPFISVDALREAIGLFLPLYQAHYLDLMRRRLGLTVAHEQDEQLVSQLLKLMQNSGVDYTLFFRRLGDQPAAEALRTLRDDFVDIKGFDGWAQAYQARIALENNGTEQERQTRMHAVNPLYILRNYLAQNAIAAAEKGDYAEVRRLHQVLCTPFTEQPGMQGYAQRPPDWGKHLEISCSS

SEQ ID NO: 53006 - protein, 432 aa, Yarrowia lipolytica CLIB122
MTFSEPQKRISSAADVDSFKRSQPYATIISLLDKYSSTVQEHLLPPNEDELAASSKALVTLCRKLSALIDETPPLEGPRRFGNVAVRDWHDKMEAQTTALLTEAFPSINKDSIIELQYYLHGGMGSKQRLDFGTGHELSFMAFVGGLQKLGLLETDLPAPDVLFIFETYFVLVRKLIMTYSLEPAGSHGVWGLDDHSHLPYILGSAQKVSRSVTASTLLVPTKYDKECPPSSVMNPRIVQQQKTTNLYFAAIAFIYDIKSGPFYEHSPILYDISGIATWAKIHSGMIKMYIAEVLGKFPVVQHFYFGSELYPWKDTEGNDLPYSKVEDEEPVKPKLPLGFKSKKEPQTTPHARLPLMGPRGMPMETVERLARRDGQRAAREKEEREDRASGGASGTTGAPGATALPPTRAPGSSVPGGDAPGMAPTKAPWAK

SEQ ID NO: 53007 - protein, 1842 aa, Arabidopsis thaliana
MALGDESEVFESENCHGDETERNMKVLFGGFKRLCADKVQHEEKLESMDSVLRQVVATLERMEIREGKRVEQGEHSCQSPRHSFSSSMPQRGAGESPILLDNRSSLIRRIEMPVFDGSGVYEWFSKVERFFRVGRYQDSDKLDLVALSLEGVALKWFLREMSTLEFRDWNSFEQRLLARFDPVKIHSSPEVLMPTTLIHVVAHETESRCTEELIEEDESSVRKKSNPEIVLITQKKSFPRFQNVATIVVGEFQEGTWFFDDKSKDNEANNSSDSKLKFGAYKVLDKILIRSHNLKQRRKLSLSPKNWMFKFKNRNLQQNRSKMDPCQAIEFSNIHYMYLCFSANVGLVRKNKSFQSLRLKKQAHMSRDLKKLESISSEELQPALPIVETLGDEDMVALQSDLRRLGEANFATIDSAQLLRLDDATLMNSALKRKCSKSWHFIYKHYKVRMQNLHTGIYKTQRPWHCLVHEANNTDSHLWHRWKTKVETLQEISEFLSWGLVHSHSSEVISFLGFSHGPLVTVNGASSDKVIDAAATSIFSEAIGLQQYEKVMILCMRLFTCMTLTGMMIVLFSSGNRCIDIENLTLPHNFSCSDEESRDHLFLTCTYSAQLWLQILARIDPNRSLFVSWAELLSWLRASSVSAPSTLRKVAAQTSIYHIWKQRNNVIHNQLIISNVTVFKLINREIKNIITARQHRKRYEVASMSRTSHVNIVSLLGFCYEGSKRAIIYEFLENGSLDKFISSKKSSNMDQSALYGIALGVARGLEYLHNGCRARIVHFDIKPQNVLLDDNLCLKVSDFGLAKLCEKKESILSLLDTGGRYMLGARNKTSIEVSVSNTSSMYQNTTLDYTKTKKCGNITADFPFWGGNRHKPCGHPLLELHCNNNNITSLYISNQEFYVRQINQTSNTLTLARSDLLGSFCSSYAYNTTTLPPEIFELSPTYKSLTVLYHCDPKLSYRSSYTCPALGTFSMSQSVDYQYSCQNSFTVNVPTSFHPEERGLNLTNLESALRKGFEVKLVIDEIPCQQCSSTRGICSFNGTTQSCCNATSPSGGVSCVPYQHSADEVYRRCSESFSCGSQRDLNYPLWKPGREECGHPNFKLNCSGGFAEINIASVKFRILDSYRSLIRLARSDYIGDLCPANPLTAPFIEKFLPVLELTGETELLTLYYGCRFNSSDIPANIYVGELGCDEGRSYYVTRNLSSPLLDSSRGVLNNLREMCKRNVSVPASGPALFDLQTRPNQDNLKMALDQGFRMLITSDCERCRGSGGACGYNQTSSGFGCYCKDGKCGYEYDALGALTGVVIVFLVLLCPCFRVQIFRKRKTSDEVRLQKLKALIPLKHYTYAEVKKMTKSFTEVVGRGGFGIVYSGTLSDSSMVAVKVLKDSKGTDGEDFINEVASMSQTSHVNIVSLLGFCCEGSRRAIIYEFLGNGSLDKFISDKSSVNLDLKTLYGIALGVARGLEYLHYGCKTRIVHFDIKPQNVLLDDNLCPKVSDFGLAKLCEKKESILSLLDTRGTIGYIAPEMISRLYGSVSHKSDVYSYGMLVLEMIGARKKERFDQNSRSDGSSIYFPEWIYKDLEKANIKDIEKTENGGLIENGISSEEEEIARKMTLVGLWCIQSSPSDRPPMNKVVEMMEGSLDALEVPPRPVLQQISASSVSDSFWNSEESSSASDILVFSTNSKLESSSVRLCFSLDSMNLSWQRSDLYFSPVITLPTLNSTNNILQREETVKTENKSQESIPEVVSYAVKTSPSFSEFGLAKLCEEKESILSMLDTRGTVGYIAPEMISRVYGNVSDKSDAYSYGMDLESCKSGRHIEDGINSEENELAKKMTLVGLWCIQPSP

SEQ ID NO: 53008 - protein, 379 aa, Zea mays
MATAGKVIKCKAAVAWEAGKPLSIEEVEVAPPQAMEVRVKILFTSLCHTDVYFWEAKGQTPVFPRIFGHEAGGIIESVGEGVTDVAPGDHVLPVFTGECKECAHCKSAESNMCDLLRINTDRGVMIADGKSRFSINGKPIYHFVGTSTFSEYTVMHVGCVAKINPQAPLDKVCVLSCGYSTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKAFDLMAKGEGIRCIIRMEN

SEQ ID NO: 53009 - protein, 466 aa, Colwellia psychrerythraea 34H
MEKSFDYDVIIIGTGPGGEGAAMNLAKRQKKVAIIERYHQVGGGCTHWGTIPSKALRQSVSRLIEYNSNPLFNQNEQVKQLTFQDILSHASAVIQKQVSLRSGFYNRNRVEHIQGQASFIDAHTISISHPDGSVEKISAKQIMIATGSRPYRPDDIDFDHPRVYDSDSILSLKHAPQHVIIYGAGVIGSEYASIFRGLGVKVDLINTRERLLSFLDTEMSDSLSYHLWNSGVVIRHGEEIERVESSEDAVIVHLKSGKKMRADCLLFANGRTGNTADLNLAAAGLKADGRGQLKVNDCYQTEVDNIFAVGDVIGYPSLASAAFDQGRIAASAMVDSSSKAKLIVDIPTGIYTIPEISSVGKTEQELTEAKIPYEVGRAQFKHLARAQISNNLVGSLKILFHRETKEILGIHCFGENAAEIIHIGQAIMQQTNGGNTIEYFVETTFNYPTMAEAFRVAALNGLNRLF

SEQ ID NO: 53010 - protein, 252 aa, Bordetella pertussis Tohama I
MGRLSGRNALITGAAVGIGAAMARRFCAEGASVLLGDIDAERGQALAAELAATGARARFARLDVTDEDSVRQAMELAEAEHGPLHILVNNAGGSSLNDRSVVEFALEEFWRAINIDLLGTVLCCRHAIPRIAAAGGGAVVNMGSIAALRGLKGRDAYTAAKGGVHALTRSMAVEFAEQRVRCNAIAPGAVLSERMARFIDEDPRVAAAVSRHLLGLPEPDEIAAMAVFLASEESRHVTGSIFQIDGGRAAAA

SEQ ID NO: 53011 - protein, 246 aa, Coccidioides immitis RS
MASAHVPAPTSVQGVGPLYKPDGEKPTATVSQEVSCENVHVLPQTPQLIALLTMIRDERTARADFVFYSNRIIRLLVEEGLNHLPVVEQPVTTPVGRTYLGLRFQGKICGVSIMRAGEAMEQGLRDCCRSVRIGKILIQRDEQTWQPKLFYEKLPQDIADRWVLLLDPMFATGGSATMAVEVLKEKGVPESRILFINLIASPSAVESFARKFPQLRVVTAFIDQGLDEKRYIIPGLGDFGDRYYTL

SEQ ID NO: 53012 - protein, 131 aa, Arabidopsis thaliana
MEKDMAMMGDKLILRGLKFYGFHGAIPEEKTLGQMFMLDIDAWMCLKKAGLSDNLADSVSYVDIYNVAKEVVEGSSRNLLERVAGLIASKTLEISPRITAVRVKLWKPNVALIQSTIDYLGVEIFRDRATE

SEQ ID NO: 53013 - protein, 498 aa, Schizosaccharomyces pombe 972h-
MGSLMLSRARCLLELRSALFFVKRESQDINNVRQSLGVYGRSFMTSSRMDKPSMSNKPREQMYGLGNMTAVQEPIPENSLKTVTLDQAQTAASTVTGLHPIYMDFQATSPLDYRVLDSMLPFFTGIYGNPHSRTHAYGWEAEKAVENARQEIASVINADPREIIFTSGATESNNAILKGVARFYKSRKKHLVSVQTEHKCVLDSLRALQEEGFEVTFLPVQTNGLINLDELRDAIRPDTVCVSVMAVNNEIGVCQPLEEIGKICRQKKVFFHSDAAQGYGKIDIDVNRMNIDLMSISAHKIYGPKGIGAAYVRRRPRVRLEPLISGGGQERGLRSGTLAPSQVVGFGTAARICKEEMKYDYAHISKLSQRLIDGLLAIPYTSLNGDPKSRYPGCVNISFNYVEGESLLMGLKNIALSSGSACTSASLEPSYVLRAIGQSDENAHSSIRFGIGRFTTEAEIDYAIENVSRQVSFLRNMSPLWDLVQEGVDLSTIEWSQH

SEQ ID NO: 53014 - protein, 251 aa, Triticum aestivum
  misc_feature (41)..(41): Xaa can be any naturally occurring amino acid
  misc_feature (84)..(84): Xaa can be any naturally occurring amino acid
  misc_feature (103)..(103): Xaa can be any naturally occurring amino acid
  misc_feature (112)..(112): Xaa can be any naturally occurring amino acid
LIGGGGRRSAGQPGETKDNRKEGPRRYAAWGQGQNGMVLGXGGGRRRHSHSAELGGLLAKGSLCGIVGVPTSKGTFEEGTSLGXPLSTLKTHPVMDLAIDGAXDEVDPDLNXLVKGRGGALLREKMVEAASGKFVVVVDETKLVTGLGGSGLAMPVEVVQFCWKHNQVRLQDLFNEEGCEAKLRLNEDGKPYVTDNSNYIVDLYFKTPIKDALGAGKEIAALEGVVEHGLFLNMATSVIIAGSDGVSVKTK

SEQ ID NO: 53015 - protein, 463 aa, Synechocystis sp. PCC 6803
MVSLTPNPSYSVSLLLELPNHAGTLASVTQAIADAGGSFGQISLIESNLKLTRREIAVDASSSEHAEKIIGAVKALDNVKLLKVSDRTFDLHRQGKISVVSRIPLTSQSDLAMAYTPGVGRICRAIAEDPEKVYSLTIKSNTVAVVTDGSAVLGLGNLGPEAALPVMEGKAMLFKEFAQLDAFPICLDTQDTEEIIRTVKAIAPVFGGVNLEDIAAPRCFEIEARLKKELNIPVFHDDQHGTAIVTLAALLNALKFVGKAMAAVRIVINGAGAAGLAIAELLKESGATDIWICDSKGIVGKHRTDLNSKKQSFAVDAEGTLADAMAGADVFLGVSAPGVVTKEMVQSMAKDPIVFAMANPIPEIQPELIQEDAAVIATGRSDYPNQINNVLAFPGVFRGAIDCRASIITTTMCIEAAKAIASLVHSNTLDSEHIIPSVFDNRVATTVASAVQLAARNEGVAGQ

SEQ ID NO: 53016 - protein, 592 aa, Physcomitrella patens subsp. patens
MECQLKMVCPRPDVLDLNNSKHDAGGGVGDTYCEDSATEDQTFIPWNQLVASGVDLLRDPRYNKGTAFSEGERDRHYLRGLLPPVVLTQERQIERILQNVRSYENNLEKYVDVMDLQERNERLFYKLLIDHVEELLPIVYTPTVGEACQKFGNIFRRPHGLYITLKDKGRVRDILRNWAEPNVQVIVVTDGERILGLGDLGCQGMGIPIGKLALYTALGGIRPSSTLPITIDVGTNNQTLLDNPFYIGLRHKRVGGQAYDELLAEFMLACKKTYGEKVLVQFEDFANHNAFRLLAKYSSSYLVFNDDIQGTAAVALAGLLAALPLTGGTLADHEFLFVGAGEAGTGIAELITIEIARQGKIKVEEARTKIYLADSKGLVTKSRINTLETFKKPFAHDMPEITKLVDVIKKLKPTAMIGTTGKGGQFTQAVLEEISSYQEKPIVFALSNPTSQSECTAEEAYKFTKGKCIFASGSPFPPVTYEGKTYTIGQSNNAYIFPGLGLGCVISGAIRVHDDMFLAAAESLANEISQDHLDKKQLFPAFSEIREISAHIGAATAAKAYELGLATKLPKPSDLLSYAKSCMYSPVYRQYR

SEQ ID NO: 53017 - protein, 325 aa, Synechocystis sp. PCC 6803
MDIKHGFVDSIGHTPLIRLNSFSDETGCEILGKAEFMNPGGSVKDRAALGIIETAEKEGKLKPGGTVVEGTAGNTGIGLAHICNAKGYKCLIVIPDTQSQEKIDLLRTLGAEVRTVPAVPYRDPNNYVKLSGRIAAELDNAIWANQFDNLANRDAHYHTTGPEIWQQTDGKVDAWVAATGTGGTYAGVALYLKEQSEAVQCVVADPMGSGLYSFIKTGEINPSGNSITEGIGNSRITANMENVPIDDAVQIDDPEALRVVYQLLRRDGLFMGGSVGINVGAAYQLAKKLGPGHTIVTVLCDGGARYQSRLYNQEWLTSKGLTIPD

SEQ ID NO: 53018 - protein, 461 aa, Spiroplasma citri
MSRIEKINAREVIDSRGNPTVQVEVWTEFGGYGSAMVPSGASTGSREALELRDGDKGRYQGKGVLKAVGNVNTKIAEQLVGMEVTNQVEIDHAMIALDGTDFKKNLGANAMLGVSMAAAKAAASELEMPLYKYLGGVNGKKLPVPMLNIINGGEHADSAIDFQEFMIMPVGAETFKESLRWSSEIFHTLKKILHDKGDITAVGDEGGFAPHFNWAYKDQTLTSFQAKTPAEVALDLIVEAIEVAGYKPGKDGVMIAMDCASSELYFDDKKYHFKKIEKVTGKEYAMTTEELIKYLDKLVDKYPIISIEDGLAEGDWAGFELQVKTMGHKIQIVGDDLFVTNPKITAEGIARNAANSVLIKLNQIGTVTETIDTIQLAQKAGWTAVVSHRSGETEDSTIADLAVALNTGQIKTGSMSRSDRIAKYNRLLAIEDELGKVAEYDGIKTFYNLKKHVSDLKKITS

SEQ ID NO: 53019 - protein, 411 aa, Bacillus halodurans C-125
MIEIKVPELAESITEGTIAQWLKKVGDHVSQGEYIAELETDKVNVEITAEHSGVIQELKREEGDTVEVGEVIAVLAEGDSPTASTEQAEAPKEEKKVSTVASEEAAPAPGNRPVASPAARKLAREKGIDLEAVPTADPLGRLRKQDVASYEEKPAASAPAKAPEKKAAPAAANVESPGKPVERIKMSRRRQTIAKRLVEAQQTAAMLTTFNEVDMSAVMELRKRRKDQFFEKHDVKLGFMSFFTKAVIGALKEFPLLNAEIQGDEILLKKYYDIGIAVSTDEGLVVPVVRDADRLGFAGIEREIMHLGKKARENKLSLSELQGGTFTITNGGVFGSLWSTPILNAPQVGILGMHKIQWRPVAIDEENFENRPMMYIALSYDHRIVDGKEAVSFLVRVKEMLEDPESLLLDS

SEQ ID NO: 53020 - protein, 381 aa, Kineococcus radiotolerans SRS30216
MPSTPAPESVRTAVLRALASVDDPELHRPITELGMVEGVDVGADGVVDVRVLLTIAACPMRDTLTRDVTAATRTVDGVRGVRVHLGEMTPDQRRELTTKVRGTTGAAPVIPFNQPGNLTRVYAVASGKGGVGKSSVTVNLAAAMAADGLRVGLLDADVHGFSVPRLLDVTGKPTKVGDMMIPPTAHGIRVMSIGMFVPGNQPVAWRGPMLHRALQQFASEVHWGDLDVLLLDLPPGTGDIAISVGQLLPRAEILVVTTPQVAAAEVAERAGSVAAQTEQRVVGVVENMSWLELPGGQRLEVFGSGGGATVAESLSQRLGTDVPLLAQVPMDVELREGGDAGTPVVLSHPDSPAAVVLRDLARTLARRPRGLAGRPLGVSVA

SEQ ID NO: 53021 - protein, 370 aa, Sulfitobacter sp. EE-36
MKTRAAVAVAAGQPLEVMDVNLEGPKRGEVLIEIKATGLCHTDEFTRSGDDPEGIFPAILGHEGAGVVLEVGEGVTTLEVGDHVIPLYTPECRECEYCLSGKTNLCQAIRVTQGQGLLPDGTTRFSMMDGTPIHHYMGCSTFANHTVIPEIALAKVRKDAPFDKICYIGCGVTTGIGAVINTAKVEIGARCVVFGLGGIGLNVIQGLRMAGADQIVGVDLNDDKEETGRYFGMTDFVNPTKVEGDMVAHLVELTKGGADYTFDATGNTKVMRQALEAAHKGWGESIIIGVAPAGAEISTRPFQLVTGRVWKGTAFGGAKGRTDVPKIVDWYMNGKIEIDPMITHKLTLDQINEGFELMHKGESIRAVVEF

SEQ ID NO: 53022 - protein, 288 aa, Zea mays
MDKSGKVIAKWDSRATKIYTEICVEEVNARNMPQQFLNAKGYANLIRKFKERTGRTYTRDQMKNRWDSLKRMFTQWKTLNERATGLGRDPHTGSISAPDEWWAKQNEAMPGCIMFKTAPLENEDELKIMFGPIVCTNERTLVPGVEDANSSSDDHLEYTLGGGENSTPDPCTNATGKRKMRHDSPKPKKKKDSREEYMKRLVEAFESRSLTTNKSITSSDNDPVRIELKKQMQQVKEDGSPEGSELHLFATHLLIQKKYRNVFANLETKEGRIAWLRNAYELETKKST

SEQ ID NO: 53023 - protein, 473 aa, Schizosaccharomyces pombe 972h-
MSSSPTESEILPKESHNSIDEQSQQPANTDTLVKDNSFNEQDDQEVDNDYKSNDEPVQSQDPISPNMASNESGNSENTSNYGSSRDENVYQKTTLWMGELEPWVTEAFIQQVWNTLGKAVKVKLIRNRYTGMNAGYCFVEFASPHEASSAMSMNNKPIPGTNHLFKLNWASGGGLREKSISKASEYSIFVGDLSPNVNEFDVYSLFASRYNSCKSAKIMTDPQTNVSRGYGFVRFTDENDQKSALAEMQGQICGDRPIRVGLATPKSKAHVFSPVNVVPVSMPPVGFYSAAQPVPQFADTANSTVFVGGLSKFVSEEELKYLFQNFGEIVYVKIPPGKGCGFVQFVNRQSAEIAINQLQGYPLGNSRIRLSWGRNQNPIAAPALNYQSQVSQTTIPATSLFPAMSLPPQAQFSPYPAVAPSPLALQTRGAPIGMEISIGSPALVPDQMHIPENGNSDTMPVPNTQGKHLSAEE

SEQ ID NO: 53024 - protein, 138 aa, Spiroplasma citri
MKALTTKLKLFNGVEIPLIGLGTYKMTDEHEVYQAIITALQNGYRHIDTAQIYGNEELIGKAIKDSGVPRKEIFLTSKIWNANHKYDAALQEIDNILKRLDTDYLDLCLVSLTNCRSKWMFPCVRNSLWSKKNSSNWG

SEQ ID NO: 53025 - protein, 670 aa, Physcomitrella patens subsp. patens
MASLSSHLVRPCVSEISFGSKLARNEDLRVQGACKLGGRTGLEIGGLGGGEDLKCGSVRTRELCIGWKGKRTAVGVRASVDGPLNRGRNVQSPKGSTPQVIATSGIAAPTVEDPADVDLVVDAPPKPEPLPSTPEYPHVMPGSLQYEAGKVGGISERTRDLESDSKAPTAISYLTRILTAKVYDVAIESPLELAKKLSERLGVKMLLKREDMQPVFSFKLRGAYNMMAKLPREQLKKGVICSSAGNHAQGVALSARRLNCDAVIAMPVTTPEIKWKSVKRLGATVVLVGDSYDETQAYAKQRSLDEGRIFIPPFDDPEVIAGQGTVGMEIVRQHPGPLHAVFVPVGGGGLIAGIAAYMKQVRPEVKIIGVEPADANAMALSLYHGKRVVLDQVGGFADGVAVKMVGEETFRLSRNLLDGVVLVSRDSICAAIKDMFEETRSILEPAGALSLAGAKAYCQYYGIKDESVVAITSGANMNFDRLRVVTELADVGARKEAVLATFMPEEPGSFKKFQQMVGSVDITEFKYRYTTDQEALVLYSVGLHKEEELSALKERMEGANMRTMDLTNNDLAKDHLRHLMGGRAHVQHELLYRFVFPERQGALMKFLDAFSPSWNITLFHYRSQGEMGANVLVALQITKEDEQAFIDRANALGYEFQDERNNEAFQLILR

SEQ ID NO: 53026 - protein, 359 aa, Helicobacter pylori 26695
MKVLSYLKNFYLFLAIGAIMQASENMGSQHQKTDERVIYLAGGCFWGLEAYMERIYGVIDASSGYANGKTSSTNYEKLHESDHAESVKVIYDPKKISLDKLLRYYFKVVDPVSVNKQGNDVGRQYRTGIYYVNSADKEVIDHALKALQKEVKGKIAIEVEPLKNYVRAEEYHQDYLKKHPSGYCHIDLKKADEVIVDDDKYTKPSDEVLKKKLTKLQYEVTQNKHTEKPFENEYYNKEEEGIYVDITTGEPLFSSADKYDSGCGWPSFSKPINKDVVKYEDDESLNRKRIEVLSRIGKAHLGHVFNDGPKELGGLRYCINSAALRFIPLKDMEKEGYGEFIPYIKKGELKKYINDKKSH

SEQ ID NO: 53027 - protein, 210 aa, Brassica napus
  misc_feature (140)..(140): Xaa can be any naturally occurring amino acid
MTEETKENQRPAPRLNERILSSLSRRSVAAHPWHDLEIGPGAPQIFNVVVEITKGSKVKYELDKKTGLIKVDRILYSSVVYPHNYGFVPRTLCEDNDPIDVLVIMQEPVLPGCFLRARAIGLMPMIDQGEKDDKIIAGLXVDDPEYKHYTDIKELPPHRLSEIRRFFEDYKKNENKEVAVNDFLPSEKAIEAIQYSMDLYAEYILHTLRR

SEQ ID NO: 53028 - protein, 184 aa, Thermoplasma acidophilum DSM 1728
MSEREKITIENIVASTSLAEHLDLSRIALALDGSEYEPEQFPGLIYRLQEPKTAVLIFRSGKVNCTGAKNIEDVKRTIKIIIDKLKAADIEVYDDPQIIVQNIVAVYDLESELNLTDIAMSLGLENVEYEPEQFPGLVYRVEEPRVVLLLFGSGKVVCTGAKEESEIEQAVIKVKKELQKVGLI

SEQ ID NO: 53029 - protein, 318 aa, Arabidopsis thaliana
MILAHLPRFHLSILAKPSFSLSSSHFSFLNPKPSVTVSRTLFSFASKSNLATVEPIPLSVSDSTDLDDAPAEIALDKLFIPPETDISGEDSASLTTRILKGSNIVLSKYARDAQVVQADYVKSSVKTEDCPADGLPEFALVGRSNVGKSSLLNSLVRRKRLALTSKKPGKTQCINHFRINDKWYLVDLPGYGYASAPHELKQDWNKFTKDYFLNRSTLVSVFLLVDASIPVKPIDLEYASWLGQNQVPMTLIFTKCDKRKKKKNGGKKPEANIKEFQDLIQGFFETTPPWIMTSSVTNQGRDEILLHMAQLRNYWLKH

SEQ ID NO: 53030 - protein, 879 aa, Ostreococcus tauri
MSDARASSSSAASAGDAAGDRDALERSVRALTRALGLDPEHRFAESLISASTAMLEKMVSKYDVTKVAQAQARRTLSARSRDPEAFAKACDGLRARGVEELDRYLAVLAKIAGDEELAFAVSEAGGRAAEAEAAAGRMGESRETEEPESPATISSPGGLGTPERYAALGRNVTSSISSQDTGGAGAKNLAGDFGRMSVGSAVKRVGATTEGPRLPDWNYKRPYLTGAHLGSGAEQDRNIRALSEYGTAEQELLILDDLLYAMMGIDGRYISAWRRKPLARVKFEVEIGLEAPLAALVNNMLPLCTDAATVRAFIESRQDFKHGFVSHALAADLRELLNDWSTLIVQLEHQRNIGSLSLQAAWFYCQPAAPALRLMANIASRAFYLKGASVLNLLHREGCEHAGDSAVLALVQRLSKAAAKPYIQAIELWVYDGQVDDPYDEFLILEQQEMKKQSLNDDYNSAYWTKRYSLREEFPQFIGEQLAQKILTTGRYLNAVRETSLASLAELPAKPSDGLGRMQFGPNMIVGTGKYADRIAERFEHAASKLLHIMWQEGDLKARLESMKMYFLHARGDYLVFFLDTAAAELKRDSDDIRLSKLDTLLDLALKSSSAANDLHSDDMSCSVEGHRLTQQLSEMDDGDGVTPPSTSNADELTGFDTFVLDYDAPWPASVVLNRRAVTMYQILFRHLFGFKYAERELCAGWQRLRSLRRNALAKAHVLNQRMLNFLQNYLYYVTNEVIEPHWDKMSAQMEEARSVDELIAIHGAFLESCMKDATLFWPKLLKRLDRLRSTCVRFARDCQRLAGAIERTLADMDDQAGVKRMDALEDEVSTIMRETESRFTDLLTDLLNALNDSGDVDIKLLSLSSKLDYNGFWTAKGG

SEQ ID NO: 53031 - protein, 432 aa, Schizophyllum commune
MSGAATNTRPSLANAAPRLGSISLPRRESQVVPDAPITPPLSPGHSELSIDDVEMVDRVLPSPGPAHHQLHQPTQHDMQVDEERPQPPLRLLEDEKVHLQKVGIKLTDFEVRGTLGTGTFARVLIVRHRGRESNNYFAMKVLRKSEIVRLRQVEHVNAERYILSRIQHPFIVDLFATFQDSLNVYMLMSYVPGGELFTHLRRAQRFTPDVTRFYLATIILALRYLHSFNIIYRDLKPENLLLDSRGYLRLTDFGFAKIVDDRTWTLCGTPEYLAPEIIQSDGHGKAADWWAVGVLCYEMLVGYPPFFDESPYGIYEKILDGHIHWPRSMDPLSRSLIRAFLNPDRTKRLGNMIGGPQDVLEHPWFRGVDWDALERREIMAPIIPHTSSGDDTRHFLRLPLPPAEDMPGLFHEEQPPALEQRFDPTAYQFLEF

SEQ ID NO: 53032 - protein, 316 aa, Methanococcoides burtonii DSM 6242
MVMEDDWDPKGPKRTKDPQMPEINIPPMVANILRGGAIVLVILLIFSAVFGSIFVSVGAGQVGVKFSQFGGVMDDELGEGLHIVPPWISVTKYSVRSEMYTMSGRAAEGEVVGDDQINALTNEGLTLGLDISVRYRLVADDASVVHSKLGTSYAQKIIRPTIKSVIREVVSGQTAMAIYGEQRDLVATEMQLEMEKALVGDGIIVEEVLLRNVQLPTKIADAIESKLQADQDAQRMIFVKQKEQLEAERRIIEANGIANATIVEATGEAEALRLVNQELSKNPKLINYKYIQMLESQEVQTLIVPSDQGIILDATA

SEQ ID NO: 53033 - protein, 427 aa, Schizophyllum commune
MSVIKRMTERFHIGSSKGYQYPDVDVGGSPYSTAPTPSLVSANTTLFDHRGSLSTQRTSFSELSGHRQGLGAIPEQEDMEARLNRLHLFSRNKGIYRLQDFLIQRTLGTGSFGRVLLVRSKHNLRFYAIKVLNKEKVLRMKQVEHTNNERNMLHRVNHNFIINLWGAFQDGNNLYMVMDFVPGGELFNLLRRSIRFPEPVAKFYAAEVSLALRYLHSNNIIYRDLKPENILLNADGHIKVADFGFAKIVDTVAYTLCGTPDYLAPEIIWGGRYNKSVDWYALGVLCYEMLSGLPPFHTPDGNPQTLYAKIREGPTSLPWNSPNFTLYSIDLIRRLMEGEPSKRYGNMRHGAGDVFAHPWFAEVDWEKLEDREVSPPYIPNIGGAGDASAFDIYHEDGMEELFRPPPLDTLADQFPDFDYTYDDSVAP

SEQ ID NO: 53034 - protein, 275 aa, Bacillus cereus ATCC 14579
MHIPTTTLHNGVKMPMIGLGVYKAKEGDEVKQAVKTALEVGYRSIDTATVYENESGVGEAIRESGIPREDIFITTKVWNDDQGYEETLEAFEKSLKKLQMDYVDLYLIHWPVRGKYVDTYRALEKLYEEGKVRAIGVSNFHKHHLELLLPNCKVKPMVNQVELHPMLTQFELRNYCQDEQIQMEAWSPLMRGGEVFQHPIIQAIANKYEKTPAQVILRWDIQSGIVTIPKSVTPSRIKENFTIFDFALTEEEIRQINTLNRDLHVGTNPDKYDTL

SEQ ID NO: 53035 - protein, 390 aa, Leptospira interrogans serovar Lai str. 56601
MKIHEYQAKEILRRHKANVPFGVVIDKKENASKAHDEVTSKTGGSVVVVKAQIHAGGRGKGGGVKVTKTKEDAIAAVDKILGMQLITPQTGPEGKKVLKVYLEQGIDIAKEYYLSILLDRSIRKTIIMASTEGGMEIEEVAETHPEKILKIAIDPGIGLQVNQARQLAFELGLPAESHKSFQSLLAAIYEAYIKEDASLLEINPLILTKQNEIIAGDCKIDLDENALYRHADNAAFRDITEEDPLEVQASEFNLNYVKLDGNIGCMVNGAGLAMATMDIVKLAGAEPANFLDVGGGANKTTVTNGFKIILGDPNVKGIFVNIFGGIVRCDMVAEGIIEAAKAVDLKVPLVVRLQGTNSELGREVLNKSGLKITGVDDLREAASTIAKLIG

SEQ ID NO: 53036 - protein, 275 aa, Oryza sativa Japonica Group
MSTSARRLLLLAGAAAAIALLLSATAPVAGAEDDGYSYIPGSPRGPQNWGSLKPEWATCSSGKMQSPINLGLLDLTLAPGLGNLNYTYQNANASVVNRGHDIMVRFDGDAGNLKINGTAYQLRQMHWHTPSEHTIDGRRYDMELHMVHLNAQKPAAVIGILYTIGTPGRVSAKKPYIIEISKQEGKERVIIGGADPNVAKGQDTVYYRYMGSFTTPPCTEGVIWTVVRKVRTVSLSQITLLKAAVLTGNENNARPLQGVNNREIDLFLPLPLINN

SEQ ID NO: 53037 - protein, 570 aa, Coccidioides immitis RS
MNNRKRDLKLYFYYNSLKPWAFTGISDSEASKMLPSTSSPNLKVPLERDEEGRPRFKGCSSIREYEFLGKLGEGTFGEVYKARSKHSGSIVALKKILLHNEKDGFPITALREIKLLKVLSHTNIIRLEEMAVERSRGEGRKKPSMYMVTPYMEHDLAGLLENPNVHLTEPQIKCYMLQLLEGLRYLHQNNILHRDMKAANLLISNRGILQIADFGLARPYDGHPPAPGKGGGEAVRDYTSLVVTRWYRPPELLLQLRRYTTAIDMWGAGCVFGEMFKGKPILAGSSDLNQAQLIFTLVGSPTEETMPGWSALPGCEGVKSWGSKPGNLSTVFREQGPGAISLLSELLKLDWRKRINAIDALKHPYFLNPPLPARPGDLPQFEDSHELDRRKFRGQKAMPPAPAGGSVGMGANGEWTSGSGVRVPPDPKLNSRIPSAARNGPRGAYDSRVPDSARGHKRQASDDHPPRSRDPSIHGRPPGQLPGRPNAATWRGGDRREQRGRDEWDRHRSRDSYVPKYDDDSTSVSRRDNLDSRPRADSRGDRFYRPSRSRSPERPRSRAGDGDSHNIYRR

SEQ ID NO: 53038 - protein, 1440 aa, Oryza sativa Japonica Group
MHRARLLVVVVTAVVTLLLLAPAAGAEEDDQFGYIPGTPRGPENWGSLKPEWATCSSGEMQSPINLGLLDLTLAPGLGDLNYTYRNANATVVNRGHDIMVRFDGGDDAAAAGGLVINGTAYRLRQVHWHAPSEHAVDGRRYDMELHMVHLNTQNQTAVVGILYAIGAQDEFLHKLEPYIIEVADQKDKEKIVNGGVDPNVAKEHDIVYYRYMGSLTTPPCTEGVIWTIVRKVHTVSLSQLALLKAAVVNLDRRAAWFSKGTLERFVRFVSTPEVLEMANTFDAEMSQLEGARKIYAQGVAGGADGAESAAAADITKKELLRAIDVRLSALKQDLVTACARASSAGFNPDSVSELVLFADHFGANRLSEACNKFMSLCQRRPDICPHYSVSSTSSQWKSFDDGNVRGSSSSDMSLDETQADQGASSNKSIIGGSVSHIHRSNSQNSVDVPPEPSAVQHPKPTIQQSVEKQEKETDALPAPAPAGGGSRRLSVQDRINMFESKQKEQTSSSGNSAACTSKVVPTKGEHRRVPSGASMDKLVRRWSNVSDMSIDLSNNDSSSLNEKREIGTPVGTPTSANLEVNSKARADGDANGLKHAVTSCQKDTSDALPLDSTTADAFSSSTLNTTSPSPLSAIASSSPQKQTAPRVEDDMVITSSIESESSFRKEVGASQGKGDVRMSGQAVSSVSTRARVKTSPRPTWPENNVTLSSPPLSQEHVQMTDEETIPIVHEVAVKKEQIVQKDNRGSRLRSKEIHAEADVVGRKDRPSRTTGKISDTRTRATSNPRANFRGSSVRDEAASTEAEVHDVNLQRKSLARKVEDSGRKVAAGSEILPQSDCSIHQGTNLSRQSSSAEQELSLHGGKVKLISDGNAVPLEQTKRPTKGSQDRHDELQKKANELEKLFAAQKLTSSRRGKSTDVQVENTPRVNEVKPPLVLPERIYTKQIVKESITNEFDANELLKMVDTEGYNNNVPQSIISLEESRGKFYDQYMQKRDAKLKEDWKLQGEQKEATIKAMRDSLERSNAEMRAKFSRSSSVPDSTYISRCAHKFPPLQSVIKDKDQGIDSFLVEEEMNSDYLSGDGSSRSADSRKHFSNKVACNQKKSIAPVHRHSSRTVSSGYANRRNLPDNPLAQSVPNFADLRKENTKPSAGLSRAAPRTQPKSFIRSKSIIEETGSTKSFLRKGNEAHPAVGIAGFAPPMFANTYQNGDDDDFLDQEEDSPDETKDEEYESIEENLRESDFPADSDSENPGISHEFGNSDDPGSENGDVSFPSDAPTLGGSKFNAFAGNMHDTPGEVPASWSTRPHLFAYANDNSDGDAFADSPNGSPSPWNSHTLDQITDADVSRMRKKWGSAQMPFVGPNASQQPRKDVTKGFKKLLKFGRKTRGADGLNDWVSASTASECDDDMEDGRDLAMGSSDDFRKSRMGYLLHMMVLLIRCFC

SEQ ID NO: 53039 - protein, 1220 aa, Oryza sativa
  misc_feature (995)..(995): Xaa can be any naturally occurring amino acid
NGPGDPSMATITINHLRQALQTSNKPIFGICLGNQLLAIAAGGSTYKLPYGNRGQNQPCMDTLTGRCLISSQNHGFAVDVKTLPPEWTEYFRNLNDGSNEGIIHKTKPFFTVQFHPEAKNGPTDPAYLFDMFIDKVREYKHDPSNMTFYIPPLPRPDPPRVRKVLILGSGGLQIGQAGEFDYSGSQAIKALKQEGIRSVLINPNIATVQTQAGLADAVYFAPLTIESVEEVIRKERPEGLFLGFGGQTALNLGVAMEQSGLLRRYGMKVLGTQVSAIINSEDRQLFNDRLAEIGVKVAESYACTEIEEAVVAANKIGYPVMVRAAYALGGLGSGFCQNDEEIRARWRQALACCPQVLIEKSLKGWKECEYEVVRDMYGNTVTVCNMENFDPMGIHTGESIVVAPSQTLTDDGYHWLREIAIKTVNHLQVVGECNIQYTYDPNSRDYRVIEINPRLSRSSALASKATGYPLAYVAAKLALGIPLPVLRNSVTKTTSADFEPSLDYIVTKLPRWDMAKFPHVDRHIGSAMKSVGEVMAIGRNFEESFQKAIRMVDSSNLGFHAKNWSSKTEHELRDELENPTDQRVFALKEALNRGYTVDQLFELTKITPWFLHKLHHIHEIEQELAAFKGSGRRVPANLLRAAKQHGFSDKQIGLLVGESELEVHNYRKSLKIIPVIKQIDTQAAEFPAATNYLYATYNGSVDDVPRNDGPPNGVIVLGSGTYRIGSSVEFDYGGVGVCKALRAMGEKTIMINFNPETVSTDYDESDSLYFEELSLERVLDIVDRENPKGVVVSVGGQLPQNIALKLHECGVPVMGTSPVQIDRAEDRFKFSQMLDRLGIDQPEWKELSSKEDGMEFARKVSYPVLVRPSYVLSGAAMNVVHNDDDLWALLSEASSVSPDHPVVMTKFLQRAKELEIDAVCQNGKIVNWAIAEHVVFAGVHSGDATLMFPTKHITQETKDRVFAISEKITEELQVSGPVNVQYLFTEAGELKVIEXNLRASRSLPFVTKTLGVPMIDNLARVFMNQEVRKDERCRRGVPFFGVKSSMFSFQRLKGADPRLTVEMASTGEVACYGKNVHEAFLKAFLSSSFKWPTNKTVLVSSVTDDLAREIRTLSGYGYKIFSTEAAADTLNGQGVPTTVIPNSHITEFISNKGADFVICWPDSLLHEDPFYYQLRRKAADFALPVIMNERVAKMLVESLCHIKSQSDIPTETFDFYHSLY

SEQ ID NO: 53040 - protein, 394 aa, Vitis vinifera
MADLTSSENPIFLSEFSAGAADDASEDSCSICLEPFSTDDPATITNCRHEYHLQCILEWSQRSKECPICWQFLVLQDPTSQELLAAVEGERSPRSRNSSPTESTFLHHFQGDFGYDHDASYSDDSDLDEHIMQHVVAAASGAPYVHRRERQRSSGLGPSESLVFPPTDVPDVQTINTPSPEEYQNSGSVSSESNSPAHSDQSAINAQPLSSGVPSVVNMVSSTAANRDGLAKPRVIFDQPLPSSPRRPSPSDLLSFSDSIKSRLSAASARYKESISKGTRGFKEKLLSRNNSVKELSKGVQREMSAGIASVTRMIERLDPILKRTGASNPDSSFTGGTSNVSHKGKGVQENVITPSGNNGEISNDSSPDASPLASVTISDRVEVFPLQVKKKSK

SEQ ID NO: 53041 - protein, 577 aa, Pseudomonas aeruginosa PAO1
MSFLNLPVRTLVAACGLSLLSLAAHADSFRGDAHAPQQAAVATPHPAATVAGLETLANGGNAFDAAAAIAAALAVAEPYGSGLGGGGFFLLRQAGAQPTYRFLDARERAPKAAYADMYRRNGKVDPRLSVDGPLAAAIPGLPAALVELSSRYGRKPLADNLVPAIRLAVDGVSVDRIYRDRAAMRLEAMRKDPETARIFLDKGGIPDEWNLLRQPQLARTLERLGRYGRIGFYEGETADKLLTGVRAGGGIWSAADLRDYRVIERRPLEVKLANGRELISAPPPSAGGVALAQSLQMLEQLPWQKAEPVQRAHYVLEVLRRAYRDRGLLGDPDFVANPLPSLLAPDYLKRLAAGIDPRRATPSSALPEAPAWREGDHTTHFAVIDAQGNAVAATLSVNLPFGAAFTVPDTGVVLNNEMDDFAADTQGANSYGLAGSQANAVAAGKRPLSSMSPSFLESPTDFAAFGTPGGSRIPSMVLISMLQYFDGRPVGQWVAAPRYHHQYKPDVVEYEPRAFSDAEAAELRRRGYQLKRLERSYGNQQVLYWDKRSGRVDAASDPRGIGYSSLSLEAQAQPRPH

SEQ ID NO: 53042 - protein, 172 aa, Streptococcus pyogenes M1 GAS
MDLTNYIASIKDYPKAGITFRDISPLMADGKAYSYAIREIAQYACDKDIDMVVGPEARGFIIGCPVAVELGIGFAPVRKPGKLPRDVVSADYEKEYGLDTLTMHADAIKPGQRVLIVDDLLATGGTVKATIEMIEKLGGIVAGCAFLIELEGLNGRHAIRNYDYKVLMQFPG

SEQ ID NO: 53043 - protein, 520 aa, Vitis vinifera
MAVSTDARISLSAAGQLHGTTGLAGRSLRQVKFCNGEMMGKKLKMTQLGMFRNKSVGKHVCMSLATDVAADSKLRDLEMEKRDPRTVVAVILGGGAGTRLFPLTKRRAKPAVPIGGSYRLIDVPMSNCINSGINKVYILTQFNSASLNRHLARAYNFGHGVNFGDGYVEALAATQTPGEAGKRWFQGTADAVRQFHWLFEDQRSKEIEDVLILSGDHLYRMDYMDFVQNHRQSGADITISCLPMDDSRASDFGLMKIDNKGRVLFFSEKPKGEDLKAMEVDTKVLGLSREEAEKKPYIASMGVYVFKKEILLNLLRWRFPTANDFGSEIIPASAKEFFIKAYLFNDYWEDIGTIRSFFEANLALTAHPPRFSFYDATKPMYTSRRNLPPSKIDDSKIVDSIISHGSFLNNCFIEHSVVGIRSRVNSNVHLKDTVMLGADYYETDSEVASLLAEGRVPIGIGENTRIKDCIIDKNARIGKNVVISNSEGIQEADRSLEGFYIRSGITIILKNFTIKDGFVI

SEQ ID NO: 53044 - protein, 465 aa, Rubrobacter xylanophilus DSM 9941
MREGENTLRAESTAAFRARKGLSEGLLERQAARESNARTYPRSIPIAVSRARGPYVWDADGRRYLDCLSGAGTLALGHNHPVVVEAIREVLDRGGPLHTLDLATPVKDRFVEELFGSLPRRFAERARIHFCGPAGADAVEAAVKLAKTATGRETVLSFSGGYHGMTHGALSLTGKLAPKEPLAGLMPGVHFLPYPYGYRCPFGVGGEDGWRVGARYVERLLDDPESGVKRPAAMVLEVVQGEGGSIPAPDGWVREMRRITRERGIPLIVDEIQTGLGRTGTVWAFERPGIEPDAVVMSKAIGGSLPLAAVVYDAALDVWEPGAHTGTFRGNQLAMAAGAATVRHVLKNRLHEHAARMGELLLERLREVQREAGCVGEVRGRGLMVGVEVVDPEAGPDPLGSRPARPDLARRVQAEALRRGLILETGGRHGAVVRLLPPLIIAEEEAEEICALFGEAVLAASRGAR

SEQ ID NO: 53045 - protein, 404 aa, Triticum aestivum
  misc_feature (162)..(162): Xaa can be any naturally occurring amino acid
  misc_feature (178)..(178): Xaa can be any naturally occurring amino acid
  misc_feature (193)..(193): Xaa can be any naturally occurring amino acid
  misc_feature (237)..(238): Xaa can be any naturally occurring amino acid
  misc_feature (246)..(246): Xaa can be any naturally occurring amino acid
  misc_feature (255)..(255): Xaa can be any naturally occurring amino acid
  misc_feature (277)..(277): Xaa can be any naturally occurring amino acid
TIEQVCTKKQAGTGPEFPGYRRPTRPLNRHLSRAYGSNIGGYKNEGFVEVLAAQQSPDNPDWFQGTADAVRQYLWLFEEHNVMEYLILAGDHLYRMDYEKFIQAHRETDADITVAALPMDEERATAFGLMKIDEGGRIIEFAEKPKGEQLKAMMVDTTILGXLNDARAKEIPYIARQXGIYVITKHVMLQLLXREQFPGANDFGGEVIPGATSTGMRGQAYLYHGYWEDIGTIEAFXXNAILGITXKKPIPDFSXFYDRSAPIYTQPRHLPPSKVLXDADATDSVIGEGCVNKNCKIHHSVVGLRSCISEGAIIEDTLLMGADYYETEADKKLLAEKGGIPIGIGKNSHIKRAIIDKNARIGDNVMIINVDNVQEAARETDGYFIKSGIVTVIKDALLPSGTVI

SEQ ID NO: 53046 - protein, 325 aa, Spiroplasma citri
MNILENIIEKINTFSQKIKIIFPEGNYERIQTVAKQLIGTNITPILVFATRAEVPSTIDELQSEVLVAEEQNEIELAEYLVELRKGKVSLSEAKQLVRECNYLAILWVKKGLADGMVGGITYDTKDIIGPALRIIKTKPNVKLVSSFFLMVRNTERYIFTDCALNIDPTAEELADIAYLGYEASQVFAFQNPNMALLSFSTKGSGRGASVDKVRTAYDLVRAKNLKNCYVDGEFQFDAAWDDTIRNKKAPSSPLKAPVDIFVFPNLDAGNIGYKIAQRLGGFEAIGPILIGLDRPVNDLSRGATINDIYNTVLVTAYLCIHKSND

SEQ ID NO: 53047 - protein, 332 aa, Magnetospirillum magnetotacticum MS-1
MTVRVGINGFGRIGRMVFRAVAKEFPEIEIVGINDLLEPDYLAYMLKYDSVHGRFAGDISVEGSNLIVNGKKVRLTAVKDPAELKWDEVKADIVIESTGLFLDAVNAEKHIKAGAKKVLMSAPSKDDTPMFVYGVNHEKYAGEKIVSAASCTTNCLAPVAKVLNDNWGIKRGLMTTVHAATATQKTVDGPSQKDWRGGRGILENIIPSSTGAAKAVGKVLPELNKKLTGMAFRVPTSDVSVVDLTVELNKDASYEDICKAMKAASEGALKGVLGYTEDKVVATDFVGCNMPSIFDADAGIALDSTFVKVVTWYDNEYGYTCNMLRFLRHIAK

SEQ ID NO: 53048 - protein, 294 aa, Populus trichocarpa
MGQYEKVEKIGEGTYGVVYKARDRVTNETIALKKIRLEQEDEGVPSTAIREISLLKEMQHGNIVRLQDVVHSEKRLYLVFEYLDLDLKKHMDSSPEFANDPRLVKTFLYQILRGIAYCHSHRVLHRDLKPQNLLIDRRTNALKLADFGLARAFGIPVRTFTHEVVTLWYRAPEILLGSRHYSTPVDVWSVGCIFAEMVNQKPLFPGDSEIDELFKIFRILGTPNEDTWPGVTSLPDFKSAFPKWPSKDLATVVPTLEKAGVDLLSKMLFLDPTKRITARSALEHEYFKDIGFVP

SEQ ID NO: 53049 - protein, 282 aa, Thermoplasma acidophilum DSM 1728
MFERNLLEGKIALVTGGGTGIGFSIGKRYGELGASIAICGRRENVLADAVFKFKEAGIDADSHRCDVRDPTQVSETVDHFMDRFGKIDVLVNNAAGNFVSPTEKLSPHAFDAVIGIVLHGTVYMTLELGKRWIRNGQHGVVLDIVTTYAWTGSGYVVPSAAAKAGVLALVRSLAVEWAKYGIRHVAIAPGPFPTEATRKNLFPIPEIEDRIVQRVPLKRPGRMDEIANLAAYLVSDGAEYINGSVVTIDGGEWLKGAGQFNHLENLTEDQWKMIYKISRKKE

SEQ ID NO: 53050 - protein, 475 aa, Porphyra purpurea
MVSTTKSTGSVTQIIGPVLDIAFPNGQLPKVFNALKVQSTDGTITCEVQQLLGDNKVRAVSMSSTEGLKRGVEVVDTGAPISVPVGTNTLGRIFNVLGEPVDNLGPVSSESTLPIHRPAPAFTKLETKPSIFETGIKVVDLLAPYRRGGKIGLFGGAGVGKTVLIMELINNIAKAHGGVSVFGGVGERTREGNDLYMEMKESKVINEDNLKESKVALVYGQMNEPPGARMRVGLTALTMAEYFRDINKQDVLLFIDNIFRFVQAGSEVSALLGRMPSAVGYQPTLATEMGALQERITSTTEGSITSIQAVYVPADDLTDPAPATTFAHLDATTVLSRNLAAKGIYPAVDPLDSTSTMLQPGIVGTDHYSTAQEVKSTLQRYKELQDIIAILGLDELSEEDRQTVSRARKIERFLSQPFFVAEVFTGSPGKYVSLEDAIKGFQMILKGELDDLPEQAFYLVGDIDEAIQKADSMKD

SEQ ID NO: 53051 - protein, 274 aa, Triticum aestivum
MMVAGACLSSNYFLYLYCRSASDLCNNCKRPGHFARDCPNVSVCHACGLPGHIAAECSSKDLCWNCKEPGHMANACPNEGICRNCGKSGHIAKDCTAPPMLPGEVKLCNNCYKPGHIAVECTNEKACNNCRKSGHLARNCTNEPVCNLCHVAGHLARQCPKSDEINERGGPPPFRGSDALFRGGDALFRGGDALFRGGDAPFRGGDAPFRGGGGALFRGGYSDVVCRACNQVGHMSRDCMGGAFMICNNCGGRGHMAYECPSGRLLDRFPPRRY

SEQ ID NO: 53052 - protein, 181 aa, Medicago sativa
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIASKA

SEQ ID NO: 53053 - protein, 451 aa, Thermoplasma acidophilum DSM 1728
MEEYDVITIGAGGAAYPAAFRLKRSGFSVLMIDKKGVMSGNCLAEGCVPSKAVIETVHNLAKMRHFGDYSIDYSKIVDHKDSVQNIRYEQHDQELKEAGLKIIKGTARIIDDNTVEVSSDTGTSRYRSSSAIIIASGSETFVPKIPGAELAWTSADLYSLKPKVKKLPKSIAIIGGGYIGMETASFMSILGVKVTVIEMLDRVMSTMDEAMVDKLLPLLPKMDIRTASPVQSIERNGSMYHVNFGKEGEKESIEVEAVLMAVGRVPVFPEGIDDLGIEHDRHGIKVNMAMQTNIKNIYATGDVNGITPLFHAAKRQSLVAANNIMANNVPIDYFDPLSVPFTVYTIPQMAYVGILPSQARKMGIEYLETDYQIEKDALAQINNEMFGEIRIFTDKRMKVIGGYVIGNDAGNVINEIALAVSKGLSLRDLAEMAHQHPMTFEGIDSAARKLY

SEQ ID NO: 53054 - protein, 460 aa, Salmonella enterica subsp. enterica serovar Typhi str. CT18
MATGKIVQVIGAVVDVEFPQDAVPRVYDALEVQNGNEKLVLEVQQQLGGGIVRTIAMGSSDGLRRGLDVKDLEHPIEVPVGKATLGRIMNVLGEPVDMKGEIGEEERWAIHRAAPSYEELSNSQELLETGIKVIDLMCPFAKGGKVGLFGGAGVGKTVNMMELIRNIAIEHSGYSVFAGVGERTREGNDFYHEMTDSNVIDKVSLVYGQMNEPPGNRLRVALTGLTMAEKFRDEGRDVLLFVDNIYRYTLAGTEVSALLGRMPSAVGYQPTLAEEMGVLQERITSTKTGSITSVQAVYVPADDLTDPSPATTFAHLDATVVLSRQIASLGIYPAVDPLDSTSRQLDPLVVGQEHYDTARGVQSILQRYQELKDIIAILGMDELSEEDKLVVARARKIQRFLSQPFFVAEVFTGSPGKYVSLKDTIRGFKGIMEGEYDHLPEQAFYMVGSIDEAVEKAKKL

SEQ ID NO: 53055 - protein, 527 aa, Arabidopsis thaliana
  misc_feature (45)..(45): Xaa can be any naturally occurring amino acid
MHSSHLLLEEPIRMASILEPSKSSFFPALTKIVGTLGPKSRSVEXLSGCLKAGMSVARFDFSWGDADYHQETLDNLKVAVRSTKKLCAVMLDTVGPELQVINKSEKAITLKADGLVTLTPNQDQEASSEVLPINFNGLAKAVKKGDTIFVGQYLFTGSETTSVWLEVDEVKGDDVICLSRNAATLAGSLFTLHSSQVHIDLPTLTEKDKEVISTWGVQNKIDFLSLSYCRHAEDVRQTREMLKKLGDLSQTQIFAKIENVEGLTHFDEILQEADGIILSRGNLGIDLPPEKVFLFQKAALYKCNMAGKPAVLTRVVDSMTDNLRPTRAEATDVANAVLDGSDAILLGAETLRGLYPVETISTVGRICAEAEKVFNQDLYFKKTVKYVGEPMTHLESIASSAVRAAIKVKASVIICFTSSGRAARLIAKYRPTMPVISVVIPRVKTNQLKWSFSGAFEARQSLIVRGLFPMLADPRHPAESTSATNESVLKVALDHGKHAGVIKSHDRVVVCQKVGDASVVKIIELED

SEQ ID NO: 53056 - protein, 198 aa, Ostreococcus tauri
MLGARLARAILFVLGVVYPGYLTYKTLEHDRKRPDACRGWCCYWVVYAAWATCERGLDRAFDGRVGLYRESKVRREGRMLTDGWITSTRAQVAFVTYLWHPRFQGALYVYDRFLAPFLAKHERGVDDVLATMFERVGDVAGRAFRSAYAYARRSVNDALSKATEAQMAAQFGGGASASGRADRVDLVRRRAVAHASTT

SEQ ID NO: 53057 - protein, 449 aa, Helicobacter pylori 26695
MELETHLSKYFTLAFTHKSMSLEMREKLAINSNATLKEFLQTIKNHCPNIKECMVLSTCNRFEIYASLKHGANTNEQKNALLKILAQNKKMSVSDLEKCVLMNTDESAVHHVFSVCSSLDSLVVGETQITGQMKNAYKFAFEEKFCSKDLTRLLHFAFKCAAKVRNLTGISKQGVSISSVAVKEALNIFEKERIKDKKALVIGLGEMAQLVIKHLLNKQFEALILGRNAAKFEDFIKELEEPKKVSFQNIENLNAYINEYELLFCATSSPHFIVQNRMLKETIFRRFWFDLAVPRNIEKPVLDNIFLYSVDDLEPMVRENVENRQESRMRAYEIVGLATMEFYQWIQSLEVEPVIKDLRELARISAQKELQKALKKRYVPKEYENNIEKILHNAFNTFLHNPTIALKKNAQKEESDVLVGAIKNLFNLDKSNANHAQNLNLYKCEYYEE

SEQ ID NO: 53058 - protein, 690 aa, Sorghum bicolor
MVTLLAFRLPPLFLLLAAAAAAAAADNGNMTEAEAAAMAALVNLKKSFTDPTGRLEAWSATSPFPPCDAASPWPGVQCYKGSLVGVRLTHMNLSGTFDFGAIAKLPRLHSVNLKHNALSGPLPASLGTLRGLRALYLSSNNFSGPIPADVFANMRWLKKLYLDNNRITGPLPADAIAKAPRLMELHLDRNQIDGPVPFKLPESLKRFNVSHNRLSGTIPQSVAERYDASSFAGNPGLCGSPGSDAAVCVAAGPALPPAFPPPTAADYMAMEEETSVFVVIGIILLVILLVSGAMVLMLRQDERNSVATAWDYYAGSTTTGGAGAGASGSSKSVADAASTTAAAPRAGEAVAVDMASGGSSSSHGGGGSSSGRRMGEFVLLNEDIPAFGLPDLMKASAEVLGNGTLGSAYKAAMRNGVTVAVKRLRDMNRFGRDEFEQHVHMLGQLRHPNVLPPVGYHYRKEEKLIVSEYMPRGSLLYILHGDQSPNRVILDWQGRVRIAVGVVRGLAFLHERLGIPAGRLVSMDGADFDAPPPPPPHGNLKSGNILLGADMEPLLVDYGFFPLVNAAQAPQAMFAFRSPEGTTRGVVSARSDVYCLGVVLLELVTGRFPSQYLLSARGGTDVVHWAATAVAEGGEAELVDPAIAAAGGDAAVRLLRVGVHCASPEPECRPSVAEAAWMVEEIGSAAGGAS

SEQ ID NO: 53059 - protein, 746 aa, Sorghum bicolor
MSMIHCKLNVQAEDLMGGATGAQGDVQWCNGGKLEEVAVLGCAHRIMAAEVSTVHQEVCKMYFWFAGAAIASRLIDCEAYLRTEFSGFIIVCKRAIVLDEMKSTVFSAVVVSIGYAMLGWDFAALLEANHHMKKEFELLNGPSIEGITLAASTFGAIVITIFSGALLDWLGRRAILVYSSLVLFSGGVLMLWSPNIYIVLLARLIVGSGSGLVFTCVPIYISETSPPNMRGLLGTMPQFMFFIGTIFSYCLIFWLTLMSSPNWRIMIGAIFAPSIVYFALLVYYLPESPRWLASDGKISEARVSLQRLRGKKHDVSGEIAVIVDGVDIISDSAVGTARAQSFSGTSASRTWPRSTFYWQLSDPLVDLLGSIHENMSEGGSRRNSFFPVFNSFSFPEHEHMNEHRDGNSDQQTREAYSAGEVNNGDGLRASLLSQAASVEVNDANTSFTSEGSSSYLRRHGTSVLAQEFMASIHDHDIEEEEEIHGFVLPHQSAPRDMESRGRHQVVRLSETADMKFKWRVLLQPGIRHALCYGMLIQALQQSTGISGLLRCAPEILEQVGVSLFSDIGLSPHSTSILISTLQALLILPCITAAMLLMDVCGRRVLVLATTPILILSLSVMSMSILFNMGPFDRAIVFHFALTVCFCSYVIGLGPIPNILCSEIFPTKARATCASFCSLSFWFGGLLSAYCLPVMMSTIGLGGACGIYALVCCAPLFLFYYRIPETKMLNLELIAELFKLSRQEYVQ

SEQ ID NO: 53060 - protein, 581 aa, Sorghum bicolor
MHPQRMKQAAAQQQLMQQALLLQQQQAQQPPLFPGHHHPHPGLLAAPQMEPIVSGNLPPGFDSSTCRSVYVGNISLQVTDTVLQEVFQSIGPVEGCKLIRKEKSSFGFIDYYDRRYAALAILSLNGRPLYGQPIKVNWAYTSTQREDTSGHFNIFVGDLCPEVTDATLFAFFSGYSTCSDARVMWDQKTGRSRGFGFVSFRNQQDAQSAINDLNGKWLGNRQIRCNWATKGANAGEEKQIVDSKVDLTNGTSESGKENPNEDGPESNPQFTTVYVGNLPHEATNNDVHLFFHSLGAGSIEEVRVTRDKGFGFVRYSTHEEAAQAIQMANGQLIGGRQIKTTIYNGVYKLRAVEESDFCEVLLYWSRLVTLVASLVVVASAVFLLEGNDAVRQGIDLLYAASTAGFAVGCWGLGVLGFLVTYLVAAQSPDEGLLTRMKGAACTACEVIVRRSKLCGGSVKECAEKGEAVVARVCTENLGMCSWGSKPTPPGTASSPLPPPAPALFSTGVSPTDFLAYQRMALNKMATNPSLMGQHALNQVALGMGGRASQSIYDGGFQGISTAAATTSAQQQQQQQQQLMYY

SEQ ID NO: 53061 - protein, 175 aa, Brassica napus
PRVRTYSIFALVFWETRRSDFGVSMGHHIATLILIVLSYVCSFSRVGSVVLALHDASDVFLEVGKMSKYSGAEGIASFSFILFVMSWIILRLIYYPFWILWSTSYEVVLELDKDKHPVEGPIYYYMFNTLLYCLLVLHIYWWVLMYRMLVKQIQDRGKLSEDVRSDSEGEDEHED

SEQ ID NO: 53062 - protein, 568 aa, Oryza sativa Japonica Group
MGLETGIELGLFKWCQKGRRCPTKKIDAMVQVLAGGGAEAVRRNKARGKLLPRERIDRLLDPGASFLELSQMVSRPTDQLQLYEHFIPGLTTKLAGSGVYEEALPSGGIITGIGPVHGRLCMFVANDPTTKGGTYYPITVKKHLRAQEIASECKLPCIYLVDSGGANLPRQAEVFPDRDNFGRIFYNQAKMSSDSIPQIALVLGSCTAGGAYIPAMADESVIVKGNGTIFLAGPPLVKAATGEEISAEDLGGASVHCKISGVSDHFAQDELHGLTLGRNIVKNLHLAAKVPNVQNSACDYQEPLYDVQELRSIAPADMKQSFDIRQVIARIVDGSEFDEFKKLYGTTLVTGFARICGQPVGIIGNNGILFTESALKGSHFIELCAQRNIPLIFLQNITGFMVGSKSEASGIAKAGAKMVMAVSCSKVPKITIIVGGSFGAGNYGMCGRAYSPNFLFMWPTARISVMGGIQAAGVLAQIEKNNRKRQGVEVLSKMITFALTQWTKDEEEAFKAKVVEAYDKEGSPYYSTARLWDDGIIDPADTRRVLSLCLSAAAKPVPEDTKYGVFRM

SEQ ID NO: 53063 - protein, 473 aa, Pseudomonas syringae pv. syringae B728a
MIHYATFLFCRSTVVTNTAFNSLPLSAAMLANLESLGYAEMTPIQAQSLPVILKGMDLIAQAKTGSGKTAAFGIGLLNPINPRFFGCQALVMCPTRELADQVAKEIRRLARSEDNIKVLTLCGGVSFGPQIGSLEHGAHIIVGTPGRIQQHLRKGSLVLDGLNTLILDEADRMLDMGFYDAIADIIEQTPQRRQTLLFSATYPVGIKQLSSKFMRDPQTVKVEALHADSQIEQIFYEISPEQRLEAVVKVLGHFRPTSCVAFCFTKQQVQEVVDHLTAKGMSAVGLHGDLEQRDRDQVLAMFANRSTSVLVATDVAARGLDIDALDMVINVELARDSEIHIHRVGRTGRAGEKGIAVSLVAPSESQRARAIEELQKAPLNWQQYDRLSIKEGGKLLPAMTTLCIGSGRKDKLRPGDILGALTGEAGIAGTQVGKIAIFDFQAYVAVERSMAKQALERLNNGKIKGKSLRVRIL

SEQ ID NO: 53064 - protein, 1584 aa, Oryza sativa Japonica Group
MATAIPQRQLFVAGEWRAPALGRRLPVVNPATESPIGEIPAGTAEDVDAAVAAAREALKRNRGRDWARAPGAVRAKYLRAIAAKIIERKSELARLETLDCGKPLDEAAWDMDDVAGCFEYFADLAESLDKRQNAPVSLPMENFKCYLRKEPIGVVGLITPWYFTFFSHPALIFIYDPSMALMNYPLLMATWKVAPALAAGCTAVLKPSELASVTCLELADVCKEVGLPSGVLNIVTGLGSEAGAPLSSHPGVDKVAFTGSYETGKKIMASAAPMVKPVSLELGGKSPIVVFDDVDVEKAVEWTLFGCFWTNGQICSATSRLILHKKIAKEFQERMVAWAKNIKVSDPLEEGCRLGPVVSEGQYEKIKQFVSTAKSQGATILTGGVRPKHLEKGFYIEPTIITDVDTSMQIWREEVFGPVLCVKEFSTEEEAIELANDTHYGLAGAVLSGDRERCQRLTEEIDAGIIWVNCSQPCFCQAPWGGNKRSGFGRELGEGGIDNYLSVKQVTEYASDEPWGWEILYSIKPELIDYPSSFKSPVSSGTKTVLLPEARARVFKSNYSQSLGELKILRSSWLVASFSESGKAGFSSFWLLVHFLDFTTTASQNLDQKLDCLGELLIMGEAAAARSSPNRPFVSLYQQPCNLLFLQNEKNNGKIQSHMDYNIVLSIFTMKSSLRSQSYWSRQVAYVKKLIEVLQREQDILWRILWENIDKVKELTDSTSATLRGPEIESMPKTAKIWLHQVREINRDIEDILEKSPSKTCSSKGSNILSCITQPINFVARQRIYKQVQSLSARIDTIKLRLSLLTNFDDKEAPANPTRYQLDDRQLDMLSLDEAKVIGIGYPKAKVTQLLLDEEKQLRVISIIGSAGVGKTTLARSVYNDKKVQGRFRCHAWITIGAPIPMVDRLKSIMVQIFVEKLEEIPARLDFMDEIQIAEVIGRYLADKSFLVVLDDIWNSDTWDYLKLALPNNGQGSRIIVSTRAQEIGRDCRLASDIQIFEKRPLNEDDAWLLFCNKAFPAIQARCPAELEETGRKIVRECHGVPLLVVTIGGLMSMKEQTVQVWKNVLDNLHKKYLPEFTLPSILWFAYSDLPHHLKCCLLYFIMFPRKYSIKRMTLIRLWMAEGFIKNDQESTLEDTAGRYLTELIDRGMVQVADFYDYGRVKSCSVHDMLREIIILKSTEDNFGIPVTRGVNKVRGNVRRLSIINTNDDFLEDNSCTNLRTLFVFGASSISTTSLHAFLVGFRLLRILDLEGAPVESLPDELPDLFYLRYLSLRNTRIDKLPKSLKKMMNLQTLDLKGTYVSQLPSGITKLESLRHLLAYRYYSGRHPPYYYTLGVTLPRGIGNLKELQKLTYVEANQGNGTIEELGSLTQLRRLGIVKLRERDCMHLCSSVAKMTELLSLSASSLDDEILDLGSLNPAPQCLRRLYLRGPLPGIPSWLHSLKNLVRIRLRWSRLNEDSLKELQSLPLVELALIQAYDGTKLEFTQGFARLEILELDHLTNLEHINLEKSMPGLQKISIRSCDKLLTIPHGIEGLENLKELYLFAMPKNFVESLMTGGVKHRRVEHIPVIRHFNEHRDISLTNL

SEQ ID NO: 53065 - protein, 557 aa, Pseudomonas syringae pv. syringae B728a
MSELIRVPDIGNGEGEVIELMVKVGDRIEADQSVLTLESDKASMEIPAPKAGVIKTMKVKLGDRLKEGDELFELEVEGEAAAAAAPAAEPAPAPAPAPAPAAAEKPAEAAPAPAAAAEPAPAASASVQDIHVPDIGSSGKAKIIELMVKVGDSIQADQSLITLESDKASMEIPSPAAGVVESIEVKLDQEVGTGDLILKLKVEGAAPAAAPAPAASAPAAAPAKAEAAAPAAPAPKAEAAPAPAAPAAPAKDGAKVHAGPAVRQLAREFGVELNAVSATGPHGRVLKEDVQAYVKTMMQKAKEAPAGGASGGSGIPPIPEVDFSRFGEIEEVPMTRLMQLGASGLHRSWLNIPHVTQFDQADITDLEAFRVAQKGAAEKAGVKLTVLPLLLKSCAHLLKELPDFNASLAPSGKAVIRKKYVHIGFAVDTPDGLLVPVIRDVDQKSLLQLAAEAAALAEKARNKKLTANDMQGACFTISSLGHIGGTGFTPIVNAPEVAILGVSKATIQPVWDGKAFQPKLMLPLSLSYDHRVINGAAAARFTKRLSELLADIRTILL

SEQ ID NO: 53066 - protein, 612 aa, Oryza sativa
MATSAAAAASTLPYLVAAASSSAAARRRGAHRIRASSAAAEVEGAMDVVSEAELREKGFMGLRKTKLVCTVGPACVGALPALARGGMGVARVNLCHGGRGWHRAVMREVRRLNEEEGFCVSLMVDTEGSQLLVADHGGAASVKAEDGSEWLFTSKRTDESHPFTMHVNFDKFSEDILVGDELVIDGGMATFEVIEKDWADIEFGIAEGVDCIALSFVKDANDIKYLKTYLSRKSLEHIKIFAKVESLESLKNLKDIIEASDGVMVARGDLGVQIPLEQIPAIQEAIVDLCRRLNKPVIVASQLLESMVEYPTPTRAEKALAVLRAASERMESWSREENMQKLLPQHQLAIALPDRISEQICTSAAEMANNLAVDAIFVYTKYGHMASLLSRNRPNPPIFAFTDNANSRKSMNLYWGVIPLQLPLSNNMEDNFNQTIKLMKSKGSVKSGDTVLVVADSDLNRPRAATSVFQSIQLEHPYRAQDTKKAMLLHLIPGKATAPSDDDDEEEKDNGKDYIAWHQPHHVPTSTPWHQRPLEAGGEVASRAGIHHQPLLTPSLEPSLLVPPSSTSVVTSRQGRPEGRSERRIKGGGMEIKEAEEEASHWATAACSLIGA

SEQ ID NO: 53067 - protein, 408 aa, Oryza sativa Japonica Group
MLSYNYLDVAFAPYSDYWREMRKLFVVELTSVSRVRSFAYARAAEVARLVDTLAASPPGVPVDLSCALYQLLDGIIGTVAFGKGYGAAQWSTERAVFQDVLSELLLVLGSFSFEDFFPSSALARWADALAGVERRRRRIFRQVDGFLDSVIDKHLEPERLSAGVQEDMVDALVKMWREQQDRPSGVLTREHIKAILMNTFAGGIDTTAITAIWIMSEIMRNPRVMQKARAEVRNTVKNKPLVDEEDSQNLKYLEMIIKENFRLHPPGNLLVPRQTMQPCLIGGYNVPSGTRVFINIWAMGRGPMIWDNPEEFYPERFEDRNMDFRGSNFELVPFGSGRRICPGVAMAVTSLELVVANLLYCFDWKLPKGMKEEDIDMEEIGQISFRRKVELFIVPVKHEQYQLMGHIN

SEQ ID NO: 53068 - protein, 397 aa, Bacillus cereus ATCC 14579
MFHRIEEALEDLKKGKVVIVCDDENRENEGDFIALAEYITPETINFMITHGRGLVCVPITEGYAERLQLEPMVSHNTDSHHTAFTVSIDHVSTTTGISAHERATTIQELLNPASKGADFNRPGHIFPLIAKEGGVLRRAGHTEAAVDLAKLCGAEPAGVICEIINEDGTMARVPDLIECAKQFDIKMITIEDLIAYRRHHETLVTREAEITLPTDFGTFHAIGYSNSLDTKEHIALVKGDISTGEPVLVRVHSECLTGDVFGSHRCDCGPQLHAALAQIEREGKGVLLYMRQEGRGIGLLNKLRAYKLQEEGFDTVEANEKLGFPADLRDYGIGAQILKDLGLQSLRLLTNNPRKIAGLQGYDLEVVERVPLQMPAKEENKSYLQTKVNKLGHLLNL

SEQ ID NO: 53069 - protein, 153 aa, Bacillus cereus ATCC 14579
MVFEGHLVGTGLKVGVVVGRFNEFITSKLLGGALDGLKRHGVEENDIDVAWVPGAFEIPLIAKKMASSGKYDAVITLGTVIRGATTHYDYVCNEVAKGVASLSLQMDIPVIFGVLTTETIEQAIERAGTKAGNKGYESAVAAIEMAHLSKQWA

SEQ ID NO: 53070 - protein, 476 aa, Pseudomonas aeruginosa PAO1
MVADIAYLQQSQQEINQLEALFARQRAAYLAQPMPDATQRVQWLKALRDLLFKEQQALIEAIDRDFSARSADETLLAEIMPSLHGIHYAAKRVKKWMKPARRAVGLQFQPASAQVVYQPLGVVGVIVPWNYPLFLSIGPLTGALAAGNRVMIKMSESTPATGRLLKDLLARIFPEDQVAVVLGEVDVGVAFSKLPFDHLLFTGATSVGKHVMRAAAENLTPVTLELGGKSPAIVSDSVPMKDAAERIAFGKSLNAGQTCVAPDYVLVPSRRVEEFVSQYKEVVQGFFPRLSDNPDYTAIINERQLGRLRGYLDDAREKGATLVPLFAEGQQRRLPQTLLLNVSDDMKVMQEEIFGPLLPVIPYERLEDALAYVNQRPRPLALYYFGYDKAQQQRVLHETHSGGVCLNDTLLHVAQDDIPFGGVGPSGMGHYHGHEGFLTFSKAKGVFSKPRFNAARMIYPPYGKSIQKLVYKLFVR

SEQ ID NO: 53071 - protein, 411 aa, Coccidioides immitis RS
MAEPIPNKKADLLGAPTPQNTPANTAPISSRAQQPNIASIKEEDLDRAAAASIFAQNPKLVSMIQGKLGSLIGRSSGYIESLPASVRRRVAGLKGIQKEHAKLEAQFQEEVFQLEKKYFAKFAPLYQKRATIVNGQAEPTEEEVEVGKAGEEEDQDEDKKAEESKDESSDVAVSGIPEFWLSAMKNQVSIAEMITDRDEEALKNLTDIRMEYLDRPGFRLIFEFGENEFFTNKTISKTYYYQEESGYGGDFIYDHAEGEKINWKEGKDLTVRIESKKQRNKTTKQTRVVKVTVPTQSFFNFFSPPKPPREEDEEEEVPDDIEERLELDYQLGEDIKEKLIPRAIDWFTGEAMQFEEYDGDFEEEDFDDDDDDDDDDDDDDRRSGDMDDESEDEWQDDGSKPKKEAPECKQS

SEQ ID NO: 53072 - protein, 306 aa, Carboxydothermus hydrogenoformans Z-2901
MRIYEDITQLIGKTPLLKLKRVTRGVKATVVAKLEYFNPGGSVKDRIAFNMIKAAEEQGLLDKDTVIIEPTSGNTGIGLAMVAAARGYRLIITMPETMSVERRMLLKAYGAEIVLTPGELGMTGAVNKALELAKEFPKAFIPQQFENPANPEIHRKTTAIEIWEDTDGQVDIVVGGVGTGGTITGVGEVLKAKKPEVKIIAVEPADSPVLSGGKPGPHKIQGIGAGFVPKVFNRDVVDEIIQVESDDAFAMAKKIAKEEGVLVGISSGAALWAALEVAKRPENEGKLIVVVLPDTGERYLSTPLFS

SEQ ID NO: 53073 - protein, 432 aa, Zea mays
MTKAWRPMLASATKCCAAEDAAVAPDGLARCRPQQSELSRRLASFRRLSSLANSPASAAGTDKDGGSVKQAGEMAGPLQLHSFGLGELRGVTHDFASSFLLGEGGFGAVYKGFVDAGMRPGLAAQPVAVKQLNAAGFQGHREWLAEVIFLGQFRHSHLVRLLGYCCEDEERLLVYEFMPRGSLENHLFRRISATLPWGTRLKVAIGAAKGLAFLHAASTPVIYRDFKASNILLDSDFTAKLSDFGLAKMGPEGEDTHVTTRVMGTHGYAAPEYVQTGHLNVKSDVYSFGVVLLELLTGRRAMEHVRGRSAHADQQLKLVDWTRPYLSGGSRRLRCIMDQRLAGHYSVKGARAVAQLAVQCTAQQPRDRPRMVAVVDALDKLQGLKDMAVTVGLWPATAPVAGRNAISAKIRAEVKGAAGAGSRRRSASSKLP

SEQ ID NO: 53074 - protein, 224 aa, Oryza sativa Japonica Group
MEESDAAAASAKAPNGEASGCCGRPVKVKDTLPGVLRSFVDGVCSQGGGGGGGEPLLRRIRAASCETAPRLREASRNSARDLLEWTRRGSGLRAILVISVGTITLIALTGLLIFMFFLLVATTNAVVVSVLMSLAAAGGFLAMFFACLVAVYIGVVSVAVFVISATVISAIVGVMIATGWLGFFWMIWFAARKSMDLTKHSIGVTNSAIQSYSASRHAKQKPID

SEQ ID NO: 53075 - protein, 705 aa, Arabidopsis thaliana
MAFHVACPITCRRICHCSLGFSRDLRGANAKHKFLKEVIRVEEFLKDPAVSSNVFIGGTVQVRVPKVVPAPQTVSILGVGDGAIGSGVDELAEEASAQKKRVALQRQAAVTVEAAEDYARRFESGVNDLTSNDHAGEELGHSGMNIMCRMCFLGEGEGSDRARRMLSCKDCGKKYHKNCLKSWAQHRDLFHWSSWSCPSCRVCEVCRRTGDPNKFMFCKRCDAAYHCYCQHPPHKNVSSGPYLCPKHTRCHSCDSTVPGNGLSVRLFVKGNYCPVCLKVYRDSESTPMVCCDICQRWVHCHCDGISDDKYMQFQVDGKLQYKCATCRGECYQVKDLQDAVQELWKKKDVVDKELIASLRAAADDEENGPVSGRSLKFSIKGLVEKSPKKSKEYGKHSSSKKHASKKGSHTKLEPEVHQEIGSERRRLGGVRIDNVGFQINEQSDVNSSVAGICSTHEPKIVKHKRVDDVMVTDEEKPSRIVRIKCSKPHDSDSEDTLRNAGEEKSVKAKKLVINLGARKINVSGSSKSNVVSHLSRDKDQSTLGGDKVDQTGEVRTLKISGRFGKTQSEGSKATFGSVTQFPAASTSEGNHVDDKTSISPALQKEARPLLKFKLRKPNSGDQTSSVTTQSEDEKLSSAKGQRSKRKRPSSLVDMASLKEDGEATTHSHQDNSRNDEMMDANWILKKLGKDSIGKRVEVHGSQNSW

SEQ ID NO: 53076 - protein, 476 aa, Magnetospirillum magnetotacticum MS-1
MALAALVGIILLPLPDGLQAAGLRMLAIMVFAVIIWMTEAVPYAVSAAVIVSLIALALGLGPALGDPTKLMGSSKALGMALSGFSNTAFALVAGAMFISAAMMITGLDKRIALVILSRLGARTGRVLAGVIFTGFALSFLVPSTTARVSCMVPIVMGIIVAFGVDKRSRFAAVLMIATAQADSLWNVGIKTAAAQNMIAVTFIEKQLHYTISWLEWFIAAAPFSAVMSVILYFVLMKLLPPEVDEIEGGKATIAAKLAELGPMSTGEKKLLSISLILLGFWTTEKVLHNFDTSTTTMVAITLMLVPRIGVMDWKDAQARIGWGTLILFGVGISLGQCLLDTGAAAWMAKYIVATFGMENFPALGIIAVLALFLIIVHLGFASATGLAAAMIPIIISVLQSIKTPGINVVGLTMIAQYVVSFGFILPVNAPQNMVVYCTETFESKDFIRTGIPITIIAYIMILVMSATYWRWLGLTG

SEQ ID NO: 53077 - protein, 318 aa, Vitis vinifera
MDSTVTKEVATELLPIIRVYKDGTVERLMASPIVPPFPEGDPQTGVLSKDISFSITPDSSISARLYLPKLPDQQSHKLPILVYFHGGGFCIESASSFLVHRYLNILVSQAKVVVVSVDYRLAPEHLLPIAYDDCWDALNWVASHSARGATDKEPWLLEYGDFERLFIGGDSSGGNIVHNMAIRGGVRISGAFLVDPYFWGSKPIGSEPKEGHEESLLSRLWKLVYPSSGLDDPLINPVGPGAPSLAGLGCSRMLVCVAEKDILRDRGVAYIDAVRTSGWEGDVDLFEAEGENHGHHIFYPETDKAKEMFQRLASFLNH

SEQ ID NO: 53078 - protein, 66 aa, Oryza sativa
FPLPVPKLAVLKIEVLEFTMSEKHAFGGQTCLPVWELNQGIRAVPFPVFRGPGSKSVRLLMRFDFL

SEQ ID NO: 53079 - protein, 411 aa, Magnetospirillum magnetotacticum MS-1
MNSQHDFHRIKRLPPYVFAEVNAMKARARAAGEDIIDFGMGNPDQPTPTHIVDKLVEAARNPRAHRYSMSRGIPGLRKALSAYYQRRFAVDIDPEAECIVTLGSKEGLANLANAITSPGDIVLVPNPSYPIHPYGFIIAGGSCRFVPVTPDAEFLKALDRAVRHSVPKPIALVLNYPSNPTALLADLDFYGQVVEFCRHHGIWILSDLAYSEIYFDVAPPPSILQIPGAKDIAVEFTSMSKTYNMPGWRIGFAAGNKTLINALARIKSYLDYGAFTPIQVAATAALNGPQDCVDEIRALYKSRRDALIEGLAAAGWDIPSPPATMFAWAPIPKPFAHLGSLEFSKLLMREAQVAVAPGIGFGEYGDSHVRIGLVENVQRTRQAVRNIKTFLGSTGQVLEASEKQRAAGTEP

SEQ ID NO: 53080 - protein, 465 aa, Oryza sativa Japonica Group
MAAGVTFNWIKTPLDIRRFHDFSSLSFRCRNTFGSIQPSWLTTDQEPSFSKVRVAADYSDSVPDSKYTRDRGYHPLEEVKERPKKKDLSLTDVETARTVVEANSKGLLVFPARVHNEPHGHVAWSDFQYIVDDYGDIFFQVPDSENILEDDAANNPVTVLIGMDGPIIGETSVVTSDFSDYMDVENFIDMPDENDSKIDTEITDILIEWGMPATMRAIHPIYFAKCLTKGAKSLSSGNKSKSLDLNLILQKGKKKVEIQVHEKAVHDKHREKMDSPSNGVSIVGYLRPAFIEEESYLRSLFHGECNGDGYSSDWRDDDKSRFDFTNVGSSTDSTIYKLEIMTVELFSIYGKQLMIDPQDFQDAEPDILANSASEIINRIKENDDQCAMALRSLCHRKKGLTVEEASLISIDSLGIDVRAFSGLEARTVRFSFNAQALSERSAEKKIRRMLFPRRKNVKPSTEDEC

SEQ ID NO: 53081 - protein, 594 aa, Schizosaccharomyces pombe 972h-
MTSFTESKKLDEIESPVPEIIVPSTTNGNGTIESYKEKSVGTSFLDFFRSYKLRPDNEFAEVHNSEDFLKPRHLQMIAIGSCIGTGLFVSTGKSLKNAGPGSLMINFIILSAMILALILSLGEMCCFLPNQSSITMYTGRLLNNNIGFAQSWLYFWIWLTVLPSEISAACEVVDFWTTQHLNPAIWVTIFLAYVVLVNAFGARSYGECEFVSSFLKVVIVIIFFFVAIIINCGAAPKGGYIGAHYWHHPGSFRNGFKGFCSVFISSAYSLSGTENIGTAAGNTSNPQRAIPSAVKKVFYRMGFFYIITIFLITLVVPYDNPDLGNVSPFIIAIKNGGIHVLPHITNAVILVSVLSVGNAAVFAASRNAMALVKQGWAPRFLGRVDQKGRPVISYLCSLAMACIAYVNAAPDGSVVFDWLMSVSGGGAFVIWGLSFIDHIRLRYAMKAQKIPDTVLPYKFPGSVYLSYYGVLINFLALCALVYISIFPVTHEKPSAYGFFVSFLGPSVFIAYLLISPIFVKPTFQSLKDVDLTTGRYDLVNSQMYVAESSTSELSEKDLTKPNLQSNDNKNSEDLESNTPPQKKSALQKVADFLC

SEQ ID NO: 53082 - protein, 206 aa, Oryza sativa Indica Group
MGRAKSKGPKFAAVKKIITKKTIQKYKEDVLNPKKKDNEKEKLGRNVPQVSSALFFSYNTALGPPYRVIVDTNFINFSIQNKLNASLTPMQLDLEKGMMDCLYAKCTPCITDCVMAELEKLGQKYRVALRIAKDPRFQRLACTHKGTYADDCIVERVTQHKCYIVATCDRDLKRRIRKVPGVPIMYITRHRYSIERLPEATIGGVL

SEQ ID NO: 53083 - protein, 454 aa, Pediococcus pentosaceus ATCC 25745
MEENGNNELARNLKSRHVQLIAIGGTIGTGLFLGAGSSIHLAGPSILLAYIVTGLVCFWLMRALGELLLSDLESTSFVTFVTKYLGKKVGFVTGWTYWVCWITIAMAEITATGMYVRYWFPSVPQWIPGFIILILLIGLNLITVEAFGETEFWFSIIKIIAIVALIAIGFIMVLLHSKTNVGHADLTNLIHFGGIFPQGLKGFILSFQMVLFAFVGIEMVGMTAAETRDPKSVIPKAINEIPVRIGIFYVGALFFLMAIYPWNEINPNGSPFVQVFKNIGIPGAGGIINFVVLTAAASACNSSLFTTGRMLFSLTYGSSNKLGKRLGTLSKSQVPKNAILLSSLVIAVAVILNILMPEGVFTLISSIATTCFLFIWGTIVLAHLKYKKGQKQAKKEFSMPFFPISNYIVLTFLSFVGVVLLLQKETAIALIGSLIWFGVMFTVAKIKGKGELMD

SEQ ID NO: 53084 - protein, 576 aa, Zea mays
KWHSQLKGQRFMSSIEKSSKLDNVCYDIRGPVLKEAKRLEEEGNKVLKLNIGNPAPFGFEAPDEILVDVIRNLPTAQGYCDSKGLYSARKAIMQHYQARGMRDVTVEDIYIGNGVSELIVQSMQALLNSGDEMLVPAPDYPLWTAAVSLSSGKAVHYLCDESSDWFPDLDDIRAKITPRTRGIVIINPNNPTGAVYSKELLMEIVEIARQHNLIIFADEIYDKILYDDAEHHSIAAMAPDVFTITFNGLSKTYRVAGFRQGWMVLSGPQKHAKGYIEGLEMLASMRLCANVPAQHAIQTALGGYQSISEFIVPGGRLYEQRNRAWELINEIPGVSCVKPKGALYMFPKIDAKRFNIHDDQKMVLDFLLQEKVLLVQGTAFNWPWPDHVRIVTLPRMDDLEMSITRFGRFLSDKVAMVAHALAAIKNRKFGGQVNAERIALLAMYHDASEVLTGDLPTPVKYFNSQIAQEYKAIEKIAQQKLVEMVPEELRDIFSELIDEHYYSADEKLIVKQADALCAYLKCLEELSAGNNEFMLAKSRLEKTLDARRSPEMDYFMQVFVPSFHLSLDEISQDSPL

SEQ ID NO: 53085 - protein, 433 aa, Zea mays
  misc_feature (310)..(310): Xaa can be any naturally occurring amino acid
  misc_feature (321)..(321): Xaa can be any naturally occurring amino acid
  misc_feature (410)..(410): Xaa can be any naturally occurring amino acid
MSVQEYLGKHLLSRKIEEALNAAVRAKAPDPAHFIAGHMGRADRAKAPDPALFIAGHMRRAAPAVITRVRERQILDGHGAPAVEVELHTNKAVHRASAASVGALEGAAADAAGASERRKFLARGVADAVRVINDKVSEALVGMDPQQQAQIDQAIMDLTRRATDFIQMEIDMILCEMQAELGANTMLAVSIAACKAGAAEKEVPLYKHIADLVGKSATTLPVPANTVINGGKHAGNGLPIQEIMILLVGAMNFEEAMQMGSETYHHLKDIILEKCGSDSCNIGDHGGISEGLDLVIAAIERAGYNGRIKXQIDVAATDFCXVAWDDLLMSDPERIKRAVSEYTCNALVLKANQVGTVTEAIEVVKQANDAHWGVMVSHRSGDTEDSFIADLAVGAAAGQIKASVPCRGEXTKYNQLLRIEEELGSEGVYAGEN

SEQ ID NO: 53086 - protein, 199 aa, Porphyra purpurea
MISGHNCLQVGQIAPDFSATAVYDQEFKTIKLSDFKNKYVILFFYPLDFTFVCPTEITAFSDKYSDFSELNTEILGVSVDSEYSHLAWLQTDRESGGLGDLEYPLVSDLKKEISIAYNVLNSGGVALRGLFIIDPKGIIQYSTVNNLEFGRSVEETLRVLQAIQYVQAHPDEVCPANWKPGDRTMNPDPIKSKNYFAAA

SEQ ID NO: 53087 - protein, 362 aa, Helicobacter pylori 26695
MPIDLNEHLKKKNSQRETPTPNTPNNGGRFIPPSNSFNSKKLSVLIVIVLLGVIAFLAKPFEVISSGEIGIKITAGKYEPTPLQPGIHFFVPIIQDILIVDTRIRNINFSRTEDMGVAGKNQGIFRNDAINVMDSRGLTVSIELTVQYRLNPQTTPQTIATYGLSWEQKIINPVVRDVVRSVVGRYPAEDLPIKRNEIAALINSGINKEVSKLPNTPVELSSIQLREIVLPAKIKEQIEKVQIARQESERVKYEVERSKQEAQKQAALAKGEADANRIKAQGVADAIVIEAKAKSQANLSISQSLSDKLLRLRQIEVQGQFNEALKTNNNAQIMLTPGGAVPNIWIDTKSKVKSSIAETKEP

SEQ ID NO: 53088 - protein, 684 aa, Schizophyllum commune
MSSPPRSSKRPVPDLSPAPSPSPAPAGPNASKGKIHVKLIQARGLNVPSPNSRPYVVVTYDQSEFVSRDPTDETDKEVRGVPTRNANGATTPVNPPPTSSSSALAALGKVSAAIDKATNGTKSNNTSPVSSLGSGKSDKSLFGRLSAHNPVWKHEVAFDVTSSKSQLTFNVYDRTQLNQGFLGMVQITPTLVHDHTVDQWYKLHANENEQVSGEIRVQITYEQYKNKRTLTPRDFEFLKLIGRGTFGKVLQVRKKDTKRIYAMKILSKREIVQKKEVAHTIGERKILQTSLECPFLVGLKFSFQTETDLYLVTDFKSGGELFWHLQRETRFTEERARFYIAELVLALEHLHKYNIVYRDLKPENILLDATGHVALCDFGLSKADLRPDELTTTFCGTTEYLAPEILLDEHGYSKIVDFWSLGVLLFEMCCGWSPFYAEDTQQMYKNICFGKIRFPRGVIGDEGKSFVKGLLTRNPKNRLGATRDAEELKEHPFFKSIDWHLLALKQVTPPFKPVIESDESTANFDTEFTNADISEIIGDEGESEIDEDDPSEAWVSQSLSESGGHMPLGPLGQEKTDPKSPTLSRNPSRGGGIEIKAKKQRKGATQGSPLTSSVQEKFKGFTYSGEGSVLNGSAMAGRRGAESGTEEDGPEPTTEDEIDDTGKSAGRYAKSRRRKGLEFTGLDD

SEQ ID NO: 53089 - protein, 402 aa, Physcomitrella patens subsp. patens
MEYYPAPGRNHLFVPGPTNVPEPILRAMNRSNEDHRSPAFPKLSKSVIDDVKEIFRTKTATSFIFPTTGTGAWESALTNTLSPGDKIISFRLGQFSLLWIDQMQRYNFDVDVVDCEWGAGIDLDVLKQKLVSDRSHSVKAVCVVHNETSTGVTNDIGAVRRVLDEANHPALLLVDGVSSIGAIDFRMDDWRVDVALTGSQKALSLPTGLGIVCASPKALEAAKRSKSTRVFFDWGDYLKFYEAGTYWPYTPSSQMLYGLRASLDMILNEEGLDNVIARHCRLAEATRQAVRAWGLTLCTKDPKWKSDTVTAVVVPSWINSNDIVKIAYKKYNLSLGVGLNKVAGKVFRIGHLGNVNELQLLGALAGVELCLMEVGYPVTLGSGVAAAQAHLAKKTPLIVSRI

SEQ ID NO: 53090 - protein, 499 aa, Schizophyllum commune
MGAQQSRRSGHGSRPCSTMKHDSSRSSSEASDSKGSRSLKTVSVASASAFAAIAAVTPSSSSSAEDISRLSERTRVEKREVQKPPPPRPKSYLEMPQTTVPCQYRTGKTLGSGTYAIVKEAIHIHTGKYYACKVINKKLMQGREHMVRNEIAVLKRISSGHKNIVTLHDYFETTHNLYLCFDLCTGGELFDRICAKGNYYEADAANLVRTILQAVKYIHDCGIVHRDLKPENLLFRTQAEDADIMIADFGLSRVMEEEKLNMLTEICGTPGYMAPEIFKKTGHSKPVDIWAMGVITYFLLAGYTPFDRDSQQLEMEAIIAGDYKFEPEEYWENVSSTAKDFVTQCLTIDPTNRPTAAEALQHKWLSDPTAHFVTDKEGPVDLLPHVKKAFNAKQLWKKAAFSIKALNRMTMLASSGLDKDAAELSENLKKYKEESAREIMEESTITHSHNMETESTTDLTLKEKEVRDAVKASDDISAHDHEDISSKLASVSLDEGQKK

SEQ ID NO: 53091 - protein, 549 aa, Colwellia psychrerythraea 34H
MSIEKVLVPDVGGDEVEIIEICFAVGDTLEADEGIVTVETDKASMDIPAPFAGELVSLTVKVGDKIKEGDIIAEMKATGAVSAPAEEAPVAAVVETPVAPVAAVVEAAPVAAAVATASQVIEIAVPDIGEDGEVDVIEVLVSVGDVIEEEDGLITLETDKATMDVPSTHAGTVKEVFISNGDKVKQGSLVIKLETAGGVAPVAAAPAVQAAPVAAAPIAAPAVVKSAPVPHHPQAGNVKKGTIYTSPSIRRLAREFGVDLTLVKGTGRKGRILKEDVQSYVKYELSRPKANAGSSVAAGEGGLQVVSAKAIDFSKFGEIETKALTRIQKISGPFLHRNWVTIPHVTQFDEADITNVEAFRKEQNVVCEKQKLGFKITPLVFILKAAADALRAFPTFNSSLSEDGESLILKKYIHIGVAVDTPNGLVVPVVRDVDQKGIHQLSRELLEISMKARDGKLKATDMQGGCFTISSLGGIGGTAFTPIVNAPEVAILGVSKSEIKPKWNGKDFEPKLMLPLSMSYDHRVIDGALAARFTVHLAGVMSDIRKLVL

SEQ ID NO: 53092 - protein, 551 aa, Schizophyllum commune
MSWKSLTRSKKSIPDMRSDTPTPANPNGGSGNDSPYRTGLLAIRVLWAEDVNLPDGKAVPPAVESALSSQAAKVASAVDPLSVSQQQQRLAKTKGHGYKDSVQRTQCWWLPYLVMEYEVNQVLITALGGDLEKPVFMYQANFDVSRNSELSLQCYLRTEEPTRGGDGIADDMGNDIFLGGLKFVPDFDNMGNEDQWYEFDAGKGKIKIGVSYKPNFGHHLSIDDFELITVIGKGSFGKVMQVRKRDTGRIYALKTIRKQHIVTRNEITHTLAERMVLTQVHSPFIVPLKFSFQSEQKLYLVLAFVNGGELFHHLQREQRFNEERARFYSAELLLALEHLHELDVVYRDLKPENILLDYTGHIALCDFGLCKLNMKGDEKTNTFCGTPEYLAPEILNGHGYSKTIDWWTLGVLLYEMMSGLPPFYDENTDTMYQKILNDPLVFGPEISAPAQSILSGLLNRDPTKRLGVNGAEEIKKHPFFESIDWTQLKEKKIHPPFKPSVASPVDVSCFDTVFTAEQPIDSVVENSNLSETVQAQFSGFSYNSSHIVSPA

SEQ ID NO: 53093 - protein, 570 aa, Escherichia coli K12
MSEKHPGPLVVEGKLTDAERMKHESNYLRGTIAEDLNDGLTGGFKGDNFLLIRFHGMYQQDDRDIRAERAEQKLEPRHAMLLRCRLPGGVITTKQWQAIDKFAGENTIYGSIRLTNRQTFQFHGILKKNVKPVHQMLHSVGLDALATANDMNRNVLCTSNPYESQLHAEAYEWAKKISEHLLPRTRAYAEIWLDQEKVATTDEEPILGQTYLPRKFKTTVVIPPQNDIDLHANDMNFVAIAENGKLVGFNLLVGGGLSIEHGNKKTYARTASEFGYLPLEHTLAVAEAVVTTQRDWGNRTDRKNAKTKYTLERVGVETFKAEVERRAGIKFEPIRPYEFTGRGDRIGWVKGIDDNWHLTLFIENGRILDYPARPLKTGLLEIAKIHKGDFRITANQNLIIAGVPESEKAKIEKIAKESGLMNAVTPQRENSMACVSFPTCPLAMAEAERFLPSFIDNIDNLMAKHGVSDEHIVMRVTGCPNGCGRAMLAEVGLVGKAPGRYNLHLGGNRIGTRIPRMYKENITEPEILASLDELIGRWAKEREAGEGFGDFTVRAGIIRPVLDPARDLWD

SEQ ID NO: 53094 - protein, 302 aa, Synechocystis sp. PCC 6803
MVAQQTRTDFDLAQYLQVKKGVVEAALDSSLAIARPEKIYEAMRYSLLAGGKRLRPILCITACELCGGDEALALPTACALEMIHTMSLIHDDLPSMDNDDFRRGKPTNHKVYGEDIAILAGDGLLAYAFEYVVTHTPQADPQALLQVIARLGRTVGAAGLVGGQVLDLESEGRTDITPETLTFIHTHKTGALLEASVLTGAILAGATGEQQQRLARYAQNIGLAFQVVDDILDITATQEELGKTAGKDVKAQKATYPSLLGLEASRAQAQSLIDQAIVALEPFGPSAEPLQAIAEYIVARKY

SEQ ID NO: 53095 - protein, 507 aa, Mycoplasma genitalium
MHKKVLLAILDGYGISNAIYGNAVQNANTPMLDELINSYPCVLLDASGEAVGLPMGQIGNSEVGHLNIGAGRVVYTGLSLINQHIKDRSFFANKAFLKTIEHVEKNHSKIHLIGLFSNGGVHSHNEHLLALIELFSKHAKVVLHLFGDGRDVAPCSLKQDLEKLMIFLKNYPNVVIGTIGGRYYGMDRDQRWDREMIAYKALLGVSKNKFNDPIGYIETQYQNQITDEFIYPAINANLNSDQFALNNNDGVISFNFRPDRARQMSHLIFNSNYYNYQPELKRKENLFFVTMMNYEGIVPSEFAFPPQTIKNSLGEVIANNNLKQLRIAETEKYAHVTFFFDGGFEVNLSNETKTLIPSLKVATYDLAPEMSCKAITDALLEKLNNFDFTVLNFANPDMVGHTGNYQACIKALEALDVQIKRIVDFCKANQITMFLTADHGNAEVMIDNNNNPVTKHTINPVPFVCTDKNVNFNQTGILANIAPTILEYLNLSKPKEMTAKSLLKNNN

SEQ ID NO: 53096 - protein, 227 aa, Oryza sativa
  misc_feature (44)..(44): Xaa can be any naturally occurring amino acid
MDSEHWISRLAAAKRFYAAQLGHADRAGMEEVDMDEEVRPEFAXCPYCYEDHDVVSLCAHLEEEHPFEPHAAPCPICSDKIAKDMLNHITVQHGYLFKNRRRLRRFVIPGSQALSLLSRDLREAHLQVLLGGGGHRSNNSSNTTNISADPLLSSFGLSFPTSDTEETSKPPISIPDDASVVKETPAQPWDSSIDSSLTREEREQKRKQASVRATFVQDLLLTTLFGD

SEQ ID NO: 53097 - protein, 572 aa, Staphylococcus aureus subsp. aureus Mu50
MSKLIKGIAASDGVAIAKAYLLVEPDLTFDKNEKVTDVEGEVAKFNSAIEASKVELTKIRNNAEVQLGADKAAIFDAHLLVLDDPELIQPIQDKIKNENANAATALTDVTTQFVTIFESMDNEYMKERAADIRDVSKRVLSHILGVELPNPSMIDESVVIVGNDLTPSDTAQLNKEFVQGFATNIGGRTSHSAIMSRSLEIPAIVGTKSITQEVKQGDIIIVDGLNGDVIVNPTEDELIAYQDKRECYFADKKELQKLRDADTVTVDGVHAELAANIGTPNDLPGVIENGAQGIGLYRTEFLYMGRDQMPTEEEQFEAYKEVLEAMDGKRVVVRTLDIGGDKELSYLNLPEEMNPFLGYRAIRLCLAQQDIFRPQLRALLRASVYGKLNIMFPMVATINEFREAKAILLEEKENLKNEGHDISDDIELGIMVEIPATAALADVFAKEVDFFSIGTNDLIQYTLAADRMSERVSYLYQPYNPSILRLVKQVIEASHKEGKWTGMCGEMAGDETAIPLLLGLGLDEFSMSATSILKARRQINGLSKNEMTELANRAVDCATQEEVIELVNNYVK

SEQ ID NO: 53098 - protein, 278 aa, Pseudomonas fluorescens
MHNYVIIDAFASVPLEGNPVAVFFDADDLPPAQMQRIAREMNLSESTFVLKPRNGGDALIRIFTPVNELPFAGHPLLGTAIALGAHTDNHRLYLETQMGTIAFELERQNGSVIAASMDQPIPTWTALGRDAELLKALGISDSTFPIEIYHNGPRHVFVGLPSIDALSALHPDHRALSNFHDMAINCFAGAGRRWRSRMFSPAYGVVEDAATGSAAGPLAIHLARHGQIEFGQPVEILQGVEIGRPSLMFAKAEGRAEQLTRVEVSGNGVTFGRGTIVL

SEQ ID NO: 53099 - protein, 455 aa, Salmonella enterica subsp. arizonae serovar 62:z4,z23:--
MSFDSLGLNPDILRAIAEQGYREPTPIQQQAIPAVLEGRDLMASAQTGTGKTAGFTLPLLQHLITHQPHAKGRRPVRALILTPTRELAAQIGENVRDYSKYLNIRSLVVFGGVSINPQMMKLRGGVDVLVATPGRLLDLEHQNAVKLDQIEILVLDEADRMLDMGFIHDIRRVLAKLPPKRQNLLFSATFSDDIKALAEKLLHNPLEIEVARRNTASEQVTQHVHFVDKKRKRELLSLLIGQGNWQQVLVFTRTKHGANHLAEQLNKDGIRSAAIHGNKSQGARTRALADFKSGDLRVLVATDIAARGLDIEELPHVVNYELPNVPEDYVHRIGRTGRAAATGEALSLVCIDEHKLLRDIEKLLKKEIPRITTPGYEPDPSIKAEPIQNGRQQRGGGGGGRGRGQSQGGAGRSQQPRRQDSGAPKAKSKPRAGEGKPAGDKARPPRRPRRITPAQ

SEQ ID NO: 53100 - protein, 424 aa, Staphylococcus aureus subsp. aureus COL
MEITMPKLGESVHEGTIEQWLVSVGDHIDEYEPLCEVITDKVTAEVPSTISGTITEILVEAGQTVAIDTIICKIETADEKTNETTEEIQAKVDEHTQKSTKKASATVEQTSTAKQNQPRNNGRFSPVVFKLASEHDIDLSQVVGSGFEGRVTKKDIMSVIENGGTTAQSDKQVQTKSTSVDTSSNQSSEDNSENSTIPVNGVRKAIAQNMVNSVTEIPHAWMMIEVDATNLVKTRNHYKNSFKNKEGYNLTFFAFFVKAVADALKAYPLLNSSWQGNEIVLHKDINISIAVADENKLYVPVIKHADEKSIKGIAREINTLATKARNKQLTAEDMQGGTFTVNNTGTFGSVSSMGIINHPQAAILQVESIVKKPVVINDMIAIRNMVNLCISIDHRILDGLQTGKFMNHIKQRIEQYTLENTNIY

SEQ ID NO: 53101 - protein, 89 aa, Rubrobacter xylanophilus DSM 9941
MAKTHRVTFKKSGVTIEVAEDEYILEKAEEAGLDLPYDCRSGTCTTCMQRCLEGEVDQDLAFAISEEELEEGYRLICIGSPLSDVVLDA

SEQ ID NO: 53102 - protein, 226 aa, Spiroplasma citri
MKKYLVAPSVLSANYLILQEELATIKEAGAQWIHFDVMDGDFVPNLTFGPKILADITSYSDLYLDCHLMVKIKNSSVENYLLPFIKAGASAITLHYEALTPPQLTEFLNLRIKLNIKIGLAIKPLTPVKVIFPYLKHLDLVLVMTVEPGFGGQTFISAAATKIKALRDYLDQNNGKTLIEVDGGINAETATLCKQYGVDVLVAGSYLFGHTDLATRLKGLLANENK

SEQ ID NO: 53103 - protein, 469 aa, Oryza sativa
MGVVGALLGPEAEALVRLRAAAWRLRREVAAATDDDEHWAFAYSMLHRVSRSFAIVIQQLGPDLRNAVCVFYLVLRALDTVEDDTSIPTEIKVPILQEFHRHIYNRDWHFSCGTKDCKILMDKFHYVLTAFLELGSGYQEAIEEITRRMGAGMAKFICKELLSVILACAPGHLHMNTSLLAKAWLQPNHLVCSIPKPTAMQIAFVSYCIYVGLCVVETVDDYDEYCHYVAGLVGIGLSRLFHAAGLEDLAPESLSNSMGLFLQKVNITRDYLEDINEIPKSRMFWPREIWSKYVDKLEDLKYENNSVKAVKCLNEMVTNGLIHTEDCLRYMSALKDITILRFCAIPQSSLLSSTETATYFICKQREFIFQHSCTLIGLTARIINETNSMADVYTAFYEFSSLLAEKIDDNDPNASLTRKRVNAIKETCKSSGLLKIRGYDLDRPKRNPAMIMMLLLLLVAIFLGALYRR

SEQ ID NO: 53104 - protein, 307 aa, Alkaliphilus metalliredigens QYMF
MKVRKAVIPAAGLGTRFLPATKALPKEMLPIVDKPTLQYIIEEAVDSGIEEILIITGRNKSSIENHFDKSIELELELEKKGKDELLKQVRAISDMVNIHYIRQKEPKGLGHAIHCAKSFIGNEPFAVMLGDDIVENDKPCLEQMMEMYDEYKTTILGVQEVPKESVNKYGIVDGMHIEGGIYKVKDLVEKPSPQEAPSNIAILGRYIINPEIFDILENTKPGKGGEIQLTDALKELAHREAMYAYVFEGRRHDVGDKQGFLEATVEFALKREDLREGFLNYLEDVVKKERESKALEEVAVTTEQKSS

SEQ ID NO: 53105 - protein, 293 aa, Staphylococcus aureus subsp. aureus COL
MTNLPMNKLIDEVNNELSVAINKSVMDTQLEESMLYSLNAGGKRIRPVLLLLTLDSLNTEYELGMKSAIALEMIHTYSLIHDDLPAMDNDDYRRGKLTNHKVYGEWTAILAGDALLTKAFELISSDDRLTDEVKIKVLQRLSIASGHVGMVGGQMLDMQSEGQPIDLETLEMIHKTKTGALLTFAVMSAADIANVDDTTKEHLESYSYHLGMMFQIKDDLLDCYGDEAKLGKKVGSDLENNKSTYVSLLGKDGAEDKLTYHRDAAVDELTQIDEQFNTKHLLEIVDLFYSRDH

SEQ ID NO: 53106 - protein, 303 aa, Pediococcus pentosaceus ATCC 25745
MSNKVVVLGSLNVDTILQVGRFPEPGETLALKDKQMAGGGKGANQAIAAARSGAETSFIGKVGTDANGQFMLKQLLDSGVSTEYVATSKVADTGQAFVMLENTGENRILIYGGSNAELNEDDVNKAAEKIQQADFIVAQLETPLETTKYAFEIAKQAGIKTILNPAPAVKNLPKELIQLTDVITPNETEAEILTGVTVVDDASMKEAAQRLHKMGVQTVIITLGSKGVYYDDGDVSGIVPAFKVHAIDTTAAGDTFLGSFSSELKPDLSNLKEAIMYGNKASSLAVQKMGAQPSIPTRKEVLK

SEQ ID NO: 53107 - protein, 233 aa, Zea mays
MSRRGDWVYENNGGTCVAIAGADYCVVAADTRLSVGYSILTRDHSKICDLIDTTVYSLHFKLADKCVLASSGFQGDIKALQKNLAARELLYQHQHNKRMSCPAMAQLLSNTLYYKRFFPYYAFNVLGGLDSEGKGCVFTYDAVGSYERTGYSAQGTGSTLIMPVLDNQLKSPSPLLLPVRDAVTPLSESEAIDLVKDVFASATERDIYTGDKLEIVVINKAGTMREYIDLRKD

SEQ ID NO: 53108 - protein, 84 aa, Porphyra purpurea
MQDNEIFEKVQDIVAEQLGIEKTIVTREANFSSDLGADSLDTVELVMAIEEKFAIEIPDEDAEKITNLSEVVDFIKSKLNTISV

SEQ ID NO: 53109 - protein, 427 aa, Oryza sativa Japonica Group
MLPQQQQQQKQQAAALMPPSMYAMPPPPPLHHHHHPLLAAAPPQQQIEPILTGNLPPGFDTSTCRSVYVGNVHVQVTEALLREVFQSTGLVEGCKLIRKEKSSYGFVDYYDRRSAALSILTLNGKQIFGQLIRVNWAYASGQREDTTDHFNIFVGDLSPEVTDSALFAFFSGYSSCSDARVMWDQKTGRSRGYGFVSFRNQQDAQSAINDLNGQWLGSRQIRCNWATKGASNGEQQTSDSKNVADLTNNLTEDGKEKANEDAPENNPQYRTVYVGNLAHEVTQDVLHRLFHALGAGAIEEVRIQLGKGFGFVRYSNHAEAALAIQMGNGRILGGKPIKCSWGNKPTPPGTTSAPLPPPAAPSVTAADLLEYQRSLALSKMVSSQALMQAQAQQHLKQAMGMGAGVSQAMYDASFPNVGPSQQQLMYY

SEQ ID NO: 53110 - protein, 1220 aa, Ustilago maydis 521
MSSSAETSPPRAGSYILISSSTAALDAPAPAADESARVFGSRPRLFFFLPLLAALDVATTLTLGILVLNQLAKHDEPAAHILGGPLSHDPVMTSSLPGRTDPRLDDAAWERRKIVLLVIVFSIARAFSYGIVGFSIRIRQLGVTVAAISILSTLFYVSVANLLFQARPKPGIVDKRSNSWSGVLASDAWRWPDAFRHFEPTMPILVGVQMAFTLFEWILYIAIVGVKIPPGGNPVEAKRWARDLADDPQYRRGADMHSLYLSDDGHDQDITEEVRQPLEHLDAQDGGELQEVRTQLSSPISNLSCRGKSDGSDQPLLGASSSTPRGYGSTLADPKTPQGPGSVRSVRSPVALQQHGMSRSSSALSGLYSRSPGTAELGPADRYEEVLADDDDDEDEQDGEGDEDAEGSDPDDIIDITPNRAVARKEARLRLARAALPARRASGGTLSTLNLFGGGGGSTNGSSGDAVSTRTGGGGTGGAGIFSDEAGSPLGRNAREGDVSRPALLSVATSDEASRGESLAADPSIQSSNSMTLPSSSSTRTASTRASSFKDRKFKLPKWIKRGNSRSSCERQACPPTTKSRMSAQLSRADFVLHLARASLSPPIDRECEITNRESRFVISTGLARIQNPYKLTSSTVTALFKALRSAARSVKITPLALFSSVRVLRASRALGPSTTTTFTRAISVGVATIDKLRSSTTSACARLPIATASVAANRLQQTSTHLSSFSHFSTSSAVKMPPVPKPTSTHYDMVVIGGGSGAMGVSRRAAAYGKKVCVIEEDGRLGGTCVNVGCVPKKLMWHAADMAEHLKEAPEYGFGDVVNKPKVPEFAWKYFAEKRDAYVRRLNGIYDRNLDKDGVEYLSGHGKLTGKNEVEVTMRGQDGSFNAGTYKITGDRIVIATGGRPVIPSDDKIPGASLGIDSDGFFELKEQPKRVAVVGAGYIAVELAGVFNTLGSQTHLLIRHDTFLRPFDPIISETLQDYMSRTGLNVHKQTNITKVEGSKGGPLTIHTDKGDSIEVDCLLWAIGRRPNTDNLGLETVGVQLDKGGNIVVDKYQETNVRNVFAIGDIQGKALLTPVAIAAGRKLSNRLYSNHASLKDDHMDYDNIPTVIFSHPTSGTVGLSEAQAVQKFGRENVSIHTSKFTSMYYGMLDHKAPSAFKMVVAPGDKVVGLHIVGLGADEMLQGFAVAIKMGATVKDFQDTCAIHPTSAEEVVTMIPTTKHA

SEQ ID NO: 53111 - protein, 484 aa, Hordeum vulgare subsp. vulgare
GKTLGIGSFGKVKIAEHIITGHKVAIKILNRRKIKSMEMEEKVKREIKILRLFMHPHIIRLYEVIDTPADIYVVMEYVKSGELFDYIVEKGRLQEEEARRFFQQIISGVEYCHRNMVVHRDLKPENLLLDSKCNVKIADFGLSNVMRDGHFLKTSCGRPNYAAPEVISGKLYAGPEVDVWSCGVILYALLCGTLPFDDENIPNLFKKIKGGIYTLPSHLSPLARDLIPRMLVVDPMKRITIREIREHSWFKARLPRYLAVPPPDTAQQVKKLDDETLNDVIKMGFDKNQLTESLQKRLQNEATVAYYLLLDNKLRTTSGYLGAEYQESMDSSFSQISPETPSSASEARQYGSPGFGLRQHFAAERKWALGLQSRAHPREIITEVLKALQELNVCWKKIGHYNMKCRWSPGFFENMMHNNNGFGVESAIIEADGLGDKSTHIVKFEIQLYKTRGDKYLLDLQRVSGPQLLFLDLCSAFLTQLRVL

SEQ ID NO: 53112 - protein, 249 aa, Vibrio campbellii AND4
MDILSDQEMLRYNRQIILRQFDFEGQEALKRASILMLGAGGLGCASSQYLATAGVGKITLIDDDIVELSNLQRQVLHHDADIGRKKVESAAEALHELNPYISIDTIAKRLNDTELKTLIEQHTIVVDASDNVDTRNQLNRLCFESKTPLISGAAIRMEGQVSVFTYDEPSQPCYQCLSTLFGSGALSCVEAGVMAPVVGIIGAVQAMEAIKVIANFGQPKQGKILILDALCMSWREMNLMKMPACPVCG

SEQ ID NO: 53113 - protein, 475 aa, Ostreococcus tauri
MGGDAGTRSATTTRATVRILGDAASAVDVREAYAFGVELGRGQFGEVREVVDTSTGRALACKSISKRGLKSESSREMVRNEVVELVSVHEDATHVHLIMEKLDGPEWFDAITEQFDEAPYSEAEAAAQFRNVARTVEYLHAMDVMHRDLKPENFVLKSKEKDSPICAIDFGLSTFFLPDQEFTELVGSPYYVAPEVMGYKYSNEADVWSCGVILYILLSGVPPFWGSSEKQIFDEIKRYKTGATSLDFASEPWPSVSDAAKELVQGMLTVNRKDRMTIEDVLSHPWLADPGVAPKTALDNIVLQRFKNFAGMDKFKRFGLHAMARSMPEEEVIGLGVMFKELDKDKSGKITIVELRQGLKLQSAEAAAQLEEVVASVDLDGSGDLDYEEFIVATIARSKRESRAAVQRAFDFFDIDGDGSITADEFQRALESLSPVERTNLGDVNELLAAADTNGDGVIDFDEFMAAMSSDTDAR

SEQ ID NO: 53114 - protein, 556 aa, Psychrobacter arcticus 273-4
MSQQYTIADYLFDRIAEAGASEVFGVPGDFNLTFLDNIIASDKLRWVGNTNELNAGYAADGYARERGFAAMVTTFGVGELSAINATAGSFAEYAPVLHIVGAPSTALQDSKRRIHHSLGDGVFNHFIKMVEPVTVARAQITPENAASEIDRVIRLILKKHRPGYLMLSPDVARQPIYPPTTKLVDSQEDITSQAALADFKQALIAFLPNKTTTLMADLMVHRLGLQNQLKALIADTDIPYTTLSWGKTLLDENSDRWAGTYAGVASRPVVKDAVENCECLIKIGVQYTDTTTAGFSQDIDENVVVDLHYERASIAGKNFAPIALKDALKTLHEVMTSDINIVPKQFYKEVKPHEQHGKDNEAIRQDDLWHIIADHLDHNNLVFAEQGTAYFGISDVRLPEGVTCYGQPMWGSIGYTLPASLGAAIASPSKRSVLLIGDGSALLTIQEIAVMIQERINPVIVLINNDGYTVERAIHGENQRYNDIPKCDWQAMPKAFGATEENSLMLKVATAGELKASLEKAAATTDKLVMLEVIAAKHDIPPLLADISAALKPKAD

SEQ ID NO: 53115 - protein, 429 aa, Solanum lycopersicum
MENGTKGKLTVSSSLQIEQPLPPSKLWKIIVVASIAAGVQFGWALQLSLLTPYVQLLGIPHRFASFIWLCGPISGMIVQPVVGYYSDNCSSRFGRRRPFIAAGAALVTIAVFLIGFAADLGHASGDPLGKGSKPRAIAVFVVGFWILDVANNMLQGPCRALLADLSGGKSGKMRTANAFFSFFKAVGNILGYAAGSYSRLFKVFPFSKTKACDMYRANLKSCFFIAIFLLLSLTTLALTLVRENELPEKEELEIDEKLSGAGKSKVPFFGEIFGALKDLPRPMWILLLVTCLNWIAWFPFFLYDTDWMAKEVFGGQVGDAKLYDLGVRAGALGLLLQSVVLGFMSLGVEFLGKKIGGAKRLWGILNFVLAICLAMTILVTKMAEKSRGHDAAGTLMGPTPGVKIGALLLFAALGIPLAVTFSIPFALAS

SEQ ID NO: 53116 - protein, 423 aa, Oryza sativa Indica Group
MAAAAALRRSLAAGPAPALLLRRQLLMRFLSTQTQSQTQTPADLATLKNSIRSAAHTPEALADLFISGLSHPAFLADRPIFTLSVHRLASAGRRDLVASILSSSLTSLPAPHPSEGFLIRLISLYSAAGMPDHSLSTFRIVTPPSDRALSALLSAYHDNRLYDRAIQAFRTLPAELGIKPSVVSHNVLLKSFVASGDLASARALFDEMPSKADVEPDIVSCNEILKGYLNAADYAAFDQFLKDNTTAAGGKRRLKPNVSTYNLRMASLCSKGRSFEAAELLDAMEAKGVPPNRGSFNTVIQGLCKEGEVGAAVAIFKRMPEVPRPNGKGVLPNSETYIMLLEGLVNKGVFAPALEVFKECLQNKWAPPFQAVQGLIKGLLKSRKAKHAKEVAMAMRKVVKGDAKEEWKKFEAEFSFEPTDKKA

SEQ ID NO: 53117 - protein, 430 aa, Staphylococcus aureus subsp. aureus Mu50
MAFEFRLPDIGEGIHEGEIVKWFVKAGDTIEEDDVLAEVQNDKSVVEIPSPVSGTVEEVMVEEGTVAVVGDVIVKIDAPDAEDMQFKGHDDDSSSKEEPAKEEAPAEQAPVATQTEEVDENRTVKAMPSVRKYAREKGVNIKAVSGSGKNGRITKEDVDAYLNGGAPTASNESAASATSEEVAETPAAPAAVSLEGDFPETTEKIPAMRRAIAKAMVNSKHTAPHVTLMDEIDVQALWDHRKKFKEIAAEQGTKLTFLPYVVKALVSALKKYPALNTSFNEEAGEIVHKHYWNIGIAADTDRGLLVPVVKHADRKSIFQISDEINELAVKARDGKLTADEMKGATCTISNIGSAGGQWFTPVINHPEVAILGIGRIAQKPIVKDGEIVAAPVLALSLSFDHRQIDGATGQNAMNHIKRLLNNPELLLMEG

SEQ ID NO: 53118 - protein, 250 aa, Leptospira interrogans serovar Lai str. 56601
MGMNKVIFNIPNILTMLRVAAVPFFVWFLFQKELEYHIAALILFSVASLTDLIDGYLARKWNQETEFGKFLDPLADKIIVTGCFITFIFLQEQIEFWMVCLIIGRDMLITSLRYLAIRQGQSIRTTMLGKVKTVFQMGAIVLILVFFILISSKKRILINQAYATGKANGLTVFEFATNNAIQFFRNLDQNNGLGDVVFGLGTFVPYWGMLVTTTITVISGIRYLVSNSKVLYPSNLKGMFQKNGTKSSRS

SEQ ID NO: 53119 - protein, 318 aa, Vitis vinifera
  misc_feature (53)..(53): Xaa can be any naturally occurring amino acid
MDAIHVKVAAQTAPTFKDYENVQIHQLHRHFRNTEGLSLKICRPRFKLKRGPXDYSMNDLATNHDGIRTVRADNRCDFSGSSDLCICVVTWNMNGQVSYKDIEQLVGSDREFDLLVVGLQEAPRNNISQLLQAALVETHIRKLTGMNLFDFAAHAGNVEDRNSQYRHISRSLFSKNQNPYARPVQVTVWLGDLNYRVQGIDTHPARNLVQKNLHRLLTRKDQLLQEAERGQIFSGYCEGTLAFKPTYKYNIGSSNYDTSYKVRVPSWTDRILFKIEDSGKISATLHSYQSIDGIHSSDHKPVKAHLCLQAIKQSPLMP

SEQ ID NO: 53120 - protein, 468 aa, Staphylococcus aureus subsp. aureus Mu50
MVVGDFPIETDTIVIGAGPGGYVAAIRAAQLGQKVTIVEKGNLGGVCLNVGCIPSKALLHASHRFVEAQHSENLGVIAESVSLNFQKVQEFKSSVVNKLTGGVEGLLKGNKVNIVKGEAYFVDNNSLRVMDEKSAQTYNFKNAIIATGSRPIEIPNFKFGKRVIDSTGALNLQEVPGKLVVVGGGYIGSELGTAFANFGSEVTILEGAKDILGGFEKQMTQPVKKGMKEKGVEIVTEAMAKSAEETDNGVKVTYEAKGEEKTIEADYVLVTVGRRPNTDELGLEELGVKFADRGLLEVDKQSRTSISNIYAIGDIVPGLPLAHKASYEAKVAAEAIDGQAAEVDYIGMPAVCFTEPELATVGYSEAQAKEEGLAIKASKFPYAANGRALSLDDTNGFVKLITLKEDDTLIGAQVVGTGASDIISELGLAIEAGMNAEDIALTIHAHPTLGEMTMEAAEKAIGYPIHTM

SEQ ID NO: 53121 - protein, 715 aa, Oryza sativa Japonica Group
METCSCWPSSSSVQFQLRLLVVALFLCLHGRALHATDTLTVSRPLTGDQKLVSERGKFALGFFQPKAGGSTGKWYVGIWYNKISVQTVVWVVNREKPVSDPSSSSLSILDDGNIILSHSNSTVWSTNSTNTGSSPMVAVLLDTGNLVIRQESNASSVLWQSFDDITDTWLPDDRVLSRHAIGVSGQTQSLVWVESAQAWVLYFSQPKANCGVYGLCGVNSKCSGSALSSCSCLKGFSIRDPNSWNLGDQTAGCRRNVMLQCGSKSSAGGQQDRFYTIGSVKLPDKSQSIEATSIHSCKLACLSNCSCTAYSYNGTCSLWHSELMNLQDSTDGTMDSIYIRLAASELPNSRTKKWWIIGIIAGGFATLGLVVIVFYSLHGRRRISSMNHTDGSLITFKYSDLQILTKNFSERLGVGSFGSVFKGALPDTTAMAVKKLEGVRQGEKQFRAEVSTIGTIHHINLIQLLGFCSEGAKRLLVYEYMPNGSLDHHLFGSTGVSLSWSTRYQIAAGIAKGLAYLHEKCRDCIIHCDIKPQNILLDSSFTPKVADFGMAKLLGRDFSRVLTSMRGTIGYLAPEWISGEAITTKADVFSYGMMLFEIISGKRNGMHGGSFFPVLVARELVEGELHKLFGSESSDDMNLGELDRACKVACWCVQDSESSRPTMGEIVQILEGLVDVEMPPVPRYLQVLGQDSSNFYLSRKSFSGGEDCSVWLEAV

SEQ ID NO: 53122 - protein, 266 aa, Triticum aestivum
RGRGRGLDKAKEQIGNSTKRNQTQSREPEEERSHSGGGFRSFLKETVRDAFESHSRHGGEDQDEQPTGDGLTKNRSLPLSTLIEMLKEQTGKDDIEEGSIRLTLFNVFGDDASPKIKKFMKVMLDKFHEGGSGEQGGVMGMVGSLAHQFLKAKLEGTEEETFKPAIEQDMGSAEEAYAGTKSWAPNNGILISGCQTSQTSADATIPGGTSFGAMSNAIQAILASDDGKITNKDLVMKARAALSKQGYTQQPGLYCSDEHVHVAFIC

SEQ ID NO: 53123 - protein, 115 aa, Nicotiana attenuata
MGVPSGLILCVLIGAFFISMATAGDSGAYDWVMPARSGRGCNGSIGECMAEEDEFELDSESNRRILATKKYISYGALQKNSVPCSRRGASYYNCKPGAQANPYSRGCSAITRCRS

SEQ ID NO: 53124 - protein, 232 aa, Glycine max
MARIKPQALLQQSKRKKGPSRISAVTVIFYFLILALVGFFLFASYRHWSSRSRLQSEDHLSVSEGENTFVDSKKSELPGYAVLNTSKGSIIIELYKESAPEVVDEFIDLCQKGHFKGMLFHKVIKHYVIQAGDNQGSGATEDWNLRGKQHTITSMKHEAFMLGTSKGKHNNKGFDLFITTAPIPDLNEKIIVFGQVIKGEDVVQEIEEVDTDEHYKPKVSIGILDVTLKQKV

SEQ ID NO: 53125 - protein, 480 aa, Kineococcus radiotolerans SRS30216
MTTAPQTAQSGSPADGSGPEQPTIFVMYGATGDLSRRLVSPAFFELARLGRLPRQWRLIGCGRGEKTHEEFRDFIREALEEFGPQPADGPWDEFAANLLFAGGGFTEADSGELPGVLAQAREALGGEAELVHYLAIPPGAFLDTTKGFEAHGLVEGSRVVYEKPYGTSLASFEELDAEVQRVFDESQVFRIDHFLAFEAQQDVMHARFANPWLASIWNREHVAQVQVDVAETLDVAQRASFYDATGAFLDMIVTHLFQMAATVAMEPPADLGPGALQAARDAALQDFRELDPAEVVLGQFEGYTDIDGVPDDSTTDTLAAARVWIDNDRWRGVPFLLRSGKRMTADEQRVTLVLRTPEDGPYAGSATAPSTISFSLLEGGAVDVALTVREPGVAGGTTQGTATLPLAGLGEPALPYVHLIEHVLTGDRSLFTGVEGLRAAWTCIERFSNDRPAVLPYAPGTWGPEAADALAEPGQWFLRS

SEQ ID NO: 53126 - protein, 246 aa, Zea mays
  misc_feature (231)..(231): Xaa can be any naturally occurring amino acid
MMFCRNVCVRRKKKKNPGSVPVYLNVYDLTPMNVYGYWLGIGIYHSGLEVHGVEYGYGAHEHSSTGIFKVEPKKCPGFTFRKSILVGETEMKAKEIGSFMEELADEYQGSKYHLITRNCNHFCNDVCLKLTQKSIPSWVNRLARLGFLCNCVLPASLNEMKVKQVGKDGKLLEVGESKKNKKKKKQKKARSRSGPLASSSDSRLDNNKPSHARSISTGNPPCSASFCPLKXTKEIQFPSVASGAQD

SEQ ID NO: 53127 - protein, 187 aa, Pseudomonas syringae pv. tomato str. DC3000
MNKKQRDEISKLLSYVLRHAPESMGLTLDRDGWCEVDELVGKANANGHSFDRQALEEVVETNEKKRFTLSEDGQRIRAAQGHSTEQVQVQHIEKEPPAWLYHGTASRFMASIETQGLIAGSRHHVHLTEDPETALSVGKRYGQPVLLAVDAKGMFEAGVQFFQADNGVWLVEAVPIEWLTKVADTVS

SEQ ID NO: 53128 - protein, 505 aa, Aspergillus fumigatus
MIESLISVAFYISTAVTLFLFLLPSRYDPRRFDREQKDASDAPKTTTQILVLGDIGRSPRMQYHAISIARGGGQVDIIGYNGTAQSGYRIANEPMTDALYNTESEVHPDISSNPRISIIALPPHPSFLQTSNKLLFLLFGPLKVAFQIVCLWWALAYRTEPAQWLLVQVRTLPAQIDSQVSFLPAKFGPMQNPPSIPTLAIASTASFLRHSKLIIDWHNFGYTILALKLGDRHPLVRFSKWYEKSFCRYATAHFCVTEAMASVLKNHFCLTAPILPLHDRPASHFQPIFDQSERKSFLESLPETTSVKDLLRAGSLRIIVSSTSWTADEDFSLLIDALCRYSNLASTSKPWLPAILAIITGKGPQKEMYLKQISKLQEAGKLSKVTIRTTWLTTDDYARLLASASLGISLHTSSSGVDLPMKVVDMFGAGLPVLGWDRFQAWPELVTEGVNGMGFGSSGELLDHLVDLFENPSKLEKIRAGARKESNRRWNDEWDPIAGRLLGLT

SEQ ID NO: 53129 - protein, 241 aa, Triticum aestivum
WNEKNLFTGCVDVPLTPKGVNEAIEAGKRICNIPVDVIYTSSLIRAQMTAMLAMMQHRRKKVPIIVHKESERAHQWSQVYSEETKKQSIPVITAWQLNERMYGELQGLNKQETADLFGKEQVHEWRRSYDIPPPNGESLEMCAERAVSYFKEQIIPQLVSGKHVMIAAHGNSLRSIIMHLDKLTSQEVISLELSTGIPMLYIFKEGKFIRRGSPAGPSEAGVYAYTKSLAKYRQKLDGMDQ

SEQ ID NO: 53130 - protein, 502 aa, Debaryomyces hansenii CBS767
MSLPLEYNVTLPDGNKFSQPSGLFINNEFVKSKSGKTIESINPSTGEVNGSVYAADEEDVDSAVKHARNAFHAVWRKTTGVARGDLLNKFAQVLQEQRDLIGAIEAWDSGKTKEQNAVYDIDECINCFKYFAGWADKIQGKVIQNDPKKLAYTVHEPFGVCAQIIPWNYPLAMAAWKLAPALAAGNVVVLKSSEVTPLSILYLAKIFRDVGFPPGVVNILSGYGATCGKALASHLDVDKIAFTGSTATGKLIQQMASSNLKAVTLECGGKSPLIVRKDADLEQAVKWAAIGIMSNQGQICTSTSRVYVHESVYDTFLTMYAKHIKEEYVQGDMFEKNAIVGPQVSKQQFDKILSYIDIGKKEGARVILGGEKNSDGNMSKGFFVKPTIFADVKPDMRIVNEEIFGPVVTCGKFASDEEAIKYANQTQYGLGAAIFTSDITKAHSMASDIQAGMVWINSSNDSDCHVPFGGVKMSGVGRELGEYGLSMYTQAKAIYVNLGTHL

SEQ ID NO: 53131 - protein, 292 aa, Vibrio campbellii AND4
MSIKIKTAEEIERMRIAGKLAADTLEMIEPHIKAGVTTDELNKICHDYALERGAYSAPLDYHGFPKSICTSINHIVCHGIPASEDEKGANGQVKPAVLKDGDIINVDITVIVPNDENADLSVRPQGYHGDTSKMFLVGDVTPANKRLCMVAQESLYIGMRQVKPGATVGDIGTAIEKYIKENNKKNPRNKFSIVKDFCGHGIGDEFHEEPQVVHYKNKDRRVLKEGMCFTIEPMINAGKFGCTVDAQDDWTVYTGDGKNSAQWEHTIVVTKEGCEVLTLRSDDSIPRLMKNV

SEQ ID NO: 53132 - protein, 273 aa, Pseudomonas aeruginosa PAO1
MSTPRIAFIGAGNMAASLIGGLRAQGVPAAQIRASDPGAEQRAKIAGEFAIDVVESNAEAVADADVVVLSVKPQAMKAVCQALAPALKPEQLIVSIAAGIPCASLEAWLGQPRPVVRCMPNTPALLRQGASGLYANAQVSAAQCEQAGQLLSAVGIALWLDDEAQIDAVTAVSGSGPAYFFLLMQAMTDAGEKLGLSRETASRLTLQTALGAAQMALSSEVEPAELRRRVTSPNGTTEAAIKSFQANGFEALVEQALNAASQRSAELAEQLGQ

SEQ ID NO: 53133 - protein, 230 aa, Pseudomonas aeruginosa PAO1
MSTIAENIAKVAARIREAAQAAGRDPATVGLLAVSKTKPAAAVREAHAAGLRDFGENYLQEALGKQAELADLPLNWHFIGPIQSNKTRPIAEHFQWVHSVDRLKIAQRLSEQRPAGLPPLNVCLQVNVSGEASKSGCAPEDLPALAEAVKQLPNLRLRGLMAIPEPTAERAAQHAAFARLRELLLDLNLGLDTLSMGMSDDLEAAIGEGATWVRIGTALFGARDYGAPAS

SEQ ID NO: 53134 - protein, 244 aa, Triticum aestivum
TVLKRMMRERMADEGRQPEDFLDVMIEELRREKPVLTETVALDLMFVLLFASFETTALSLTLGIRLITENPKVLEALTEEHEAIVRDRKDPDAGLTWAEYKSMTFTSQVTLEIARIANIVPGIFRKALQDIEFKGYTIPAGWAVMVCPPAVHLNPEIYEDPLAFNPWRWQDKMEITGGTKHFMAFGGGLRFCVGTDLSKVLMATFIHCLEFRHFRWKTVKGGNIMRTPGLSFPDGFHIQLFPKN

SEQ ID NO: 53135 - protein, 401 aa, Leptospira interrogans serovar Lai str. 56601
MIQPIENAIEEIKSGKMIILVDSEDRENEGDLVVAAEFADKEKINFMAAFGRGLICIPMEVERLKKLGLNRMVDDYSLGDKHGTAFTVSVDAKHGTSTGISAQDRAVTVQVLLDDKTVSADLMRPGHLFPLQAVPGGVLRRAGHTEAAVDLSKLAGLYPAGVICEIMNDDGTMARLPDLEKFAEKHGLNIYTIEDLIRYRRAKENLIRLEVESKLPTEYGEFTIRAYSTLIDDKIHIALIKGDIKKEETIMVRVHSECLTGDIFSSNRCDCGPQLHAALEMISKEGRGVLLYMRQEGRGIGLINKLKAYNIQDKGYDTVEANEKLGFAPDLRDYGIGAQILREIGVGKMKILTNNPRKIVGLDGYGLEVVERVPIEIQPGSDNHDYLMTKKLKLGHMLGLG

SEQ ID NO: 53136 - protein, 317 aa, Triticum aestivum
  misc_feature (30)..(30): Xaa can be any naturally occurring amino acid
  misc_feature (176)..(176): Xaa can be any naturally occurring amino acid
MHCHTFRELVVALVILGNYDMIQHPRNVSXLSKANAWFYMFVNEQTMLYVKISSSLYNDNKVGLWRLVVVRNLPYEDPRRTGKIPKLLLHRLFPNVRFSVWIDAKLQLVVDPYLLLERFLWRKNSSFAISRHYRRFDVYEEAEANKAAGKYDNASIDEQIDFYRNEGLTHYSPAKXLPITSDVPEGCVIIREHVPISNLFTCLWFNEVDRFTARDQISFSTVRDKIRAKVGWMPQMFLDCERRNFVVQAYHRELLEQMIASGRNTPPIAVEPSRKIRPGSSRRAPPSKKPVVRRKKEKKSSSRRRAVKPVTWAMDAV

SEQ ID NO: 53137 - protein, 102 aa, Brassica napus
  misc_feature (54)..(54): Xaa can be any naturally occurring amino acid
  misc_feature (80)..(80): Xaa can be any naturally occurring amino acid
SLFVDKRYKQPLFQVIVREGRITDNLLDDLTFAAEFKDDGSYLLYRENFRVVLXHLGVTFNNTVLEVACLLYRLLSAHFXVNQMPNTFSPKSEFEELEGVPT

SEQ ID NO: 53138 - protein, 457 aa, Pseudomonas aeruginosa PAO1
MTSDSRPAVLDLIGNTPLVRVTRFDTGPCTLYLKLESQNPGGSIKDRIGVAMIEAAERDGRLRPGGTIVEATAGNTGLGLALVGRAKGYRVVLVVPDKMSTEKVLHLRAMGAEVHITRSDVGKGHPEYYQDVAARLAQDIPGAFFADQFNNPANPLAHECGTGPELWAQTGHDLDAIVVGVGSSGTLTGLTRFFQKVQPELEMVLADPEGSIMAEYSRSGTLGTPGSWAVEGIGEDFVPAIADLSSVRHAYSISDEESFAMARELLRVEGIPGGSSTGTLLAAALRFCREQKEPKRVVSFVCDTGTRYLSKIYNDQWMTDQGLLQRKHYGDLRDIIARRFEEGRVISVGPDDTLLTAFQRMRLADVSQLPVLDDGKLVGVIDESDILLGVHADAPRFRDAVSSAMNAAPETLAPGASLAQLQAVLDRGLVAIVADASGFHGLITRFDLLNHLRRKLA

SEQ ID NO: 53139 - protein, 186 aa, Sulfitobacter sp. EE-36
MFIQTESTPNPATLKFLPGQTVLEMGTADFPAPEAASASPLATRLFAVEGVTGVFFGTDFVTITKADGIEWDHLKPALLGAIMEHFQSGQPVMETGHDHASGHAEHTGEDGAIVGQIKELLDSRVRPAVAQDGGDITFHGFERGVVYLHMQGACAGCPSSTLTLKMGIENLLRHYIPEVTEVRPVA

SEQ ID NO: 53140 - protein, 450 aa, Staphylococcus aureus subsp. aureus Mu50
MNNKRHSTNEQLSLDEINNTIKFDHRSSNKQKFLSFLGPGLLVAVGYMDPGNWITSMQGGAQYGYTLLFVILISSLSAMLLQSMTVRLGIATGMDLAQMTRHYLSRPIAIIFWIIAELAIIATDIAEVIGSAIALNLLFNIPLIVGALITVLDVFLLLFIMKYGFRKIEAIVGTFIFTVLFIFIFEVYISSPQLNAVLNGFIPHSEIITNNGILYIALGIIGATIMPHNLYLHSSIVQSRTYSRHNNEEKAQAIKFATIDSNIQLSIAFVVNCLLLVLGASLFFNSNADDLGGFYDLYHALKTEPVLGATMGAIMSTLFAVALLASGQNSTITGTLAGQIVMEGFLRLHIPNWLRRLITRSLAVIPVIVCLIIFKGNAAKIEQLLVFSQVFLSIALPFCLIPLQLATSNKDLMGPFYNKTWVNIISWTLIIILSILNVYLIVQTFQELQS

SEQ ID NO: 53141 - protein, 195 aa, Oryza sativa
  misc_feature (144)..(144): Xaa can be any naturally occurring amino acid
MDSEIKRYEQETSSSSSAAAGPVGHHWSPYEMNGGTLIAVAGADYVILASDTRLSEGYSILSREEPHTFPLQPHCMIGCTGFHGDCLTFVKKLEIRLRMYEYENSLKTMSTPAIAQLASTMLYYKRFFPYYVNTIVAGLNPDGXRGAGFSYDPGGSFEREMYRRSGSSFALIPPLLESQFGLKNPRGQLSRLTRI

SEQ ID NO: 53142 - protein, 237 aa, Glycine max
MSSGKQETAAVRVLGRWPSPFVIRVLIALGLKGVDHELVEEAAGNKSELLLASNPVHKKIPVLLHHGRPVSESLIIVQYVDEAWASQAPALIPSDPYARAAERFWAQYVDDKFPTAIRVLRGRLDGDKEEAAAQVCAALQHLEVAFVECGQGKDYFGGDGVGYLDIALGSHLGWVRAVERIAEIRLLDAAKVPKLAAWADRFCAHPAVANAMPNVDRFVEFSVKNDGVLKAASANSK

SEQ ID NO: 53143 - protein, 275 aa, Staphylococcus aureus subsp. aureus Mu50
MALYGFAQGLIQEAGIRIKQLMEQNLTIETKSNPNDLVTNVDKATEDFIFDTILETYPNHQVLGEEGHGHDIDTSKGTVWVVDPIDGTLNFVHQQENFAISIGIYIDGKPYAGFVYDVMADVLYHAKVGEGAYRGSQPLKPLNDSNLRQSIIGINPNWLTKPILGEIFKEIVNDSRSARAYGSAALEIVSVATGNLEAYMTPRLQPWDFAGGLVILYEVNGQASNLLGEPLTISGPNSILVGNRGLHQEISNDYLEPYHDTLIQLHEQRFKRKSK

SEQ ID NO: 53144 - protein, 181 aa, Zea mays
SEILSLVSGAVSGSRDMDNNNNKNNEENGNTSKTASDDEGVGSVGRQMSESSLCVTEEEEEDDSKLHLGPQYTIKEHLEKDKDDESLRKWKEQLLGSVDVTNIGETLDPEVRIISLVILSPGRPDIVLMVPENGNPKGMWFTLKEGSRYCLKFTFQGNNNIVSGLRYTNTVWKTACKGKRE

SEQ ID NO: 53145 - protein, 257 aa, Oryza sativa Japonica Group
MAGLGKAFYAVGFWIRETGQALDRLGCRLQGNYYFHEQLSRHRTLMNIFDKTPHVHRDAFVAPSASLIGDIQVGQGASIWYGCVLRGDANNVQIGSGTNIQDNSLVHVAKSNLSGKVFPTIIGDNVTVGHSAVLQGCTVEDEAFVGMGATLLDGVVVEKHGMVAAGALLYWIQVWGGNPAKFLRKLTDDEITFIKESASNYSTLAKAHAAENAKPVEKTEFEKLFRKKSAHQDEEHDSMIGATREVTPELTPSSSAQ

SEQ ID NO: 53146 - protein, 575 aa, Glycine max
MKKKNIETKIIKKTKSDEEKWVHDASVDYKGRIPLRASTGVWKASLFVLAIEFSERICHFGIATNLIMYLTKVMHEDLKTATKNVNYWVGATTLMPLIGGFVADAYTGRFRMVLFSSLLYLKGLSLLTMSQFIPSLKPCNNEICHWPRKVHEVVLFLALYCVALGTGGFKPCLQSFGADQFDDDHLEERKKKMSFFNWWNFTLCTAMLLGATVIVYVQDFVSWGVSYLILSMFMALTIIAFYEGKRFYRYRSTEGNPFMLILQVLIAAIRKSNLSCPSNPDSLYEFPKSEKSQGRLLSHTCRLRFLDKAAIVEGKYTEHRDQNPWRLATVTRVEETKLILNVIPIWLTSLIIGICIAQGSTLFVNQAASMNLKIINSFKIPPASMTSVSAISPIIAIPIYDKIIVPIMRKVKGNERGISVLWRVGIGLAFLVIAMVVAALVETKRLRMVEHDETMSVLWLIPQYLILGIGADSLSLIGLQEYFYDQVPDSVRSLGVGLYLSVVGVGFFLSSFLIITVDHVTGKNGKSWIAKDINSSRLDKFYWMLAVINAFNLCFFLFLAKGYTYKTVQRKTREI

SEQ ID NO: 53147 - protein, 705 aa, Oryza sativa
MRRPSPSPPAARGPALAAAAAVVVLLPSIFPAIFTPLGRAFPSLFSEWNAPKPMHESLLNEALRRTISNEQKRELWSPLPYQGWKPCLKSSSVHGVPLEPTGYIQVFLDGGLNQQRMGICDAVAVAKILNASLVIPHLEVNPVWKDTSSFEEIFDVDHFINTLKAEVSIVKVLPKKFSWSTREYYGTGIRATRIKTAPVHASASWYLENVSPILQSYGIAAIAPFSHRLAFDDLPVDIQHLRCKVNFQALVFLPHIISLGETLVKRLRSPVQGQSGELIQEVGEDTNQAGKYAVLHLRFDKDMAAHSACDFGGGRAERLALAKYRQVIWQGRVLNSQLTDEELRNLGRCPLTPEEIGLLLAALGFDSRTRIYLASHKDKRSLASEEELTNVEGKASVLAALDYYISMHSDIFISASPGNMHNALMAHRTFENMKTIRPNMALLGRIFVNKSMEWLEFQEAVQAGHKGRYGQIRLRKPKQSIYTYPAPDFRGKNHTSPVYRKLTSKQIVEHHRRFNEFVRDQQQFTRVFYEKTKPKSPMAEAAAKEVAGAAAAAGDMILLISSDGQRFEVAQAVASMSRLVRNMVEDECTDNGVPLPNVPSAVLAKVLEYCSEHAAAAAAAGEEVEELKSFDAAFIEVDNATLFDLILAANYLNVPCLLALACQRAADLIRGKTVEEIRAEFNIANDFTPEEEAEIRKENAWAFQD

SEQ ID NO: 53148 - protein, 174 aa, Porphyra purpurea
MANRKKQGKSKEKDNGWEERVVQVKRVTKVVKGGKKLSFRVILVVGNEQGQVGVGVGKASDVIGAVKKGVTDAKKHLVTVPLTKSNSIPHPINGISGAAQVILRPSAPGSGVIAGGSVRTVLELSGVQNILAKQLGSNNTLNNARAVLNGLTQLRTFSEAAKDRGVPIENLYSK

SEQ ID NO: 53149 - protein, 485 aa, Thermoplasma acidophilum DSM 1728
MENGVRYSDLIERLDMSRVTRFYWLLTILATIGGFLFGYDTSNIGSALPLLERIYPGISGFVEGYLVAGASLGAAVGAIIAAGLTDRYGRKYLLIADAAIYAAGALLSAFTVDLVMLLLSRTLIGIAVGADSGIATAYIAEYAPKARRGSLGILQQWMITIGILAAYLIGMATLFFAPGLAYAVGWRIMLGVAAIPAIIGLAFRFMMPESPRWLLVNGKYKEASASLKRLGLNMSEEDLKSVKLSQPHKITPGVKRALLIVGLFFVFQQITGINIPFYYGPVVLENLHIVGKSTSLVYSIYYSIAASAILAIINVAATYIGFRYIDSVGRRKLALMGYAGMTFFGILGGILLYLKLDIGLFIAFAGFIIFFAFGVGGTGWMIQGEYFPTSMRGLYASLGAFIDWIANFAIIELFPVMDSAITIKNVEFVFGVLSLIALILFYYIMPETKGLSVEQIDTLFENNSLGQMKHASISMKKESVPADPK

SEQ ID NO: 53150 - protein, 454 aa, Arabidopsis thaliana
MTLIASLSLPPPAIQRQSLSEFHNLPAKSQSFNCQFRSSSSPLSSLHSSSLSNFLDFRLRRRNSGLVPVVACSTTPFMGRVGLHWRDGNMSLLSFCGGTDVTEKADSSQFWSALLPFVVALTAVAALSYPPSFTWVSKDLYAPALGGIMLSIGIQLSVDDFALAFKRPVPLSVGFVAQYVLKPLLGVLVANAFGMPRTFYAGFILTCCVAGAQLSSYASSLSKADVAMSILLTSSTTIASVIFTPLLSGLLIGSVVPVDAVAMSKSILQVVLVPITLGLVLNTYAKPVVTLLQPVMPFVAMVCTSLCIGSPLSINRSQILSAEGLGLIVPIVTFHAVAFALGYWFSKIPGLRQEEEVSRTISLCTGMQSSTLAGLLASQFLGSSQAVPAACSVVIRFRGDGIGSVDKMVFINHLVCSLLIHGIKGYLLLPLSELLLRNSVKANAEPMKNLQKWY

SEQ ID NO: 53151 - protein, 478 aa, Zea mays
MAEETVQELRASFASGRTRGAEWRAEQLKGLIRMIDEKEAEISAALHEDLAKPHMESYLHEISITRSSCKFALDGLKSWMKPEKIPAALTTFPSSAQIVPEPLGVVLIISAWNYPFILSIDPVIGAIAAGNAVVLKPSEIAPATSSLLAKLLPEYVDNSCIKVVEGGVAETTSLLEQRWDKIFYTGNGTVGRIVMAAAAKHLTPVALELGGKSPVVVDSNVDLHVAVKRIVVGKWGCNNGQACIAPDYIITTKSFAPELVASLKRVLERFYGEDPLQSADLSRIVNSKHFRRLTELIEEKSVADKIVYGGEVDEKQLKIAPTLLLDVPQDSAIMTGEIFGPLLPIVTVEKIEESFDLINARPKPLAAYLFTKNKWVQEEFVADVPAGGMLVNDTVLHLANPYMPFGGVGDSGMGCYHGKFGFDCFSHKKGVLVRGFGGEANARYPPYTTEKQKILRGLINGSFIALILALLGFPREKR

SEQ ID NO: 53152 - protein, 241 aa, Brassica napus
  misc_feature (13)..(13): Xaa can be any naturally occurring amino acid
  misc_feature (232)..(232): Xaa can be any naturally occurring amino acid
MAAIARLPLTHSXLPTILNHTRLLPQRRLSFPTYLNRSPFRSFSAVSSSSSQGDSRSLGSDSNASIVGDLLDYLNESWTQFHATAEAKRQLLAAGFHLLSENEDWNLKPGGRYFFTRNMSCLVAFAVGDKYVPGNGFHAIAAHTDSPCLKLKPKSASSKSGYLMVNVQTYGGGLWHTWFDRDLSVAGRAIVRASDGNFVHRLVKVKRPLLRVPTLAIHLDRTVNSEGFKPNXETQLVPLLA

SEQ ID NO: 53153 - protein, 282 aa, Solanum lycopersicum
MTGGKEIIDKIKEKVGLSSSDTGRGKSKMSKNITHGYHMVEGKSHHTMEDYVFAQFKQVDENELGLFAIFDGHLSHEIPEYLRSHLFNNILNEPNFWAEPESAIRKAYRITDTTILDKAADLGKGGSTAVTAILINGQKLVVANVGDSRAVIYKNGVAKQLSIDHEPGREREIIEGKGGFVSNFPGDVPRVDGQLAVARAFGDKSLKMHLSSEPDVVVELIDDDTEFLILASDGVWKVLSNQEAADCIKDIKDARSAAKHLNEHALARGSTDDISCVVVRFQ

SEQ ID NO: 53154 - protein, 490 aa, Burkholderia pseudomallei K96243
MLQRFQQYIDGTFEHAASEFDSIDPAGGTVWARMPAASADDVDRAVRAAHRALNEAAWANLTASERGKLLYRLAELIERDALRLAELETRDTGKIIRETRSQIGYVAEYYRYYAGVADKIQGAWLPVDKPDMEVTLRREPVGVVAAIVPWNSQLFLSAVKVGPALAAGCTVVLKASEDGPAPLLEFARLVHEAGFPKGVVNIVTGFGNDCGRTLTSHPLVSHIAFTGGPETARHVVRNSADNLAAISLELGGKSPVLVFDDADLESTCNAVIAGIFAATGQSCVAGSRLIVQRGIHDALVERLTARARAIRIGDPQDMATEMGPLATRRQLEHIQRVLDASIEAGGRVVTGGSQPEGLAAGHYFLPTIVDCPNAKVPSVMEELFGPVLSVVMFDTEAEAIALANDTKYGLASGVFTGDLTRAHRLTRALRAGIVWVNTYRAVSPIVPFGGYGLSGLGREGGFEAVLEYTRTKSVWIRTSDEPIADPFVMR

SEQ ID NO: 53155 - protein, 364 aa, Wolbachia endosymbiont of Drosophila melanogaster
MSFNCGIVGLPNIGKSTLFNALTESSAAEAANYPFCTIEPNIGKISIKDQRLKQIAAIAGSEKVIYNQLEVVDIAGLVKGASKGEGLGNKFLSHIREVDAIVHLLRCFTDDDISHIHSKIDPISDAEVVEMELILADIDSIEKRLPQLEKKAKQGDKELKRQLELMQEVLATLKLGKPARSLENINEDEMKLLQLLTTKPVMYVCNVEDTNVITGNELSKKVERMAEENKSKFYCISAKLEADIANLDSEEEKQSFLSEFGLQESGLDGVARIMYEVLSMITFFTVGPKEARAWPVKIGSTADKAAGVIHTDFEKGFIKAETISFADYIKYGSESACKDAGKIRFEGRDYIVQDGDIMHFRFNV

SEQ ID NO: 53156 - protein, 837 aa, Janthinobacterium lividum
MKFGFIAHPTSVGLKRYVKMLDLLQRQSKDLQSGYQRDLWRRENMVPFVDFGQIRSAAGATCEGIVHYLPLTADEMLASAREVQERIFEGIDTLGKQGAQLVGLGGFTSIIGKRGLVTAERASLPVTSGNSLTTYAGYKALLQVFDWLQLHPQEARVAIVGYPGSICLSLAKLLLAQGCRLDLLYRSGSASPDELLEHLPAKWHAQVTLRDSIDDCYVNNRIFASATSSGDVIDEARLLPGSIVVDIALPRDAVRSTPPRTDTLVIDGGCMTASPQVKLGGESLNMAIKQQINGCLTETMVLALEGRAECFSIGRTLEPEKVLEIGALAERHGFYAFPLASWGERINEKIISGLRRYHRRQESAPAQADGGEQRRTQTLQRYRSHINPMMADFLGMQRCDHVFDRAEQCTLTDTEGRQFLDMVSGYGCLNLGHNPSIVTDAIRKFLTDSTPNFVQYVSLPQETAKLAERLCAIAPGEFERVFFSNSGTEAVEAALKLARAATGRTRFVYAENSYHGKTLGALSVTGREKHKKHFRPLVPGCVGVAFGDLEALRSELISEEVAAYIVEPIQGEGGVKMPPAGYLAAAQEICRQTGTLLIVDEIQTGLGRTGRMFASEWEGLEPDIMVLAKSLSGGLIPIGATLSTAQVWDAAYGTMGRFLLHTSTFGGCNIAAVAGLAALDGLHQQGLAERADELGTYFKAELEKATEHYPFIAEVRGRGLMLGIQLDNDFAGAVEACAREFGTRLPGDWHLTYRFFPDEVKQHLADAMSKMEESLAEMFCMRFVTKLSNDHGILTFVTANSSTVIRIQPPLVISREEIDHFVRSFATVCEEMSTFLN

SEQ ID NO: 53157 - protein, 203 aa, Oryza sativa Japonica Group
MPSARVQAGGGGNGGAGGGGSGRFKRALLRNLILGLRKGGVASGEMGFHERKSAIKRAADAALAAARGAAPCWSRSLAAELAQAPQQHRSPPSPSPRKMICRKIVRRSLIRRRRRPIRPANNTTAATTKAYGGGGGGGGGVARAMVRKRASVLKEIVPGGKALDMCALLGETLDYAVSLKAQVDVMQLLVRTLQEQKLKNSGN

SEQ ID NO: 53158 - protein, 306 aa, Magnetospirillum magnetotacticum MS-1
MRNTSLNKVHELAQKDSRVVFIGSDLGVGTLKAMKAEMPERFFMEGVAEQNVIGMAAGMAMDGLIPYVNTIAPFITRRCYEQVAVDVCVHNLPVRLIANGGGVVYAPLGPTHLAIEDFAIMRALPNMAVVAVSDAEEMKRLMDASLDWKGPIYIRLAKGGDPVISQPTDDFKIGKAILRREPGRVLMVSTGATTERCLKAADILAEAGITAGVLHMHTVKPLDCEALKALVPGRDLLVTVEEHLLAGGLGSAILECLVDCGVTLPKVKRLGLPDSFTKEYGSQDSMFETYGLKAEQIATTVRTALA

SEQ ID NO: 53159 - protein, 221 aa, Nocardioides sp. JS614
MYAVLHTVVPPVAKAIWRPQVVGLENVPRTGPVILASNHLSFADSLVIPIVAPRKVVFLAKSDYFAGGGVKGTLQKAWFEGMGMLPVDRDDTKAALASLDTALDVLGRGEAFGIYPEGTRSRDGRLYRGRTGVAHLALTAGAPVVPVGLTGTERLQPVGAKLPRVVPVTVRFGRAIDVAGRYDGVPPGRARREVTDEIMAAIQELSGQEQAGIYNDRAPDA

SEQ ID NO: 53160 - protein, 486 aa, Burkholderia pseudomallei K96243
MYLEHALKDPSLLRHQAYIGGEWQAADSDATFEVFDPATGESLGTVPKMGAAETARAIEAAQAAWAGWRMKTAKERAAILRRWFDLVIANSDDLALILTTEQGKPLAEAKGEIAYAASFIEWFAEEGKRVAGDTLPTPDANKRIVVVKEPIGVCAAITPWNFPAAMIARKVGPALAAGCPIVVKPAESTPFSALAMAFLAERAGVPKGVLSVVIGDPKAIGTEITSNPIVRKLSFTGSTAVGRLLMAQSAPTVKKLTLELGGNAPFIVFDDADLDAAVEGAIASKYRNNGQTCVCTNRFFVHERVYDAFADKLAAAVSKLKVGRGTESGATLGPLINEAAVKKVESHIADALAKGASLMTGGKRHALGHGFFEPTVLTGVKPDMDVAKEETFGPLAPLFRFASEEELVRLANDTEFGLAAYLYSRDIGRVWRVAEALEYGMVGINTGLISNEVAPFGGVKQSGLGREGSHYGIDDYVVIKYLCVAV

SEQ ID NO: 53161 - protein, 410 aa, Cytophaga hutchinsonii ATCC 33406
MNTTVSLSQQAIELEDKYGAHNYHPLPVVLAKGEGVHVWDVEGKHYYDFLSAYSAVNQGHCHPRIINALIEQAQTLTLTSRAFYNDKLGEAEKFICDLFGYDKALLMNSGAEANESAIKLARKWGYQVKGIPTDQAVIVAVERNFHGRTTGIISASTDPDSRNNFGPFMPGYQIIPYNDVIALEEALKNPNVCGFWVEPIQGEAGVFVPGDGYLKKAQELCTKYNVILMMDEIQTGCGRTGKLIASNHEGVHPDMLILGKALSGGTYPVSCVLTSDEIMLTIKPGEHGSTFGGNPLACAVLVESLAVLMDEGLIDNAASMGELFRDRMNALKDKCEHVTLVRGKGLLNAIIIKPTADGRTAWDVCMKLMENGLLAKPTHGDIIRFAPPLIITEEQINACCDIIEKTLLEF

SEQ ID NO: 53162 - protein, 401 aa, Carboxydothermus hydrogenoformans Z-2901
MGFNTIEEALEDLKQGKMVIVVDDEDRENEGDLVCAAEKVTPEIINFMAKYGRGLICVPMEGKRLDELEIPIMVTQNTDPHHTAFTVSVDAVDTHTGISAAERAKTILKLIDPQARPQDFRRPGHIFPLRAKEGGVLRRAGHTEAAVDLARLAGLYPAGVICEIMRDDGQMARVPDLLEFAQKHNLKIITIASLIQYRRRNEKLVERGAFAMLPTKYGEFVAVAYESLLDHQTHLAVVKGNVADGEPVLVRVHSECLTGDVFGSLRCDCGDQLQTALKMIEKEGRGVLLYMRQEGRGIGLANKIKAYHLQDMGKDTVEANEALGFPADLRDYGIGAQILADLGIKKIRLMTNNPKKIKGLEGYGLEIVERVPIEIPPKKENKKYLLTKKKKLGHLLNLTEN

SEQ ID NO: 53163 - protein, 163 aa, Acinetobacter sp. ADP1
MRHIISVLVENEAGALSRLVGLFSQRGYNIETLNVAPTEDPTLSRLTLTTYGDDHKIEQITKQLNKLVEVVKVVDLSEGAHIERELMLIKVKALGSARAEIKRTADIFRASIVDVTPTTYTIQIAGTTDKLDGFIDALAENTILEVVRSGVSGIARGEKVLSI

SEQ ID NO: 53164 - protein, 574 aa, Acinetobacter sp. ADP1
MELLSGGEMLVRALADEGVEHVFGYPGGAVLHIYDALFQQDKINHYLVRHEQAAGHMADAYSRVTGKTGVVLVTSGPGATNTVTPIATAYMDSIPMVILSGQVASHLIGEDAFQETDMVGISRPIVKHSFQVRHASEIPAIIKKAFYIASSGRPGPVVIDIPKDATNPAEKFAYEYPEKVKLRSYQPPSRGHSGQIRKAVDELLTAKRPMIYTGGGVVQGNASELLTELAHLLGFPVTNTLMGLGGFPGDDPQFVGMLGMHGTYEANMAMHNADVILAIGARFDDRVTNNPAKFCQNAKVIHVDIDPAAISKTIMAHIPIVGAVQPVLQEMLTQLKQLNVSKPNPEAISAWWDQINEWRKVHGLQYQAGQDGIMKPQQVVEALYKATDGNAIITSDVGQHQMFGALYYKYKRPRQWINSGGLGTMGVGLPYAMAAKLACPDQQVVCITGEASIQMCIQELSTCKQYGLNVKILCLNNRALGMVKQWQDMNYEGRHSSSYVESLPDFAKLMEAYGHVGIQIDHTDELESKLAEAMAINDKCVFINVMVDRTEHVYPMLIAGQSMKDMWLGKGERT

SEQ ID NO: 53165 - protein, 429 aa, Salmonella enterica subsp. arizonae serovar 62:z4,z23:--
MTTDDLAFDKRHIWHPYTSMISPLPVYPVARAEGCELILASGERLIEGMSSWWAAIHGYNHPQLNAAMKSQIDAMSHVMFGGITHMPAVNLCRKLVAITPEPLECVFLADSGSVSVEVAMKMALQYWRARGESRQRFLTFRNGYHGDTFGAMSVCDPDNSMHSLWKGYLPENLFAPAPQSRMDGEWDEGDIAPFARLMAAHRHEIAAVILEPIVQGAGGMRMYHPEWLRRIRNMCDREGILLIADEIATGFGRTGKLFACEHAGIAPDILCLGKALTGGTMTLSATLTTRQVAETISNGEAGCFMHGPTFMGNPLACAAACASLTLLESGEWRQQVASIESQLRAELAPAQSSPRVADVRVLGAIGAVETTHPVNMAALQRFFVGQGVWIRPFGKLIYLMPPYIIRPEQLRRLTQAVNDAVHNETFFSH

SEQ ID NO: 53166 - protein, 335 aa, Carboxydothermus hydrogenoformans Z-2901
MPVKVGINGFGRIGRNMFRAALNNPEIEIVAVNDLTDAKTLAHLLKYDSVHGIFAADVEAKDDAIVVNGKEVKVYAEKDPANLPWKELGVEIVIESTGKFTKKADAVKHLEAGAKKVIISAPATDEDITIVMGVNEDKYDPANHHVISNASCTTNCLAPVAKVLHEKFGIVKGLMTTVHSYTNDQRILDLPHKDLRRARAAATSIIPTTTGAAKAVALVLPELKGKLNGFAMRVPTPNVSVVDLVVELEKPATKEEINAALKEAAEGELKGILGYTELPLVSVDFNGNPLSSIVDGLSTMVIEDNMAKVIAWYDNEWGYSNRLVDLATYIAKKGL

SEQ ID NO: 53167 - protein, 225 aa, Nocardioides sp. JS614
MPLDGLDADRERGGDVLRRAALRDQLEDLVLALGQDGLGHPLALAFVAFAVAGVVGASGLMAIYVAGLTLGNTRLPHRSATASFVEGLAWLSQIGLFVMLGLLVSPGRLLDARPYALVQGPTLPWVTRRLGATVDNQPQPVAIESAPLEKLDATLLQLTVGPGSRLAGVEVSELRLPQPAAVSLVLRGDQIFAPTGHRAARRRPRPARRRPGGARRGRAPPARRQ

SEQ ID NO: 53168 - protein, 284 aa, Glycine max
MEGKEEDVRVGANRYGERQPIGTAAQAKDYREPPSAPLFEPGELSSWSFYRAGIAEFVATFLFLYITVLTVMGVFKSKSKCSTVGIQGIAWAFGGMIFALVYSTAGISGGHINPAVTFGLFLARKLSLTRAIFYIIMQCLGAICGAGVVKGFEPHLYERLGGGANTIAKGYTNSAGLGAEIVGTFVLVYTVFSATDAKRNARDSHVPILAPLPIGFAVFLVHLATIPVTGTGINPARSLGAAIIFNKDQAWDDHWIFWVGPFIGAALAALYHQIVIRAIPFSSK

SEQ ID NO: 53169 - protein, 507 aa, Aspergillus fumigatus
MNSLKLLVVSPEINPSNRKARSIPVLNPFDRYGRVFFFSWLGFMVAFLSWYAFPPLLTVTIRKDLHMTQQQVANSNIVALLATFLVRFIAGPLCDRFGPRLVFIGLLLCGSIPTAMAGLVTTPNGLIALRFFVGILGGTFVPCQVWCTGFFDKNIVGTANSLAAGWGNAGGGITYFVMPAIYDSLVHSQGLAPHKAWRVAYIVPFIIIVVLALCMLLICEDTPTGKWSERHIWMKENNESQANIVNLMSGSPSTRPSGPPSINISTPQSEKKGAQTPQMVDPEAQAVGQVDILRADTVVAPSRKEVMNVLLSLSTAAVAIPYACSFGSELAINSILGEFYSKNFPDMSQTESGRWAAMFGLLNVVFRPAGGFIADMLYKYTGAVWSKKVLLSFLGVVMGAFQLAIGLADPRSEATMFGLTAGLAFFLEACNGTNFAVVPHVHPFANGVVSGAVGGMGNLGGIIFAIIFRYNETHYSRSLWIIGVISIAANLAVSWIRPVPKSQMMRQ

SEQ ID NO: 53170 - protein, 303 aa, Oryza sativa
MGVPPVDWEAESYPAYSDFAAIPLFAVFLFAVRYLLDRFVFEWLARRLIFEKDEKLDLATHAGRIKIRKFKESAWKCIYFLSAELLALSVTYKESWFTSTKNFWVGPGDQVWPDQRIKFKLKLVYMYAAGFYTYSIFALQFWEIKRSDFGISMVHHVVSVILIALSYIFRFARVGSIVLAIHDASDVFLELGKISKYSGYQLLADVSFLIFVCSWAVLRLIYYPFWILWSTSYEVVPMLDKKKHKFDGPLHYYVFNCLLFSLLVLNIYWWVLMYRMLVEQILSKGHVGDDVRSDSEGEEEHED

SEQ ID NO: 53171 - protein, 293 aa, Vitis vinifera
MLRRNIRLRREYIYRKSLEGKERLLYEKKRKIKEALEEGKPIPTELRNEEAALRQEIDLEDEQTAVPRSHIDDEYANATEKDPKILLTTSRNPSAPLTQFVKELKFVFPNAQRMNRGGQVISEIIETCRAHDFTDVVLVHEHRGVPDGIIISHLPFGPTAYFGLLNVVTRHDIKDKKAIGKMSEAYPHLILNNFSTKLGERTANILKHLFPVPKPDTKRIITFANQSDYVSFRHHVYEKRGGPKSIELKEVGPRFELRLYQIKLGTMDQSEAQIEWVIRPYMNTTKKRKFLGD

SEQ ID NO: 53172 - protein, 101 aa, Oryza sativa
KLRNSSSTVGLLAISKSFGVLIPDQGIALRGLFIIDKEGVIQHSTINNLAIGRSVDETMRTLQALQYVQDNPDEVCPAGWKPGDKSMKPDPKGSKEYFAAI

SEQ ID NO: 53173 - protein, 409 aa, Thermoplasma volcanium
MLMNIVTLISWDFKRNNESFQRAIINGYDYWSRILDDHGVEKYVILLTCNRVELYYRGDPFDVQEKGYNIISDDMAINHLFHVAAGLDSMSIGENEVLKQVKQAYEKSSSMGKSDKFLSLIFQRAISVGKLVRSKTGIGKGKVSIPSIVYDIVRKNGGNKILLVGNGMLASEIAPYFSYPQYKVTVAGRNIDHVRAFAEKYEYEYVLINDIDSLIKNNDVIITATSSKTPIVEERSLMPGKLFIDLGNPPNIERGNNVITLDEIYEISKKNEMLREEKINQAEILIENEMKATMNKIKDLMIDDIFSQFYRFASVVQTMEIQKFRKMHPEVNENDLEALAHSIINKILNVPVTTLKAVSRSQGNSDFNRLFESFSSNFNDIVSAALQSYEGLRDTQSLRDRTRQLLQKS

SEQ ID NO: 53174 - protein, 451 aa, Solibacter usitatus Ellin6076
MRPRTHMNRYLLKSTIVAALGGLLFGFDTVVISGATSTLSDVYHLTPMLLGFTVASALLGTVLGSMVAAAPSDRYGRRQCLQALAVLYVVTAIGCAAAWNWPAFVVFRFIGGLAIGGSSVIGPMYIAEIAPAAKRGRLVGLFQFNIVAGILIAYLSNYFVGTLALGPEEWRWKLGLAALPAVLFFVTLFGIPQSPRWLIRRGFIAEAREIFRRIGEPDPDREVADVVRSVESEDRTKVEPLFQHKYRRPIFLAIAIGFFNQLSGINAILYYLNDIFKSAGFDKVSSDLQAVAIGGTNLLFTMIAMSLIDRLGRKKLLLTGAAGTAVCLAGVAVIFSTGQGEHLLVWLLIGFIGFFAFSQGAVIWVYLSEVFPNLVRAKGQSLGSFTHWIMNAIIAFTFPLVAALSRPAPFVFFAAMTVVQFVVVLFLFPETAGITLEDMEKQLERKASSGV

SEQ ID NO: 53175 - protein, 631 aa, Cryptococcus neoformans var. neoformans JEC21
MLESISCLPAQLQPYFIWLSALTLGEIWLTIYNPPNRVNLSIAFIIISFKLPTWARKYNSWKNERKVVRFGYPVPKEASKQWEGRVIENPNLLSHLEDESLLPPETGLSGRKREHITCYDPSTGYHLNTLPLHTAEEVSLQISKANSAFFAWSRTTFAQRRHFLRNVRGWVLRDMDYIVQVACRDTGKTNVDAVFGEILTSLSKIDWLLKHGEKTLSPQKRAGNLLLAHKVSKVHYHPLGTVLALVSWNYSFHNLLSPIIAALFAGNTIVVKCSEHVAWSSMWFIGGIKECLKICGLDPEVVQLVICLPGGAEKVTRNPIFKHITFIGSEPVGKKVAAAAAEIMVPTCIELGGKDPAFILPGTDLDFFASTWMRGAFQSAGQNCIGIELFLVHRSQYSRFLEILTPRVQALRPGHDVGSLISHAPISKLQSLLASSISSGARLLAGGHPYVHPLYPQGAYFEPTLIADVTMDMAVAKEELFAPVMTVVPYDDVNEAVEWLNKGKFGLGGGVYGKDKKECRRVAEKLECGMVAINDFGVFYLNQAMPFGGVKASGHGRFGGEEGLRSLCSVKAITEDRFFSWIRTTIPRPVDFPLPEDGTAWQFLKGLVGLAYAPTTPGRVSGLVNLVKAST

SEQ ID NO: 53176 - protein, 405 aa, Cryptococcus neoformans var. neoformans JEC21
MVDYKFPIFFRNPAVVSPELISSSLHISSKSIQNMVVSRSASILRSVCPTFISSRAYATAAPAFGKPVNGFVGAIGNTPLIRLSRLSEETGCNILAKAEFMSPGGSIKDRAALYLVQDAEEKGLIRPGGTVVEGTAGNTGIGLAHVCRSKGYKCVIYMPDTQSQEKIDLLRMLGADVRPVPAVAFDNPQNYNHQAARYAASLENAVWTNQFDNVANRNAHIVSTGPEIWEQTDGGKLDAFICSTGTGGTLAGVTRYLTEKSNGRVEAWLADPPGSVLFNLVENGEIKREGNGSITEGIGQGRVTNNLAPDLSLLSGAIHVPDSASINMIYRLLDEEGLYVGASSALNVWSAVELAKRKGKGSTVVTVLCDGAYRYQARLFSRVWLESKGLVSHIPDHLQKYIVLP

SEQ ID NO: 53177 - protein, 284 aa, Zea mays
MTTCRTANAAAVVRLLLLCSFCAAAAIACDPPNGAKFGYTGSVGPDHWGALSPSFRQCATGTKQSPIDISTAQAVSNPALQPLHRDYTVANATLVDNVVNVALRFDGDGGAGSVSVGGKLYTLKQVHWHSPSEHTVDGRRFPVELHMVHASDDGNVTVVAMLYRFGRPDPLLWQIQDKLAALHAEGCRADKGAPVAAGDVSLWSLRLYSHTYYRYVGSFTTPPCTENVIWSVLAQVREMTVDQAAALMAPLEQAYRRNNRPTQPRNGRVVQVYRNGFINKKTAP

SEQ ID NO: 53178 - protein, 339 aa, Escherichia coli
MVIFVTGGAGYIGSHTILELLNNGHDVVSIDNFVNSSIESLKRVEQITNKKIISYQGDIRDKNLLDEIFSRHHIDAVIHFASLKSVGESKLKPLEYYSNNVGGTLVLLECMKRYNINKMIFSSSATVYGSNSIPPHTEDRRIGETTNPYGTSKFIIEIILSDYCDSDNNKSVIALRYFNPIGAHKSGMIGENPNGIPNNLVPYISKVAQNQLPVLNIYGNDYPTKDGTGVRDYIHVCDLAKGHVKALEYMFLNDVNYEAFNLGTGQGYSVLEIVKMFEIVTKKSIPVAICNRREGDVAESWASADLAHKKLSWKAEKNFERMIEDVWRWQTNNPNGYKK

SEQ ID NO: 53179 - protein, 572 aa, Oryza sativa Japonica Group
MNVSEASPKLNYDKKNCDLYFILHLQILEEEKVHQKLTLGEYPLYLVPLDEDVICFELDHSLQECLIEGDTSSVWHVAKAIHKLEFAFGVIPNVRAKGVASTKAAELLNSMQQEDPVNMDDMGTPEINTVILLDREVDLVTPMCSQLTYEGLLDEMLQINNGSVEVDATIMGAQQDGFSFSHLWEVFCLPLLGRLTSLAFQVVGSDKLYKEIRDLNFEVVVQVLRQKATSIQQDYAEVKSTNTQSVSELKDFVKRLHSLPEIARHVHLAQHLQSFTGKPSFHARLDIEQTILEVQNFEICFEYIEEMIHKQEPIENVLRLLVLLSLTNAGLPKKNFDYLRREILHSYGFEHMPLLYNLEKAGLFKRQESRSNWIGITRALQLIVDVNDTANPSDISYIFSGYAPLSIRLVQHAVRSGWRSIEELLKLLPGPHLDLKRGSSAINSSLDVHQGLGLQQSIDRLFALSGDEGFMRDLIQTYESKPETGVGHRSLVLVVFIGGVTFAEIAALRFLSSQEGMGYDFLVATTKVVNGNTILRPIITNSKELDLYQKSLKGVLDHDLTINRRFRWKRRA

SEQ ID NO: 53180 - protein, 365 aa, Wolbachia endosymbiont of Drosophila melanogaster
MTIRVGINGLGRIGRGVLRAIFEIEEYSKQIEVVAVNGSLSAKQHAHLIKYDSVHGKFSGDIDFNESQNWISINGKKFSLYRERNPENIPWNVDVILECTGAFNKREEAIRHNAEKVIVSAPVPDADVTIVYGVNDDMLEKEHKVISAGSCTTNCLAPIVKVLHSSLGIKSGFMTTIHAYTNDQNVLDGNHKDLRRARACGLSMVPTTTGAAKTIGSIIPELKGKLDGTAVRVPVSNVSMVDFTFTTDKKATVKEINEMFKDAALSSTSFQRVTLESNFWIPVSATRMTSEGTRMTEGYPMSNVLSICEEPLVSIDFVHNPYSAIVDLTGTYVTGDICRVAAWYDNEWAFSLRMLDIALLSYSKV

SEQ ID NO: 53181 - protein, 306 aa, Physcomitrella patens subsp. patens
MGAVFAKSDSPSPDRSPSPDWLNLPCPVKYDEIQRENIMSLKPELFEGLRFDFTKPLNQRFSLSHSLFMGSVEVPSQGAQIIKVPAAHYEFGANLIDQRMMMLIGRILTDGRMSARIKYDFTDRFSVKVNAQLTNEPHFSQGMFHFDYRGKDYQTQLQLGNNAFYGFNYIQSVTPTVALGGEVFWLGHQRKSGIGFAGRYNTDKVVATGQFASTGIVSLTYVQRVSDKVSLASDFLYNWNSKEATTSVGYDYLLRQCRLRGRLDTNGCIAAYLEERLNLGVNFLLSAEIDHWKKDYKFGFGMTVGE

SEQ ID NO: 53182 - protein, 478 aa, Bifidobacterium longum NCC2705
MDQLVAESTPLKRTMRTFDLTMLGIGAIIGTGIFVLTGKGALTAGPALSVSFLLAAVCCGFAGLCYAEFAAMAPVSGSAYSYAYLAFGELIAFVIGWDLILEYALQAATVSAGWSGYFNKLLEGFGLHLPVELTAAYGTNPDVTTYFNLPGFVIVLIITWVLSIGINQTKRTNDVMVLIKLAIIVLFIACAVWYVKPSNWQPFSPYGVYTFQPGSTQPYGIVPAASIVFFSFIGFDAVSSSAEETINPNKTLPRGILLSLAVSTVLYIVMTMIMTGVVPYQDFAKYIDAPVAGVILETGMNWLAVIVNLGALIGMTTVMLVQLYGQSRICYAMSRDGLFPKFFGHVHEKYRTPFKGTWFFGLLTAFAGGFININVLFELVNIGTLSAFIIVSAGILWMRKTQPNAPRGFRAPGVPVTPILAIVFCFVLIAGLNWETWVRFAIWFGLGLIVYFGYSRKRSKLGLEQKAGADTKVAATED

SEQ ID NO: 53183 - protein, 512 aa, Oryza sativa Japonica Group
MGRSMLPEQQEDVSRKSKKEKKSKKDKKRKLEAEAEVVVVEAAAATSTDEATKSSKKKRAKGDLGQGEEAENGGGKVVAVTGKGSADAKYAPLSSFAATALPPQVLDCCKGFERPSPIQAYAWPYLLDGRDFIGIAATGSGKTIAFGVPALMHVRRKMGEKSAKKGVPRVLVLSPTRELAQQIADVLCEAGAPCGISSVCLYGGTSKGPQISALKSGVDIVIGTPGRMKDLIEMGICRLNDVSFVVLDEADRMLDMGFEPEVRAILSQTASVRQTVMFSATWPPAVHQLAQEFMDPNPIKVVIGSEDLAANHDVMQIVEVLDDRSRDSRLVALLDKYHKAQRNRVLVFVLYKREATRVETMLQRRGWSAVSVHGDKAQHDRTKALSLFKEGSCPLMIATDVASRGLDIPDVEVVINYSYPLTTEDYVHRIGRTGRAGKKGVAHTFFTQENKGLAGELVNVLREAGQVVPPALTKFGTHVKKKESQIYGSHFKEIKADAPKSTKITFGDSDED

SEQ ID NO: 53184 - protein, 242 aa, Bordetella pertussis Tohama I
MLQNREGQRVPSVTFPVRENNAWKQVTTDDVFKNKTVVVFSLPGAFTPTCSSTHLPRYNELAPTFFAAGVDSIVCVSVNDTFVMNERAKDQESANVTLLPDGNGEFTDGMGMLVDKKDLGFGKRSWRYAMLVKDGVVEKMFIEPEKEGDPFEVSDADTMLAYVAPQARKPDQVVVFSKPGCPFCVDAKALLKGKGFDPIEIPLDNKVRGRVIGAVSGGDTAPQVFINGKLIGGFDALKAYLA

SEQ ID NO: 53185 - protein, 293 aa, Elaeis oleifera
MAEEDGRSESSNYTSEDEGTEDYRRGGYHAVRVGDSFKQGAYVVQSKLGWGHFSTVWLAWDTVHSRYVALKVQKSAQHYTEAAMDEIKILKQIAEGDPDDKRCVVKLLDHFKAFGTLWAPCVHGVLSFSGITSHLIKYTLLPGCSLSMVKEICHHVLGVLTTFTVICKLSTLTNAWRTFSWYPTLTLAKDPLRSGFLPLSLAIQVLRTGYPSLLPSWGTLTSELIKNKSSRKSKSEALCCHNGGILGASNFLGNAYGPRIKLALVKWVWELLNTMGHLCHRGDPEQGKAWLNP

SEQ ID NO: 53186 - protein, 277 aa, Xanthomonas campestris pv. campestris str. ATCC 33913
MQKPAVTVMVKAARLAGNVLLRGINKLDALNVVQKGRMDYASEVDADAEKVIIKELKRGYPEYAVFGEEGGVQGGKSGRYTWVIDPLDGTSNYLRGFPHYCVSIALVENGEPTDAVIFDPLRNELFTASRGAGAVLNDRRIRIAERKDLEGAMVHTGFPPRERARASAQLKCVDALLVQAEDVRRTGSAALDLAYVACGRADAYFEAGVKAWDIAAGVLLVREAGGRVCDYKGATPPRMDNMGPETQQIVAGNIKISDALQKVIVNTGYAREFDSKF

SEQ ID NO: 53187 - protein, 426 aa, Colwellia psychrerythraea 34H
MLHSLKNVKLGIIGLGYVGLPLAVEFGKKYPTLGFDINTKRVGELKQGHDFTLEVSSEELADSEFISYSADVDDLKNCNIYIVTVPTPIDKHKQPDLTPLVKASAMLAKVINKGDIVIYESTVYPGATEEVCLPEVERHSGLVFNQDFYAGYSPERINPGDKEHRVTNILKVTSGSTPEISDFIDSLYKSIITAGTYQASSIQVAEAAKVIENTQRDLNIALINELAVIFNKLNIDTEEVLKAAGTKWNFLPFRPGLVGGHCIGVDPYYLTHKAQSIGYNPEVILAGRRINDSMGEYVVSQLVKTMLKRKLPVNGANVLVMGLTFKENCPDVRNTKVVDILSELAEFDINVDVYDPWVNPKDAKHEYDVDLISAPKHSFYDAVIFAVAHDQFKALSADDIKLLMKKDHVIYDLKYMLDKELADIRL

SEQ ID NO: 53188 - protein, 437 aa, Glycine max
MEDEVMSEVAAPPRRVLLVSAGASHSVALLSGNVVCSWGRGEDGQLGHGDTDDRLFPTKLSALDGQDIICVTCGADHTMARSESGRDVYSWGWGDFGRLGHGDHSDLLIPHPIKALQGLMIQQIACGDSHCLAVTMDSQVLSWGRNQNGELGLGTAEDSLLPQKIQIFEEIPIKMVAAGAEHSVAITKDGNLYGWGWGRYGNLGLGDRNDRLLPEKVTVDGDKMAMVACGWRHTICVSSSGGLYTNGWGKYGQLGHGDFEDHLVPRKVQALSDKFILQVSGGWRHSMALTSSGQLLGWGWNKFGQIGVGNNFDCCSPMQVNFPHDQKVQMISCGWRHTIAVTERENVYSWGRGANGQLGNGETIDRNVPTIIEAFSVDGSSGQHIESSKPYPSSGKSSSSISERYAIVPDETASGSQPTTSEEGNRHDTSVPESDVN

SEQ ID NO: 53189 - protein, 348 aa, Kluyveromyces marxianus
MSIPTTQKGVIFYENGGQLYYKDIPVPKPKSNELLINVKYSGVCHTDLHAWKGDWPLDTKLPLVGGHEGAGVVVAMGDNVKGWKIGDLAGIKWLNGSCMNCEECELSNESNCPDADLSGYTHDGSFQQYATADAVQAAHIPAGTDLAQVAPILCAGVTVYKALKTAEMKAGDWVAISGAAGGLGSLAVQYAKAMGFRVLGIDGGEGKEELFKSLGGEVFIDFTKSKDIVGEVIKATNGGAHGVINVSVSEKAIESSIEYCRSNGTVVLVGLPKDAKCKSDVFNQVVKSIHIVGSYVGNRADTREALDFFCRGLVNAPIKVVGLSTLPEIYEKMEQGKVLGRYVVDTSK

SEQ ID NO: 53190 - protein, 236 aa, Thermosynechococcus elongatus BP-1
MSDDAVKQMKQVVAKAAADRVQSGMVVGLGTGSTTAFVIQFLGDRLRKGELSNIVGVPTSFQASVLAKKYGIPLVTLDDVEKLDIAIDGADEVDPAKNLIKGGGAAHTREKIVDSLAEQFLVVVDSSKLVQKLGSTFPVPVEVLPFAVAPVTRALKALGGEPELRMGVKKDGPVVTDQGNFVLDVRFDDIPDPAELEKAINNIPGVVENGLFVNVADVILVGEIVDGQPQVREIFH

SEQ ID NO: 53191 - protein, 365 aa, Sulfitobacter sp. EE-36
MGFKMGIVGLPNVGKSTLFNALTKTAAAQAANFPFCTIEPNVGEVAVPDSRLDKLAAIAGSKQIIPTRMTFVDIAGLVKGASKGEGLGNQFLANIRETDAIAHVLRCFEDGDVTHVEGRVDPVADAETIDTELMLADLESIEKRRAGLVRKIKGNDKDAAQQDRLLAAAQEAIENGKPARTVEVDADDAKAWRMLQLLTTKPVLYVCNVGESEAAEGNALSAKVAEMAAAQGNSHVVISAQIEEEISQLEPEEASMFLDEMGLEEAGLDRLIRAGYELLHLETYFTVGPKEARAWTIKAGTSAPKAAGVIHGDFEKGFIRAETIAYDDFVALGGEGPAKEAGKMRAEGKSYTVKDGDVLHFLFNT

SEQ ID NO: 53192 - protein, 421 aa, Triticum aestivum
RPPPAAGLVDVAAAAEEDDERRGVVLDGSPPPIVLVHGIFGFGKGRLGGMSYFAGAEKKDDRVLVPDLGSLTSIHDRARELFYYLKGGQVDYGVEHSQVYGHTRFGRIYETGHYPVWDEQNPVHFVGHSAGAQVVRVLHQMLAEKAFPGHDTSEDWVLSLTSLSGALNGTTRTYYDGMLAEDGRSMKSICLLQLCRLGVIVYDWLDIPWLKNYYNFGFDHFEMSWRKVGFSGLVDLLLGNTGPFSSGDWILPDLTIQGSLKINSTLKTFPNTFYFSYATKRTRKLFGITVPPTVLGVHPMLFLRVLQMCMWRHPQNAPLPYKGYRDEDWEDNDGALNTISMTHPRIPIEHPNRFVVDDSDCNPLQPGIWYHKIIEGDHILFIVNRERAGVQFDLLYDGIFERCRKHAFRKSPPTMPNEASH

SEQ ID NO: 53193 - protein, 236 aa, Triticum aestivum
  misc_feature (69)..(69): Xaa can be any naturally occurring amino acid
  misc_feature (114)..(114): Xaa can be any naturally occurring amino acid
  misc_feature (118)..(118): Xaa can be any naturally occurring amino acid
  misc_feature (166)..(166): Xaa can be any naturally occurring amino acid
NISKTTQKLGSILKQSRQSTFRSSFSAGKISSAHVQHTLLCINSPTNAIIRRQYHEKVLDHYSRPRNVXSMSKTDADVGTGLVGAPACGDVMKLQIRVDPATKKISDVKFKTFXCGSXAIASSSYLTELVRGMTLDEAGRVRNTEIAKELCPPPVKLHWSMLAEDXLSSPAISNYYTKNPNASPTNLGGTSSKLPHIERENRVDPTIVMIWQYTLFRYEFHIISIQTACLEDCGVT

SEQ ID NO: 53194 - protein, 168 aa, Thermosynechococcus elongatus BP-1
MPLNLATTITLARLLIVPVILGLLSFNNGPVYRWWGVGLFLVAALTDWLDGYIARRFNQVTDLGKVLDPLVDKLLVLVPLLLCIEWGEVPAWSVALILFRELGIASWRVQQSHIQGANLWGKAKTVSQIVAVALLLAPLPPTWQGGILIVYGGAIALTLISGALYLRG

SEQ ID NO: 53195 - protein, 690 aa, Schizosaccharomyces pombe 972h-
MHSLKRRRNHAPDWQDFYKNGVPQEVIVIEDSASPRLTPNLPPPFSVHQLQSFVPPQPPSSSSPSTTGTVAVPINGANAVYPSTNSVSLPQSYDPWLDANGVVPLPHDVASHPSYMVQSPTSYHACSNNQSPFPHSHHPPLHNPLPVSCQPVLRPPPVPQVPSHWYPVSLPSPNLPHQPISKPPVIPNLPKLQVHPNRLPHPIHNHPYSSPTSYPPPLCPATYCPSNPPQLAPATAIAPSSQSSQHKSVNYSVTPSSINNHTAVPLSPTLAVWLPMTQPTFQPPSANVYQPASNANQVITPVSISDYRPPKKRKRAAWPPYKKVDRVNVPVVHDTTAFDPSTFDDDDGHYKVVPNSKFANRYTVVRLLGHGTFGKVIQCYDQSTGRHCAIKVTRAIPKYREASLIELRVLQTIAHSDPTNENKCIQLRDYFDYRKHICIVTDLFGWSVFDFLKNNNYIPFPLKHIQMLSQQLFKSVAFLHSLGLVHTDLKPENVLLVSNASRTIRLPYRNYSQKVLNSCEIRLIDFGSATFEDEYHSSVVSTRHYRAPEIILGLGWSYPCDVWSIGCILVELFTGQALFQTHEDSEHLCMMEKILGPFDRNMISRSSRTSQRFFKSDGKVRYPLSNTPKKSINYLQSLQTLEQIFAVSSPEVALLLDLLKKVFVYDPKRRITAKEALWHPFFTQPISSNL

SEQ ID NO: 53196 - protein, 251 aa, Deinococcus radiodurans R1
MSANPDRFLGRAEVYAAARPDYPPALGNELARRGLLRGQVADLGAGTGLFTRLLLQRGAQVIAVEPNPEMREQLLRALAAEVTRGQLRVQSGTAEATGLPGSSVDLLTAAQAAHWFDPAPTRREFQRVLRPGGQVLFVWNDWREADGPFNEAYGAVVAHFSPEEGRVRTRVPRDELAQWFSGAPEELSFDHPLTFTRERLHALAGSVSYLPAPGSERFPELLARLDQAFDRQARQDTVELTYRTFAFLGRV

SEQ ID NO: 53197 - protein, 258 aa, Vitis vinifera
MSQEQPRRPQSDQEPIKYGDVFPVAGSLADKPVAPQDAALMQSAETAVLGQTQKGGPAATMQSAATRNERAGLVGHTDITNAAGDEGVTVTETDVPGRRIITESVAGQVLGQYVEPTPVSQMNPTVTARQAAITIGEALEATAQTAGNKPVDQSDSAAIQAAEVRATGSTIISPTGVAAAAQSAASMNTGLTRDEDKIKLTDVLSNATARLPADKAVTRQDAEGVMSAEMRNNPNLATHPGGVASSVAAAARLNESVV

SEQ ID NO: 53198 - protein, 463 aa, Zea mays
SLLPSSVQQQASSTPPAAAVAARSKVFGGGVNQARTRTGCRVGITRKNFGRVMMALAVDVSRFEGVPMAPPDPILGVSEAFKADKSELKLNLGVGAYRTEELQPYVLNVVKKAENLMLEKGENKEYLPIEGLAAFNKATAELLLGADNPVINQGLVATLQSLSGTGSLRLAAAFIQRYFPEAKVLISSPTWGNHKNIFNDARVPWSEYRYYDPKTVGLDFEGMIADIEAAPEGSFVLLHGCAHNPTGIDPTPEQWEKIADVIQEKKHMPFFDVAYQGFASGSLDEDAFSVRLFVKRGMEVFVAQSYSKNLGLYSERVGAINVVCSAPEVADRVKSQLKRLARPMYSNPPIHGAKIVANVVGDPIMFGEWKQEMELMAGRIKNVRQKLYDSLSAKDKSGKDWSFILRQIGMFSYTGLNKAQSDNMTDKWHIYMTKDGRISLAGLSLAKCDYLADAIIDSFHNVN

SEQ ID NO: 53199 - protein, 365 aa, Aspergillus fumigatus
MAEFVRAQIFGTTFEITSRYNLQPVGMGAFGLVCSARDQLTGQPVAVKKIMKPFSTPVLSKRTYRELKLLKHLRHENIISLSDIFISPLEDIYFVTELLGTDLHRLLTSRPLEKQFIQYFLYQILRGLKYVHSAGVVHRDLKPSNILINENCDLKICDFGLARIQDPQMTGYVSTRYYRAPEIMLTWQKYDVEVDIWSAGCIFAEMLEGKPLFPGKDHVNQFSIITELLGTPPDDVIQTICSENTLRFVKSLPKRERQPLANKFKNADPEAVDLLERMLVFDPKKRIRAGEALAHEYLSPYHDPTDEPEAEEKFDWSFNDADLPVDTWKIMMYSEILDFHNIDQGNDAGQVLMEGGVAQAQQNYA

SEQ ID NO: 53200 - protein, 140 aa, Arabidopsis thaliana
  misc_feature (59)..(59): Xaa can be any naturally occurring amino acid
  misc_feature (102)..(102): Xaa can be any naturally occurring amino acid
  misc_feature (108)..(108): Xaa can be any naturally occurring amino acid
MASSMLSSATMVASPAQATMVAPFNGLKSSAAFPATRKANNDITSITSNGGRVNCMQVXPPIGKKKFETLSYLPDLTDSELAKEVDYLIRNKWIPCVEFELXTDLCTXVSTVTHPDTMMDGTGQCGKLPLFGLHPTPLKC

SEQ ID NO: 53201 - protein, 338 aa, Yarrowia lipolytica
MEANPEVQTDIITLTRFILQEQNKVGASSAIPTGDFTLLLNSLQFAFKFIAHNIRRSTLVNLIGLSGTANSTGDDQKKLDVIGDEIFINAMKASGKVKLVVSEEQEDLIVFEGDGRYAVVCDPIDGSSNLDAGVSVGTIFGVYKLPEGSSGSIKDVLRPGKEMVAAGYTMYGASANLVLSTGNGCNGFTLDDPLGEFILTHPDLKLPDLRSIYSVNEGNSSLWSDNVKNYFKALKFPEDGSKPYSARYIGSMVADVHRTILYGGMFAYPADSKSKKGKLRLLYEGFPMAYIIEQAGGLAINDNGERILDLVPTEIHERSGVWLGSKGEIEKAKKYPLK

SEQ ID NO: 53202 - protein, 747 aa, Aspergillus fumigatus
MTLTKREFAYTDLASSTALRIHFIWLAVHNFCTSQKAVSNGQGLQAHRGGSSFRPLCEWYVGLCWPCSDDFSSVAHLLGEELYKLLGEYLSRHLEAVYRESLSHTEEALLGFYIREWVRYTTAAKYVNHLFRYLNRHWVKREIDEGKKNVYDVYTLHLVKWKDDFFMKVHEKVMEAVLNLIEKQRNGETIEQSQIKNIVDSFVSLGLDENDNTKSTLEVYRVYFEKPFIAATRVYYENESRQFVAENSVVEYMKKAEARLDEEKARVGLYLHPDIMKRLTDTCLDVLVTAHSELLRDEFQVLLDNERQDDLARMYRLLSRIKDGLDPLRAKFETHVRKAGLAAVEKVAAEGEAFEPKMYQNLVNEAFNGESEFVRSLDNACREFVNRNKVCKSSSTKSPELLARYTDSLLKKGSKAAEESELEEMLVQIMTVFKYIEDKDVFQKFYSKMLAKRLVHVSSVSDDAETSMISKLKEACGFEYTNKLQRMFQDIQISKDLNSNYKDWQEKVLDEDDRKKQVDAHFQILGTGFWPLNPPTTGFSAPPEIVKTYERFQSFYYDKHNGRKLTWLWQLCKGEVKANYIKNTKVPYTFQVSTFQMGILLLFNENDTLTYSDIQKATSLAPEILDPNLAILLKAKVLLPSPEGAKPEPGTSFSLNYNFKNKKIKKVESDDTHKTIEEDRKLLLQSAIVRIMKSRKKMKHVQLVQEVIQQVKSRFPPKVQDIKKNIEALMEKDYIERLDGDEIAYIA

SEQ ID NO: 53203 - protein, 164 aa, Sulfitobacter sp. EE-36
MKRRNFLKCTTMTMAALPFGVGAAAQAGTVAQGDFEVSRTPAEWRAQLGDDAYAVLREGDTERAFTSPLNDEVRKGVFHCKGCDQALYSSETKFKSGTGWPSFFAPLDDAVETMPDKGFFTTRTEVHCDRCGGHLGHVFDDGPAPTGKRHCINGLAMTFTPAAA

SEQ ID NO: 53204 - protein, 250 aa, Mycobacterium smegmatis str. MC2 155
MRLAGKIALITGAANGMGCATAETFSRQGATVVIADVDDEDGLQVAKQIGTSGGTAHFVHLDVTDETAWACAVEDVLGRYERLDILVNNAGISGTFDPDLTSTAFFDRLIAVNARGVFLGIKHGAAAMKHTGGGSIVNLSSISAHIGQLGVHLGYGASKAAVKAMTTTAAVHYAADGIRVNAVAPGMLPPMQTSRGSADPAWRAKQIDGVPLKREGHVQEVADAVLFLASDESSYITGTELMVDGGLTAV

SEQ ID NO: 53205 - protein, 172 aa, Triticum aestivum
  misc_feature (58)..(58): Xaa can be any naturally occurring amino acid
  misc_feature (67)..(68): Xaa can be any naturally occurring amino acid
  misc_feature (83)..(83): Xaa can be any naturally occurring amino acid
  misc_feature (86)..(86): Xaa can be any naturally occurring amino acid
  misc_feature (88)..(88): Xaa can be any naturally occurring amino acid
  misc_feature (104)..(104): Xaa can be any naturally occurring amino acid
  misc_feature (106)..(107): Xaa can be any naturally occurring amino acid
MADRGGERGGHRGGKRGGSGHGFGRGGRGDRGGRRGGRRGPRHDDEKWVSVTKLGRLXRGGGGGIIXXLYLHSQPINDNHILXTLXQXPKDNFINITTIYNYTXSXXLILYKPFLLLHNIHLNLHLLIKSTNYFITSINYITILINLSTFPIPNLYYNKIIHIHYTFHSHSP

SEQ ID NO: 53206 - protein, 206 aa, Physcomitrella patens
MDFSRKLSVALLIAAAILGLASHAEGQVLFSKLPKSLVVTATLPDGKPIGVVKTGEDSILVKWAVNTSAQIPASKVKTKLCFAVESQLLRGWRATKDDLKKDKTCLYNIATQDYTTAGGEVTYMLAKSIPGAKYFVRAYAVNADGVQVATGQSSPNKVANTFTVIPISGRHASIDIAVGVLSVFSVGSLFGFFILERIYLKRKKGV

SEQ ID NO: 53207 - protein, 99 aa, Porphyra purpurea
MADYKIHLLSEDEGIDVTFDCSEDTYILDAAEEAGIELPYSCRAGACSTCAGKVTEGSVDQSDQSFLDDEQLLKGYVLTCIAYPESDCTILTHVEQELY

SEQ ID NO: 53208 - protein, 245 aa, Oryza sativa Japonica Group
MAGRSELVVSFGEMLIDFVTLRADGEREFMFYRNPSADMLLTHAELNVELIKRAAVFHYGSISLIAEPCRSAHLRAMEIAKEAGALLSYDPNLREALWPSREEARTKILSIWDQADIVKVSEVELEFLTGIDSVEDDVVMKLWRPTMKLLLVTLGDQGCKYYARDFRGAVPSYKVQQVDTTGAGDAFVGALLRRIVQDPSSLQDQKKLEEAIKFANACGAITATKKGAIPSLPTEVEVLKLMESA

SEQ ID NO: 53209 - protein, 206 aa, Physcomitrella patens
MASSRMLYLILVATVATLGVASCVEGQVLFSTLPKSLVVTAALPDGKPIGEVKTGEDSILVKWTVNSTASVDAVKLKTKLCFASESQVLRGWRATNDDLKKDKTCLYDIATQDFSRTGGETTYKLSKSIPGAKYFVRAYAINAEGKQVATGQTSPNKVANTFTVIPISGRSTSIDIAVGVLSIFSVSALFGFFIFESIYLKRKKAV

SEQ ID NO: 53210 - protein, 155 aa, Coccidioides posadasii
FDVGGQRSERKKWIHCFENVTTILFLVAISEYDQLLFEDETVNRMQEALTLFDSICNSRWFTKTSIILFLNKIDRFKEKLPVSPMKNYFPDYEGGADYAAACDYILNRFVSLNQAEQKQIYTHFTCATDTTQIRFVMAAVNDIIIQENLRLCGLI

SEQ ID NO: 53211 - protein, 381 aa, Prochlorococcus marinus subsp. marinus str. CCMP1375
MSIFSGNDNAILVLSDGTFIEGKAFGFRGTVSGEIVFNTGITGYQEVLTDPSYFGQLITFTFPELGNTGVNPEDQESDSPSAKGVIARQVSCYASNWRSTKTFEQWLKDEKVVGICDVDTRALVRHLRSSGTMNAIISSENNASPSSLLNTIRQAPQMKGLNLTGEVTTKKPYKWNSLASVDFDERVVNQAMSPFNVVAIDFGIKRSILNRLVAHGCEVNVLPANTSFSEVMSFNPEGVFFSNGPGDPSSVKEGMSLAKRLIEEVDVPMFGICLGHQILGLALGGKTFKLAYGHRGLNHPCGKTGRIEITSQNHGFALDALSLDKDVVEITHLNLNDGTVAGIAMCNRPIFGIQYHPEASPGPHDADHHFSRFVDLMSERR

SEQ ID NO: 53212 - protein, 209 aa, Physcomitrella patens
MDSYRHLSVSLLVLLALLGAVSHAEGFVSFNSLSSKRTLVVTVSMANNSDIKEVHTGQDSILVNWSVNASAPAIVDAKTVETRLCFAKESQTLRGWRKTDDNLKKDKTCLYKIQRQPYAPAGSVTYALPKSIPGAKYFVRAYVFNSSDLQIAYGQSSPNKINNTFTVIPISGRHGSIDAAVGVFSIFSVGSLFAFFIFENLYLKRKKAV

SEQ ID NO: 53213 - protein, 246 aa, Physcomitrella patens subsp. patens
MATEFVSPEGLRLDGRRPPEMRHLHAVVGVVPSADGSALFHMGNTQVMAVVYGPHEVHNKAHQLHDKALVRCEYSMAAFSTGERRRRGKTDRRATELSLVIGQTLEAAIMTHLLPRSQIDIYVQVLQADGGTRAACINAASMALADAGIPMRDLVVSCAAGYLNSTPLLDLNYQEDSGGGPDLVVGYFPKLEKLSLLQMDSKVSIETFEKVLELATEGAKAVATFTREKLLENTRTLASARGHLKI

SEQ ID NO: 53214 - protein, 408 aa, Bifidobacterium longum NCC2705
MVNMKNRFTFRIHRTVSGNTRFSNQSHSPFVWERRFTNATQQNPHNPSNEGLHMTIHNSLAELIGNTPLVKLNHIPQAAGVKATIAVKVEYFNPGGSSKDRIAERIIDAAEQSGQLKPGGVIVEPTSGNTGVGLALVAQQRGYRTIFTLPDKVSESKRAVLRAYGAEVIVTPTDAGPDDPRSYYQVAERLANTIPGGFRPNQYDNPNGPLSHYYTTGPEIWEATDHKVTHFVAGIGTGGTISGTGKYLKEASNGAVKVIGSDPEGSIYSASSRDEVHQYDIEGVGEDFYPKAFDRNITDDIVRVSDAEAFEMTRRLAGEEALLVGGSSGMAVASAIKYALANDLDENQIVVVLAPDSGRSYLEKIFNDDWMRANGYGDIVERTSKPSLAEQYLNGAPSDEGAGDGLHN

SEQ ID NO: 53215 - protein, 363 aa, Psychrobacter arcticus 273-4
MGFNCGIVGLPNVGKSTLFNALTKAGIAAENFPFCTKDPNTGIVPVPDPRLKKLADIVNPERVLPTTMEFVDIAGLVAGASKGEGMGNQFLANIRETDAIAHVVRCFDDDNVVHVDGRVSPIDDIETINTELALADLEAVERAIFNLTKKAKGGDKDAQAMLDIFKKIEPLLAEGQAARAANLDADEKKLIRSYGLITLKPTMYIANVSEDGFENNPYLDAVRNYATGEDSIVIALCNQIESEIAQLDEDDKKDFLAEMDMEEAGLDQVIRGGYDLLDMQTYFTAGVKEVRAWTVAVGATAPQAAGVIHTDFERGFIRAEVIAYDDFIEHNGEKGAAAAGKSRLEGKTYIVQDGDVMHFRFNV

SEQ ID NO: 53216 - protein, 338 aa, Burkholderia thailandensis E264
MNLQKFPRYPLTFGPTPIQPLKRLSAHLGGKVELYAKRDDCNSGLAFGGNKTRKLEYLIPDALAQGCDTLVSIGGIQSNQTRQVAAVAAHLGMKCVLVQENWVNYHDAVYDRVGNIQMSRMMGADVRLVPDGFDIGFRKSWEDALADVRARGGKPYAIPAGCSDHPLGGLGFVGFAEEVRAQEAELGFKFDYVVVCSVTGSTQAGMVVGFAADGRADRVIGIDASAKPAQTREQILRIARNTADRVELGRDIASGDVVLDERFGGPEYGLPNEGTLEAIRLCAKLEGVLTDPVYEGKSMHGMIEKVRLGEFPAGSKVLYAHLGGVPALNAYSFLFRDG

SEQ ID NO: 53217 - protein, 171 aa, Wolbachia endosymbiont of Drosophila melanogaster
MYHILKYKDYEPKIDESAFIAGGSHIIGKVEIGRDASIWFNCVIRGDVGSIKIGNGTNIQDGTVIHVDRNPGGDTIIGSMVTVGHFCVLHACTVHDKAFIGMGSTVMDHAVVEPEAMVAAGSLVTHGKVIKSGEIWAGRPAKFFKKMSNEEIKHITQSAQNYIMLMKEYKN

SEQ ID NO: 53218 - protein, 301 aa, Bacillus cereus E33L
MRKWGIELLILAVVIIWGINFTIAKYGLLEFTAIEFTALRMISAAPLMLLLTFFIEKSVYMERKDIPRLIIVSVVGIVLYQTLFMETVKYTSATNASLLISISPIFTTVFAIFLKQEKFSSRKLIGSIIAFGGAALVLVAGHSLASSFYGNGIGLITSICWGLYPVLAGPLIKKYSALRVTAWSALVGAIPLLLLSGPHVFTMPFHITHGMTLFALLYSIFFVTVFGLVMWYVGVQKIGASHTMVYMYITPLIAVLFAAVWADEYVSFQQIIGGIIIFFGLWFVKSEKVNIHSTAGEPISK

SEQ ID NO: 53219 - protein, 458 aa, Xanthomonas campestris pv. campestris str. ATCC 33913
MNEFSALPLSPALAPGIDALGYTTLTPIQAQSLPPILQGLDVIAQAPTGSGKTAAFGLGLLQKLDPALTRAQALVLCPTRELADQVGKQLRKLATGIPNMKLLVLTGGMPLGPQLASLEAHDPQVVVGTPGRIQELARKRALHLGGVRTLVLDEADRMLDMGFEEPIREIASRCDKHRQSLLFSATFPDIIRTLARELLKDPVEITVEGADNAPEIDQQFFEVDPTYRQKAVAGLLLRFNPESSVVFCNTRKEVDEVAGSLQEFGFSALALHGDMEQRDRDEVLVRFVNRSCNVLVASDVAARGLDVEDLAAVVNYELPTDTETYRHRIGRTARAGKHGLALSLVAPRESARAQALEAEHGQPLKWSRAPLATARPAQLPLAAMTTLRIDGGKTDKLRAGDILGALTGEAGLSGAAIGKIAIYPTRSYVAIARAQVARALTHLQAGKIKGRRFRVTKL

SEQ ID NO: 53220 - protein, 186 aa, Xanthomonas campestris pv. campestris str. ATCC 33913
MNDCSRCAGSTSSGPAHWSGRIRDIADFPKPGIVFKDITPLLSDGPDFASALDEMAQPWRTTPLDAVLGIEARGFILGAALARELRTGFVPVRKPGKLPGRTLIQEYALEYGTDRIEMHEDALPRGARVLIVDDVLATGGTLRAALGLAAQLELEIVGAAVLVELLALQGRSKWLNDVPLLATLSY

SEQ ID NO: 53221 - protein, 274 aa, Glycine max
  misc_feature (260)..(260): Xaa can be any naturally occurring amino acid
MADRVHPSHSPSVSADSQPASPQDSSVVPKPPLPPSSEKPVPPPGTYVIKIPKDQVYRVPPPENARRYDQYTRRKHRRSRCCCCFCWLIGILFILVVFLAIAAGVLYLVFRPEEPKYSIENIAVRGINLTSPSSTAAMSPVFNVTVKADNPNDKIGIRYLKDSSAEVFYKDARLCNGALPAFYQPSNNVTVFGTALRGDGIELRSEVRRALLEAQTKRRVPLTVKIRAPVKIKVGSVKTWKITVKVNCHMTVNELTARAXKIVSKRCNYDVDLW

SEQ ID NO: 53222 - protein, 518 aa, Xanthomonas campestris pv. campestris str. ATCC 33913
MTHLQFDNRLRAELPGDPEEGPRRREVLAAWSAVQPTPVAAPTLLAYSADVAQRLGLRAEDLASPRFAEVFGGNALYPGMQPWAVNYGGHQFGHWAGQLGDGRAISLGEAIGVDGGRYELQLKGAGPTPYSRGADGRAVLRSSIREFLCSEAMHYLGVPTTRALSLVGTGDAVVRDMFYDGHPRREPGAIVCRVAPSFIRFGNFELPAARGDVDLLRQWVDFTLARDFPDLPGSGEDRIASWLGQVCERTAVMVAHWMRVGFVHGVMNTDNMSILGLTIDYGPYGWVDDYDPDWTPNTTDAQGRRYRFGTQPQVAYWNLGRLAQALSPLFGDAAPLQAGLDQFRDTYLACDRRDTAAKLGLAECQDEDLHLIDDLRALMREAEMDMTLTFRGLVDLSPQQPDASVLREAFYDETKRAAQAPALGAWLQRYAARCLQDGASDAVRASRMRAANPRYVLRNYLAQQAIDQAEQGDLSGVHALLEVMQRPYDDQPRRESFAAKRPDWARDRAGCSMLSCSS

SEQ ID NO: 53223 - protein, 77 aa, Brassica napus
  misc_feature (7)..(7): Xaa can be any naturally occurring amino acid
  misc_feature (45)..(45): Xaa can be any naturally occurring amino acid
  misc_feature (53)..(53): Xaa can be any naturally occurring amino acid
  misc_feature (59)..(61): Xaa can be any naturally occurring amino acid
EKEEVVXAYSMLSSAAVVTSPAQATMGAPFTGLKSSSAFPVTRKXNNDITSIXSNGGRXXXVPSIFASINLPSLPLP

SEQ ID NO: 53224 - protein, 490 aa, Pseudomonas putida
MVSIPPYENLHLLRIGDQWREGSGVDTLTVNDPYTLAVLVKIRQGTRIDVDEAYAAAEDSQRKWAMAGPAARASVLHKAAEIFDRRKEEIIDWLIREAGSTRIKATIEWGAARSITQESASLCSRVSGHLLESNVPAKENRVYRLPIGVVGVISPWNFPLHLTQRSVAPALAVGNAVVIKPASDTPVTGGLLLAKIFEEAGLPPGLLNVVIGSGGEIGDYFVEHATPGFISFTGSTAVGKRIGSNAFRGGHIKHVALELGGNSPFIVLADADLKQAVNAAVVGKFLHQGQICMAINRIIVEDSIYEEFVGQFIARVSELKWGDPAKGDTVIGPIINAKQLDGLLGKIELARQEGAKLVCGGNPVGNVLPPHVFVDVTPEMEIAKEEIFGPLVGILRARDAEQALQMANKSEFGLSSAIFTGDLERGVNLARRIKAGMTHINDIPVNDEPHVPFGGEKNSGLGRFNGQWVLDELTTLHWISVQHAPRHYPF

SEQ ID NO: 53225 - protein, 584 aa, Oryza sativa Japonica Group
MSAAVGGAEFHGFRGGGGGAAQLQRSRMLGRPLRVATPHAAAPAGGGGSSSASIRAVSAPLKKDASEVKRSKVEIIKEKSNFLRYPLNEELVSEAPNINDSAVQLIKFHGSYQQTDRDVRGQKNYSFMLRTKNPCGKVPNQLYLAMDTLADEFGIGTLRLTTRQTFQLHGVLKKNLKTVISTVIKNMGSSLGACGDLNRNVLAPAAPYVRKDILFAQETAENIAALLTPQSGAYYDLWVDGEKIMSAEEPPEVTKARNDNTYGTNFPDSPEPIYGTQYLPRKFKIAVTVAGDNSVDILTNDIGVVVVSDSAGEPVGFNIYVGGGMGRTHRVETTFPRLADPLGYVPKEDILYAIKAIVVTQRENGRRDDRRYSRMKYLIDNWGIEKFRAEVEKYYGKKFEDSRPLPEWQFNSYLGWQEQGDGKLFYGVHVDNGRVAGQAKKTLREIIEKYNLEVSITPNQNLILCGIDQAWKDPITAALAQSGLLEPKDVDPLNITSMACPALPLCPLAQTEAERGILPILKRIRAVFDKVGIKDHESVVVRITGCPNGCARPYMAEVGFVGDGPNSYQIWLGGTPNQKKKMCL

SEQ ID NO: 53226 - protein, 602 aa, Physcomitrella patens
MQGTMQSQMWRGQVSGASLHFTGATRVQGNSHQDLVYPTQFHKHGVRASAEREVKAKAVAAPPTIAADRLVPRVEERDGYYVLKEEFRQGINPSEKIKIAKEPMKFFMENEIEELAKTPFAELDSSKAGKDDIDVRLKWLGLFHRRKHQYGRFMMRFKLPNGITNSSQTRFLAETISKYGEYGCADLTTRQNWQIRGIVLEDVPALLKGLESVGLSSLQSGMDNVRNPVGNPLAGIDPDEIVDTAPFCKVLSDYIINRGQGNPQITNLPRKWNVCVVGTHDLFEHPHINDLAYMPATKNGVFGFNILVGGFFSPKRCAEAIPMDAWVPADDVVPLCKAILETYRDLGTRGNRQKTRMMWLIDEMGIEEFRAEVERRMPGGSILRAGKDLVDPSWTRRSFYGVNPQKQPGLNYVGLHIPVGRLHAPEMFELARIADEYGNGEIRISVEQNLILPNVPTEKIEKLLKEPLLEKYSPNPTPLLANLVACTGSQFCGQAIAETKARSLQLTQELEATMETTRPIRLHFTGCPNTCAQIQVADIGFMGTMARDENRKPVEGFDIYLGGRIGSDSHLGELVVPGVPATKLLPVVQDLMIQHFGAKRKT

SEQ ID NO: 53227 - protein, 283 aa, Porphyra purpurea
MLTNTERVKVLSDVTILQKFSSRIIVIKYGGAAMKNQKLKDHVISDLVFLSFIGLRPILVHGGGPEINFWLDQLKILPKFENGVRVTDQPTMDIVEMVLVGRVNKDLVASINKQGGKSVGLSGKDGLLITSRPSDKPNLGFVGEVQNVDTNLLEILINNNYIPVIASVAADKQGQSYNINADTVAGEIAARLNAEKLILLTDTPGILRNASDATTLISHLSIQEARDLTKTAVISGGMIPKVNCCIRSLAQGVASAHILDGRIDHALLLEILTDQGIGSMLVV

SEQ ID NO: 53228 - protein, 241 aa, Zea mays
  misc_feature (42)..(42): Xaa can be any naturally occurring amino acid
  misc_feature (150)..(150): Xaa can be any naturally occurring amino acid
  misc_feature (200)..(200): Xaa can be any naturally occurring amino acid
HWDPRGRPGYCFAPHTDAQRIGLCRQERVLFASYLRMKAVRXMIMGHPLDFFNHHLNRLLPPHRADFYSIIHAMTALPEAIKLLYPPLHKDLPHGNILDVVGDFCADTFALHENALRANCPAFQHAGPMLGFRALTLGTSYPELYDMHRXTIFEAAITMTNQAAQVIPDIMSPLDGTPQQLAHQVTLIRQDDEKVFDYGXQTIGNKVGTMIEIPTAALEPDDIAEQDEFFSFGTNDLTQMT

SEQ ID NO: 53229 - protein, 494 aa, Psychrobacter arcticus 273-4
MHHVKQLINGQFVDSNTSEWIDITDPATQEVIAKVPQTTDDEINQAVAAAQKAFQTWRKTPITTRARIFLRYQALIRDHMDELAEILTAEQGKTIADARGDVFRGLEVVEHAAGIANLQIGDFVENVASGVDTYSIWQPLGVCAGITPFNFPAMIPLWMFPMAIATGNTFILKPSEQDPMVTMRLVELAVEAGVPEGVLNVVHGGKATVDAICDHPDIKAVSFVGSTNVGKHVYERASQSGKRAQCMMGAKNHGVILPDANKEQTLNQLAGAAFGAAGQRCMALSVVVLVGAAGEWIDDIKAKAEGLIVSAGKHDKDLGPLISPAAKARVEHLIGTGVEEGASLILDGRGITVEGYEKGNFVGPTIFDNVTSDMQIYQQEIFGPVLCIMRANSLDEAIELLNANPHGNGTAIFTQSGAAAHKFQQDIQVGQIGINLPIPVPLPMFSFSGSRASKLGDLGPYGKQAVQFYTQTKTVTARWFDDEASRGVNTTISI

SEQ ID NO: 53230 - protein, 224 aa, marine gamma proteobacterium HTCC2080
MTDFKIAPSILSADFARLGEEVDTVLAAGADIVHFDVMDNHYVPNLTIGPMVCQALRNHGVVAPIDVHLMVQPVDNLISMFADAGATYITFHPDASTHVDRSLQLIRGAGCKSGLVFNPAASLEALKYVMDKVDMILLMSVNPGFGGQKFIPATLDKLREVRALIDASGLDIRLEVDGGVGPGNIAEIAAAGADTFVAGSAIFNQPDYRAVIDEMRRELASVHS

SEQ ID NO: 53231 - protein, 321 aa, Psychrobacter arcticus 273-4
MATNDKGSSNTTTTDNDGTTAKPNIAFIGLGNMGGPMAENLLKAGYTLSVYDLSAEATARLQQAGANIANSPKDAAQNAQVVISMLPAGKHVHSVYLGEDRSKGLLADLPKGTLVIDSSTIAAADARKVAEAASKLGIDFLDAPVSGGTGGAIAGTLTFIVGGSDDAFAKAEPILAVMGKNIFHAGEHGAGQVAKICNNMLLGILMAGTAEAINLGVKNGLDPKVLSDIMLQSSGRNWTLEVYNPYPQVMENVPSSNGYQGGFMSKLMQKDLNLAMQTAQDTNVETPMGAKATELYAAHTVENGDRDFSSIMARYDSSVLS

SEQ ID NO: 53232 - protein, 72 aa, Methanopyrus kandleri AV19
MIIPIRCFTCGRPIAHLWEKYVELIEEEGMEPGEALDELGVDRYCCRRMFLSHVDLLEESLPYTPPRLGMPR

SEQ ID NO: 53233 - protein, 510 aa, Cytophaga hutchinsonii ATCC 33406
MIKQLQLFDFSQKIHYRTEILAGLTVAMTMIPESLSFAILAGFPPLMGLYGAFIMGIVTAIFGGRPGLISGGAGATVIVLIALMKSHGIEYVYGAIALAGIIQILIGIFRFGKFIRLVPQPVMFGFVNGLAIIIFMSQLNQFQTVVNGQTEWLSGIPLFIMAALVALTIIIVLLLPRITKAIPGSLAAILIVFGIVTFFGIDTRQVIDIASISGSLPPFHIPAIDISIESFNILFPYALVMAAVGLTEGLLTLNLVDEITGTKGRSNKECIAQGGANMLNGFFSGMGGCPMIAQTLVNLSAGSRARLSGIVAALTILLIILIGAPVIERVPLAALTGVMIMVAAGTFEWASFKAIRRMPTADIFVMAVVTIITVFLHNLALAVLIGVIISALVFAWESAKRIRARKFIDAHGVKHYEIYGPLFFGSTANFSEKFDVQNDPAEVVIDFKESKISDMSAIDAVNKITERYASINKKVQLKHLSEDCRLLLKNADSLIEVNILEDPTYKVMTD

SEQ ID NO: 53234 - protein, 628 aa, Zea mays
MDHSSDEDTEISDSEIDDYEGKIYARLMSGDLKLNKNGENYICPFCSSKKKNYSKSSLVQHASGVSAAPNREAKEKAVHRALFKYLKNGLAKSPEPGSHATPVEPQPLQNRDEKFVWPWMGVLVNVPTEWKDGRQIGESGNRLKEQLSHFCPLRVIPLWTFRGHTGNAIVEFGKDWNGFRNARTFESHFAAGGFGKKDWIGKKNQGSELYGWLARAEDYNSPGIIADHLRKNGDLKSVNDLAKEGARKNDRLVANLANQIEVKNRYLQELECKYSETTASLEKMMGQREQLLQSYNEEISKMQQLARRHSQKIIDENQKLRSDLEAKMNDLDVRSKQLDEIAAKSDYDRRSLEQEKQKNAIKSSHLKLATLEQQKADENVLKLVEEQKREKHAALKKILMLEQQLDAKQKLELEIQQLKGKLKVMEHMPGDEDSASKNKINELSEALQEKIDELDGMESLNQTLVIKESKSNIELQEARKELENGLLDLSGGQTHIGIKRMGELDLKAFSKACQKERTENAEVTAAFLCSKWEAEIKNPDWHPFRVVTIDGKEMAIIEDDAKLRALKEEHGEEIYAMVTKALLETNEYKSKGSYPVGELWNFKENRKVTLKEAVQFVLRQWRTNRRKR

SEQ ID NO: 53235 - protein, 437 aa, Thermosynechococcus elongatus BP-1
MAVQMEFSMKRVLAIILGGGAGTRLYPLTKRRAKPAVPLAGKYRLIDIPVSNCINSEIHNIYVLTQFNSASLNRHIARTYTFPGLTGGFVEVLAAQQTPENPNWFQGTADAVRQYLWLLADWDVDEYLILSGDHLYRMDYRLFVQRHRDTGADVTLSVLPVEEKAASGFGLLKVDGTGRVTDFREKPTGDALRDMRVDTTRYGLTIEEAHRKPYIASMGIYVFKRQVLIDLLQQMADATDFGKEIIPAAARSHLVQTYLFNGYWEDIGTIGSFYEANLALTQQPQPPFSFYDENAPIYTRPRYLPPSKILSSTITESIISEGCILKECQVHRSVLGVRSRVESGCVIDHSLLMGADYYQDSAQRSQLRLQHKIPIGIGANSVIRRAIVDKNACIGRDVKIINKDNVEESNREDQGFYIRSGVVVIIKNAVIPDGTII

SEQ ID NO: 53236 - protein, 258 aa, Deinococcus radiodurans R1
MSTAPKPTVQNPFASADAAGRYAAGRPAFHLLVLSRLAPHLTGRELGADVACGTGLSSAALAELVGEVRAFDASAAMLAEAAPHPRVTYAQAPAEALPLADGVLDVMTVAQAFHWFDHAAFLAEARRTLKPGGVLALYDDFFLGEMEGEPNFGTFAKTYLARYPTPARHRDPFGETEAQAAGFTFHEETWKHPLALTQPQLVAYLLTHSNTLAATENGTASQDEIAEWLNEQLAPFYAGGGTRNVVYGALLTVLRREG

SEQ ID NO: 53237 - protein, 511 aa, Burkholderia vietnamiensis G4
MSAIPNSDPPGSPANPPTLHRALKARHLTMIAIGGSIGTGLFVASGASISQAGPGGAMVAYMLIGLMVYFLMTSLGEMAAFMPVSGSFATYGAKYVDEGFGFALGWNYWYNWAVTIAVELVAAQLVMHYWFPDVPGVWWSAAFLAVMFLLNALTVRGFGEAEYWFALIKVVTVLAFIGVGLLMIFGILKGAPANGWGNLTIGDAPFAGGLPALMGVAMIAGFSFQGTELIGVAAGESEHPRTTIPRAVRQVFWRILLFYVLAIFVIGVLIPYTDPNLLKSDVTDIGVSPFTLVFRHAGLAFAAGVMNAVILTAVLSAGNSGMYASTRMLYNLATEGRAPKLFAKLSPGGVPRNALYATTAVGALCFFTSLYGDKTVYLWLLNTSGMTGFIAWLGIAISHYRFRKGYVTQGYSIDQLPYQSKWFPFGPLFAFVLCMVIALGQDYQAFLANRIDWAGVAATYVGIPLFVVVWLGYRLMNRSRFVRYEDMEIAPWIAANRGGAAPRVENRETAG

SEQ ID NO: 53238 - protein, 184 aa, Salmonella enterica subsp. arizonae serovar 62:z4,z23:--
MVEQILTDLQKAQPAWSIALLRYFNPVGAHPSGDMGEDPQGIPNNLMPYIAQVAVGRRESLAVFGNDYPTEDGTGVRDYIHVMDLADGHIVAMEKLADKSGVHIYNLGAGVGSSVLDVVNAFSKACGKPINYHFAPRRDGDLPAYWADAGKADRELNWHVTRTLDEMAQDTWRWQSRHPQGYPD

SEQ ID NO: 53239 - protein, 520 aa, Kluyveromyces lactis
MNEYDAVDRHTFKVFNQDFTVDKRFQLIKEIGHGSYGIVCSARFTEAADETTVAIKKVTNVFSKTLLCKRSLRELKLLRHFRGHKNITCLYDMDIVFQPDGMFNGLYLYEELMECDMHQIVKSGQPLTDAHYQSFIYQILCGLKYIHSADVLHRDLKPGNLLVNADCQLKICDFGLARGYSENPVENNQFLTEYVATRWYRAPEIMLSYQGYTKAIDVWSCGCILAELLGGKPIFKGKDYVDQLNRILQVLGTPPEETLKRIGSKNVQDYIHQLGYIPKIPFSTLYPNANPDALNLLEGMLSFDPQLRITVDDALQHPYLSIWHDPADEPICTEKFDFSFESVNEIEQLKQMVIDEVTDFRQYVRLPLLHEQQQQQGKTDGGFDDQIREDQRTFQAQLEEQVNNGRTASNVPSFDEPFSSQMMGSASQQDPLVGIHSDNLPSHELDFPPRPSENVLDSPMGLSHQQTHNGSPECQDINDLLGLERELEFGLDRQFNETVWYIASSTLFVEHKLLLRFCYT

SEQ ID NO: 53240 - protein, 410 aa, Bradyrhizobium japonicum USDA 110
MGHDACQEMTMSFLAAALDRVKPSATIAVTDKARALKAAGRNVIGLGAGEPDFDTPANIKLAAIHAIEAGKTKYTAVDGIPELKEAIIAKFQRENGVVYKPNQVIVGTGGKQVLYNALMATINPGDEVIIPAPYWVSYPEMVALAGGEPVPVVCTAATGFKLGAEALERAITPKTKWVILCSPSNPTGAAYTRAELKALTDVLVKHPHVWVMTDDMYEHLVYDDFQFTTVAQVEPSLYDRTLTVNGVSKAYCMTGWRIGYAGGPAQLIKAMATIQSQSTSNPCSIAQWASVEALNGPQDFIPANNKVFKERRDLVVSMLNQANGIECPRPEGAFYVYPSCAGTIGKKAPSGNVISNDEQFVTELLETEGVAVVQGSAFGLGPAFRISYATKTSDLEDACKRIQRFCGNLR

SEQ ID NO: 53241 - protein, 204 aa, Brassica napus
AGCVLHTAAVSRESEMAAAAAAKEDGQDPRIPKIASSIRVIPDFPKPGIMFQDITTLLLDTEAFKDTIDIFVERYKCKGISVVAGVEARGFIFGPPIALAIGAKFVPMRKPKKLPGKVISEEYSLEYGTDKIEMHVGAVEPGERAIIIDDLIATGGTLAAAIRLLERVGVKIVECACVIELPELKGREKLGEAPLFILVTSDAA

SEQ ID NO: 53242 - protein, 638 aa, Mycobacterium smegmatis str. MC2 155
MLEQVRGPADLQHLSQSQLRDLAQEIRQFLIHKVAATGGHLGPNLGVVELTLALHRVFDSPHDPIIFDTGHQAYVHKMLTGRSEDFDTLRSKDGLSGYPSRSESDHDWVESSHASAALSYADGLAKAFELTGHRNRHVVAVVGDGALTGGMCWEALNNIATSRRPVVIVVNDNGRSYAPTIGGLAEHLAALRLQPGYERVLEEGRKAVRGVPLIGELCYQCIHSIKAGIKDAIAPQVMFTDLGIKYVGPIDGHDEHAVESALRHARGFNAPVIVHVVTRKGMGYAPAENDEADQMHACGVIDPETGLPTKASGTSWTSVFSDELISQAAKRRDVVAITAAMPGPTGLSAFRDRFPDRFFDVGIAEQHAMTSAAGLAMGGLHPVVAIYSTFLNRAFDQLMMDVALHKLPVTMVLDRAGITGPDGASHNGMWDLSILGIIPGIRVAAPRDGARLRAELGEALAVNDGPTAIRFPKGDVGEDIPAVQRRDGVDVLAVPATGLTHDVLLVAVGSFAKMALAVAELLRSQGIGVTVVDPRWVLPVPEALADLARDHKLVVTVEDNGLHGGIGSSVSAALRHAEIDVPCRDVGVPQQFQDHASRGEVLAEVGLTDRHIARQITGWVAAIGTRSAAEDEVGQTLD

SEQ ID NO: 53243 - protein, 468 aa, Solibacter usitatus Ellin6076
MTDTYDLIAIGSGPAGESATELAAFFGHRCAVVERARPGGTVTTTGGAPTKTLREAALYFSGLVDGDVYGIKISTPPEVATEVIRKRTWHVCDLLQKVTGENIAKNNVDYIQGAARLEGDGKVMVTGDDGSRRRLRANVLLLATGSRPRRPPNIPFDLAGVCDTDTILQRGRVPKDILIVGGGPVGVEFATIAHALGAKVTLADRGNRLMSMMDGEITECMEELFRTWGIRVLFGSTCNSVVAKDDALEITMSTGERLSPDTVLFAAGRVPNTGDLGLDAAGVAMDARGRIVVDQQFRTSAEGVYAAGDVLGPTLASIAMEQGRVAICHAFGIPFEGIVDPAPVSAVYGMPEVSGAGRTEEECREMGVDYEVGRADLARTPRGAIAGRGGRLKLIFQKEDRRLIGVHCIGDIASEIVGIGQMTIRCGGTIHTIANMSFNTPTYSYAYKYAAFDGLRKLAAQGQTGEYK

SEQ ID NO: 53244 - protein, 297 aa, Actinobacillus pleuropneumoniae serovar 1 str. 4074
MSYSLSTDLSVIQQRINDFLSTKLKTYPAYDSALIEAMSYAVLLGGKRVRPFLIYATGRMLDVPFEQLDHSAAAMEAIHAYSLVHDDLPAMDDDKLRRGKPTCHIAFDEATAILAGDALQSFAFELIAQDESLTDSQKVRQIQSLAQAAGARGMCLGQSLDLLAEDTAVNLAELELIHRNKTGALIIASVLMGFNLSAHSQNLAIKQPLERYAQAIGLAFQVQDDILDVIGETDKIGKTVGSDENLHKSTYPKLLGLEGAQQKAQDLYQTALNALEELPFDTTALKELAHFIVKREN

SEQ ID NO: 53245 - protein, 358 aa, Glycine max
MAVIPCHCYRTVGSDKPYLSGQSLRRRAPFPAVSVSFRRRISCVASSAIAHKVGLKDFLHLDDFDKDTILKMLDRALEVKALLKSGDRSFRPFEGKTMAMIFTKPSMRTRVSFETGFTLLGGHAIYLGPDDIQMGKREETRDIARVLSRYNDIIMARVFAHKDILDLAKYATVPVINGLTDYNHPCQIMADALTMVEHIGRFEGTKVVYVGDGNNIVHSWLLMASVIPFHFVCACPKGFEPDAKTVEKARKAGISKIEITNDPKEAVKGADVVYSDVWASMGQKEEAEYRRQVFKGFQVNQNLMDLAGSKAFFMHCLPAERGVEVTDEVIEAPNSIVFPQAENRMHAQNAVMLHVLAK

SEQ ID NO: 53246 - protein, 158 aa, Actinobacillus pleuropneumoniae serovar 1 str. 4074
MIRIGHGFDVHAFGQDRPLMICGVEVPYHTGFIAHSDGDVALHALTDALLGAVALGDIGKLFPDTDMQYKNADSRKLLIEAYRQVRAQGYKVANVDVTIIAQAPKMRPYIDQMRQTIADDLQCDAMQVNVKATTTEKLGFTGRGEGIACEAVALLIKQ

SEQ ID NO: 53247 - protein, 379 aa, Hordeum vulgare subsp. vulgare
MATAGKVIKCKAAVAWEAGKPLTMEEVEVAPPQAMEVRVKILFTSLCHTDVYFWEAKGQTPMFPRIFGHEAGGIVESVGEGVTDVAPGDHVLPVFTGECKECPHCKSAESNMCDLLRINTDRGVMIGDGKSRFSIGGKPIYHFVGTSTFSEYTVMHVGCVAKINPEAPLDKVCVLSCGICTGLGASINVAKPPKGSTVAIFGLGAVGLAAAEGARIAGASRIIGVDLNASRFEEARKFGCTEFVNPKDHTKPVQQVLADMTNGGVDRSVECTGNVNAMIQAFECVHDGWGVAVLVGVPHKDAEFKTHPMNFLNERTLKGTFFGNFKPRTDLPNVVEMYMKKELEVEKFITHSVPFSEINKAFDLMAKGEGIRCIIRMDN

SEQ ID NO: 53248 - protein, 193 aa, marine gamma proteobacterium HTCC2080
MILMLDNYDSFTWNIVQYLWELGAEVEVHRNDEIDIEGIERLAPAGICISPGPCSPKEAGISMQVIEHFSGKLPIFGVCLGQQSIGAVFGGDVVRAEKVMHGKTSAVHHTGQGVFKNLPSPFNATRYHSLVVAEASLPECLEITAWTETPDGDREAIMGLRHRELAVEGVQFHPESILSEHGHALLQNFLDRL

SEQ ID NO: 53249 - protein, 194 aa, Legionella pneumophila str. Lens
MNNLVEKKEAFRFGVSGDIGSFSEEAALLYAKEKDINVHLVHLLDMEGVLNAIENETIDLGILPVVNLLGGLVKPAFQAMGKYSFTPIDEIWHDINQCLLVKTNTQHHKITHIVSHPQGFAQCKKFLRNKFRNAKKIEWIDTAKAARDLAEGILPPYTAVIASARCAPLYGLQISARNIQDSYQNKTAFILVKK

SEQ ID NO: 53250 - protein, 177 aa, Wolbachia endosymbiont of Drosophila melanogaster
MLKKNVPNLLTISRALAIPAIILSFYIENKYAGLITISIFVFACITDFFDGYLARAWKVQSKFGKLFDPIADKLIVVSTIIMLVYKHKINDFTIVPSIIIICREILVSGLREFLIATNVSLPVSKAGKIKTFLQMVAVVALIMNDYYMIQYTGAICLWVAAIITMWSGYNYILAGIK

SEQ ID NO: 53251 - protein, 440 aa, Wolbachia endosymbiont of Drosophila melanogaster
MNDDLDSTTKQEALKYHSRGGNPGKISIMPTKPLSTQYDLSLAYSPGVAAPCLEIAKNPEVVYDYTAKSNCVAVISNGTAVLGLGNIGPLAAKPVMEGKAVLFKRFADIDAVDIEVGTENIEDFINAVRYLGPSWGGINLEDIRSPDCFIIEKRLNELMDIPVFHDDQHGTAVVVAAGIENALDIVEKKLEDVKIIMNGAGAAGIACLEILKSMGAKNIVLCDKQGVIYKGRNEDMNEWKEKYAIDTSERSLLDTIKGADVFIGLSAKDVLNEEMLKSMGKDPIIFALANPDPEVRPEFAKSVRPDAIIATGRSDYNNQVNNVMGFPYIFRGALDVHATTINDEMKIAAADAIAKLAREPVPGEISAVYGSRKMGYGREYIIPTPFDPRLISIVAPAVAKAAVDSGVARKAIQDWSKYENQLKSRLSNVLSTLNLLSSHM

SEQ ID NO: 53252 - protein, 388 aa, Legionella pneumophila str. Lens
MNQCEKKNLPKDSATVAINSLAQQKINAGIKIHNLSAGEPKLPPHPSIINAVTQAMEQGHTLYPPIMGIPELRHLGCEWMHRSYDCSFQNEQCLVVNGGKLGIYLLMQLLLQPNDEVIIPSPYWVSYPAMVSLFGGTPVPVETTEAEEWKLTPQALQKACTTKSKILILNNATNPTGALYTQSELIHLLQTAKKHNLLVISDEVYSELTYDGHHYVSCGSLPQFRESVIIIQSCSKNFSMTGWRVGFIFAPEVFIKPLSALVSQSTSGVTTLSQWAAVAALQEVNQVNIWVQQNMEKRRNCLLRTLHDYLGLTITPPISSLYVFLSLKDIGCKNQNSEEFCKQVLDKANVAMVPGIAFGKEGYVRLSFGGNEDDLKSGIYALAQWLHR

SEQ ID NO: 53253 - protein, 270 aa, Psychrobacter arcticus 273-4
MQLEINVIDAFTDTVFKGNSAAVIITESWLSEKLMQSIAFENNLSETAFIVLDNKGTYHIRWFSPLTEIDFCGHATLASAFVLFKKNPTLTSIKFSAKAVGVLTVKQTDHDKIQMDFPNTKPEKVSDIPDSLLAGLSIAPVEVYKNSQAYFVIYDLESDVLNVERDNEALKQLAPLDVVVTCQAKSADYKDYDFISRYFWPTNGGDEDPVTGSAHTGLAPLWAQRLGKNTLVAYQASKRGGVLDCVVTGDRVLISGHAVHYLTGFITVEE

SEQ ID NO: 53254 - protein, 225 aa, Camellia sinensis
EAEVEHKTVFGLLKMIESERLGEAVDRTLLNHLLKMFTALGVYSESFEKPFLDRTSEFYAAEGVKYMQQSDVPDYLKHVEMRLHEEHERCVLYLDASTRKPLVATAERQLLERHISAILDKGFMMLMDGNRIEDLQRMYLLFVRVNALESLRQALSSYIRRTGQGMVMDEEKDKDMVSCLLEFKASLDTIWGRKAFSKNGSILPPLFKDAVLEPSPLIFRQESGL

SEQ ID NO: 53255 - protein, 661 aa, Candida albicans SC5314
MSKPSSIKKSKASAIKPSANSKSKTPKIETPKLQQVETRLEGEVPTTKVSIKRNSITTESVKASEDKSTPQSTNTPAAAVAKSNPNTNAEPAKIPNEKSLKTESPSSQKQNGATTTKEKSDVSLETKSTSSTTVSNNNSVLQYTELSEIPIGVERITKAFHSGKTHSLQFRLKQLRNLYFTMKDNQEALCDALQKDFHRLPSETRNYEFATGLNELVFIMSQLHKWSKPQPVDELPLNLSLNPVYIERIPLGTILVIAAFNYPFFVSISPIVGAIASGNTVALKPSELTPRFSKLFTDLLSKALDPEIFFVVNGAIPETTCLLEQKFDKIVYTGSGLVGTIIAKKAAETLTPVILELGGKSPAFVLDDISDKDLATVARRIAWGRFVNAGQTCIGVDYVLVAKSKHDKFISALQEVIEKEFFQDVDKTRNFTHMIHDRAFEKMESILNTTSGNVIIGGKLDHGTRYVGPTVIDNVTWTDSSMKDEIFGPILPILTYTDLEKSCREIIANHDTPLAQYIFTSGPTSRQYNSQINTITTLVRSGGLVINDVLMHIALHNAPFGGVGTSGNGAYHGEFSYRAFTHERTVLEQHLWNDWVLKSRYPPYANKKDKLIASSQQKYGGRVWFNREGNVRIGGPPLLFSAWNNALGVAELVRDFIGAGL

SEQ ID NO: 53256 - protein, 253 aa, Zea mays
MASAAAPPTSLSLAARAATRAAAAAAAPLRRGGLATACQPARSLAFAAGDARLAVHVASRCRQAFSGRGTRAMATMAKKSVGELTEADLEGKRVFVRADLNVPLDENQNITDDTRIRAAIPTIQYILSKGAKVILSSHLGRPKGFTPKFSLAPLVGRLSELLGIQVQKADDVIGPEVEKLVAALPNGGVLLLENVRFYKEEEKNDPEFAQKLASLADLYVNDAFGTAHRAHASTEGVTKFLQPSVAGFLLQKE

SEQ ID NO: 53257 - protein, 388 aa, Zea mays
  misc_feature (15)..(15): Xaa can be any naturally occurring amino acid
PCPTPARCPPPLTTXHEHTPLCRSCGAPTTSPTPAPWSGTTDSPPPAYRPIRLPAINAPTNTAAIVLSPVPQPLPVPPAAPPHAFLVPAKRITSPDDIARFHASVHGLHFLGFVAALSASVHGRKLSDPLPSPPSPAIAALLDLVSALAALVASTPPLPHSSRYGNPAFRLWHEKLTDSASELISRITATASSPADLAGADVELAPYLLDSFGNATRIDYGTGHETNFAAFLYCLARLGLITEPDYPAVVLRVFTAYLDLMRTLQDTYQLEPAGSHGVWGLDDYHFLPFVFGSAQLIDHKYMKPKSIHNPDILENFSKEYMYLACVAYVKKVKKGPFMEHSPMLDDISGVANWKKVNSGLLKMYKAEVLEKVPIMQHFLFGSLIKWED

SEQ ID NO: 53258 - protein, 426 aa, Thermosynechococcus elongatus BP-1
MIRELFMPALSSTMTEGKIVSWLKSPGDKVTKGETVLIVESDKADMDVESFYDGYLAVITVPAGEVAPVGSTIGLVAETEAEIAEAEAKAKSLGTATSSGPAPASTSTVATSNGSGTAPVAAAPAASAAVPAGRVMASPRARKLAKEHKIDLKTLKGTGPNGRITAADVEALIGAPATPVPPVATSPAPIPTAPPATAAVVAKEDLVPLTTLQNAVVRNMVASLGIPDFHVAYTITTDALDRLYQQIKSKGVTMTALLAKAIALTLQKHPIMNAYYTEQGIQYRRDINIAVAVAMPGGGLITPVLKNADQIDLYSLSRTWKDLVERARAKQLQPDEYSTGTFSLSNLGMFGVDFFDAILTPGQGAIMAVGASRPTVVATEDGLLGVKRQMKVNITCDHRVIYGADAAAFLQDLAKLIETNPQALTL

SEQ ID NO: 53259 - protein, 257 aa, Salmonella enterica subsp. arizonae serovar 62:z4,z23:--
MSYRSESMAVTKLVLVRHGESQWNKENRFTGWYDVDLSEKGVSEAKAAGKLLKEEGFSFDFAYTSVLKRAIHTLWNVLDELDQVWLPVEKSWKLNERHYGALQGLNKAETAEKYGDEQVKQWRRGFAVTPPELTKDDERYPGHDPRYAKLTDKELPTTESLALTIERVIPYWNESILPRMKSGERVIIAAHGNSLRALVKYLDNMGEDEILELNIPTGVPLVYEFDENFKPIKHYYLGNADEIAAKAAAVANQGKAK

SEQ ID NO: 53260 - protein, 141 aa, Zea mays
  misc_feature (47)..(47): Xaa can be any naturally occurring amino acid
  misc_feature (130)..(130): Xaa can be any naturally occurring amino acid
QKTKDGKPLCDVLKEGGVLPGIKVDTGTIEVVGTDKETTTQGHDDLXKRCAKYYEAGARYAKRCAALKIVPNEPEQVAIDLNAHGLARYAIICHENGLVPIDEPEILCDGPHDIDRCSYLTDTVLAACYXLNAYHVLLEGT

SEQ ID NO: 53261 - protein, 418 aa, Xanthomonas oryzae pv. oryzae KACC10331
MSPDLHHLHTFAELDPPQRLLMGPGPVNAHPRVLRAMAADLLGQFDPEMTTYMNEVMALYRPLFGTDNRWTFLVDGTARAGIEAALVSLVQPGDRALVLNFGRFGLLLIELLGRLGADVHTVDAPWGEVVPLAAIAKAIERVAPKLVATVHGDTSTTMAQPLDGLGALCRAAGALSYVDATATIGGMPIASDRWDLDVLTGGLQKCMGGPSGSAPITISERAAEAIFARRHVERGIVRADILNGSGPRIASNYFDLAMIMDYWSDKRLNHHTEATTMLYGARECARVALQEGLDARFARHAAAGRAVSAGIRALGLDVFGDDAHRMTNVTGVVIPPGIDGEAVRRRMREDFEIEIGTAFGPLQGKIWRIGAMGYNAMKHKVLLTLAALEAVLRAEGCACTQGLAVAAALAAWHAEPQA

SEQ ID NO: 53262 - protein, 401 aa, Salmonella enterica subsp. enterica serovar Paratyphi A str.
MNAFNPTQFRAQFPALADAGVYLDSAATALKPQAVIDATHQFYCLSAGNVHRSQFAQAQRLTAQYEAARAKAARLLNAPDEKSIVWTRGTTEAINMVAQCYARPRLRPGDEIIVSVAEHHANLVPWLMVAQQTGAQVIKLPLNDRRLPDVERLPELITSRSRILALGQMSNVTGGCPDLASAISTAHAVGMVVMVDGAQGAVHFPADVQQLDIDFYAFSAHKLYGPTGIGVLYGKPELLEAMSPWLGGGKMIRDVSFEGFTTQSAPWKLEAGTPNVAGVIGLSAALEWLSDIDIEQAENWSRGLATLAEDALAKRPGFRSFRCQDSSLLAFDFVGVHHGDMVTLLAEYGIALRAGQHCAQPLLAELGVTGTLRASFAPYNTQHDVDALVNAVDRALELLVD

SEQ ID NO: 53263 - protein, 398 aa, Shewanella sp. MR-7
MSIEIKVPVLPESVADATIATWHVKVGEQVSRDQNLVDIETDKVVLEVVAPEDGHIGEFLFQEGDTVLGEQVIAKFIAGAVSGQEVTKAEAEAAAPVAAAVTEESNDALSPSVRRLLAEHNVDASKVKGTGVGGRITKEDVEAFIKSAPKAAAAPAAPAVQPLAAGRSEKRVPMTRLRKTIANRLLEAKNSTAMLTTFNEVNMKPIMDIRKQYQEIFEKRHGIRLGFMSFYVKAVTEALKRFPEVNASIDGDDIVYHNYFDVSIAVSTPRGLVTPVLRDTDTMSLADIEKAVRDLAIKGRDGKLTVADMTGGNFTVTNGGVFGSLMSTPILNLPQSAILGMHAIKDRPMAVNGQVEILPMMYLALSYDHRIVDGRESVGFLVAIKDFLEDPTRLLLDL

SEQ ID NO: 53264 - protein, 514 aa, Nocardia farcinica IFM 10152
MSTTAEKLADLRKRLELAQEPAGEAGVAKRAKKGIPSARDRINMLLDPGTFVEIGALVRKPGDPAALYGDGVVTGHGLVDGRPVAVFSHDQTVYGGSVGEMFGRKVAYIMEYAAKVGCPVVGINDSGGARVQEAVTSLAWYAELGRRQEPLSGLVPQVSMILGKCAGGAVYAPINTDVVVATEEAYMFVTGPKVIREVTGEDVSLEELGGAQSQAEYGNIHHVAKDEKAAFQWVRDYLSFLPTSCQELPPVVNPGLEPEITDSDRELDSIVPDSDNAGYDMHEILLRIFDDGDFHEIGATAGRNIITGFARVDGRSVGVVANQPLVYAGALDARASDKAAHFVRLCDAFEIPLVFVVDTPGFLPGVEQEKIGVIKRGGRFLFSFVEATVPKVTVVIRKSYGGGYAVMGSKQLGADVNLAWPTARIAVMGAESAVSLIGGKQLAAAPEDQRAAMRQQMIDFYNATVATPWVAAERGYIDAVIEPSATRLELRRALHLLRDKKLARNPRKHHLLPL

SEQ ID NO: 53265 - protein, 424 aa, Wolbachia endosymbiont of Drosophila melanogaster
MNKVINNVFAREILDSRGYPTIEVEIELCDGAIGRASVPSGASTGKLEVLELRDQDEKRYCGKGVLKAVQAVNGIIADEIIGMNAADQNAIDKALIELDGTKNKSKLGANATLGVSLAVAKAAANSFKMPLYRYLGGKQTSVMPVPLINIINGGVHADNKLDFQEFMILPVGAETFSEAIRISAEVFHNLRSILKKKGYSTNVGDEGGFAPNIESTEEALDLIIYVIESAGYSAQSDFALGLDVASSTFYEDGIYKFEHRDLTSEELTEYYCNLVERYPIISIEDAMSEDDYEGWKLLTAKLGSKIQLVGDDLFVTNCELICKGIEEKMANAVLIKPNQIGTLTETFAAIEMAKSNGYKAVVSHRSGETEDTTISHIAVASNCGQIKTGSLSRSDRLAKYNELIRIESALGKDAKYYRGLAWVL

SEQ ID NO: 53266 - protein, 195 aa, Laccaria laccata
FGRVNDYKINPNQELIAIGVTNTIGSCFGAYPATGSFSRSALKSKSGVRTPLAGVYTAIVVIVALYGLTSAFFWIPTAALSAIIIHAVADLVASPAQVYSYWRVSPLEFCIWVAAVLVTIFSSIENGIYTSISASLALLLLRVARPRGAFLGKAAVRPSSGSTVDRDVYLPLTKDGITNPYVKVEAPSPGVLIYK

SEQ ID NO: 53267 - protein, 307 aa, Bacillus cereus ATCC 10987
MRVAQSVSELIGKTPIVKLNRIVESDSADIYLKLEFMNPGSSVKDRIALAMIEDAEKKGLLKEGDTIIEPTSGNTGIGLAMVAAAKGYKAILVMPETMSIERRNLLRAYGAELVLTPGPEGMGGAIRKATELAKENGYFIPQQFKNQSNPEIHRLTTGPEIVEQMGDQLDAFIAGIGTGGTITGAGEVLKEAYKDIKIYAVEPADSPVLSGGKPGPHKIQGIGAGFIPETLDVEVYDEIVQVKTEQAFEYARRVAKEEGILVGISSGAVIYAATEIAKKLGKGKKVLVIIPSNGERYLSTPLYQFES

SEQ ID NO: 53268 - protein, 407 aa, Bacillus cereus E33L
MDTLIFEVGTALVLVAFAAILAAKLKFSIIPFLIILGMLVGPHAPDLGLIDLRFIESGEVISFLGRVGVIFLLFYLGLEFSIKKLIKSGKSIAFGGTVHISLNFLLGLLYGYVMGFPLLETLIIAGIITISSSAIVAKVIVDLRRSGNKETELILGIIMFDDIFLAVYLSVVSGLVLGGATSFVGALTSVLIAVGYMLLFFIIARKATPFLNKVLDISSNEIFIIVIFAILFFVAGFSETIHVAEAIGALLLGLVFSETEHSDRIEKLVVPFRDFFGAIFFFSFGLSIDPFSLGGAVWLALGAVFITLIGNFTAGMIAGRKAGLSHKTSTNIGLTLVSRGEFSIIVANIGIAGGLMAAIKPFSALYVLILASLGPLLTKESGRIYSLLDKVFKWSAKERAKREKEVG

SEQ ID NO: 53269 - protein, 195 aa, Bacillus cereus ATCC 10987
MILMIDNYDSFTFNLVQFLGELGQELVVKRNDEVTISDIENMKPDFLMISPGPCSPNEAGISMEVIRYFAGKIPIFGVCLGHQSIAQVFGGEVVRAERLMHGKTSLMHHDEKTIFSDIPNPFTATRYHSLIVKKETLPECLEVTSWTEEGEIMALRHTTLPIEGVQFHPESIMTSHGKELLQNFIRKYSPSVTSC

SEQ ID NO: 53270 - protein, 372 aa, Methanopyrus kandleri AV19
MILQRDSDYSDGTVLGSMCTEPHPVAAEAFVAGLHVNLGDPYLFPNAYRAERECIGWLAETLLDHPAPEEAEGSIVSGGTEANILAAYAAREVTGGREIIVPATRHFSFEKAARMLRMKLVEAPLRSDYTVDVDAVQDLISRDTALIVGIVGTTETGSVDDIEALSDVAEDHGVPLHVDAAFGGFTAPFLREEYPLPRFGFDLEAVVSVTVDPHKMGLVPPPAGGIVFRDDEFPKAIEVYAPYLSGGGASQYTITGTRPGAPVLALYANILELGEEGYRRIAFRCYEETLKVAEKARELGLELAVDPPHLNLVNIRLPDRGTAERLLRESEREGWKISVSTKPLGVRIVMMPHLDAETVSRFLELVARVLGG

SEQ ID NO: 53271 - protein, 455 aa, Debaryomyces hansenii CBS767
MVDRKRNSSVISDNEENGRVDKKTKIKDEIEGDEVERDVKNEEANGADTDDKEEVRKDNEEENAENGGGEGDDDDDDDDEAEEEKKRTTTFNFDGVTYSFKERPSVLEEKEGKIEFRVVNNDNTKESLMVLTGLKNIFQKQLPKMPREYISRLVYDRSHLSMAVVRKPLTVVGGITYRPFDNREFAEIVFCAISSTEQVRGYGAHLMNHLKDYCRATSNVKYFLTYADNYAIGYFKKQGFNKEITLDKSVWMGYIKDYEGGTLMQCSMLPPILRYLDLAKILLLQKAAIEKKIKLRSKAHVVRPGLQVFKTNKDAKLNPAKDIPGLAESGWLEEMDKLAQKPKRGPHYNFMVTLLSELTNHPSAWPFSTPVNKEEVGDYYDVIKEPMDLSTMELKLENDKYDSFDQFLYDARLIFNNCRSYNADSTTYFKNATKLEKFMNNKIKDSAEYSHFLDQ

SEQ ID NO: 53272 - protein, 507 aa, Arabidopsis thaliana
MAMASLARRKAYFLTRNLSNSPTDALRFSFSLSRGFASSGSDENDVVIIGGGPGGYVAAIKASQLGLKTTCIEKRGALGGTCLNVGCIPSKALLHSSHMYHEAKHSFANHGIKVSSVEVDLPAMLAQKDNAVKNLTRGIEGLFKKNKVTYVKGYGKFISPNEVSVETIDGGNTIVKGKHIIVATGSDVKSLPGITIDEKKIVSSTGALSLSEVPKKLIVIGAGYIGLEMGSVWGRLGSEVTVVEFAGDIVPSMDGEIRKQFQRSLEKQKMKFMLKTKVVSVDSSSDGVKLTVEPAEGGEQSILEADVVLVSAGRTPFTSGLDLEKIGVETDKAGRILVNDRFLSNVPGVYAIGDVIPGPMLAHKAEEDGVACVEFIAGKHGHVDYDKVPGVVYTHPEVASVGKTEEQLKKEGVSYRVGKFPFMANSRAKAIDNAEGLVKILADKETDKILGVHIMAPNAGELIHEAVLAINYDASSEDIARVCHAHPTMSEALKEAAMATYDKPIHI

SEQ ID NO: 53273 - protein, 239 aa, Vibrio sp. Ex25
MKKSLAALGLALVFTGTAYAASWGYEGSHGPEHWGEFASECSKGQNQSPINIVSAAEAKLDKLQFDYHGKAISLLNNGHTLQTSLEGDNTLLIDGNAFTLKQFHFHTPSENHVDGKEYPLEAHFVHADTTGHLAVVAVFFQSGKANPDLAKLLANIPSKDQAVEIKLPFEADALLPKDKAYYRFNGSLTTPPCSEGVRWLVMKEAQTISPEQIKAFTKVMGENNRPIQPLNARMVLMQH

SEQ ID NO: 53274 - protein, 461 aa, Burkholderia thailandensis E264
MVSDQDNDSLKRGLKNRHIQLIALGGAIGTGLFLGIAQTIQMAGPSVLLGYAIAGVVAFFIMRQLGEMVVDEPVAGSFSYFANKYCGHFTGFLSGWNYWVLYVLVSMAELSAVGIYVQYWWPGVPTWISALVFFVAINAVNLASVKSYGETEFWFSIIKVAAIVGMIGFGGYLLLSGHAGPDAGVANLWRHGGFFPNGIGGLAMAMAVIMFSFGGLELVGITAAEADDPSHSIPRATNQVIYRILIFYIGALGVLLSLYPWQKVVTGGSPFVLIFHALSSDVAANVLNVVVLTAALSVYNSCVYCNSRMLYGLAQQGNAPRALARVSRRGIPIAALGVSAFATALCVVINYFMPGKAFELLMGLVVSAIIINWAMISVIHLRFRQAKRASGETTRFKSLGYPLTNYLCLVFMAAILVVMFRTPDLRLSVYLIPVWLVVLALGYRFRQRGAGYALGEGVSAR

SEQ ID NO: 53275 - protein, 541 aa, Oryza sativa Japonica Group
MSAAHLLRHSRKLRSLHNALDCERSGLVRYFSTASGSFPTKGNGAEKRIGGARFPQRKQPGKELETSKLSLGLNGSYTCRRSPNNFIPNTITGLNGSLSCGQIASARSFSSSADLPPHQEIGMPSLSPTMTEGNIARWLKKEGDKVSPGEVLCEVETDKATVEMECMEEGYLAKIIHGDGSKEIKVGEIIAVTVEEEGDIKKFKDYKPSTLAAPVAPSELKAQSEPTEPKVEEREPSKASELKAPRTEEPSRSGDRIFSSPLARKLAEDNNVPLSSVKGTGPDGRILKADIEDYLAKGCRKEALAAPGLSYTDVPNAQIRKVTANRLLSSKQTIPHYYLTVDTRVDNLIKLRGELNPLQESSGGKKISINDLVIKAAALALRKVPQCNSSWMNDFIRQYHNVNINVAVQTEHGLFVPVIRDADKKGLGMIAEEVKQLAQRARDNSLKPDDYEGGTFTISNLGGPFGIKQFCAIINPPQSAILAIGSAERRVIPGSANGQYEFGSFMSATMSCDHRVIDGAIGAEFLKAFKGYIENPTSMLL

SEQ ID NO: 53276 - protein, 254 aa, uncultured bacterium
MTRPLIAANWKMNGDLALAEAVIAGLAEGGGGGVDVLLCPPFVYLREVARMVRQAKVEGLMVGAQNLDCHAHGAFTGEVSAAMIADAGCEYVIAGHSERRALFGESDDDVARKAQAARGAGLATVVCVGETFAEREAGRTEAVVESQLAPLAGFFAGGGDGCDFAVAYEPVWAIGSGQSATPGDARAVHEFIRRRIAANNPAAADRARVIYGGSVKPGNAAGLFAEPGIDGALVGGASLAARDFLSIIRSGYAD

SEQ ID NO: 53277 - protein, 1086 aa, Candida albicans SC5314
MLLKQIFLPFFVLFNAINAIDIYQNQVSRGTIDLSIGAITIHSGAYWSIIDNAISALVGTLTVQQDAGFYITGLNPLLGLQVELLGVLNSIKNDGIVSFNGLNSLVGPIYNLVGLSFQNNGEFYLSASGVAPPVFSITAADWHNNGLLVLAQAKRTSALANLGFPTGSIENQGSICLFGTAYQQLTSITGSGCISADRDSTIYIFSSLLPIATTQTLYLADRASSIVIQPVTLPATYTVRGFGNGNKVGISLPLLSVPLLGQPAYSYDPSSGVLTLRGLGVGLLSQRFQIGTGYDSTSFEIVTDDGAGLPTTLLGSVRYNGPVPNNAVPASCNCKYVPPSPGTDESSSSLSSSTSEQSSSSATSVSASETSDTSSTQESSSSSEVSSTQEPSSSTPEPSSSSETSSTQESSSTEGPSSSTDSSTEASSSESSTAPSSSTEASSSTESSTEEPSSSTEGPSSSQESSSSEESSTQEPSSSTKESSSTEGPSSTEESSSTEGPSSSTDSSTDITSASSTDEQSSSGTGQSSTEDEPIDSTESDTSSATDSSTATDSSATNTDTNSESTDSSTATDTSSTDSNTASSTETNTDVTDSSTDSNTGATESSTATDTNTDATDSSTVSETGATDSSTATDTNTGATESSTDSNTGATESSTATDTNTSATNTDTNTGSNTATNTDDNTATDTSSTETNTATNTDGTETNTGATETNTDTSASNTDDNTGSNTATNTGGTDTNTDTNTGGTDTNTGTNTGGTDTKTGTNTATGNNTGATETNTATNTNGNGTNTNTGATDTATNTATGTNTNTGATDTNTNTNTGATVTNTATNTDNVSTTKDIPSPTSTNEGSNNGGGSNNGSGSNNGSGNESGSGSGSGNGSGDGSNNGSGNGSDNGTGSGNGSDNGTGSGSGSDNGSGSGSGSGSGSGNGSGSGSDNGSGSGNGSGSGSGSGSGSDNGSGSGSNNGSGNGSGNGSGSGSDNGSGNGSGSGSGSGSGNGSGNGTGSGSGSGSGNGSGSNNNNGSGSGSGSGSGQDNGIITSSIGQPGSSTSTQGPSSSNSATIPEQANSGNHIKFTLFNRLLIGLVSIVFM

SEQ ID NO: 53278 - protein, 117 aa, Oryza sativa Japonica Group
MATAARRLLLPALRKSLPAANGAARGVSTERAVGAAAVVGSHTAKWMQDTSKKSPMELINAVPPIKVEGRIAACDGRQDKGRETGSLGHPIEYICLDLDQPAVCKYCGLRFVQDHHH

SEQ ID NO: 53279 - protein, 2154 aa, Oryza sativa Indica Group
MAESGQSIASDVTALIGNTPLVYLNKVVDGCEAQIAAKLEIMEPCSSVKDRIGYSMITDAEEKGLITPGKSVLIEPTSGNTGIGLAFMAAAKGYKLILTMPASMSMERRIILKAFGAELVLTDPLLGMKGAIQKADELAAKMPNSYILQQFENPANPKIHYETTGPEIWKATAGKVDILVSGIGTGGTVTGTGKYLKEQNPEIKIYGVEPTESAILSGGRPGPHKIQGIGAGFVPGVLDVNLLDEVVQVSSDEAISMAKQLALKEGLLVGISSGAAAVAAIRVAQRPENKGKLVVVVFPSFGERYLSSVLFESIKREAENMGTPVNIIVGSHVWAEDPDDAWIDGEVVEIRAGDATIVSTDGKTIVASLASIYPKDTEAPPAGVDDMTKLAYLHEPGVLHNLACRYGINEIYTYTGNILIAVNPFRRLPHLYDVHMMEQYKGAAFGELSPHLFAIADACYRAMINEQGSQSILVSGESGAGKTETTKMLMRYLAFMGGRSGTEGRTVEQQVLESNPVLEAFGNAKTVKNNNSSRFGKFVEIQFDKYGKISGAAVRTYLLERSRVCQVSDPERNYHCFYMLCSAPPEDVKKFKVGDPRSFHYLNQTNCYEVANVDDAREYLETRNAMDVVGIGQEEQDAIFRVVAAILHLGNINFSKGQEIDSSKLRDEKSVYHLKIVAELLMCDEKALQDSLCERVIVTPDGNITKPLDPDSAALSRDALAKTVYSRLFDCFEQLCINLTNEKLQQHFNQHVFKMEQEDYTREEIDWSYVEFVDNQDVLDLIEKKPGGIIALLDEACMFPKSTHETFAQKMYQTYKAHKRFSKPKLARTAFTINHYAGDVTYQADQFLDKNKDYVVAEHQALLNSSRCPFVANLFPPLPEETSKQSKFSSIGTRFKQQLQALMETLSTTEPHYIRCVKPNAVLKPGIFENFNVLNQLRCGGVLEAIRISCAGYPTKRTFDEFIDRFGMLAAELVDSSDEKAACAAICDKMGLKGYQIGKTKVFLRAGQMAELDARRAEVLANAARLIQRRIKTHLTRKEFINLRKASIQSQKFWRARLARIFFEHMRRNAASIRIQKHARTHSARKSYLQMYESAIVIQTGLRAMAACNEHRFRRETKASIIIQEARETGALKEAKDKLEKRVEELTWRLDVEKHLRIDLEEAKGQEISNLKSVLQEMQEKLSEAHAAIEKEKEDAKLAIEQAPPKIVEVPVVDNAKVELLTRQNKELEDELVTFRTKAEDLEKRLLEVQKESDELSREILEKDSKLNQLQEMIERLETNLSSLESENQVLRQQSLLASADDDKSKQIESLESKIAILESENQLLRSKSSVAVQAVITPEVIQPSAMEEEVVVPPIKNLSKQKSLTDRQQENHDVLIKSLAEDRRFDNGRPAAACIVYKSLLHWHSFEAEKTNIFDRIIHTISTLKVLQNWLIGCRLHQLFSTYYKILLSLAVQQNARSSSLGSGISSGYSGMVGRPDTASKVEAKYSALRFKQQLTAYVEKIYGMIRDNLKKEINPFLIMCIQVPPMIIRKTFNQAFAFMNVQLFNSLLLRRECCSFSNGEFLKAGLQELEQWCSVTTEEYAGTSWDEFQHIRQAVGFLVLHQKTHKTLEEITDELCPVLSITQIYRIGTMFWDDKYGAQGLSQEVIGKMRTMATDDSITTPNSSFLLDDDSSMFPKSTHETFAQKMYQTYKAHKRFSKPKLARTAFTINHYAGDVTYQADQFLDKNKDYVVAEHQALLNSSRCPFVANLFPPLPEETSKQSKFSSIGTRFKQQLQALMETLSTTEPHYIRCVKPNAVLKPGIFENFNVLNQLRCGGVLEAIRISCAGYPTKRTFDEFIDRFGMLAAELVDSSDEKAACAAICDKMGLKGYQIGKTKVFLRAGQMAELDARRAEVLANAARLIQRRIKTHLTRKEFINLRKASIQSQKFWRARLARIFFEHMRRNAASIRIQKHARTHSARKSYLQMYESAIVIQTGLRAMAACNEHRFRRETKASIIIQEARETGALKEAKDKLEKRVEELTWRLDVEKHLRIDLEEAKGQEISNLKSVLQEMQEKLSEAHAAIEKEKEDAKLAIEQAPPKIVEVPVVDNAKVELLTSQNKELEDELVTFRTKAEDLEKRLLEVQKESDELSREILEKDSKLNQLQEMIERY

SEQ ID NO: 53280 - protein, 342 aa, Thermosynechococcus elongatus BP-1
MFGLIGHLTSLEHAQAVAHQLGYPEYADQGLEFWCMAPPQIVDEITVTSVTGKTIYGKYVESCFLPEMLANQRVKAATRKVINAMAHAQKHNIDITALGGFSSIIFENFDLEKMSHIRNIELDFRRFTTGNTHTAYIICQQIEQAAPQVGIDLRQATVAVCGATGDIGSAVCRWLNTCLDVQDLLLVARNRDRLLELQAELGRGKILDLMEALPLADIVVWVASMPKGVELSIEQLKRPSLMIDGGYPKNMATKIQHPQIHVLNGGIVEHALDIDWKIMEIVNMDVPSRQMFACFAEAMLLEFEGWHTNFSWGRNQITVEKMQQIGEVSRKHGFQPLLLNPQ

SEQ ID NO: 53281 - protein, 465 aa, Escherichia coli
MSSIIPVIMAGGSGSRLWPLSRELRPKQFLKLDGELTMLQATINRLKNFVTTQPLVICNEDHRFLVAEQLRYLGKLENNIILEPFGRNTAPAIALAAFTALQSSSLKEDPILLVLAADHVIRDEESFKRSVQQAVPYAKSGKLVTFGIVPTHAETGYGYIQRGKELNDAYSVKQFVEKPELETAQQYFNSGEYYWNSGMFLFRASRYLDELALFRPDIYTACGKAIGAIDPDHDFVRIDKDAFNSCPSDSIDYAVMEKTSDAVVVPMDAGWSDVGSWLSLWELSKKDSMGNSFHGDVIQHSSKNNFVFTESCLVSLVGVEKLVVVQTKDAILVADQNKVQDVKNIVEKLKNSCRTEHRIHREVFRPWGKHDLIDDGDVYRVKRISVKPGERLSLQMHHHRAEHWIVVSGIAKVTNGDNIYLLKENESTFIPSGTIHALENPGEIMLELIEVQSGVCLDENDIIRL

SEQ ID NO: 53282 - protein, 412 aa, Triticum aestivum
  misc_feature (272)..(272): Xaa can be any naturally occurring amino acid
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSGFTINGKPIFHFVGTSTFSEYTVIHVGCLAKINPEAPLDKVCVLSCGISTGLGATLNVAKPKKGSTVAIFGLGAVGLAAMEGAKMSGASRIIGVDLNPAKYEQAKKFGCTDFVNPKDHTKPVQEFFPSPSTHIFTFVRSSXHAQSCAKNSMCNVALQVLVEMTNGGVDRAVECTGHIDAMIAAFECVHDGWGVAVLVGVPHKEAVFKTSPMNLLNERTLKGTFFGNYKPRTDLPEVVEMYMRKELDLEKFITHSVPFSQINTAFDLMLKGEGLRCIMRMDE

SEQ ID NO: 53283 - protein, 468 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDCEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEDYNWDLNYGEIAKIFRAGCIIRAQFLQKITDAYAENPKIANLLLAPYFKQIADDYQQALRDVVAYAVQNGIPVPTFSTAVAYYDSYRAAVLPANLIQAQRDYFGAHTYKRIDKEGVFHTEWLD

SEQ ID NO: 53284 - protein, 455 aa, Ruminococcus flavefaciens
MALKNQYLKELLERVEKRNPGEPEFIQAVTEVLETLQPVAEKRQDLIDAGVFERIVEPERQIIFRVPWVDDNGKVQVNRGFRVQFNSAIGPYKGGIRLHPSVYLGIIKFLGFEQVFKNSLTTLPMGGGKGGSDFDPKGKSDGEIMRFCQSFMTELSKHIGADCDVPAGDIGTGAREIGFMFGQYKRLRNEFVGVLTGKGLTYGGSLARTEATGYGLCYFTNEMLQANGKSFEGKTVVISGSGNVAIYATEKATQYGAKVVTVSGSNGYIYDPDGIELDLVKQIKEVERGRIKEYASRTSHKNAEYHEGSVWTLKCNAGGIKLDIALPCATQNEINGDGAKAIVANGGFAIAEGANMPSTPEAIETYLSNGLLYGPAKAANAGGVATSGLEMSQNSERLSWTFEEVDEKLHGIMKSIFKACDDAAKEYGMAGNYMAGANIAGFLKVAEAMKAQGCV

SEQ ID NO: 53285 - protein, 469 aa, Cryptococcus neoformans var. neoformans JEC21
MSPIALNQRTGVSTTHLKSSVAPTPISTAATSTYQLHHTVPNPVATKGDGMHFTLTTGETVLDAAAGGAAVSCLGNGNSEVIETMYEQAKKMAYTYHQSLDAEGSEKLAKWLCDRSEGALVAGAFLNSGSEAIEAAIKMARQYWVEAGKPERKYIIARFPSYHGNTLGALAIGNAPGRRDIYKPLISMNAFHHVTSPVYKRYAQPGETEEAYSARLADELEAKILELGPENVIGFFAEPVVGSALGVMPPPKGYFPAMDKVIKKYGTLFIMDEVMSGSGRVGQLFAHQAVGEGVKPDIVAIAKGLGGGYVSISGVFVGQRVADRVREGGQWKNSHTYQNHPINCAVAAKVMEIVERENLLQNVRERGEQILEELKEAAKGVPTIIDVRGKGLFIGVEFDGPSSLKPRFASRVKDQAFKNGLIVMGISGTIDGVEGETTIICPAYTVTKKQISEIVRLLVKSIKEVVEEL

SEQ ID NO: 53286 - protein, 303 aa, Cryptococcus neoformans var. neoformans JEC21
MPRAISIRLFNTPRNILSEMSGPAPVKSLDARLKMHDGNAIPQFGLGVYEMNDKETYDCVKWALEAGYRHVDTAEWYENEAPCGKAIADFLKATGTSREEIFLTSKLKNNSSYEQAFVDLKGSLKRSGVEYFDLYLMHSAIGGPVIRKNVWKALCDAQSQGLVKSIGVSNFGKKHIQEFIDQKVPLPTVNQVDLHPFMRHPEIVEICEQNEILLEAWGPLARAMRFDHPVVVKIAKEKGKDAAQIMLRWGIQHGFVVIPKSVSQKRIVSNSKIFDFELSSEEMKELDGLDEYLVTDWDVVDCE

SEQ ID NO: 53287 - protein, 127 aa, Brassica napus
  misc_feature (6)..(6): Xaa can be any naturally occurring amino acid
  misc_feature (110)..(110): Xaa can be any naturally occurring amino acid
  misc_feature (118)..(118): Xaa can be any naturally occurring amino acid
  misc_feature (126)..(126): Xaa can be any naturally occurring amino acid
MAGVSXASPAAAQIGSFLSKKPYAPPSWASHLALAPSHTFSFGHFPTPIHKWNLPNLPEGTEVWIKRDDLSGMQLSGNKVRKLEFLLADAVAQGADCVITVGGIQSNHCXATAVAAKXLNLDCYLXL

SEQ ID NO: 53288 - protein, 120 aa, Bacillus cereus ATCC 10987
MDKIYIHDMEFYGYHGVFPEENKLGQRFKVDLTVELDLKQAGESDDLEQSVNYGELFELCRKVVEVRTYKLVESIAENIATDILKQYESISRCTIKVIKPDPPIPGHYRAVAVEITRERP

SEQ ID NO: 53289 - protein, 390 aa, Candida albicans SC5314
MSQQINPPLGSTDIAKLSIPTLPQVTTEPPKQNGLWSSNPVFSYINDVYITINEHRKSLGLTNPGTIENLNKEVARDVFLGQYFFTGLRADLNKAFSMMPAFQTSHTLSIGSNVLPAYAFSALYATDDYFLQGNIDNDLSFSGRINYGWDKSNISKVTLQLAHGQPSMIQLEQDYQANDCSINVKTLNPNFLSGNEFSGVVVGSILQSLSSKLAVGLETMYSKQPLAPPDTAVSYVARYNAGNWIASAQLQAQGALIASFWRKVTDKVEAGLETQVAATMKQVADPLMGVGFEPVIEGQTTIGAKYEYRTAVFRGQLDSKGKISAFLEKRIMPTVSILFSGEIDQFKNTSRLGLGLQFEAAGNEQLMLMQQGLVDANGNPIPGAPAPGAL

SEQ ID NO: 53290 - protein, 572 aa, Mycoplasma capricolum subsp. capricolum
MKKLLTLLGSIGMVASTAAVAVACTDRGTNTSSNKDNNGGEKPGNQPTNENSDKNEEIQGDDSGTGKSTDEAKEKQIAEAREAVKKAEDKVAAAKEKHQKAESEAKKAQGPEKQAKQQAEKNAKEELDKAEAELKTARENLEKLQKPSTDEAKEKQIAEAREAVKKAEDKVAAAKEKDQKAESEAKKAQGPEKQAKQQAEKNAKEELDKAEAELKTARENLEKLQKPSTDEAKEKQIAEAREAVKKAEDKVAAAKEKHQKAESEAKKAQGPEKQAKQQAEKNAKEELDKAEAELKTARENLEKLQKPSTDEAKEKQIAEAREAVKKAEDKVAAAKEKHQKAESEAKKAQGPEKQAKQQAEKNAKEELDKAEAELKTARENLEKLQKPSTDEAKEKQIAEAREAVKKAEDKVAAAKEKHQKAESEAKKAQGPEKQAKQQAEKNAKEELDKAEAELKTARENLEKLQKPSTDEAKEKQIAEAREAVKKAEDKVAAAKEKHQKAESEAKKAQGPEKQAKQQAEKNAKEELDKAEAELKTARENLEKLQKPSTRLLTVSDSLDLNIDTESYNVLGF

SEQ ID NO: 53291 - protein, 270 aa, Zea mays
  misc_feature (63)..(63): Xaa can be any naturally occurring amino acid
  misc_feature (239)..(239): Xaa can be any naturally occurring amino acid
MAAADASSLPPSAITCRAAVAWGPGQPLVMEEVEVAPPGPMEIRVKVVSTSVCRSDVTAWQSXQAQLDLFPRVFGHEASGVVESVGEGVTEFQVGDHVLTVFIGECKSCKHCVSGKSNMCQKLGLERKGVMHSDQKTRFSVKGKPVYHYCAVSSFSEYTVVHSGCAVKVGLTVPMDRVCLLSCGVSSGLGAVWNVANVSKGSSVAIFGLGTVGLSVAQGAKLRGASKIIGVDTNPEKQXKGKSFGVTDFINPDELSEPVQQVIKRITDGG

SEQ ID NO: 53292 - protein, 287 aa, Picea abies
MEGKEEDVRLGANKYSERQPLGTAAQTREKDYKDSGPAPLFEPGELASWSFWRAGIAEFMATFLFLYVTILTVMGVKRSPSMCQSVGIQGIAWSFGGMIFALVYCTAGISGGHINPAVTFGLFLARKVSLPRTVFYMICQCLGAMCGAGVVKGMQKGMYEVEGGGANLVAHGYSKGDGLGAEIVGTFVLVYTVFSATDAKRSARDSHVPVLAPLPIGFAVFLVHLATIPITGTGINPARSLGVAIIYGRSHAWDDRWIFWVGPLVGAALAAIYHQLIIRAIPFKSRS

SEQ ID NO: 53293 - protein, 343 aa, Vibrio sp. Ex25
MKIKALSKLKPEEGIWMTEVDKPEVGHNDILIKIKKTAICGTDVHIYNWDEWSQKTIPVPMVVGHEYVGEVVAIGQEVRGFEIGDRVSGEGHITCGHCRNCRGGRTHLCRNTIGVGVNREGAFAEYLVIPAFNAFKIPDEISDDLASIFDPFGNAVHTALSFDLVGEDVLITGAGPIGIMAAAVAKHVGARHVVITDVNEYRLELARKMGVTRAVNVAEEKLEDVMAELGMTEGFDVGLEMSGNPAAFNSMLTTMNHGGRIALLGIPPSDMGIDWNQVIFKGLVIKGIYGREMFETWYKMASLIQSGLDLSPIITHHYKIDDFQEGFDVMRSGMSGKVILDWE

SEQ ID NO: 53294 - protein, 380 aa, Aspergillus nidulans FGSC A4
MNFMNSTFSSTTPETYWDHYDDISAHSSHLNVAERLWAAWYAWMQNDVLATGIMSFVMHELVYFGRSLPWILIDTLGFFKNYKIQSSKIPSLREQWDCAKFVLLSHFTVELPQIWLFHPMAQFFGLSTSVPFPSFWTMAYQIAIFFVMEDTWHYFSHRALHWGPLYKAIHKIHHQYSAPFGMAAEYASPIEVMILGFGTVGCPIVWCAATGDLHIFTMPLMHTVGMSSHGVYTTFFLFGLEQIITTFTTRSSLATTPAVSGGGIMFWTQSTVPRRSGGGGITRRSAVRRKPNNAIVLEVSWNGINMSIVTPLARSTSPDMLIWDRGIPRHIDSPTAHRLGEVPGLEEPPRFSFDYIGHSSSFNNPLWDWNPYPVNGADLS

SEQ ID NO: 53295 - protein, 280 aa, Picea abies
MVNEGRSQKAQYEEPPPAPFLDRNEFYLWSFYRAIIAEFVATLLFLYVTIATVIGNANQKKPCGGVGTLGIAWSFGGMIFVLVYCTAGVSGGHINPAVTFGLFIARKVSLNRAVFYIVAQCLGAVCGAGMVKALQKNYYSAGGGGANTVREGYASETALAAEIAGTFVLVYTVFCATDPKSNARDSHVPALAPLSVGFAVFMVHLATIPITGTSINPARSFGPAVIYGHKKSWDDLWIFWVGPLVGAAIAAAYHQYVLRAGGLGLKSLRSFRSQPTSLAI

SEQ ID NO: 53296 - protein, 51 aa, Zea mays
VEDEEEDEEGNKRVVVLGPQVPLKEQLELDKDDESLRRWKEQLLGQVDTEQ

SEQ ID NO: 53297 - protein, 337 aa, Candida albicans SC5314
MSKELSLNQKNYLIQALKSNIRLSTSTNTGGSRKFNQFRPIDIKLSNTRYGSVELSLGKTKVMVNITSRITEPYQDRPFEGIMTINCEIPNHIKLQSNDTTNNNNDNEDEFINLINRALDRAIRRSNAVDLENLCIIAGEKVWELIIDLQVLNYDGNLIDSGCLAIITALLDFKKPDVTINNNNTSNSSSTSGGGGNIIVHDDEMKRPFIELSILHIPICLTFSLFNLGSKETNLKTNDIDQEIWLLDGDAMEESCRDGYLIMTMNQNHELIQLSKIGGGGNNGGVSIDGQQLINLCHESIDEINRLTNLVKSTVKNHQLNRYNNENYKLLESSADR

SEQ ID NO: 53298 - protein, 158 aa, Arabidopsis thaliana
MGIHLEKSAYLALAGNFLRSNELSKVIDVVKEMVKSQHSLGVYHGAMLIHMLGFGRRPSLAAEALDLLPDDQKGLSAYTALMDVYISAGSPEKAMKILGEMREREIMPSLGTYDVLLSGLEKTSDFQRETSSLRKEQKSLVASTRFREIVHVEDKICM

SEQ ID NO: 53299 - protein, 242 aa, Brassica napus
MGYLDLALSCSNPTQTVETPASGGGLSQNGKFSYGYASSAGKRSSMEDFFETRIDGIDGQIVGLFGVFDGHGGARAAEYVKRHLFSNLITHPKFISDTKSAITDAYNHTDSELLKSENSHNRDAGSTASTAILIGDRLIVANVGDSRAVISRGGNAIAVSRDHKPDQSDERERIENAGGFVMWAGTWRVGGILAVSRAFGDRLLKQYVVADPEIQEEKIDDSLEFLILASDGLWDVFSNEEA

SEQ ID NO: 53300 - protein, 273 aa, Zea mays
PRPNSLGIFTRPWFTAGTFLCKDDHRKIVACTNSHQVRLYDTALQRRPAISVEFKESPIKAVAADPNGHDVYIGTGTGDLASFDMRTGKLLGCYFGKCSGSIRSIVRHPDLPLIASCGLDSYLRIWDTNTRQLLSAVFLKQHLTTVVLDSHFSVEEPGEMKSKQLESSVETETEVRKEKKKKSKAITEDETEAQIRKEKKSRTIEEEEQAGLVDHSDINDEVYARKEKKKKKSRGIEGGKERDSDGEICSPKRRKFGERSKCLKKRSKKQLVA

SEQ ID NO: 53301 - protein, 365 aa, Bradyrhizobium japonicum USDA 110
MGFKCGIVGLPNVGKSTLFNALTETAAAQAANYPFCTIEPNVGEVAVPDPRLDKLAAIAKSGQIIPTRLTFVDIAGLVRGASKGEGLGNQFLANIREVDAIAHVVRCFEDSDITHVEGKIAPLADIETIETELMLADLDSLEKRVDNLTKKAKGNDKDAKEQLDLVNRTLVLLREGKPARLVERKAEEERAFGMLGLLSSKPVLYVCNVEEGSAATGNSFSKAVQEQAAKEGAVAVVISAKIESEIATISREERADFLETLGLEEAGLDRLIRAGYTLLDLITYFTVGPKEARAWTIHRGTKAPGAAGVIHTDFEKGFIRAETIAFDDYVALGGEAGARDAGKLRLEGKEYVVADGDVMHFRFNT

SEQ ID NO: 53302 - protein, 132 aa, Escherichia coli
MFLEYYYSYRYYRLFKIPIANHLTIGLKKLGEKNTIFPHPVGIVIGKKVSIGNNCTIYQNVTIGVSNNKTEDYPIIGDNVIIYAGAIIIGSVSIGNNVIIGAGCIVTKDVPEDKIAVGSPMKIIDKKANVLY

SEQ ID NO: 53303 - protein, 172 aa, uncultured bacterium
MFSLDPHISKTPGFPKEGITFYDISPALEDAVVLKKLMAAMAEKTAAFQPEIIAGIDARGFLFALPLSLELNCGTVMVRKSGKLPGKVLEESYALEYGTARLSVQASRSLAGKRVVLCDDLLATGGTLSAAANLISRAGGILAGAVCVIELTGLNGRDKLPCDVVALQTYEF

SEQ ID NO: 53304 - protein, 154 aa, Triticum aestivum
NKFVQKSRLVPVRNSRDIVDPRVRKKASRAFSTFPSLAMAAKAPALAAALLLLAAAALLLARGAEAGATEVPLSWELGVEDVADDGFGFAGAGGDEAVAARRVLQSGNGYISYGALRRDNVPCSVRGSSYYNCRPGGQANPYSRGCSAITRCRG

SEQ ID NO: 53305 - protein, 388 aa, Escherichia coli
MKITISGTGYVGLSNGILIAQNHEVVALDIVQAKVDMLNKKQSPIVDKEIEEYLATKDLNFRATTDKYDAYKNADYVIIATPTDYDPKTNYFNTSSVEAVIRDVTEINPNAVMIIKSTIPVGFTESIKERFGIENVIFSPEFLREGKALYDNLHPSRIVIGEQSERAERFAALLQEGAIKQDIPTLFTDSTEAEAIKLFANTYLAMRVAYFNELDSYAESLGLNSRQIIEGVCLDPRIGNHYNNPSFGYGGYCLPKDTKQLLANYQSVPNNLISAIVDANRTRKDFIADSILARKPKVVGVYRLIMKSGSDNFRASSIQGIMKRIKAKGVPVIVYEPAMKEDDFFRSRVVRDLDAFKQEADVIISNRMSADLADVADKVYTRDLFGND

SEQ ID NO: 53306 - protein, 334 aa, Escherichia coli
MKFLVTGAAGFIGFYVSKRLLAAGHQVVGIDNLNDYYDVNLKQARLDLLKHDNFSFYKIDLADREKMAALFADERFDRVINLAAQAGVRYSLENPNAYADANLIGFLNILEGCRYNNVQHLLYASSSSVYGMNLKMPFSTDDSVDHPVSLYAATKKANELMAHTYSHLYGLPTTGLRFFTVYGPWGRPDMALFKFTKAMLEGKSIDVYNFGKMKRDFTYIDDIAEAIIRLQDVIPEKDPQWAVETGSPATSSAPYRVYNIGNSSPVELMDYINALEEALGIEANKNMMPLQPGDVLETSADTKALYDVIGFKPETSVKEGVKNFVEWYRNFYKV

SEQ ID NO: 53307 - protein, 290 aa, Triticum aestivum
MAAPVALTIFLLILLPAHHALATAAGDVHPGYADAETDTCGPALDLGGSSSSSSSAGGAAGRRHAPGLEEYGGGRIVDITHAFRPGMPAYAPGAAAGPLVRLKESMENGSDYNLSELRMPCHMGTHVDAPGHMIQAHFAAGLDVDTLDLEVLNGPALLVDVPRHTNITAEAMESLNIPRGVRRVLFRTLNTDMGLMWKEGGDMSYVGFTEDGAQWLVDNTDIKLVGIDYISVASFDHLITAHVAFLKNADIIPVEALKLDNINTGLYMLHCLPLRLVGSEGSPIRCILIK

SEQ ID NO: 53308 - protein, 443 aa, Yarrowia lipolytica CLIB122
MLLRRVVHNTSSIRFYSSMTLQPLPKPARFAQTPKDVWSLINEAAAASEEASGKKVVNLGQGFFSYSPPQFAIDAAKKALDVPALNQYSPTRGRPSLLKAVSDAYSPYFGRTLDPASEIVITAGANEGMYAAFTAFLNPGDEVIVFEPFFDQYISNIELPGGKVVYVPLHPPKDSQHTSSAANWSLDIAEFEAAITPKTKMIVVNTPQNPTGKVFSKEELTQIGELAVKHNLIVLSDEVYDRLYFEPFTRIATLNEALARLTLTVGSAGKIFAATGWRVGWLIGNPDLIKYVAAAHTRICFCVNSPLQEASAQALIQAQTNSYYDDTIASIKKKHELLNSAFEYLGLPYSQAQGGFFVLVNFSKVKIPADYAFPSDLDGRAKDFRTAYWLIKEVGVVAIPPTEFFIPEHAHLAEDYLRFAVCKDDDLLEEAVERLKGLKKYIE

SEQ ID NO: 53309 - protein, 507 aa, Prochlorococcus marinus str. NATL1A
MSMPVTNPLRIGLRQERVVPPQCLVIFGASGDLTHRKLVPALFELFKQRRLPSEFAVLGCARRPWTDEIFKEKMEEALSSQIKESPKEWELFSQNLFYEPVDLQQPEHLVKLGERLEIIDKLKATHGHRTFYLSVSPKFYGSGCRALAAAGLLKDPKRSRVVIEKPFGRDFNSAQSLNSLVQGCAQESQIFRIDHYLGKETVQNILVLRFANTIFEPIWNRNYISSVQITSSETVGVEDRAGYYESSGALRDMVQNHLTQMLALTAMEPPGHFDPEAIRNEKAKVLQAVKLANEEKPWECCVRGQYSKGGSDEEPLLGYRDEPGVNPNSTTETYVAMKLFIDNWRWQGVPFYVRTGKRLAKRLSEVVLTFREAPVHLFDAAGGCPTSNQLILRIQPNEGAEFSFEVKSPGSGMRSRPVNMEFSYDESFGEPSDEGYVRLLADAMLGDPTLFTRSDEVEAAWRLYTPLLEKIEDSPWELPIYPYESRTWGPTESDLLIGKDQLLWRRP

SEQ ID NO: 53310 - protein, 436 aa, Actinobacillus pleuropneumoniae serovar 1 str. 4074
MTILALGINHKTASVNLRSKVAFDDQKRQLAFEQIQHRALAESVVILSTCNRTELYFHNAEITPREEHEDNIAWREQCFEWFAEIHQLEHNELRECIYFKQNMESARHLMRVACGLDSLILGEPQILGQVKQAYQYSENFYQSQNSHISTKLSRLFQRTFSTAKRVRSETEIGSSAVSVAYAACGLARQIFDNFGKLRFLLVGAGETIELVARYLIQHGAKNIMIANRTPQRAETLAERLNTPMQILSLSALQIGLNQADIVISSTGSPDMLISKEMVEIAQKQRQFDPMLLIDIAVPRDIDENAGELDAVYSYSVDDLQHIIQRNMAQREQAAEQAAQIVDEECKAFFEWLKQQQSSDLIKRYRQDAEQTRQELLAKALVALTSGQDSEKVLNELSYKLTNSLLHVPTQALQAMAKSGNSQGLQSFSKALKLEEQ

SEQ ID NO: 53311 - protein, 748 aa, Salmonella enterica subsp. enterica serovar Paratyphi A str.
MLTRLREIVEKVASAPRLNEALNILVTDICLAMDTEVCSVYLADHDRRCYYLMATRGLKKPRGRTVALAFDEGIVGLVGRLAEPINLADAQKHPSFKYIPSVKEERFRAFLGVPIIQRRQLLGVLVVQQRELRQYDESEESFLVTLATQMAAILSQSQVTALFGQYRQTRIRALPAAPGVAIATGWQDATMPLMEQVYEASTLDTSLERERLTGALEEAANEFRRYSKRFAAGAQKETAAIFDLYSHLLSDARLRRELFAEVDKGAVAEWAVKKIIEKFAEQFAALTDNYLKERAGDLRTLGQRLLFHLDDSVQGPNTWPERFILVADELSATTLAELPQDRLAGVVVRDGAANSHAAIMVRALGIPTVMGADIQPSVLHRRTLVVDGYRGELLVDPEPVLIQEYQRLISEEIELSRLAEDDVNLPAQLKSGERVKVMLNAGLSPEHEEKLGSRIDGIGLYRTEIPFMLQSGFPSEEEQVAQYQGMLQMFNDKPVTLRTLDVGADKQLPYMPISEENPCLGWRGIRITLDQPEIFLIQVRAMLRANAATGNLSILLPMVTSIDEVDEARRLIERAGREVEEMIGYAIPKPRIGIMLEVPSMVFMLPHLANRIDFISVGTNDLTQYILAVDRNNTRVASIYDSLHPAMLRALSMIAQEAEKNGLDLRLCGEMAGDPMCVAILIGLGYRHLSMNGRSVARVKYLLRHIDFEDAQTLARRSLEAQMATEVRHQVAAFMERRGMGGLIRGGL

SEQ ID NO: 53312 - protein, 331 aa, Bradyrhizobium japonicum USDA 110
MLNVLSSKAREEASMSAKNGSIKLVAGNSNPALAQAIAQGLHLPLTKAVVRRFADMEIFVEIQENVRGSDAFIIQSTSFPANDHLMELLIITDALRRSSARRITAVLPYFGYARQDRKSGSRTPISAKLVANLITQAGVDRVMTLDLHAGQIQGFFDIPTDNLYAAPLMVRDIKDKFDLSKTMVISPDVGGVARARGLAKRINTPLAIVDKRRERPGESEVMNVIGDVAGYTCILVDDIVDSGGTLVNAADALIAKGAKDVYAYITHGVLSGGAAARITNSKLKELVITDSILPTDAVSKAPNIRTLPIASLISDAIARTAAEESVSSLFD

SEQ ID NO: 53313 - protein, 195 aa, Clostridium acetobutylicum ATCC 824
MILIIDNYDSFTYNLYQYVGEIYKDVKVARNDEISLEDIKKMKPEGIIISPGPGTPYDAGISIEVVKRLGEFIPILGICLGHQSIAEAFGGKVIGAQTIMHGKTSVIKHDEKEIFEGIKNPLKVMRYHSLVADKYSFPNELYITAETDDGVIMAVRHKRYKIFGIQFHPESYFTEDGRKLIKNFLGGICNVKGCY

SEQ ID NO: 53314 - protein, 225 aa, Medicago truncatula
MAEVKLHGFWYSPYTLRVVWTLNLKGIPYENIEEDRFNKSPLLLQYNPIHKKTPVLVHDGKPICESMIIVEYIDEIWPQNTLLPADPYDRAQARFWVKYVDELISVIAAFLHSKVGEEREKARENLWERLRVIEDQCLDDRKTFYGGDTINIVDIALGSFIKFIEVQEDMFKVKILQSERFPRLHLWFNNFKDAPVIKENTPDQEKLVAFLNPLIEKIKAVKASS

SEQ ID NO: 53315 - protein, 223 aa, Medicago truncatula
MAEIKLHGSWYSPFTLRVVWTLNLKGIPYDSIEEDHFNRTPQLLQYNPIHKKTPVLVHDGKPICESMIIVEYIDEIWPQNSLLPADPYARAQARFWVKYIDDMFSAIRAFHRSIIKGEEREKSRENLSERLKVVEDQCLDDHNKFYGGETINIVDIALGSFVKFIEVQEDMFEVKILKSERFPRLHLWFNNFKDVPIIKENTPEQEKFVAYVRPLIEKIMASS

SEQ ID NO: 53316 - protein, 489 aa, Clostridium acetobutylicum ATCC 824
MSAELEKDKNGELKRSLKTRHMNMIAIGGSIGTGLFFTSGNTISTAGPGGAIAAYAIMGVLVYFLMTSLGEMATMIPNAGSFETYASKFVDPALGFALGWNYWFNWAITVAAELVAGGLVVKFWLPNTGTTIWSIGFLVILFGLNLLSAKAYGEGEYWFSSIKVVTIIVFLIMGVLIIFGIMGGHGVGFSNWVLKDGKGNSAPFVGGGMAILMSFLTAGFSFAGTEVVGLAAGEAENPEKDVPKAINSVFWRILIFYIGAIIVIGFIIPFNDSNLLKNGVSDIAYSPFTIVFKRSGIALAASIMNAVILTSVLSCGNSGLYAGSRMMYAMAKEGKAPKIFGKLNKSGVPLNALIFTSVIASTAFFASLIGDGKIYSILYNLSGITTFITWLGIAICHYRFRKAYIAQGNKIEDLKYKALLYPFGPIFAMILCTVVLFGANIWVFQAKTFSWFDFTTNYGSIPLFLCFYFIYKKVHKTRIVSLMECDLNK

SEQ ID NO: 53317 - protein, 190 aa, Picea abies
TAGISGGHINPAVTFGLFLARKVSLPRAILYMIAQCLGAICGTGLVKAFQKSFYDKYGGGANYVHHGYTKGVGLAAEIIGTFVLVYVVFSATDPKRSARDSHVPVLAPLPIGFAVFMVHLATIPITGTGINPARSFGAAVIYGHKQSWDDHWIFWVGPFIGAALAAAYHQYILRAAAVKALGSYRSNVDV

SEQ ID NO: 53318 - protein, 191 aa, Cryptococcus neoformans var. neoformans JEC21
MSIENLHIADETEIPAGATVELHSRPERKARKALEGLGLKRVQGIQRVTLRRARNVLLVVSSPEVYKSPGSDCYIVFGEAKVEDPNSAAQLQAQAQLAASSQAAQQAHAHGGFKEGVPKSLEELMQDAPSTDSSAPAPSGEATDASASGDFKVSDEEIQLIVAQTGVDEAKAREAYISEKGDLINAIMKLQ

SEQ ID NO: 53319 - protein, 158 aa, Bacillus cereus ATCC 10987
MFRIGQGFDVHEFAEGRPLIIGGVTIPHEKGLIGHSDADVLLHTIADACLGAIAAGDIGKHFPDTDPAFKDADSAVLLQKVWEFVREQGYELGNLDCTIIAQKPKMAPHIESMRKRISELLETSIDNINVKATTTEKLGFTGREEGIASQAVVLLQKK

SEQ ID NO: 53320 - protein, 533 aa, Aspergillus nidulans FGSC A4
MPPKGASKPAARATTTSKKKTATTASTTKNSRGRAAATTKTTVKSTATRKTTKADEVGATKKTAAPAKKRRADAEDAETSRSTKRARVVKPAAAKPRPKVVINNAPTAKLNVYVCGEGSSGELGLGVGKNVIDVKRPRLNPHLLPDDVGVVQVAVGGMHCVALTHDNKVLTWGVNDQGALGRDTTWEGGYKDMDNRDSDSDSDSDSDDNPDLNPHECTPTAIPSSAFPHGTVIVEVAAGDSSSFALTDEGQVYGWGTFRSNDGILGFDAKTKVQTTPKLLPDLKKIKHLVCGDNHVLALNDKGAVLSWGSGQQNQLGRRIIERNKLNGLQPREFGLPKGIVHIGAGAFHSFAVHQSGKVFAWGLNSFGETGIRENAGDSEAAIVHPTVVDSLSKKNVTQICGGAHHSIAATQDGECLVWGRLDGYQTGLKIDTLPDDAVIKDERDRPRILIEPTAVPGIKAKAVAAGSDHSIAIDTSGRPWSWGFSATYQTGQGTQDDVEVATVIENTAVRGKSLNWAGGGGQFSVFTEPVEL

SEQ ID NO: 53321 - protein, 357 aa, Clostridium acetobutylicum ATCC 824
MKEYKVAVIPGDGIGVEIVGEALKVLEKVGAKYDTKFNFTEVKAGGCAIDEFGVPLPNETLEICKNSDAVLLGAVGGPKWDTLPGEKRPEKALMGLRGGLGLYANLRPAKVYDILKSASPLKEEIINKGVDLLVVRELTGGIYFGERGRDIQNGINSAYDTERYNVEEIKRIAHVAFKAALKRNKKVTSVDKANILESSRLWRETVTEVAKEYPEVELNYLYVDNAAMQLVREPSQFDVIVTSNIFGDILTDEASMVTGSIGMLPSASLRNDTFGMYEPIHGSAPDIAGQDLANPLAQILSVAMMLEYSFNMTEAARDVEDAVEKVLNSGYRTGDIYTEGSKKVGTKEMGKLVLAEL

SEQ ID NO: 53322 - protein, 416 aa, Bifidobacterium longum NCC2705
MTAVEFIEPLTHEEGVSQATKLFVDTYGAAPEGVWAAPGRVNLIGEHTDYNAGLCLPIALPHRTFIALKPREDTKVRVVSDVAPDKVAEADLDGLKARGVDGWSAYPTGVAWALREAGFDKVKGFDAAFVSCVPLGSGLSSSAAMTCSTALALDDVYGLGYGDSDAGRVTLINAAIKSENEMAGASTGGLDQSASMRCTEGHALLLDCRPELTPLENVSQQEFDLDKYNLELLVVDTQAPHQLNDGQYAQRRATCEQAAKILGVANLRVTADGIAKADDPFQALKETLDALPDETMKKRVRHVVTEIERVRSFVRAFASGDIEAAGRLFNASHDSLAADYEVTVPELDVAVDVARKNGAYGARMTGGGFGGSIIALVDKGRSQEVAQKIADEFEKQGFHAPRALAAYAAKSASREA

SEQ ID NO: 53323 - protein, 454 aa, Xanthomonas campestris pv. campestris str. ATCC 33913
MSYDTVNPANGQVEHTQHTLDAAAIEARLAASAKAFPEWAALPLAERGALLRRVGEELTKRREDLQRIMTAEMGKLRREALAEIDKCAQGCAYYAEHAAEYLAPRAIPTEAQSSYVRYEPLGCVFAVMPWNFPLWQAFRFLAPGLMAGNVALLKHASNVPRCADAMKEVLDAAGIPPGVFDVLHIDNDQAAEVLRDDRIAAVTLTGSERAGRSLAANAGDQLKKCVMELGGSDAFVVLDDADLERTVQSAVQSRFDNSGQTCIAAKRFIVVDAIADQFVERFVAAAAQRVLGDPQQDATTLAPMARADLRDELHKQVQESVSKGAKVLLGGEPVAGSHAGYPATILDQVGPGMPAYEQELFGPVAAVIRVADEAEAVRVANDTTFGLGGSVWTADAKRGERVAQQLQCGAAFVNSVVKSDVRLPFGGIKRSGFGRELAEHGIHEFMNIKTIYVA

SEQ ID NO: 53324 - protein, 299 aa, Prochlorococcus marinus str. NATL1A
MQEAIASFDFAEYLEKARTRVEDALGASLGPEKPEKLRESMRYSLLAGGKRLRPILCLAACELAGGELEKALPTAVALEMIHTMSLIHDDLPSMDNDDLRRGRPTNHKVYGDAVAILAGDALLTRAFEMVSIRTEGIPSERLLKIIGELSLAAGAPGLVGGQVVDLDCEGKEVDLETLEYIHLHKTGALLKACVTCGALIGGADEKLLDALSIYARGIGLAFQIIDDILDVTASSEVLGKTAGKDLIADKTTYPKLLGLDESRRRADLLVAKAKSALDPWPEKSKPLLALADYITSRDR

SEQ ID NO: 53325 - protein, 872 aa, Magnaporthe grisea 70-15
MPNIAQSARIIFWLRCSSAELVNTPPEVLARTGAADVDIAMLKLGGSRSAGVWCASFCTPGQSRPQAWGKMGSGRTAARLVGIDVDRYSKERRTAVPGNLVGVSYYVEAEPTAKEALEQLIPTAAGVKRYFRSLFPFLSWIFHYNLTWLSGDLIAGITVGFVVVPQGMAYALLAQLPPEFGLYTSFVGFLLYWAFATSKDITIGTVAVMSTIVGNVVIRVQSTQPDIPAEQIARCLALLSGVVLLFLGLVRAGFIVEFISLTAIASFMTGAAVSIAAGQVPTMMGISGVSSRDPTYLVIINTLKGLPRTKLDAAMGLSALVMLYSIRSFCNFMARRQPRRQKMWFFIATLRMAFVILLYILISFLVNRNVTKASDARFRILGTVPSGFQHVGAPVMTSKVLNAVAPDLPVTIIVLIIEHIAISKSFGRINNYIIDPSQELVAIGFSNVFGPFLGGYPATGSFSRTAIKAKAGVRTPLAGIFTAAIVLLALYVLTSVFFYIPSASLAALIIHAVGDLITPPNTVYQFWMTSPIEVVVFFAGVILTVFTNIENGIYLNMAASAALLLFRIARSPGRFMGHTRIYTTTSTAGASASELEASGTGRDAYFDEERRDNANPDLPIRQVHPGIFVYRFPDGFNYTNSAAHLDFITMYVYKKTRRTVLDNNAKIGDRPWNDPGPRRGQMVTDDMANRPILRAMVLDFSSINYADVTSVQALIDLRNQFAKHAAPSPVEWHFAGVTNRWTKRALVAAGFGFADTAAEADHSASSSREKDYESDSGSRVPGSPNTPWAPLFSVSVVDGSGNVEPRHEDGSRMAVDAEKGNGTAADGNGSAAGAASLGGSSLVPVYGLNRPFFHVDVAEAVQSALSSIESNT

SEQ ID NO: 53326 - protein, 292 aa, Bradyrhizobium japonicum USDA 110
MVMGPGLRRDDTEFVVTTVANSTLQNITGTILLAGAGKMGGAMLTGWLAGGLDPRRVAVVDPHIAPEISALAAKGVALNPDAKAAGQVETMVVAVKPQMFREAGAKLKPFVSEKTSVVSIMAGTTIASLQEVCGGAVVRAMPNTPAAIGRGITVAVAAKNVSTAQRAVADALLRATGSVEWVEDESLMDAVTAVSGSGPAYVFLLAEELARAGVEAGLPEALATKLARETVAGSGELLHQSELPSGTLRQNVTSPGGTTAAALGVLMGEPGLRDLMIRAIAAATQRSKELAK

SEQ ID NO: 53327 - protein, 344 aa, Magnaporthe grisea 70-15
MADSNNGPETEKVNTNIVTLTRFLTEEQAKHKEATGDFTLLCHALQFSFKAIAYYIRRATLVNLTGLAGSSNTTGDDQKKLDVIGNDLFIEAMRSSGKCALLVSEEEEEIIFFTNGNGSARYAVACDPIDGSSNLDAGVSVGTIFGIHKLAEGSTGSKEDILKPGSELLAAGFTMYGASAQLVLTMKNGGVNGFTLDNAFGEFILTHPDMRMPKSRAIYSVNEGNSLYWEDHVKEYFSSLKHPQEKSGKPYSARYIGSMVADAYRTLLYGGIFAYPADKKSPKGKLRILYECAPMAMVFENAGGQAIDSNMKRMLDVVPEHIHDRSGIFMGSWDEVEKVKAYHK

SEQ ID NO: 53328 - protein, 424 aa, Zea mays
MPSASLRLAVVGAGAAGLVAARELRREGHAPVVFERAAAVGGTWLYTPPATSSDPLGAAATHSSLYASLRTNLPRETMGFLDFPFAAGAAGSRDPRRFPGHEEVLRYLEAFARRFDLLRLVRFETEVLSVRREDGGRWAVTSRKLGDKGSGEEEFYDAVVVCNGHYTEPRLAVIPVINSYTYRTSTGVDAWPGKQMHSHNYRVPEPFLDQVVIIIGASASAVDISRDIASMAEEIDHAQEDGTVVFQDGSSIKADVIMHCTGYLYDFPFLGDDSTITVDDNRVDPLYKHIFPPEVAPHLSFIGLPWKVIPFPLFELQSKWVARVLSGRINLPSEDRMMEDVKAFYLKLEAHGWPKRYTHNFANYQFEYDDWLAEQCGHPPVEEWRKQMYAVTSMNKAARPESYRDEWDDEHLVAEANEYFKKFL

SEQ ID NO: 53329 - protein, 490 aa, Nicotiana attenuata
MGFENEKNNSILSKLATNEEHGENSPYFDGWKAYDNDPFHPLKNPNGVIQMGLAENQLCFDLIEEWIKRNPNASICTTEGIKSFRAIANFQDYHGLPEFRRAIAKFMEKTRGERVTFDPERVVMAGGATGANETIIFCLADAGDAFLVPSPYYPAFNRDLRWRTGVQLIPIPCDSSNNFQITTKAVNEAYENAQKSNIKVKGLILTNPSNPLGTTLDRDTLKNFLTFTNQHNIHLVCDEIYAATVFNTPQFVSIAEILNDEMSHCNKDLVHIVYSLSKDMGLPGFRVGIVYSFNDAVVNCARKMSSFGLVSTQTQYLLAEMLSDEKFVSNFLAESSKRLAKRHKHFTNGLEEVGIKCLRSNAGLFCWMDLRPLLKQSNFDAEMSLWKVIINDVKLNVSPGSSFDCQEPGFFRVCFANMDDETVDIALARIRRFVGVKESGDETTAMEKKQQWKKNNLRLSFPKRMYDESVNNLSPLSSPIPHSPLVRARN

SEQ ID NO: 53330 - protein, 244 aa, Zea mays
  misc_feature (207)..(207): Xaa can be any naturally occurring amino acid
  misc_feature (217)..(217): Xaa can be any naturally occurring amino acid
  misc_feature (238)..(238): Xaa can be any naturally occurring amino acid
TTRPGDMTKTKATGGLTGRESSSSSHASKRRRGLRGESMADRFIPNDFPDFVAEAEASDGEGHRPAGHRGLLSLPYTRLSDHFVRAARRLKDKVVEETWVKAGRKVTDYTLYTGSLGTALLLFKSFQVTGDRGDLALAADIVRACDDASRGLPFLTFICGRAGVCALGAVIAKHCDDQLRVTQYLSSFDEITITEKVPNELLYGRAXYLWACLFLKXHLSEKTIPLDHINSVAKDIIXEGRGFA

SEQ ID NO: 53331 - protein, 209 aa, Triticum aestivum
  misc_feature (22)..(22): Xaa can be any naturally occurring amino acid
  misc_feature (103)..(103): Xaa can be any naturally occurring amino acid
  misc_feature (150)..(150): Xaa can be any naturally occurring amino acid
  misc_feature (167)..(167): Xaa can be any naturally occurring amino acid
  misc_feature (195)..(195): Xaa can be any naturally occurring amino acid
MTSVWKTKVLPVLNKIFDKDGXKAADGEFLISFNKEDIDKEIDDKKIELEPKVVETIEASPPEIKGLMKDKKASKIKKNSVAVNKYLDDLDNIDFPGAKLVSXAVPKSGTTPLSPAIVFIWDKVAPFVPAPKEEPKAEPVDAAPAEETTXREVAVEEMMVEAEPSAXPAEAPAPVEAAAPAAEVVEEKKEEEKPXAEAAAPAAEEPEKK

SEQ ID NO: 53332 - protein, 256 aa, Solibacter usitatus Ellin6076
MIVRKTAAELEKMRRSGLLVWNVLHALKDMAVEGASTMDLEVAAEKMIADAGAKPAFKGYYVPAAGEAFKFVLCTSVNDEIVHGMPNVKRVLKKGDIVSIDTGVKLDGYYGDSAITVPIGEVSEQTKKLLQVTQDSLELAIEKVRSGNRLFDVCATVENHVKGNGFSIVREYVGHGIGTQLHEEPQVPNYVDRKNENPKLKPGMVLAVEPMVNAGKPEAMVLKDKWTAVTRDGSYSAHFEHCIAVTENGPWVLTRP

SEQ ID NO: 53333 - protein, 293 aa, Deinococcus radiodurans R1
MTDAGGQEQREQWQQEEAAGYAVAFQGNPGSYGEIAALNALPQVRETLGYPTFHEVARAVENGEADYGVLPVENSLMGAIHQSIDLLTETELHVTGEVVVRVSHCLMALPGVEMADIRKVGSQQPALDQCTHLIREHGWQPLAKHDTAGSAKDLAERGARDEAAIASRRAAELYGLNILQTGVEDEPFNFTRFMVLSRHAPEPSDAPHKTSLIFAVRHTPGFLLETLGELRGLNLSRIESRPRRDRAWSYLMYVDIEGKASDPQVAQALAGILVKASYAKIIGSYPAAQGTVQ

SEQ ID NO: 53334 - protein, 225 aa, Medicago truncatula
MAEVKLHGFWYSPFTLRVVWTLNLKGIPYENIEEDRFNKSSQLLHYNPVRKNTPVLIHDEKPICESMIIVEYIDEIWPHNSLLPSHPYDKAQARFWVKYVDGMISAIEAFRHSISCEEREKAKENLWARLRVVEDQCLDDQKKFYGGDTISIVDITLGSFVKFIEVQEDIFGEKILQSERFPRLHLWFNNFKDFPVIKENTPDQEKLVAFHNLLIKKIKAIKTSS

SEQ ID NO: 53335 - protein, 306 aa, Alteromonadales bacterium TW-7
MKAVIPVAGLGTRMLPMTKAIPKEMLPIVDKPLIQYIVNECVAAGIKEIVLVTHSSKNAIENHFDTSYELEATLEKRVKRTLLEEVRSICPSDVTIMHVRQGEAKGLGHAILCAKPIVGIDDFVVVLPDVILDAYTANQKTENLAAMIARFNETAASQIMLEPVAQDDVSKYGIADINGVQLVAGESAKIKTMVEKPDVDAAPSSLAVVGRYVLSKNIWPLLAKTPVGAGGEIQLTDSIDALMAQETVEAFHMSGRAHDCGDKFGYLKAIVEYGMRDEKLGKEFAQHLNTLVNGENALTLNNVVNL

SEQ ID NO: 53336 - protein, 221 aa, Medicago truncatula
MTVKLHGFWYSPFTLRVVWTLNLKGIPYENIEEYRFNKSPLLLQYNPIYKKTPVLIHDGKPICESMIIVEYIDEIWPHNSLLPADPYDRAQARFWVKYVDELISAIEPFLNSISGEEREKARENLWERLKVIEDWCLDDKKKLYGGDTINIVDIALGSFVKFIEIQEDMFEVKVLQSERFPRLHLWFNNFKDVPVIKGNTPGQEKLVAFGKCLIEKILVSF

SEQ ID NO: 53337 - protein, 157 aa, Alteromonadales bacterium TW-7
MIEQGQNVPEVTLTQLTSEGMQTLTNKELFDGKKVVLFAVPGAFTPTCSNAHLPEFITLADKIKAKGVDAIYCVSVNDAFVMKAWGDSQNAEEILMLADGDASFTKALGLEKDTAGFGGIRSSRYAMIVNNAVVTGLFVEEGKEFTVSRAEHVLEKL

SEQ ID NO: 53338 - protein, 185 aa, Lentisphaera araneosa HTCC2155
MIFVTHMETTPNPNALKYVLNETILEDGICQFSAAEEATDDLARACFAVEGVVSIFYRDNYITITKNDSADWFEIEMTIKDEINNRVEAIEFKAQAVPEINFGEKQTLVFEIDDILDETIRPGLAMDGGGVDIIDLSDEMVLSVRYQGACGSCPSSTTGTLMAIENILQEQFDPRITVQIANHTY

SEQ ID NO: 53339 - protein, 488 aa, Bacillus anthracis str. Sterne
MNSATNQTTSQTETTKGKGELRRGLKSKHLTMISLGGTIGTGLFLASGGVIHSAGPGGALIAYAAIGIMVYFLMTSLAELTAYMPVTGSFSTYATKFVDPSLGFALGWNYWYNWAITIAAELAAVTLIMKFWFPDTPSLIWSGLCLAIIFLLNYLSVKGFGESEYWFALIKVATIIIFLIVGFMMIFGIMGGETVGFKNFTVADAPFNGGIMAIIGVFMAAGFSFQGTELLGVAAGETSDPERNIPKAIRSIFWRILLFYILAILVIGLLIPYTTESLAASDVTVSPFTLIFEKAGVAFAASVMNAVILTAVLSAGNSGMYASTRMLWDLARQGKAPKFLGKLDSRGVPVNALIVTSIVGSIAFIASLFGDGVVYIWLLNASGMSGFIAWVGIAISHYRFRKAYIAQGKDLNDLPYRAKWFPFGPIFAFALCVIVILGQNYGAFMGESIDWNGVLVSYIGLPLFLVLWLGYKFTKKTKVIPLDKCELK

SEQ ID NO: 53340 - protein, 169 aa, Solibacter usitatus Ellin6076
MNTTVKRIDPASLNLKEQVVAINRVTKVVKGGKNLSFSALVVIGDPSAKVVGYGVGKAKEVPSAIRKGIEAAKKNLRRINSLDTTIPHQVLGVFASSQVLLKPASPGTGVIAGGAVRAVITACGVPNVLTKSIGRRNPHNVVKATIVALEMLRDRNTVAEMRGLAVEKL

SEQ ID NO: 53341 - protein, 400 aa, Nocardia farcinica IFM 10152
MTYDVARVRGLIPSLGDGWIHLDPQAGMLVPDVVSRAVSTGFRTASFSHLGRNNAARRSAAILDAAREAVADLVGGDPAGVVLGPDRAVLLAWLAESLSSRLGLGTGIVLSRLDDEANVAPWLRIANRYGAHVRWAEVEIETCEMPSWQFEELIGPTARLVALTAASPIVGSAPAVRVAADRVHEVGGLLVADAFGAAPYALIDIDELNADVVALSAPAWGGPQIGALVFRDPAFLDRIPSMSLNPYAKGAERLEVGGHQYTLLAGLTSSIDFLAGLDDRARGTRRERLEISITSLQDYHDQLFEHLMDTLDKIPNLTVIGRASTRIPTVSFTIAGMQAEKVAATLADARISTLSGVHGGSRLLDALGVNDEGGAVTVGLAPYTTRFEIDQLGRALAALD

SEQ ID NO: 53342 - protein, 319 aa, Nicotiana attenuata
MENFPIINLEKLNGSEKAATMEMIKDACENWGFFELVNHGIPHEVMDTVEKLTKGHYKKCMEQRFKELVASKGLEGVEAEVTDMDWESTFFLRHLPVANISEVAGLDDQYREVMRDFAKRLENLAEELLDLLCENLGLENGYLKNVFYGSKGPNFGTKVSNYPPCPKPDLIKGLRAHTDAGGIILLFQDDKVSGLQLLKDGQWIDVPPMRHSIVVNLGDQLEVITNGKYKSVMHRVIAQKDGTRMSLASFYNPGSDAVIYPAPALVEKEAAESKQVYPKYVFDDYMKLYAGLKFQAKEPRFEAMKSIESDVKLDPIATA

SEQ ID NO: 53343 - protein, 192 aa, Lentisphaera araneosa HTCC2155
MLVMIDNYDSFTWNLVQYFGELGHLPKVIRNDKVSIAELDELNPQALIISPGPCSPKEAGISCEAIEHFAVKGVPVFGVCLGMQSIVEVYGGTVGRAPMLMHGKTSPIEHTGQSVFTDIPSPYDATRYHSLCALGELPDCLEITAKSDDGVVQGVMHKTLPVHGVQFHPESILTEHGHDLLNNFLKIAGIVN

SEQ ID NO: 53344 - protein, 665 aa, Zea mays
  misc_feature (121)..(121): Xaa can be any naturally occurring amino acid
  misc_feature (142)..(142): Xaa can be any naturally occurring amino acid
MATMSAASHRCCASSLRALTVLFVLAALVSDVGGRHHHHVCRPYFSCGGFSNISYPFRRQGDPSGCGVQSYELVCTDTDATIRIGSGTYTVLSINSTYSYFWVVDANLDIQSSCPLPWWDXMVRPVLPTHIVGGLSSGLISXYPNSMSIIFVNCSKPIENNDIYEPVPCLSNSSFIYLLTHYSYGYALAEILEPSCGYLAMIYLGGPGIPVPKNTSYPDVVKLMRNGFGLRFPSSIGDRGIRECFAESVRNFLKEPRKYQIVDILMVEELWSCFLDQHGSTNNVVTSVIIDIIKTIPICMWLLKSTHVFCRLVLMPLAVFVFLAHKYWKARITIDAVEKFLRMQQMLVPMRYAYTNIIAITGHFREKLGQGGYGSVYKGVLQPGEVHVAVKMLGNSNCNGEEFISEVATIGKIHHVNVVRLIGFCSEENIRALIYEFMPRGSLDKYIFSSEKSFSWDKLNEIALGIARGLNYLHHGCDMQIVHFDIKPHNILLDNNFVPKVADFGLAKLFPRDDSFVPLSAMRGTIGYIAPEMVSRSFGVISSKSDVYSFGMLLLEMTGGRRNADPHAGSSSQAYYPSLVYRQLSQGDANRISEGVDMHELEKKLCIIGLWCIQMKPQDRPTMSEVIEMLEAGVDGIQMPPRPYFCDEEGDSSYSIISELDTIEE

SEQ ID NO: 53345 - protein, 165 aa, Clostridium acetobutylicum ATCC 824
MRLYVLSVLVDNIPGVLTRVCGLFNRRGYNLESVTAGVTENDKISRLTLIASVKDENEIDQIVKQIKKIEVVHKVVLLNRENSVCREIMLIKVNAEGVQRQEILNTVSIFRASVVDVTTKTFTIEITGNSSKIEAFQKMLEPYGIIEVVSSGSIAIERGQNSILS

SEQ ID NO: 53346 - protein, 440 aa, Photobacterium damselae subsp. piscicida
MNDLSYIAETQQSAIKQTRLIQIRGRVTQVTGTIIKAVVPGVRVGELCELRNPDQTLSLLAEVVGFQQHHALLTPLGNMFGISSNTEVSPLGKMHEVGVGDHLLGKILDGLGRPFDGSQSTEPSAWYPVYRDAPPPMQRKLIEKPISMGVRSIDGLLTCGEGQRMGIFAAAGGGKSTLLAKLIRSADVDVTVLALIGERGREVREFIEHDLGEKGMARSVLVVATSDRPAMERAKAAFVATSIAEYFRDQGKRVLLLMDSVTRFARAQREIGLAAGEPPTRRGYPPSVFAALPKLMERAGQSDKGSITALYTVLVEGDDMTEPVADETRSILDGHIILSRKLAAMNHYPAIDVLRSASRVMNQIVDKTHQASAAHMREMLAKYEEVELLIKIGEYQHGADSRADMAIAQGDDIRVFLRQGTHEPSELEETVTQLSGLAGL

SEQ ID NO: 53347 - protein, 198 aa, Ehrlichia ruminantium str. Welgevonden
MTLVPMVVEQTSRGERAYDIYSRLLKERIIFITGPIEDQMASLVVAQLIFLEAENPEKDISMYINSPGGVVTAGLSIYDTMQYVKPRIATLCLGQAASMGSLLLAAGEKGMRCALPNSRIMIHQPSGGFQGQATDIEIHAKEILNIKSRLNYIYVKHTGRELSEVVASMERDNFMSADSAQDFGIIDKVIEKRLDIDV

SEQ ID NO: 53348 - protein, 46 aa, Populus suaveolens
MGSGQWLVEKRSGLENDSFLNEHETAPESGCLSIIVLGASGDLAKK

SEQ ID NO: 53349 - protein, 441 aa, Corynebacterium diphtheriae NCTC 13129
MLDAQQSPPLTRNQRLDRLPLNSQHKRLLVGSGLGWALDAMDVGLISFVMAALIKHWGLTHGQTSVLASAGFVGMAIGATFGGLLADKWGRRNVFALTLLVYGLATGASALAGGLAVLIVLRFIVGLGLGAELPVASTLVSEFAPLRHRGRLVVILEAFWAVGWILAAIIGAFVVSASDSGWRWALVLGCVPALYSAYVRSSLPESVRFLEARGRHDEAEAAVQQFEKASATIPDTPVIATEDPADQADSIFAPNMRRRTFGLWTVWFCINLSYYGAFIWIPSLLVADGFSLVKSFQFTLIITLAQFPGYALAAWLIEIWGRRTTLAVFLLGSAGSAALYGFADTTALIIAAGCCLSFFNLGAWGALYAISPELYPSQIRGTGTGSAAGFGRIASIIAPLIVPPIVAAAGTPALFALFGAAFLAAAIAAFTLPEQRGKALV

SEQ ID NO: 53350 - protein, 443 aa, Prochlorococcus marinus str. MIT 9313
MPLRLLLVRHGLSSFNRERRIQGRSDLSTLTSQGQEQARQTGQALKEIQINAVYSSPLKRAASTTTNLLASKGSDLRPCFDDGLLEIDLAPWSGLCSDEVKSMFPDAYRTWKQQPQELVLKREDGNPYKPIGELMEQAREFLRKLIQRHPMEGDETVLVVSHNCILRCLILVLLGEPDQGLRRLRLDNASLSVFNLIPLSEQSHQAQVECLNSTVHLHQQLPSKGKGPRLILVRHGETDWNQQGRFQGQIDIPLNKNGFAQAAAAGAFLSDVLIDQAYSSSMTRPRQTAEAILKHHPDVQLEVTQGLVEIGHGLWEGKLESDIEAGWPELLDAWKKAPQTVQMPEGETIQDVWKRSVACWNKIANSLAPEATALVVAHDAVNKTILCHLLGMTPADIWAVKQGNGGVTVVDIATDPGQPAVVTSLNLTSHLGGVLDRTAAGAL

SEQ ID NO: 53351 - protein, 540 aa, Arabidopsis thaliana
MERKAIPNAHQEETGGKVRFITSNPGLRAPVKMLLGGQATNGALRSKTKIICTLGPVSRSVEMIEKLLKAGMNVARFNFSHGSHSYHQETLDNLRTAMDNTGILSAVMLDTKGPEIRTGFLKEGKPIQLNQGQEITISIDYMIEGDSNVISMSYKKLAEDVKPGDVILCSDGTISLTVLSCDKSFGLVRCRCENSAILGERKNVNLPGIVVDLPTLTEKDKEDIIQWGVPNKIDIIALSFVRKGSDLTEVRRLLGEHSKNIMLMSKVENQEGVMNCEKILENSDAFMVARGDLGMEIPIEKMFLAQKTMIKMANALGKPVVTATQMLESMTVSPRPTRAEATDVANAVLDGTDCVMLSGETAAGAHPEAAVLTMSRICKEAEDFIDYDILHKKTLGMVSLPLSPIESLAASVVSTAQSVFASAIVVLTKGGYTAELVAKYRPSVPILSVIVPEIAQGNDMEMSCSDSVAHAARRGLIYRRIIPVVATGSSARDSNKDATEEMINLAIGFAKTKGICKNGDSIVALHKIDGSSVVKIVTVE

SEQ ID NO: 53352 - protein, 460 aa, Xanthomonas campestris pv. campestris str. ATCC 33913
MSERVVDPSVLRSLQQLDAAHHLHPFNDNAALASKGTRILTRGEGVYVWDADGNKLLDAFAGLWCVNLGYGRAELAQAAARQMEQLAYYNSFFQCTTEPTVHLAAKLAELAPGDLNHAFFANSGSEANDTILRLVRHFWAVQGQPQKHIFIGRHDGYHGTTMGGASLGGMRGMHRQGGLPIPGIEHIAPPNHFGEGGEMDPDDYGLLAARRLEEKILQLGPDTVAAFIGEPIMGAIGVYIPPRSYWPEIERICRRYDVLLVADEVICGFGRTGAWFGAEYFGFQPDVMTLAKGITSGYIPLAAAMFNDRVAGVLKRQGGELAHGGTYAGHPVCAAVALENLRLLQDEGIVDTARTQIAPYLAQRWAELGAHRLVGEARIAGLVGALELVPDKRRRGVYFPERGRVGALCRDFALRRGLILRATYDAMLLSPPLIITCEQVDELFDKTWAALDDTAQALGK

SEQ ID NO: 53353 - protein, 431 aa, Burkholderia thailandensis E264
MNAPVERGATAAPHHAGSLTILQGTALYIGAVLGTGVIALPALAAEVAGPASLLAWAALVVLSIPLAATFAALGARYADAGGVSTYVRNAFGAKAAAVVGWCFYFAVPAGAPAAAMFGGAYVAAVTGGGHATMIASAAALIAIVAAANAFGVTVSGRMQLVLSALLVALLVAAVLASAPHARAANLHPFAPHGWLAVGQAAALLVWSFAGWEAITHLAAEFRRPAHDLPRSTGIAVAVVGLLYLSVAAASVLVLGPAAGTSGAPLAALIARGIGGNAQLIATAAALLLTLGTMNAYFAGAAKLGAALGRDGALPRWFAQGSQTGGVPRRSLAVLAALAGCALAATVATGTGPKPLVLATSGNFVMVYVLGSAAATKLLPRGGFARRASVVAFLSSLLLLATTGWYLLWPLLLTAAAIGYLRVTDKRTAAKR

SEQ ID NO: 53354 - protein, 174 aa, Prochlorococcus marinus str. MIT 9313
MDLSSLLPSPSPGLVNLLVEIPAGSRNKYEYFDEAGVMALDRVLHSSVRYPFDYGFIPNTLAEDGAPLDAMVIMEEPTFAGCLIRARPIGVLDMHDSGAYDGKLLCVPVADPRQRSISSIRQISASQLEDVAEFFRTYKNLEGRVVDIGGWRDSEAVEPLLETCAKAAQVKLKK

SEQ ID NO: 53355 - protein, 126 aa, Kluyveromyces lactis NRRL Y-1140
MSAPNPKAFPLADATLSQQILDVVQQASNMRQLKKGANEATKTLNRGISEFIIMAADCEPIEILLHLPLLCEDKNVPYVFVPSRTALGRACGVSRPVIAASITTNDASAIKSQIYAVKDKIETLLI

SEQ ID NO: 53356 - protein, 459 aa, Xanthomonas campestris pv. campestris str. ATCC 33913
MATETRVASLPSIDAAALAAIEGCALVDLLLPDTNGVLRGKRVTREALDKVYRDGVCLPMSLIATDITGNTVEETGLGYAIGDADRICRPIAGSLRPVPWAPQPMAQLLLAMHTPNGALFEVAPRAVLQRVVQGFAALGLTPVIAVELEFYLFDAMADAQGRPQTPRDAHTGERNTSTQVYALQDLDDHRSFTDAVTAACRQQGIPADTAVAEYAPGQFEINLQHRADAVAACDEALLLKRTIKAIAQQQHLLASFMAKPFAGQAGSGLHVHVSLLDAAGHNVLHGTADAPAAALRHAIAGLQRHADASLLLFAPHANSYRRFVPNAFVPLDASWGFNNRTVALRIPHSDAHNTRIEHRIAGADANPYLVAAAVLAAMLDGLQHPGDPTAPVQGNAYAQATFTPRTWQGAVDAFLRSDFIATQLGTQFQHVFGQQKQRELLDYQALVPDLDYARYLRTV

SEQ ID NO: 53357 - protein, 151 aa, Neurospora crassa
MSTAARRRLMRDFKRMQTDPPAGVSASPVPDNVMTWNAVIIGPADTPFEDGTFRLVMHFEEQYPNKPPSVKFISEMFHPNVYATGELCLDILQNRWSPTYDVAAVLTSIQSLLNDPNTGSPANVEASNLYKDNRKEYHKRVRETVEKSWED

SEQ ID NO: 53358 - protein, 146 aa, Prochlorococcus marinus str. MIT 9313
MKRMTTALHHMAKQLMRAGLAICLVLCLMLTANGSANAAEIQLSGNYVDDTVNVAHNLQDAIALSSDDEGFSAAQEEARDLSYNYIARYRPRSKVNNLQSFTTMQTALNSLAGHYNNFANRPLPEELQNRITKELAKAEQTVLRGR

SEQ ID NO: 53359 - protein, 153 aa, Actinobacillus pleuropneumoniae serovar 1 str. 4074
MAKITGNLVATGLKFGIVTARFNDFINDKLLSGAIDTLVRHGAYENDIDTAWVPGAFEIPLVAKKMATSGKYDAVICLGTVIRGSTTHYDYVCNEAAKGIGAVALETGVPVIFGVLTTENIEQAIERAGTKAGNKGSECALGAIEIVNVLKAI

SEQ ID NO: 53360 - protein, 370 aa, Oryza sativa Japonica Group
MSSGPPQRSKRWLYAIVISSIALLFIGIACMFLLCRNKSVATIGPWKTGLSGQLQKAFVTGVPKLQRSELEGACEDFSNIVASYPHYTVYKGTLSSGVEIAVVSTVIATNKDWSKHSEGRFRKKIDLLSRINHKNFINLLGYCEEENPFMRMMVLEYAPNGTLYEHLHVEGFDHIDWNGRMRVIMGVAYCIQHMHELNPSITHPDLHSSAILLSEDGAAKVADMSVWQEVISKGKMPKNDDIVDHHEPVSADPAGNVCSFGLLMLEIISGRPPYSEHKGSLANLAMECIKDDRNISCLLDPTLKTHKENELEIICELIQECIQSDPKKRPGMREVTTRLREVLAISPEAATPRLSPLWWAELEILSVEAT

SEQ ID NO: 53361 - protein, 436 aa, Haemophilus influenzae R2846
MAKIVKVIGREIIDSRGNPTVEAEVHLEGGFVGLAAAPSGASTGSREALELRDGEKSRFLGKGVLKAVAAVNNEIAQAIVGKDATNQAEIDQIMIDLDGTENKSNFGANAILAVSLANAKAAAASKGLPLYAYIAELNGTAGIYSMPLPMMNIINGGEHADNNVDIQEFMIQPVGAKTLREALRIGAEVFHNLAKVLKSKGMSTAVGDEGGFAPNLASNADALACIKEAVEKAGYVLGKDVTLAMDCASSEFYNKENGMYEMKGEGKSFTSQEFTHYLEELTKQYPIVSIEDGQDESDWEGFAYQTKVLGDRVQLVGDDLFVTNTKILKEGIEKGIANSILIKFNQIGSLTETLAAIKMAKDAGYTAVISHRSGETEDATIADLAVGTAAGQIKTGSMSRSDRIAKYNQLIRIEEALERAGTPAAFPGLKAVKGQA

SEQ ID NO: 53362 - protein, 377 aa, Magnaporthe grisea 70-15
MAKSPEPNDTITTRYHYSPPWADLSIIGVAGSSGSGKSSISDAIVRKLNLPWVVILSMDSFYKSLDAESSKKAFANEYDFDAPDAIDFDALVNLLRDLKAGFSAKKTQMCASPVVFVDPQRKVADIIVPRGVENKVAITMMVQYIEQKLLEKSKQHRAALSRLQLESLEIPLSSKVIFIEQTPQLRGIDTILHDIDTTSEDFIFYFDRLSALLIELALNHVRFESTAITTPQGYTYNGLRRAQGDVSAIVLERGGAALEVGLKRVIPDCKTGHIVIESNVRTGEPELKYQKLPRDIQTHGSVLLLDCHMSSGGSALMAVQVLLDHGVTQDRIVLATYSAGRMGLHRLTTVFPDITVVACKLVQDIEERWIEKRYFRC

SEQ ID NO: 53363 - protein, 520 aa, Oryza sativa Japonica Group
MDAQMAAAAAHHPLPHQQKAANLARTFTKLLRRKRADAVAAATAVGEPGVPDAAAASVVGDEYECSVEAAAAGVPSLSKLKLSGNLGAAYSLDAFFRNAAEKKAAGVAGVAVAQTSPQVAPDVAKDSLLANLFAGVSAVKAAYAQLQLAQFPYDAEAIQAADAALVAELTRLSDTKRRYLRDPAAAAKNAAAAGHTALYAHAEEQRHLLKTYQITARKLEGELRAKEAEADRARSSLTAELRAERAMEARLHPGRTLASLDELHLSGLNPTHFLTALRHTVKSIRSFSKSMLNSMQSAGWDLAAAAAAVHPGVQLRRAGDTKFVFESYVAMKMFANFHRRDFNLSFLDEREFYDRRRFFEEFTELKAAPASAFLDARNARWGGFGKFLRAKYLSLVHARMETAFFGRLEQRGIVSAGPGFPESSWFADFAEMARRVWLLHCLFYAFDGGAEEDGASIFQVRTGARFSEVYMESVSDGRSDEAAAAAAEERVVGFTVVPGFRVGRTMIQCRVYLSRPGRRP

SEQ ID NO: 53364 - protein, 409 aa, Oryza sativa Japonica Group
MATQIHHLEQEAYCSVLRAFKAQSDAITWEKEGLITELRKELRVSDVDHRELLNRVNSDDIIRSIREWRSAGGPQAMLPNNAQPMHDLAPSPTTSGRKRQKTSQSFPALPAPPPVMHSQQLALQGPPSSSTAKKGASSGAKGKKTKPGQKVPGGPSVKAMTSSAGPSGRGPHMNRNFPVGLVSFEPSEALHINPLINRKVMSRWPEDNSFYEATITDYNPETDLYALAYDINTANESWEWVDLKQMGPEDIRWQGDDPGIYQGVRGAPGSGGKKSSSRGGPTPGTGRGRGLPKHVSRKDFPPSQNGVGKRSSDDIDILHTESLIKEVERVFSINNPDPLEVEKAKKVLKEQEQSLIDAIARLAEASDGESDEHNRVRRNAPYAGSQHQANYADAMAVDGGHMLGGADAV

SEQ ID NO: 53365 - protein, 482 aa, Haemophilus ducreyi 35000HP
MALSKVQKVAVLLIIPTLFFCLPTPEGLSLIAWRLLGIYIATIVGLVLKPYGEPVLLLAAVAASATTIGNTEGAEQLVKVSQTLSGYQSGTTWLIFTAFTLSSAFVITGLGKRIAYHMIRLLGSTTLRLGYVTVFLDLLLAPATPSNTARAGGIVFPIINSVAVALGSEPEKTPKLAGRYLLLNVYMVVKTTSYIFLTAMAPNALALSLMLPILGFNVNWLQWLLAASVPGLLCLFLIPFICYIIAKPELKRVDNKAIAQKGLEELGPMSLREKALACLFVLALLGWVFSDFLHVNATVVALITMVLCIMLSIVSWDDIRKNKAGWDTLIWYGGIISMSTVLSKAGFFEWLATTLSENLNFGDYGNVALVVILLLSVSVRYLFASGGAYVAAMVPVFATVGKVAGAPVELLALGLLFSNSYGGSVTHYGGGPGPITFGAGYNDIKSWWMAGAVIAFGSLIIHVTLGIAWWQFLFNMWLPMAK

SEQ ID NO: 53366 - protein, 539 aa, Coccidioides immitis RS
MAAPVLPLPQVKLPSIPSTRLTAEQLHWRSFKTPLLISSPSNTPINHISQPPAPALSSPASLHPPDIFTVTTGARVQIYSIRTRKLLKSITRFDDTARCSEIRPDGRILVAGDETGTIQVFDVNSRSILKTWRDHKQPVWVTRFSPTDPTSLLSASDDKTVRLWDLPSENSAQVFVGHSDYVRSGCFMPGAQSANLVLSGSYDQTVRLWDSRVAGRQVMTFKMAAPVEGVLAMPSGTTVLAAADNQIAVLDVVAGKPLHLIKSHQKTVTCLSLASKGSRIVSGALDGHMKVFETTGWNVVGGSKYPSPILSLGVITSGPQREDKHIAVGMQSGVLSLRTRLSGEQKIRERQRQREMQALLEGKLDEHDRTVSKEQKKRGRGWEKRLRGMDFIGEGVDIVIDAQDTKKRKKEKSWENDLRKGRYAASLDQVLAAGDNITVVTLLTALRHRAALRTALSGRDEVTLQPILKWVHKSITDPRLVDICVEISMNVLDLYSAHLGQSAQIDRLIEKLHRRVREEVDRAQHAWQTKGMLDMLRRS

SEQ ID NO: 53367 - protein, 322 aa, Alteromonadales bacterium TW-7
MRRLPPVLLEDGCPRELLSLIRTILAACKEISFRVGQGALSGVLGSTLDENIQGETQKKLDVLSNQLLKDILLESGTVKAIASEEEDYTVAGNPDAKYIVAFDPLDGSSNTDINSLVGTIFSIMEAPEGSDAADESIFMQPGHKQVAAGYVLYGPSTMLALSTGKGTRMFTLDKTQGSFLLTEDFATIPADTNEFAINASNQRHWQPAMQNYINDLLEGDTGPRAKNFNMRWIAAMVGDVHRVLSRGGVFTYPTDTKDPNKPNKLRLLYEANPMAMLVEQAGGIASTGSERIMDIQPDAIHQRVAVILGSKNEVETCLGYHK

SEQ ID NO: 53368 - protein, 695 aa, Zea mays
MTVTPRITVGDGRLVAHGRSVLAGVPDNIVLTHASGAGLVDGAFVGATAAEPSSMHVFTFGTLRDLRFVCCFRFKLWWMTQRMGTSGRDVPLETQFMLLECGPGDGDGDAAVYVAMLPLLEGQFRAALQGNDRDELEITFESGDKAVQTAHGTCMLYVHAGTNPFDTITQAVKVVERHMQTFHHREKKKLPSFVDWFGWCTWDAFYTDVTAESVKQGLKSLADGGTPPRFLIIDDGWQQIGSENKEESANAVVQEGQFASRLTGIKENAKFQKKTKTKESGGGGGEQQAQTPGLKLLVEEAKREHGVRYVYVWHAMAGYWGGVKPAAEGMEHYESALAYPVQSPGVMGNQPDIVMDSLSVLGLGLVHPRRALSFYDELHSYLASCGVDGVKVDVQNIIETLGAGHGGRVALTRAYHRALEDSVARNFPDNGCISCMCHNTDMLYSARQTAVVRASDDFYPRDPASHTVHVSSVAYNTLFLGEFMQPDWDMFHSLHPAADYHGAARAIGGCPIYVSDKPGNHNFELLKKLVLPDGSVLRAQLPGRPTRDCLFADPARDGTSLLKIWNVNKCTGVVGVFNCQGAGWCRVTKKTRVHDAAPGTLTGSVRADDVDVIAGLAGDGWGGEAVVYAYRSGELVRLPQGATLPVTLKVLEFEVFHVSPVRAVAPGVSFAPIGLLDMFNSGGAVEQCEVRGGAN

SEQ ID NO: 53369 - protein, 173 aa, Oryza sativa Japonica Group
MAAEGEKKMITLKSSDGEEFEVEEPVAMESQTIRHMIEDDCADNGIPLPNVNSKILSKVIEYCNKHVHAAAAAASKAADDAASAAAAVPPPSGEDLKNWDADFVKVDQATLFDLILAANYLNIKGLLDLTCQTVADMIKGKTPEEIRKTFNIKNDFTPEEEEEIRRENQWAFE

SEQ ID NO: 53370 - protein, 522 aa, Triticum aestivum
MSSMQFSSVLPLEGKACISPVRREGSASERLKVGDSSSIRHERASRRMCNGGRGPAATGAQCVLTSDASPADTLVLRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFRGTADAVRKFIWVLEDYYKNKSIEHILILSGDQLYRMDYMELVQKHVDDNADITLSCAPVGESRASEYGLVKFDSSGRVVQFSEKPKGDDLEAMKVDTSFLNFAIDDPAKYPYIASMGVYVFKRDVLLNLLKSRYAELHDFGSEILPRALHDHNVQAYVFTDYWEDIGTIRSFFDANMALCEQPPKFEFYDPKTPFFTSPRYLPPTKSDKCRIKEAIISHGCFLRECKIEHSIIGVRSRLNSGSELKNAMMMGADSYETEDEISRLMSEGKVPIGVGENTKISNCIIDMNARIGRDVVISNKEGVQEADRPEEGYYIRSGIVVIQKNATIKDGTVV

SEQ ID NO: 53371 - protein, 391 aa, Ehrlichia ruminantium str. Welgevonden
MHNSPILQVYDPSTVTFSHGKGVYLYGHDGKKYIDFHSGIATSSLGHAHPVLVETLKRQGEKLWHLSNLHTIPEAIKLAQKLVDISFADKVFFNNSGAESVECALKIARSYQCGKGNTQRYRFITLRRSFHGRTYTACSANEPNNFSPLLKPYVEWFDSAEPDINSIKNALTENTGAILIEPIQGEGGINVLDASFIKELRTICDQNDILLIFDCVQCGAGRTGKFFAHEHINVTPDICTLAKGLGGGFPVSACLSTNNASQFMTPGMHGSTFGGNPLATTIAGAVVDEILKDGFLENVTKNGQYLHKKLEDLSNKFSVIEQIKGKGLLIGVKVNTDSRALMKDLLNYGLLLSTASGNVLRIMPPLIITQQEIDEGISLLESYLQENKNKL

SEQ ID NO: 53372 - protein, 179 aa, Vitis vinifera
MGWWKEEHFNASDADGDGLLNITEFNDFLHPADSKNPKLVQWLCKEEIRERDTDKDGKVNFNEFFHGLFDLVRNYNEEGHNSSHESSDLMEAPAKKLFSQLDKDGDGLLSEDELLPIIGKLHPSEHYYAKQQADYIISQADADKDGRLTLTEMIDNPYVFYSAIFNDDEDDYDDFHDEF

SEQ ID NO: 53373 - protein, 223 aa, Corynebacterium diphtheriae NCTC 13129
MDRVAVVTGGSRGVGLSVVRTLLEAGWRVHAHYRTQPADITHDRLTWWQADFTQGLPTAQASGFPQLPRIDALIHCAGVATLGSCASVERDEWERHMSVNLHSPVQLTRQLLPQLRANHAHVVYINSGAGKRANPQWGAYAASKFAARAWCDALRQEEPEITVTSIFPGRIATDMQKAIVEYEGNSYNPKNFIAPTTVAHSVLHSLSVGADAIIPEIVIRPRM

SEQ ID NO: 53374 - protein, 1000 aa, Euglena gracilis
KAKAKGVEIVLPVDFVTSSKFGEDGEIGTATLESGIPDGMLGLDCGPKTNALNAATIQASKTIIWNGPMGVFEMKKFEQGTKQMMDEIVKVTQQGATTVIGGGDTATACKVYGTEDKVTHVSTGGGASLELLEGKVLPGIAALTDASVAMMAVTGETSLNKLQLKDADVKGKRVFIRVDFNVPFDKKDPTKITNLARVQGALPTIQYCLENGAKSVVLASHLGRPDGKMPEKYSLAPVARALEGLISRPVTFLKDCVGPEVEAACDPAPGSVILLENVRFYAEEEGKGLDAEGNKVKASPEAVAAFPKSLAKVADVYVNDAFGTAHRAHSSMVGEGLPREASGFLVAKELDAFAKVLNNPVRPVLAILGGAKVSDKILLIENLLDKVDKMIIGGGMAFTFQKVLNNMAIGSSLYDEAGAKIVPEIMAKAKAKGVEIVLPVDFVTSSKFGEDGEIGTATLESGIPDGMLGLDCGPKTNALNAATIQASKTIIWNGPMGVFEMKKFEQGTKQMMDEIVKVTQQGATTVIGGGDTATACKVYGTEDKVTHVSTGGGASLELLEGKVLPGIAALTDASVAMMAVTGETSLNKLQLKDADVKGKRVFIRVDFNVPFDKKDPTKITNLARVQGALPTIQYCLENGAKSVVLASHLGRPDGKMPEKYSLAPVARALEGLISRPVTFLKDCVGPEVEAACDPAPGSVILLENVRFYAEEEGKGLDAEGNKVKASPEAVAAFPKSLAKVADVYVNDAFGTAHRAHSSMVGEGLPREASGFLVAKELDAFAKVLNNPVRPVLAILGGAKVSDKILLIENLLDKVDKMIIGGGMAFTFQKVLNNMAIGSSLYDEAGAKIVPEIMAKAKAKGVEIVLPVDFVTSSKFGEDGEIGTATLESGIPDGMLGLDCGPKTNALNAATIQASKTIIWNGPMGVFEMKKFEQGTKQMMDEIVKVTQQGATTVIGGGDTATACKVYGTEDKVTHVSTGGGASLELLEGKVLPGIAALTNA

SEQ ID NO: 53375 - protein, 579 aa, marine gamma proteobacterium HTCC2080
MFDRFKIAALSTLLFLGTAQTQSAEVASSDSPLIDFRSRFVPVAANGNMVVGPERLASEAGLIMLEQGGNAVDAAVATGFALAVTLPRAGNIGGGGFMLVHLAAENRNVFIDYREMAPAAATRDMFLTPEGKVDKRRAYFSHQASGVPGTVAGLIHALEEYGTLPLATVIQPAIDLAADGFVMDITLHQNLSARAERLAQDPETKRIFLREGGKAPAIGSRFKQPDLAATLQRIAEKGRDGFYAGHTAELIAKDMAANDGLITQDDLANYVAVERTPVTGQFKDYAIVSAPPPSSGGIHVIQMLNILEPYPLKSWGHNSAQYLHHVIEAMKLAYADRSEHLGDPERMEAPIDFLLAKDYASNRRGLINSDSATPSSEIAPGAMPSPESPDTTHYSVADSAGNVVSNTYTLNFSFGSHITIPGTGILMNNEMDDFAARPGFPNAYGLVQGEKNSVAPGRRPLSSMTPTLVFRNGEPWLATGSPGGSLIITAVMQTILNAMAFDMNIAEAAAAPRVHHQWMPDRVLIEPGISRDTLDILEGMGHNIESTRRTLGRTNSIQLDGPWRYGYSDLRRPGGHVAK

SEQ ID NO: 53376 - protein, 313 aa, Desulfitobacterium hafniense DCB-2
MPVLHKEHFTGRDFICLQDFTPDEILYMLKVAKELKEEKKGGTPHPILQGKSLAMIFTKSSTRTRVAFEAGMLQLGGHALFLSNRDIQIGRGEPIKDTARVLSRMVDGIMIRTHSHQDVIELAKYADIPVINGLSDFLHPTQVLADLLTIQEHKHCLEGLKLTYIGDGNNMAHSLMFAGKMGMHVVIATPAGYKPDAQVVAQAQAQAKQYGGLVEWVEDPLAAAEGADVLYTDVWASMGQEEEAAIRMKAFQSYRIDRETMERAQANAIVMHCLPAHRGEEITEEVLEGPQSVVFDEAENRLHAHKAIMALLI

SEQ ID NO: 53377 - protein, 450 aa, Xanthomonas campestris pv. campestris str. ATCC 33913
MHDHPSSDAAHAMQTPAAMEAFWMPFTANRQFKARPRLLASAAGMYYRDVEGRQILDGTAGLWCCNAGHARERIVAAIRAQAGTLDFAPTFQMGSPLPFALAERLAALAPPGLGHVFFTNSGSEAVDSAMKIVLAYHRLRGEGQRTRFIGREKAYHGVGFGGMSIGGLPNNRKWFGPLLAGTDHLRHTLDLQRNAYSRGLPAFGVELADDLERLITLHDASTIAAVFVEPVSGSAGVILPPEGYLQRLRAICDRHGIVLVFDEVITGFGRVGEAFAAQRFGVTPDLITAAKGLTSGTVPMGAVLVADAIHDAFMHGPQAAIELFHGYTYSGHPLACAAALATLDTYAEEQLFTRAITLGPQWEEALHSLRGLPHVIDIRNIGLIGAIELAPREGAPGARGYEVFERCFHEGGLLVRVTGDVIALSPPLIVTPDQIGQMVETLAAILRKVD

SEQ ID NO: 53378 - protein, 308 aa, Prochlorococcus marinus str. MIT 9313
MESAKSAAALVEPCQTNSARRLTEDDSLRVSVLSEALPYIQRFSGRRIVIKYGGAAMAHANLQEAVFRDLALLVSVGVEPVVVHGGGPEINQWLERLEIPAQFRDGLRVTDADTMDVVEMVLVGRVNKQIVNGLNQLGAKAVGLSGSDGNLVEARPWGDGSHGFVGDVARVNTDVLEPILAKGYVPVISSVAATVEGCSHNINADTVAGEIAAALEAEKLILLTDTPGILLDRDDPSSLVHQLRLSEARQLITEGVVAGGMTPKTECCIRALAQGVGAAHIIDGRVPHALLLEVFTDAGIGTMVVGRS

SEQ ID NO: 53379 - protein, 302 aa, Panicum miliaceum
MADAKQQQAVAPSAAWMMVKPFVNGGASGMLATCVIQPIDMVKVKIQLGEGSAATVTKKMLANEGIGSFYKGLSAGLLRQATYTTARLGSFRVLTNKAVEANEGKPLPLLQKAVIGLTAGAIGASVGSPADLALIRMQADSTLPAAQRRNYKNAFHALYRIVADEGVLALWKGAGPTVVRAMSLNMGMLASYDQSVELFRDKLGAGELSTMLGASAVSGFCASACSLPFDYVKTQIQKMQPDANGKYPYTGSLDCVMKTLKSGGPFKFYTGFPVYCVRIGPHVMLTWIFLNQIQKFEKDMGL

SEQ ID NO: 53380 - protein, 527 aa, Burkholderia vietnamiensis G4
MSPVAAFKLILLSFVAIVALECIAKRLRLPPAAALLMGGIGIAFIPGLPPVNLDPELVLLVFLPPLLMDGAYFTVWEEFKRNVGGILLLAIGAVAFTTFAVGYAVHWVAPSLPWAACFALGAIVSPPDAVAAKAVLERVALPRRLMVLLEGESLLNDAAGLVLFRFAVAAALTGAFSLEHAVVRFAELGIGGVVVGFVVGRIVVWFLKLLDDDYLVITVAVIAGWLAYIAGEMVEVSGVIATVTAGMIVGWHQHEVFSAAVRTRGTAFWQVIVFLLEAMVFVLIGLSLRGAIHRLGGFEQVLGTMMPAVLAVLAAVIVSRFVWVYAVEALKWPVRGIVRRGAAPDWKAATVMSWAGMRGVVTLAIALSLPEAMPGRDVILVASFAVILVTVLLQGTTIGPLIRLLCLPQRDERAAHHLSEPQTWAYIEAAQLAAIQPLVHDASGNVIHPRLLEQYTYRAALTERTKDAPQYPPEVRAAHYDVVLAAIRAGRAELLRLHRSGHIHDEMLHMVERDLDLQEVSAQHARG

SEQ ID NO: 53381 - protein, 205 aa, Bradyrhizobium japonicum USDA 110
MNIATTRGTTSRAMSLPNILTYGRIAAIPVVVGCIYAQSILDQPLWLRWVAVAIFIAAAVTDYLDGYYARIWNQQSAFGRMLDPIADKLLVASCLLMLAADGIIHGWSLWAAIVILCREILVSGLREYLAALRVSVPVTKLAKWKTTVQLVAIGFLLAGEAGDQVVPVVTQIGLLLLWASAILTMYTGYDYFRSGIHHLIKEDEV

SEQ ID NO: 53382 - protein, 165 aa, Acinetobacter sp. ADP1
MAKVEQNEGLVEKLVAVDRVAKVVKGGRIFSFTALTVVGDGNGRVGFGRGKAREVPAAISKALEAARRNMITVDLAGTTLQHPVNARHGASRVYMQPASEGTGVIAGGAMRAVLEAAGVHNVLAKCYGSTNAANVVNATFKGLRDMTSPEKVAAKRGLSVEQIQG

SEQ ID NO: 53383 - protein, 422 aa, Haemophilus ducreyi 35000HP
MGDLKQAALDFHEFPIPGKISVTPTKSLKTQHDLALAYSPGVAEPCLAIEKDPSTARRYTAKGNLVAVISNGTAVLGLGNIGALASKPVMEGKGVLFKKFAGIDVFDIEINEQDPDKLIDIIASLEPTFGGINLEDIKAPECFYIEQKLRERMGIPVFHDDQHGTAIIVGAAVLNGLQIVGKSLDQVRLVVNGAGASAIACTNLLCSLGIKKENITMCDSKGIIFKGRGDQIDQTKQAYAIVDNGWRTLSDAINGADVFLGCSKAGALTQAMVKKMAKDPLILALANPVPEITPDEVKQARLDAIVCTGRSDYRNQVNNVLCFPFLFRGALDVGATEINEEMKIAAAKAIADLAKQPVSLEVLSTYGELSFGPEYIIPMPFDPRLIVEVSTAVAKAAMASGVATRPISDCAVYAEKLKTLLA

SEQ ID NO: 53384 - protein, 370 aa, Arabidopsis thaliana
MNTGGGQYTDFPAVDTHGGQFISYDIFGSLFEITSKYRPPIIPIGRGAYGIVCSVLDTETNELVAMKKIANAFDNHMDAKRTLREIKLLRHLDHENIIAIRDVVPPPLRRQFSDVYISTELMDTDLHQIIRSNQSLSEEHCQYFLYQLLRGLKYIHSANIIHRDLKPSNLLLNANCDLKICDFGLARPTSENDFMTEYVVTRWYRAPELLLNSSDYTAAIDVWSVGCIFMELMNRKPLFPGKDHVHQMRLLTELLGTPTESDLGFTHNEDAKRYIRQLPNFPRQPLAKLFSHVNPMAIDLVDRMLTFDPNRRITVEQALNHQYLAKLHDPNDEPICQKPFSFEFEQQPLDEEQIKEMIYQEAIALNPTYG

SEQ ID NO: 53385 - protein, 449 aa, Bacillus cereus G9241
MISIGGVIGAGLFVGSGAVVHSAGPGSIVSYALAGLLVIFVMRMLGEMAAINPTSGSFATYAREAIGPWAGYTIGWLYWFFWVIVIAIEATAGAGIIQYWIPEIPLWLLSLILTILLTLTNVFSVKSFGEFEYWFSFIKVISIVLFLCLGLAVILGFVPGTEAPGTSNLVGQGGFMPNGISSVLLGITVVIFSFMGSEIVAVAAGESAEPVKAVKTATNSVIWRILVFFIGSIAIVVTLLPWNSANILKSPFVAVLEHIGIPAAAQIMNFIVLTAVLSCLNSGLYTNSRMLFSMAERGDAPKAFLKLNNSGVPVRAVLFGTFFAYIGVVFSYISPDKVFLFLVNASGGIALLVYLVIAVSHLNIRKKMGRVEQQNLKVKMWFFPYVTYVTIAAIIAVLIAMLAIESLRSQALLTMFVTVLIIISYFIFNRNKNSTVLNTKSKNEESIRF

SEQ ID NO: 53386 - protein, 422 aa, Haemophilus influenzae R2846
MGLIVAGKWLMNPLFRLISKARIREMMTAGALLVVLGAALAMEIGGLSMAMGAFVAGVMMSESAFRHQLEADIEPFRGLLLGLFFMGVGMSLDLHLVFNHWILLLGIVFLYILGKASAVYIIARITRLDHREAIGRMSLMAHGGEFAFVLFSAAATAEVISNEEKATFTAAVIISMLFSPIIAQIARKLIQRTEPKHLDQLDENDLDSIVDLEDNVLVIGFGRFSQIVCQTLLIRGISVSVIDRNIENIRAAAKFGFKVYYGDGIRLDVLRAAGIEKAKCVVLGINDTQRIEHIVSQMKEAYPNLPILTRTYDRKTTVSLIKQDVDFIVRETFESAITLSRATLMKLGIDKIEAEEIIKEVRTLDQERLNEEVLHGFSNEIVKKYWTPRPFIKPHLDTKALNKETEEILSEKIEEEISNDHS

SEQ ID NO: 53387 - protein, 186 aa, Haemophilus influenzae R2846
MSQLANPELMKVVILLASSVTIVPLFKRLGLGSVLGYLVAGCLIGPSVFGIVQDPTAVVHLAELGVVMFLFIIGLEMYPERLWAMRKAIFGRGLLQVGLCGCLLTFSGIYLLGLTKEVSFIAGMGFTLSSTAIVMQSLEERGLTSTSKGQRVISTLIFEDIAIVPLLASVAFLAPHSHILIGYQLV

SEQ ID NO: 53388 - protein, 405 aa, Actinobacillus pleuropneumoniae serovar 1 str. 4074
MERFPKSDKLANVRYDIRGAIHKEALRLEEEGNKILKLNIGNPAPFGFEAPDEIVVDVIRNLPKSQGYCDSKGLYSARKAIVQYYQSKGIRNVDVNDVYIGNGVSELITMSMQALLNDGDEMLIPMPDYPLWTAAATLAGGKAVHYLCDENNEWMPDIEDIKAKITPRTKGILVINPNNPTGAVYSRSMLLEIAEIARQHNLMIFADEIYEKIIYDGAVHHHIAALAPDLLCVTYNGLSKAYRVAGFRQGWMVLSGPKNQARGFIEGLDMLASMRLCATTPMQHAIQTALGGYQSINEFVLPGGRLLEQRNKMYELLVQIPGISCVKAKGALYMFPKIDTEMYGIKDDAKFIYDLLQAERVLLVQGSGFNWHKPDHFRVVTLPYAHQIEEALGRLANFLKTYKQS

SEQ ID NO: 53389 - protein, 812 aa, Glycine max
MKFILSLMSIILYTLFISSLVVSIAADKSSNSQFQSLSHEETIVSPNGVFELGFFPLGNSNKSYLAIRYKNYSDETFVWVANGSYPINDSSAKLTLHSSGSFVLTHNSNQVWSTSSLKVAKNPVAELLDSGNLVIREKSEANSEDKEEYLWQSFDYPSNTMLARMKIGWDLKRKINRRLIAWKSDDDPTPGDLSWVIVLHPYPEIYMMRGKEKHHRLGPWNGLRFSGMPEMKPNPVFHYKFVSNEEEVTYMWTLQTSLITKVVLNQTSLERPRFVWSEATASWNFYSTMPGEYCDYYGVCGGNSFCSSTASPMCECLKGFTPKSPEKWNSMVRTQGCGLKSPLTCKSDGFAQVDGLKVPDTTNTSVYESIDLEKCRTKCLKDCSCMAYTNSNISGAGSGCVMWFGDLLDIKLYPDPESGQRLYIRLPPSELDSIRPQVSKIMYAISVAAAIGVILAIYFLYRRKIYEKSMAEKNYESYVNDLDLPLLDLSIIIVATNKFSEGNKIGEGGFGSVYWGKLASGLEIAVKRLSKNSDQGMSEFVNEVKLIARVQHRNLVKLLGCCIQKKEKMLVYEYMVNGSLDYFIFDSTKGKLLDWPKRFHIICGIARGLMYLHQDSRLRIVHRDLKASNVLLDDTLNPKISDFGVAKTFGEENIEGNTNRIVGTYGYMAPEYAIDGQFSIKSDVFSFGVLLLEIICGKKSRCSSGKQIVHLVDHVWTLWKKDMALQIVDPNMEDSCIASEVLRCIHIGLLCVQQYPEDRPTMTSVVLLLGSDEVQLDEPKEPGHFVKKESIEANSSSCSSTNAMSITLLTAR

SEQ ID NO: 53390 - protein, 813 aa, Kluyveromyces lactis NRRL Y-1140
MDDITQPTQQATQATQKYLIDKFSQEKIDDDVVCRVICTTGQISLRDLKVQPESIFKKESSIKKTWTFGRNQGCDYYLGDISRLSNRHFMLMLGEEGTLMLKDTSTNGTWLNGARIQKDTNHILTQGDEISVGVGVPSDVVSLVIFINDSFKNRLKELNMMKDVTSPASSSKSKYQISMGHTELKGIHKYYSISDSIVGQGAFATVKKAVERSTGKTFAVKIIHKRKVMDKFDGVKRELDVLQKLNHPRIVKLKDFFEDNDNYYMLMEFVSGGDLMDFVAAHGTVGEDAGREITRQVLEAVKYMHDQGISHRDLKPDNIMIEQDDPVLIKITDFGLAKVQNQNTFLNTFCGTLAYVAPEVIDGKNAEDKTNRDLYSSLVDMWSIGCLVYVILTGHLPFSGQSQNELFKQIKRGSYHEGPLKDYRISEEARNFIDCLLNVDPKERMNAGKALQHPWMKMAYVDSMQSQISISQSLSQQQFVDSMNEAEYESYIAKKRLEIIKKEITAPAAETNKEPVFKKPQIAPSKIAQSQNLQFNFSNPNTGKAINVNYKSGEEGLSNNKNKKINRPLTKVNGEGLFLTLHSLPGSSISGKVQVKQGINPFFIGRSDECNCKIDDNRLSRIHCFILKKRHAVGDSIYESPAQGLDDVWYCQSGTNSSYVNGKKITPGTKILLHDGDEIQIIWDKINDVTVSFQLEFNDTTGLFHEGKLDTNEKTNKTLLHKQTQEELALVPKFMEFMKSRSSQHAKSNINQSSSSNIDANSQNIEELDSVVEMNSTTGLKRIHSVSLSQSQPQTTKRAKLAQAQKPDIEGFL

SEQ ID NO: 53391 - protein, 338 aa, Alteromonadales bacterium TW-7
MTILVTGGAGYIGSHTVLELLQQGSDVVVIDNLANSSQESLARVKQITGKEVTFYQGDILDKAFLDSVFAKHTVNSVIHFAGLKSVGESVAKPVEYYQNNVQGTLTLVDAMRDAGVFKLVFSSSATVYGDPASLPIKEEFPVGGTTNPYGTSKLMVEMMLQDIAKSDERFAFAILRYFNPVGAHESGLIGEDPNGIPNNLLPFIAQVAVGKLKQLAVFGDDYDTIDGTGVRDYIHVVDLAIGHLKALDKIAKNTGALVYNLGTGNGYSVLQMVNAFIKASNQAVPYQVSPRRPGDIAACYAAPEKALNELGWEAKRGIDAMMQDTWRWQSNNPNGYSK

SEQ ID NO: 53392 - protein, 414 aa, Euglena gracilis
MPGSALGPKLSIDDLDIKDKNVLVRVDFNVPMKDGKILDDFRMRSALPTLEKVINSGGKLIIMSHMGRPAETGYEAKYSLKPIADHLGTLLGKPVTFAADCMDAAAEVAKLTPGDVLVLENLRFYPHEGSKDKDQRLEMAKKLASYADLYVSDAFGTAHRDAASMTGVPEVMGQGASGYLMKKEIDYFSKALKEPEKPVVAIVGGAKVSDKIQLLENMLKTVNQMVIGGAMAYTFLKAQGKSTGKSKCETEAETKKGKIDIVELAGKLLSKAKEQGVEIYLPVDHRCSAEFKDVEPVITSDENIPDDLMALDIGPKTEELYCSVDFAKAKTAIWNGPMGVFELEHFKPGTWAVARPLADHSDSCCSIVGGGDSERREKSGYAPKLSHISTGGGASLELLEGKVLPGLAILTDKP

SEQ ID NO: 53393 - protein, 187 aa, Candida albicans SC5314
MFTRTILPTTRRILTQQSRVLVPRLAIPTSTFTRSYHEKVIDHYENPRNVGSLNKESSDVGTGLVGAPACGDVMRLQIQVDEETGKIKDVKFKTFGCGSAIASSSYATELIRGKTLDEALDIKNTLIAKELSLPPVKLHCSMLAEDAIKAAVKDYQSKRKTTTLGATAASTVSSSSASAAAPATATA

SEQ ID NO: 53394 - protein, 117 aa, Brassica napus
MATMARSFLQAISKDEAVAPPLRVVQIEGLAVLKIIKHCKEFAPTLVTGQLLGLDVGSVLEITNCFPFPVRDEDEEVEADGANYQLEMMRCLREVNVDNNSCGWYQSTVLGSYQTVE

SEQ ID NO: 53395 - protein, 302 aa, Panicum miliaceum
MADAKQQQAVAPSAAWMTVKPFVNGGASGMLATCVIQPIDMVKVKIQLGEGSAATVTKKMLANEGIGSFYKGLSAGLLRQATYTTARLGSFRVLTNKAVEANEGKPLPLLQKAVIGLTAGAIGASVGSPADLALIRMQADSTLPAAQRRNYKNAFHALYRIVADEGVLALWKGAGPTVVRAMSLNMGMLASYDQSVELFRDTLGAGELSTMLGASAVSGFCASACSLPFDYVKTQIQKMQPDANGKYPYTGSLDCVMKTLKSGGPFKFYTGFPVYCVRIAPHVMLTWIFLNQIQKFEKDIGL

SEQ ID NO: 53396 - protein, 195 aa, Prochlorococcus marinus str. MIT 9313
MANIDQAPSRSTPNLLHVLPAFADESELRLNTIVELNSNTINKYELITETGHLKLDRVGYSSLAYPFAYGCIPRTWDEDGDPLDIEIVSVTEPLVPGSIVEARIIGIMTFDDGGEVDDKVIAVLADDKRMDHITSFEQLGEQWLKETQYYWEHYKDLKKPGTCRVNGFLGVQKAVEIIKACEARYLAEIDPKLVD

SEQ ID NO: 53397 - protein, 379 aa, Arabidopsis thaliana
MMKGISSVSQSINYNPYIEFNRPQLQISTVNPNPAQSRFSRPRSLRVLSLSADPSANRNPKSAVDAHAPPLVVVGSANADIYVEIERLPKEGETISAKTGQTLAGGKGANQAACGAKLMYPTYFVGRLGEDAHGKLIAEALGDDGCGVHLDYVRSVNNEPTGHAVVMLQSDGQNSIIIVGGANMKAWPEIMSDDDLEIVRNAGIVLLQREIPDSINIQVAKAVKKAGVPVILDVGGMDTPIPNELLDSIDILSPNETELSRLTGMPTETFEQISQAVAKCHKLGVKQVLVKLGSKGSALFIQGEKPIQQSIIPAAQVVDTTGAGDTFTAAFAVAMVEGKSHEECLRFAAAAASLCVQVKGAIPSMPDRKSVLKLLKFSI

SEQ ID NO: 53398 - protein, 452 aa, Blastopirellula marina DSM 3645
MTETMSKHASTEQLAAQLQQAILTKQAKVGVIGLGYVGLPLVQAFIGSEFSALGFDVDQRKVDALTRGESYIKHVDSKWIAAWVASGRFAATSDPRRLPEADILLICVPTPLTANRDPDLSYVESTAQMIAENLRPGQLVVLESTTYPGTTRDVVAPILAQSGLTPGVDFFLAYSPEREDPGNPNFTASAIPKVVGGYDPISLQIADAFYAQAVVKTIPVSSCEVAEACKILENTYRAVNIALVNELKLLFDRLDIDVWEVIEAAKTKPFGFQAFYPGPGLGGHCIPIDPFYLSWLARANEMPTRFIELAGEINTSMPQYVVQKLCDALNLVRKPANGSKVLILGAAYKKNVDDPRESPSFKIMELLSERGAVLSYNDPFIPKLPAMRHYDLPDLTSVELTPENLASFDAVMIVTDHDDYDYQQIVTHSQLVIDTRNATKNVEHGREKIVRA

SEQ ID NO: 53399 - protein, 418 aa, Bradyrhizobium sp. BTAi1
MTRSNRTDHIRLTSHPVPGAKHHFPLQWGAASARERGPIIGTVSRPQDRNVIGSHGGSYTVYRALAVSSGALDPIRRPDLTNTHPAATIGPFGQWRDPAKIVALDPWGHLVAESFGSEIAEGIDIRPTIAVTKARIELPELHAALAAKRLVHDGHVVHANGSVSVVKIAIDPVWYLPGVAARFGTSETNLRRGLFEQTGGMYPELVTRPDLQVFLPPIGGTTVYLFGDVTKLNDARTKITCRVHDECNGSDVFGSDICTCRPYLIHGIEECVAAGQNGGLGIIVYNRKEGRALGEVTKFLVYNARKRQEDGDAAAAYFERTECVAGVQDARFQQLMPDVIHWLGITRIDRFISMSDMKHDALTGQGVDIVERVPIPDELIPADAHVEIAAKKAAGYFSLEPQKPQELGDTVGRPLEKY

SEQ ID NO: 53400 - protein, 331 aa, Blastopirellula marina DSM 3645
MKAAFFTEPGPPSVIQYGDVPTPEVGPRQALVKMTAVAVNPIDTYIRGGAAYWDLPQPYIIGSDLAGVVEEVGAEVSDFQPGDRVWCSNQGFRGQQGTFAEYCAIDAEWLYKLPEGANDRSAAACALVGITAHLGLFKENANLQPGETIYIQGGSGGVGSMVVQMAKLAGARVIAAAGSEEKAAICRDLGADEVVLYKSENVGERIQELAPQGVNVFWETQREPNFDLIVESLAERGRIVLMAGRTARPEFPVGPFYVKQGRMCGFVMFKSPAAEMRVCGEEISRWLAAGKLKSQIGAEFPLSEAAQAHELQEGNTLHGQQTLAGKIVLHP

SEQ ID NO: 53401 - protein, 364 aa, Adonis aestivalis var. palaestina
MATITSSPLHFFSWSYNHGTLTPRSIPSTCFIFHNKPVSPKSTKPLSFKTPISSVYLTNTENKGKDKEMTFDFKAYLLEKGKSVNQALDNAILIREPEKIHEAMRYSLLAGGKRVRPILCIAASELVGGNESMAMPSACAVEMIHTMSLIHDDLPCMDNDDLRRGKPTNHKVYGENVAVLAGDALLAFAFEYVANATVGVSPSRVVRAIGELAKDIGSEGLVAGQVVDILSAGMSNIGLDHLEFIHLHKTAALLEASVVIGAILGGGTDEQVERLRKFARCIGLLFQVVDDILDVTMSSEELGKTAGKDLVADKATYPKLLGLEKAREFAEKLKNEAIEQLDEFDPEEAAPLLALAEYIAHRQN

SEQ ID NO: 53402 - protein, 268 aa, Glycine max
EMLAGASLMDEANRSTVLRNNPAALLALCWYWATDGVGSKDMVILPYKDSLLLFSRYLQQLVMESLGKEFDLDGNRVNQGISVYGNKGSTDQHAYIQQLREGVHNFFVTFIEVLRDRPPGHDWELEPGVTCGDYLFGMLQGTRSALYANNRESITVTVQEVTPRTVGALIGLYERAVGIYASLVNINAYHQPGVEAGKKAAGEVLALQKRVLAVLNEASCKEPVEPLTLEEIADRCHAPEDIEMIYKITAHMAANDRALIAEGSCGSP

SEQ ID NO: 53403 - protein, 310 aa, Adonis aestivalis var. palaestina
VYLTNTENKPEDKTMDFDFKAYLLEKGKSVNQALDNAVLIREPEKIHEAMRYSLLAGGKRVRPILCIAACELVGGNESMAMPSACAVEMIHTMSLMHDDLPCMDNDDLRRGKPTNHKVYGENVAVLAGDALLAFAFEYVANATVGVSPSRVIRAIGELAKDIGSEGLVAGQVVDILSAGMSNIGLDHLEFIHLHKTAALLEASVVIGAILGGGTDEQVERLRKFARCIGLLFQVVDDILDVTMSSEELGKTAGKDLVADKATYPKLLGLEKAREFAEKLKNEATEQLDEFDPEKAAPLLALAEFIAHRQN

SEQ ID NO: 53404 - protein, 298 aa, Deinococcus radiodurans R1
MFERDEHHFPVKRLLLLGALVGAGAYYLSREQNRKALDAKLAELGLKDAAQDVGSSVTKGWEKTKDAAQNAGSVIADKAQDVAGEVKSAVAGATAEIKDAGKEVADTAKDAGQNVGQNVKREAADLADQAKDKAQDVKADVSKAADQAKDKAQDVAQNVQAGAQQAAANVKDKVQDVKADASKAADQAKDKAQDVAQNVKQGAQQAASDAKDKVQDVKADASRAADQAKDKAQDVAQNVKQSAQDAKTDVDAKAKSWAFDLRTDAEAGKQGGQTGSTTNNAGTAGNTGMTGNTNTRKN

SEQ ID NO: 53405 - protein, 506 aa, Triticum aestivum
MGCFQSKPAGKPLPPDADAALPPDDPADPEAANGADGAGADGDDKDGAKRAVPVFREFGLAELRAATKGFSADLIVSESGEKAPNVVYRGRLDGGRLIAVKRFSRLSWPDPQQFLAEAAGVGKVRHKRLVNLIGCCAEGDERLLVAEYMPNDTLSKHLFHWDKQPLPWEMRLRVAHYIAQALDHCNAENRKIYHDLNAYRVLFDEEGDPRLSSFGLMKNSRDGKSYSTNLAYTPPEFLRTGRVIAESVIYSYGTVLLDLLSGKHIPPSHALDLIRGKNILLLMDSSLEGQYANEDASKLVDLASKCLQFEARDRPNIKYLLSSVGPLQKQKEVASHVLMGITKTTSVLPTILSPLGKACAGMDLTAVHDILLKTGYKDDEGAENELSFQEWTQQVQEMLNTKKFGDIAFRDKDFKTAIDYYSKLVGMMSVPSATVFARRSFSYLMNGQSELALRDAMQAQVCMPEWPTAFYLQALALSKLGMETDAQDMLNDGATFEAKKQNSWRG

SEQ ID NO: 53406 - protein, 56 aa, Zea mays
MKTFDPWPVFFRREWRRNWPFLTGFAITGFLITKMTANFTEEDLKNSKFVQEHKRH

SEQ ID NO: 53407 - protein, 449 aa, Burkholderia vietnamiensis G4
MAGLPIRSPVSMPLLPTTATAPFCPSEVKGSITIDARASRWMKFKRFFGPGLLVAIGYMDPGNWATDIQAGSQFGYSLLWVVAFSSLAAIFLQMLAARLGLVAGKDLAQASYDRYGRVGRLVQWVTAEVSIIACDIAEVLGCALAFKLLLGVPLAWGIVLTALDTMIVLGLQGKGVRQIEAIVLGLISTMAFCFVAQVAITPPDWHAVAKGLVPSNPGHDSKDAIVLALGIVGATIMPHNLYLHSSVVQTRHVVGGARGLIRDTLALVRIDTCVSLFVAMLVNAAILIVAGAAFHATGQHNVTDIEQAYRLITPIAGGAAALLFGIALLASGQSSTLTGTIAGQVIMDGFLHTKIPCYQRRLITRGLALVPALIGVLWLGDGSVGQLLVWSQVVLSLQLPFAMWPLIRSVSDRGTMGEHAIGRGMQALAWALFAVIGGTNLLLITGVAS

SEQ ID NO: 53408 - protein, 359 aa, Adonis aestivalis var. palaestina
MASFASLCPHESFTHQLKRLPTLSPPLKLTRVSHSHRRMLQFPSAAMKATVTKGMIAETQSYKESAFQFEEYMAEMAERVNQALDDSVPLRHPLKIHEAMRYSLLAGGKRVRPILCIASCELVGGDPVAAHPIACALEMIHTMSLIHDDLPCMDNDDFRRGMPTNHKAFGEETAVLAGDALLSLAFEHVATRSTGVSADRVVRVIAELGKCVGSDGLVGGQIVDIASAGKQIELSELEYIHLHKTAILLEASVVCGAIMGGGMAPDIERLRKYARYIGLLFQVVDDILDVTKSSEELGKTAGKDLATDKATYPKLMGIDKAKEFADALVAQAHKELDYYDFAKAAPLYHFADYIAYRQN

SEQ ID NO: 53409 - protein, 360 aa, Kluyveromyces lactis NRRL Y-1140
MAIKRLINEHDMELWNNSKTFEDVIGFINTLALSVRGRENNDYTQPISDNVQRVSNLLSKVTEIIGKHEVIKDANTSRFGKIEFRDFYDDISEHSNELISKIFEGIEKPDTGKLDDICTYFINSWGDRSRIDYGSGHELNFICFLYCLTESKVFDLENDSSNIVLMLFIKYLGIMRSLELKYWLEPAGSHGVWGLDDYHFLPFLFGAFQLSTHKHLKPKSIHNPEVVEMFQDRYLYFGCIAFINKVKTTASLRWHSPMLDDISGVKRWSKVAEGMVKMYKAEVLQKLPIMQHFYFGYFLKCPEGVSEPSARAQDHHEDDSCCTDGSHGHSTWADCCGIAVPSAIAASQMANKDVRLFPFD

SEQ ID NO: 53410 - protein, 308 aa, Lilium longiflorum
MVGNGSRRGDTGVSQAISSRNVFAALDTLKKKKRSDKEKCKVKEEPAPHVFWAPAPLTVKSWADVEDDDDDDYYATTAPPSAWGVPEQKKSKEVPVAIEEESASEDEGLDEPDDEAVDEQADHQLEVPAPAEPDVKKPPVPSVPKDTERQLSKKELKKKELAELEALLTELGMAAEDNQAAKQNGTTGVGEEKLEEHSGANEKKENVPVESKTSKKKKAKKEKLSKEAKDSNEHPNGNGADAGTSAEVTARPVDMKERLKKMASTKKKSSKEMDSAARAAAVEAAARSAKLAAAKKKEKSHYNQQPMR

SEQ ID NO: 53411 - protein, 707 aa, delta proteobacterium MLMS-1
MPGRLFFGKRLALFLFTAILACTMIKFDDSQAGELAPRLHKEELANGLTVITRQTPATGVATVQIWLEAGSVYEEPHEAGITHFIEHLIFKGTEKRGPGEIAGAIEALGGRINAYTSFEHTVYHATLDARHWEQALEVLADAVLNSVFDPDEIEREKPVIFEEIRMRQDRPELHLFQELLSHAYQQHPYRLPIIGSQESVAAIERDDILAYVKEHYHPGNMTVVVVGDVNPAEVSAQTRKLFGELPAKEETPPRELPVEPPPTDFRFFLEEQAINQTHLTLALPIPAFKHPDTPVLSVLSQILGQGEASRLNERLRHEKGLVYRLGTSLLSLRDPGLLRISATLDAERAPEVLEEILAELFALRHFPVDDEELERARRNLEADFVFNLEQAEGMARVLGTFELLTGDPREHEYLERIRAVEAADIKRVANQYFRKEHLTAGLLTPLAASLELDRRQLTEIMVRAAERARKQVPDRRASDLPPHTHRFELDNGLTLLVRERPDVPTVAMRAVFPGGLRGETPATNGAFAFLAELLPRGAGELGARQMARTIADLAGELEGFSGRNTFGLKGDFLARFFDQGLLLLRDVIKKPAFDAEEAEKIRGELLANLRRQEDALPSVAIRELNRLLFRGHPYALNTMGSAGSLRELELATLKDIYQAHARPDKMVLSVVGDIDAEGVRRQVEELFGNWQAPPEVDTQVVETLLPP

SEQ ID NO: 53412 - protein, 357 aa, Zea mays
  misc_feature (312)..(312): Xaa can be any naturally occurring amino acid
AGKDKITLSPQPQRTSAMAAASAADEAWCRETVPRVMELVSPRLPQRDACVLLSVSPWCHRALAANPKLWEVLDLHEMKKAGERLIPALSLARYRHLKVVNLEFAQDIEDRHFLRLKGAILLEELELLNLNACQKISDTGIGAATSLCPNLRALSIYWIVGLTDASIEHVVKNCKQIIDLNMSGCKNISDRGIQLVADNYQGLQKLDITRCIKLTDDALQKVLEKCSALESLNMYALSSFTDKAYTKIGYLANLTFLDLCGAQNLTDDGLRSISRCGSLTYLNLSWCVRVTDVGGGSYRTKVVESLELLSLXFGIIGVTDAWPGRFCKIFAQIILTTFGWKMGWNWKLKREEAGGPG

SEQ ID NO: 53413 - protein, 365 aa, Vanilla planifolia
MATWVEHQQQQNGSKDVDEEACMYAMQLSSMVVLPMTLRVAVELGILEQIQAGGPDSYLTAEDLAARLGNSNPLAPVMIERILRLLTSYSILNFTDTVDGEGRTVRSYGAAHVCKYLTPNQDGVSMAPLVLMNTDKVLMESWYHMKDAVTNGGIPFNLAYGMTAFEYHGKDLRFNKVFNEGMKNNSIIITKKILERYKRFEDVNVLIDVGGGIGGTISMITAKYPHIHGINFDLPHVVSEAPPFQGVEHVGGNMFESVPIGDAIFIKWILHDWSDEHCLKLLRNCAKSLPDKGKVIVVECILPDAPLVTPEAEGVFHLDMIMLAHNPGGKERTKKEFKELAMLSGFSNFKALFSYANVWVMEFNK

SEQ ID NO: 53414 - protein, 217 aa, Kluyveromyces lactis NRRL Y-1140
MSSTQPFPNVHLLAQSKQLLGLYTIIRDSLTKRSDFIFYSDRIIRLLVEEGLNHLPVTPKTITTDTNQKFEGCSFLGKICGVSIVRAGESMEQGLRDCCRSVRIGKILIQRDEETAMPKLFYEKLPEDIADRYVFLLDPMLATGGSAIMATEVLIQRGVLPERIFFLNLICSKEGIDNYHAKFPNVRIVTGAIDAGLDENKYLMPGLGDFGDRYYCI

SEQ ID NO: 53415 - protein, 298 aa, Desulfitobacterium hafniense DCB-2
MTPLDKGLDKARVLIEALPYIQKFAGKTVVIKYGGHAMLEQDLKEKVMLDILLLHSVGIRPVVVHGGGPEINSMLTRVGKESHFVRGLRVTDKETMEIASMVLVGKLNTEIISLLNRFGGRAVGLSGKDAQLLQAVKKPMQFQNSQGELEDVDLGFVGEIEQIRPEIVTSLVEQGYIPVISPVAGGEDGESYNINADTAAGEIAKALKADKFLLLTDVPGVLRDVEDKDSLLSVIKEDEISGLIDLGVISGGMIPKVECARAALQGGVGSVHILDGRIPHAILLELFTDGGIGTMFNA

SEQ ID NO: 53416 - protein, 59 aa, Oryza sativa Indica Group
MRHRAGAAPTSPASPSAPRLAQGVRYKVCSWIAIIFCAQSLVNMKNFENDLKQLSMAFM

SEQ ID NO: 53417 - protein, 389 aa, Blastopirellula marina DSM 3645
MKAVRWHGKSDVRVEDAPDPKIEDPGDVVIQITSTAICGSDLHLYNGFMPGMKAGDIIGHEPMGVVVEVGRDVRRLAKGDRVVVPFTISCGHCWFCEQTMFSLCDNSNPNAEQARKQMGHSPAGLFGFSHLLGGFPGGQAEYLRVPSADVGPIKVPEGLSDEQVLFLSDIFPTGYMAAENAEIAPGDTVAVWGCGPVGQFAIQSAWMFDAGRVIAIDRIPERLRMAETNGRAETINTDEVDVYEKLMEMTNGRGPDRCIDAVGAEAHASSSVWSAMDTMREAIHLESDKPYVLQEAIRCCRKGGTISVPGVYVGSVQLPFGAAMNKALTFRMGQTHVQRYLDPLMKKIEEGKIDPSFVITHRVPLMDAAKAYETFRDKEDECIKVVLKP

SEQ ID NO: 53418 - protein, 125 aa, Glycine max
  misc_feature (104)..(104): Xaa can be any naturally occurring amino acid
YWHCCYTDNGLNGFYAGKPFVEVLKEVGVLPGIKVDKGTVELAGTNGETTTQGLDGLGQRCAKYYEAGARFAKWRAVLKIGPNEPSELAIHENAYGLARYAVIXQENGLVPIGEPEILGDGSLDI

SEQ ID NO: 53419 - protein, 409 aa, Actinobacillus pleuropneumoniae serovar 1 str. 4074
MTIEILTPVLPESVADATVATWHKKVGDTVKRDEVLVEIETDKVVLEVPAPNDGVLAEISQEQGATVTSKQLLGKISTVQAGDFTQETIKQTNEATPADRKSAAIEYDHSDADSQGPAIRRLLAEHNIEAHLVKGTGVGGRITREDIEHYLAQRQVQETKQAMASEHNTVSTVAYSARSEKRVPMTRLRKRIAERLLEAKNTTAMLTTFNEVDMQPIMSLRKTYGEKFEKQHGVRLGFMSFYIKAVVEALKRYPEINASIDGDDVVYHNYFDISIAVSTPRGLVTPVIRNCDKLSMADIEKTIKALAEKGRDGKLTVEDLTGGNFTITNGGVFGSLMSTPIINPPQSAILGMHAIKDRPVAVNGQVVIRPMMYLALSYDHRLIDGRESVGFLVAVKDLLEDPTRLLLEI

SEQ ID NO: 53420 - protein, 843 aa, Kluyveromyces lactis NRRL Y-1140
MFTTRAEQNNIKATIAASYDKLYSQFSSDELSEIGNYKISKFIGEGSFGKVYLATHRLTHQKVVLKTGNKRDPNVVREVFYHRQFDFPYITKLYEVIVTESRVWMVLEYCSGHELYEHLLKEQRLSLEESKKLFSQIASAVYYAHELKCVHRDLKLENVLLDGNGHAKLTDFGFTREMATRSQLETICGTTVYMAPELIERKCYDGFKVDIWSLGIILYTMINGYMPFDEDDDIKTKLKIVNDELDFNQEWISDDAIDLIQGMLRKNPNERISLAQVLSHPFLQPWGVVAKEKTDKVLLKQRGGHVHFHSKHEKRLLKRLKQCGFDTGSIKNSVNKRKCDSLSGLWFLLLERYELSDAKVPKRSKSVMSVRKVFESSVNMVMDDILVTSPECVKINSLKKILSRKSVDQDVELPQTIEDVKVRTQPKDRKAAEPESIHPADTTNKKKGFLQRVSSLFKPKKHNNHVDDNQSIKFSSQGIHPLLGKKRHKNGSNDSEAPSISQSTKPPPEQEDLNVQFEDITNKANHSFKKLKSHSSSEISKNINEPQLNHLHIDGGTEDSLKISNNRGIRRSSIASQHSAISNDTFNSDYSTDAQSGFRSNNTQSSSRINANSETSAATRKNVRRTLSVLSSASSNSEMSSRTDSFYDITTASSPMNMDIRSNYNIRSDSQFPKINGNSPWLIKRGKSPIGRRSRISNRSLNRKFRQPTPNRADSVIQEESSFDENERASNLPEVSEYDSGEIAIHSDSETPSKGNTPLYAIGINHPESRPVLFNVGRSVSDGSSWSHPQSDFHEPLSAPVIRKSSRRHVEDDDYESNIAADDEDNSLEDEEQEHVRSIAESV

SEQ ID NO: 53421 - protein, 178 aa, Arabidopsis thaliana
  misc_feature (74)..(74): Xaa can be any naturally occurring amino acid
  misc_feature (116)..(116): Xaa can be any naturally occurring amino acid
  misc_feature (125)..(125): Xaa can be any naturally occurring amino acid
  misc_feature (171)..(171): Xaa can be any naturally occurring amino acid
SGIFGANHPSGLKTQWSFHPWFPKISVSFPVTRKARDDITSITSNGGRVSCMKAWPPIGKKKFETLSYLPDLSXTVELVNEADYLLRNKWIPCVEFELEHGFVYREHGISLGYYDXRNWTSLKLXLVGGTDSAQRATEVEDCQKEYPGAFFLIIGFDNTRQVQCISFIAHXPPSFTEA

SEQ ID NO: 53422 - protein, 141 aa, Brassica napus
MEGRLANMWRLTVNESKFVETALQSELRVDGRGLYDYRKLTIKFGKEYGSSEVQLGHTHVMGFVTAQLVQPYKDRPNEGSLSIFTEFSPMADPSFEPGRPGESAVELGRIINRGLRKSRAVDTESLCVLAGKKVWSVRIDL

SEQ ID NO: 53423 - protein, 89 aa, Brassica napus
  misc_feature (20)..(20): Xaa can be any naturally occurring amino acid
MDQHFQSTPLERNLPVILGXWRVWKESFLGYPARAILPYSQALEKFVPLIHQVSLESNGKGGSIDGLPFPFETVEIDFGEPGPNGHHSF

SEQ ID NO: 53424 - protein, 456 aa, Aspergillus nidulans FGSC A4
MFTVLRSRPVAALRAATGSSSRIAQQQRNLSIHEYLSANLLKSYGVGVPKGEVARSAEEAEKVAKSLGNDDMVIKAQVLAGGRGKGHFDNGLKGGVRVIYSPTEAKMFAGQMIGHKLITKQTGAGGRLCNAVFIVERKFARREFYLAVLMDRKTQGPVIVASSQGGMDIEAVAKENPDAIITTPIDINVGVTDAIATKIANELGFSEQCVDDAKKTIQNLYKAFMETDATQIEINPLSETSDHQVLAMDAKLGFDDNAEFRQKEIFSWRDTTQEDADEVKAAEHGLNFIKLDGDIGCLGVYPRPNDIIAVLTRTVNGAGLAMATMDIIKLNGGSPANFLDVGGGATPAAIKSAFELITSDPKVSAIFVNIFGGIVRCDAIAQGLINVVQEMGLRTPIVARLQGTNMEQAHKLINESGLKIFSIEDLQSAAEKSVQFSKVVKMAREIDVGVEFTLGI

SEQ ID NO: 53425 - protein, 329 aa, Alteromonadales bacterium TW-7
MDEYILDKPTLNRRFSVAPMLDWTDRHCRTFHRKMTKHTVLYTEMITTGAILFGRGDYLHFNQHEGPVALQLGGSDPEALAKCAKLAGERGYDEINLNVGCPSDRVQNGRFGACLMAEPELVAQCVAAMKNEVSIPVTVKTRIGIDEQDSYEFLCALIEASHKVGCDDFIIHARKAWLNGLSPKENREVPPLDYPRVYQLKKDYPQLDLSINGGVKTVEQSLEHLQYIDGVMVGREAYSNPFMLNEVDEKIYGDTANTQTRHDVVRSMYDYIEEEMRLGANFWHVARHMLGIFQGQPGARGFRRHLSENGHGKQADLSVMDKALSFVPE

SEQ ID NO: 53426 - protein, 466 aa, Brassica napus
MTSINVKLLYHYVITNLFNLCFFPLTAIVAGKAYRLTIDDLHHLYYSYLQHNLITIAPLFAFTVFGSVLYIATRPKPVYLVEYSCYLPPTHCRSSISKVMDIFYQVRKADPSRNGTCDDSSWLDFLRKIQERSGLGDETHGPEGLLQVPPRKTFAAAREETEQVIIGALENLFKNTNVNPKDIGILVVNSSMFNPTPSLSAMVVNTFKLRSNVRSFNLGGMGCSAGVIAIDLAKDLLHVHKNTYALVVSTENITYNIYAGDNRSMMVSNCLFRVGGAAILLSNKPRDRRRSKYELVHTVRTHTGADDKSFRCVQQGDDENGKTGVSLSKDITDVAGRTVKKNIATLGPLILPLSEKLLFFVTFMGKKLFKDKIKHYYVPDFKLAIDHFCIHAGGKAVIDVLEKNLGLAPIDVEASRSTLHRFGNTSSSSIWYELAYIEAKGRMKKGNKVWQIALGALSVTVQFGWL

SEQ ID NO: 53427 - protein, 180 aa, Butyrivibrio fibrisolvens
MKKVEDYIRTIPDFPEPGIMFRDVTSILQDAEGFKLAIDEMIKLLDGVDCDVIAGAESRGFIFGAPLAYALGKPSVLVRKKGKLPCETIEKTYDLEYGTATIEMHKDAIKPGQKVVVVDDLIATGGTIEAACQLIEELGGEVSKIVFLMELAGLNGREKLKYDVASVCYLRGKIITDFLG

SEQ ID NO: 53428 - protein, 337 aa, Zymomonas mobilis
MAILITGIAGFIGSFAAKSLLERGEEIVGIDNLNDYYDPELKKKRLAELKKLKNGKLHFSPIDFSDGALLNNTLEKFDFDRIIHLGAQAGVRYSLINPQIYGDSNLIGHLNILELARHRKVRHMVYASSSSVYGNRSTLPFKVDSQPDYPASLYAATKRAGEMLSESYAYLYRIPLTGLRFFTVYGIWGPPDMAMWIFTKKILQKQPIMLFNNGEMQRDFTYIDDAVSGLIAALDNPPQDNNKIKSGGSLNPHNLYNIGNHHPENLKYLVELLEEACGCHAIKELRPMQAGDVSTTYADIETSKRDLGFYPKDYAGYRSRPFCRMVSPLYHPFMKLL

SEQ ID NO: 53429 - protein, 349 aa, Waddlia chondrophila
AETIPFLKVWGVVPSAVVFMLIYAKLSNTLSKSALFYVTITPFLAFFGLFALVLYPNKELLHPTELADSLQAVLPLGFSGLIGCLRNWTYSVFYILAELWGSAVLSLMFWGFANDIMRVTEAKRFYNLLGLGANVALLASGTAIIHFSDIRKHLPADVDAWQISLNFLMGMVVLAGIVIIGIYWWMQKNVLTDPAFYDPSDVKKKKEKPKMSITESFKYLLSSKYILCIAILVIAYGISINLVEVTWKNQLKLQYPNPNDYSAFMGGFSRWTGLVTICMMFVGGYIIRTKGWGFAAAITPVVLLLTGIAFFTFVLFRENLSTYIAALGTTPLFLAVVIGMIQNIMSKSS

SEQ ID NO: 53430 - protein, 507 aa, Isatis tinctoria
MTSVNVKLLYHYVITNFFNLCFFPLTAIVAGKASRLTTNDLHYFYYSHLQHNLLTITLLFAFTAFGSVLYILTRPKPVYLVDYSCYLPPPHLKSSVSKVMDIFYQVRKADPLPNVACDDSSWLDFLRKIQERSGLGDETYGPEGLLQVPPRKTFAAAREETEQVIIGALENLFENTKVNPKEIGILVVNSSMFNPTPSLSAMVVNTFKLRSNIRSFNLGGMGCSAGVIAIDLAKDLLHVHKNTYALVVSTENITYNIYAGDNRSMMVSNCLFRVGGAAILLSNKPGDRRRSKYELVHTVRTHTGADDKSFRCVQQEDDESGKTGVSLSKDITGVAGRTVKKNIATLGPLVLPLSEKFLFFVTFMAKNLLKDKIKHYYVPDFKLAIDHFCIHAGGRAVIDVLESNLGLAPIDVEASRSTLHRFGNTSSSSIWYELAYIEAKGRMKKGNKVWQIALGSGFKCNSAVWVALRNVKASTNSPWEHCIDRYPVKIDSDSAKTSETRVQNGRS

SEQ ID NO: 53431 - protein, 319 aa, Clostridium acetobutylicum ATCC 824
MINHGKNIKIFTGNSYPSLAEEIADIIGVQVGDSRVGKFSNGETAVDINETVRGTDLFLIQTLCEPVNDSIMELLIMLDAFKRASAGRITAVIPNYAYARQDRKAKARQPITAKLMADLIHTAGADRVLTMDLHAPQIQGFFDIPVDHLEGVPILAKYFINQNSNTDDLIVVSPDIGGVKRTRKFAEKLHAPIAIIDKRRPKPNVSEVMSIIGDVKGKKAILVDDMIDTAGSIVNAAEALVKMGAKEVSACCTHGVLSGPAIERLENSPLKEVVILNTIPIEGDKRIDKIKVLSVAPIFAEAIRRIYEDMPVSKIFQEE

SEQ ID NO: 53432 - protein, 338 aa, Debaryomyces hansenii CBS767
MASNIQNRTFEFQQCISSFDKLNKKNNVGRNPSQTTPARKTQFSQQASIIAKDIAHTTELLSKLALLAKRKPLFDDKPIEIGELTYVIKQDIFKIEENITLLQKYAKGESSIQIDTQVTQYSKNVLNLLNSKMKNISGEFKNVLEIRQKNELMNKNRTEHFLSAATNNRTSNNHSPLTNLSPQLSNNNNLSGLGENPYLMQAQSNGQAQTTYDPDLDQDAYSNYNNGEFLSIPDQTRQLLLMEEQGNQYLQERNSAVETIESTINEVGNLFQQLASMVSEQGEVIQRIDLNVEDINMNISGAQRELLKYYAHISSNRWLFLKIFGVLIMFFLIWVLVS

SEQ ID NO: 53433 - protein, 506 aa, Sinapis alba
MTSVNVKLLYHYVITNLFNLCFFPLTAIVAGKASRLTIDDLHHLYYSYLQHNLITIAPLFAFTVFGSVLYIVTRPKPVYLVEYSCYLPPTHCRSSISKVMDIFYQVRKADPSRNGTCDDSSWLEFLRKIQERSGLGDETHGPEGLLQVPPLKTFAAAREETEQVIIGALENLFENTKVNPKEIGILVVNSSMFNPTPSLSAMVVNTFKLRSNVRSFNLGGMGCSAGVIAIDLAKDLLHVHKNTYALVVSTENITYNIYAGDNKSMMVSNCLFRVGGAAILLSNKPRDRRRSKYELVHTVRTHTGADDKSFRCVQQGDDESGKTGVSLSKDITDVAGRTVKKNIATLGPLILPLSEKLLFFVTFIAKKLFKDKVKHYYVPDFKLAIDHFCIHAGGRAVIDVLEKNLALAPIDVEASRSTLHRFGNTSSSSIWYELAYIEAKGRMKKGNKVWQIALGSGFKCNSAVWVALSNVKASTNSPWEHCIDRYPVQIDSDSAKSETRVQNGRS

SEQ ID NO: 53434 - protein, 506 aa, Sinapis arvensis
MTSVNVKLLYHYVITNFFNLCFFPLTAIVAGKASRLTIDDLHHLYYSYLQHNLITIVPLFAFTVFGSVLYIATRPKPVYLVEYSCYLPPTHCRSSISKVMDTFYQVRKADPFRNGTCDDSSWLDFLKKIQERSGLGDETHGPEGLLQVPPRKTFAAAREETEQVIIGAVENLFKNTKVNPKDIGILVVNSSMFNPTPSLSAMVVNTFKLRSNVRSFNLGGMGCSAGVIAIDLAKDLLHVHKNTYALVVSTENITSSIYAGDNRSMMVSNCLFRVGGAAILLSNKPRDRRRSKYELVHTVRTHTGADDKSYRCVQQGDDENGKTGVSLSKDITDVAGRTVKKNIATLGPLILPLSEKLLFFITFMAKKLFKDKVKHYYVPDFKLAVDHFCIHAGGRVVIDVLEKNLGLAQIDVEASRSTLHRFGNTSSSSIWYELAYIEAKGRMKKGNKVWQIALGSGFKCNSAVWVALSNVKASTNSPWEHCIDRYPVKIDYDSAKSEVRVQNGRS

SEQ ID NO: 53435 - protein, 236 aa, Oryza sativa Japonica Group
MAGSGELKLLGVWSSPYAIRVRVVLNLKSLPYEYVEENLGDKSDLLLASNPVHKSVPVLLHAGRPVNESQVIVQYIDEVWPGGAGGRPSVMPSDPYERAVARFWAAYVDDKVRPAWLAILFGSKTEEERAAAVAQAVAALETLEGAFGECSKGKPFFGGDGVGFVDVVLGGYLGWFTAIDKLIGRRLIDPARTPALAAWEERFRATDAAKGVVPDDADKLLEFRQTLLRWSASKAK

SEQ ID NO: 53436 - protein, 463 aa, Corynebacterium diphtheriae NCTC 13129
MAYATTNPYTGEVVKEFPTATAQEVEQAITRAHDTFTQWSRKPVAERVEVLARAADILETKKREYAEIITLEMGKLIAEAEAEIDICVDMLRYYVANGEAQLAPRYLPAKGFGEHDVQLVNEPLGVLYAVEPWNFPYYQVIRIGAPQFTAGNTIVLKHASNVPQSALKMVELFREAGAPEGLLVNIFADHNATETILSDPRVRGVALTGSEGAGAAVSATASKYLKKSTLELGGADAFIVLNDAELDKAVDWAVFGRHWNAGQVCCSSKRIIVEDSLYDAFLTQYTQKVAALTAGDPMDPNTQLAPLSSQTAADDLGKLVDKARAEGATVTEVGIDLPEHGAFYQPTILTDIPLDSDTAHSEFFGPVSQIYRARDIDHAVEIANSSPFGLGGSVFSQDEAKAKDIARRLDTGMVYINQPTGVKADIPFGGTKRSGFGRELIDLGLHEFVNQKVVVVTDIDGSF

SEQ ID NO: 53437 - protein, 464 aa, Oryza sativa Indica Group
MAVIALKCPAIEVVVVDISKPRIDAWNSEQLPIYEPGLDEVVKECRGRNLFFSTDVEKHVAEADIIFVSVNTPTKTRGLGAGKAADLTYWESAARMIADVSKSDKIVVEKSTVPVKTAEAIEKILTHNSKGINYQILSNPEFLAEGTAIDDLFKPDRVLIGGRETAEGRKAVQALKSVYAHWVPEDRIITTNLWSAELSKLAANAFLAQRISSVNAISALCEATGANVTEVAYAVGKDSRIGPKFLNASVGFGGSCFQKDILNLVYICECNGLPEVANYWKQVIKINDYQKSRFVNRVVSSMFNTVSGKKIAVLGFAFKKDTGDTRETPAIDVCHGLLGDKAQISIYDPQVTEDQIQRDLAMGKFDWDHPMHLQPTSPTAFKQVSVVWDAYEATKNAHGLCILTEWDEFKTLDYQKIYDNMQKPAFVFDGRNVVDPEKLREIGFIVYSIGKPLDAWLKDMPAVA

SEQ ID NO: 53438 - protein, 286 aa, Brassica oleracea
MEGKEEDVRVGANKFPERQPIGTSAQSDKDYKEPPPAPLFEPGELASWSFWRAGIAEFIATFLFLYITVLTVMGVKRAPNMCASVGIQGIAWAFGGMIFALVYCTAGISGGHINPAVTFGLFLARKLSLTRAVYYIVMQCLGAICGAGVVKGFQPKQYQALGGGANTVAPGYTKGSGLGAEIIGTFVLVYTVFSATDAKRNARDSHVPILAPLPIGFAVFLVHLATIPITGTGINPARSLGAAIIFNKDNAWDDHWVFWVGPFIGAALAALYHVIVIRAIPFKSRS

SEQ ID NO: 53439 - protein, 650 aa, Thiobacillus denitrificans ATCC 25259
MILLKNLSLRRGAKVLLDDASVAINPGEKVGLVGRNGAGKSSLFALLNGSLHEDKGDFSVPSQWRLAQVAQDMPETDAPATDFVIAGDTRLVAAQAEVEAAEASDDGERMAHAYMALHDAGAHDAESRAQALILGLGFQVRELSQPVNSFSGGWRMRLQLARALMCPSDLLLLDEPTNHLDLDALVWLEAWLKKYAGTLLVISHDRDFLDAVTDVTLHIENGRLTRYGGNYSTFEDMRVEQMALQQAAYARQQEKIAHLKKFIDRFKAKASKAKQAQSRVKALDRMERLAPLLADAEFSFEFQEPESLPNPMLTIDDASFGYPPPDGAPAGTPPTVIVQHVSRSVFAGQRIGILGANGQGKSTLVKTIARTLPVVAGSVIEGKGLNIGYFAQQELDVLRPADTPLEHMIRLARDVIANGGAGRFSSREQDLRNFLGTFNFSGDMVKQAVGSMSGGEKARLVLCMIVWQRPNLLLLDEPTNHLDLATREALAMALNEFEGTLMLVSHDRALLRSVCDEFWLVTRGGVVPFDGDLDDYQRYLLDEAKRLRESLKAADKAVETPAPKAPLAPAKRAPSGKLKPLKQSLEKSEQRLAALQAEKATLEARLDGAVARDEIAAAGTRLQQLADELEREEERWLQISGEIETHEASA

SEQ ID NO: 53440 - protein, 298 aa, Bradyrhizobium sp. BTAi1
MEFAQEDGSLFRRGFGGDTLNTALYLARLGVPTSYVTALGDDPLSAMMLAAWQAEGINTAEVLRVDGRVPGLYMIERDAKGERSFLYWRDRAPARELFDRADPAMLDRLSRFDLIYLSGISLSLYSETGKAKLRELLTVARKRGARVAFDGNYRPRGWPSREAAQRAFRAILPLVDLALPTLEDEQMLFGDSDVSVSLRRFKDAGVREIVVKRGARGCLIDADGVLVDITPPQVMQPVDTTAAGDSFNAAYLAARLNRVPPRKAALAGHRLAGAVIMSPGAVIPRAAMPKDILVQSET

SEQ ID NO: 53441 - protein, 507 aa, Kluyveromyces lactis NRRL Y-1140
MSSTIAEKLNLKIVEQDAVSITLPNGLTYQQPTGLFINNQFIKSQDGKTLKVENPSTEEIIVEVQSATSQDVEYAVEAADAAFNSEWSTMDPKKRGSLLFKLADLIEAQKELIASIESADNGKTLALARGDVGLVIDYIRSAAGYADKLGGRTINTGDGYANFTYKEPLGVCGQIIPWNFPLMMLSWKIAPALVAGNTVILKPASPTPLNALFFASLCKEAGIPAGVVNIVPGPGRSVGDTITNHPKIRKIAFTGSTDIGRDVAIKAAQSNLKKVTLELGGKSAHLVFEDANIKKTIPNLVNGIFKNAGQICSSGSRIYVQDTIYDQLLSEFKTYLETEIKVGSPFDESNFQAAINNKAQFETILNYIDIGKKEGASILTGGERVGNKGYFIKPTVFYNVKEDMRIVKEEIFGPVVTISKFSTVDEAVALANDSEFGLGAGIETENISVALKVAKRLKAGTVWINTYNDFDAAVPFGGYKQSGYGREMGEEAFESYTQIKAVRIKLD

SEQ ID NO: 53442 - protein, 130 aa, Haemophilus ducreyi 35000HP
MKAISDLTKEQREILINHGTELPFTGKFLNEARTGTYRCVRCHHSLFRSDTKFDAGCGWPSFYEAISAEALRYVDDYRLSRPRTEIRCAHCDSHLGHVFNDGPPPTGLRFCLNSVALNFKWDQTGEEIDG

SEQ ID NO: 53443 - protein, 300 aa, Prochlorococcus marinus str. NATL1A
MVRLNEIKMQDGKVFLITGANSGLGYETSKFLLERGATVIMSCRDLIKGEKAKQELLKFNFSGKIELVELDLSDLINVKKFAESIKNKFDYLDVLINNAGIMAPPKTFSKQGFEIQFAVNHLAHMFLTLELLPMLEEKNNSRVVTVTSGVQYFGKIQWADLQGNLKYDRWASYAQSKLANVMFGLELDSKLKESNSKTSSLLAHPGFARTNLQPKSVEANQSWQEELAYKLMDPMFQSAKMGALPQITAATLTSASGGEQYGPRFSFRGYPKICSNAPKALNQTSRKKLWEISEKLIKGV

SEQ ID NO: 53444 - protein, 141 aa, Haemophilus influenzae R2846
MMTERTFSIIKPDAVKRNLIGAILTRFEQNGFKIIASKMVRLTREQAEGFYAEHQGKEFFAPLVEYMMSSPIVVSVLEKENAVKDYRTLIGTTNPETAAEGTIRKEFALSQRENSVHGSDSIENANREIAYFFTDCEIFER

SEQ ID NO: 53445 - protein, 334 aa, Haemophilus ducreyi 35000HP
MAIKIGINGFGRIGRIVFRAAQLRDDIEVVGINDLIDVDYMAYMLKYDSTHGRFDGTVEVKDGQLVVNGKTIRVTSERDPANLKWDEIGVNIAVEATGLFLTDETARKHITAGAKKVVLTGPSKDATPMFVNGVNFDTYAGQDIVSNASCTTNCLAPLAKVIHNKFGIKEGLMTTVHATTATQKTVDGPSAKDWRGGRGAAQNIIPSSTGAAKAVGKVLPALNGKLTGMAFRVPTTNVSVVDLTVNLEKAASYQEICAEIKRASENEMKGVLGYTEDAVVSTDFNGATETSVFDAAAGIALTDTFVKLVSWYDNETGYSHKVLDLVAHVYNYRG

SEQ ID NO: 53446 - protein, 106 aa, Glycine max
  misc_feature (12)..(12): Xaa can be any naturally occurring amino acid
  misc_feature (43)..(43): Xaa can be any naturally occurring amino acid
ELMLHLKPPSMXAMMMILCPHDREKSTRISNSVEDKEDIAPEXVITCAAVSKTPLSKMVKMLIPTCRDLLEHNEHIAHQASDENMPDSGMHLALDMSQSSLLRAHF

SEQ ID NO: 53447 - protein, 780 aa, Coccidioides immitis RS
MAAAFDDEDLSISLPSFDRDGKDDRTPHSRPSMPPPSRPFTVPPEQSPATARDMQRLEQYKTVRILGEGSFGKVKLAIHQATGREVALKIISRRKLLSRDMVGRVEREIQYLQLLRHPHIIKLYTVITTKTDIVMVLEYAERELFDYLVSRGKCNDDEARTFFQQIICAVEYCHRHKIVHRDLKPENLLMDREKNVKIADFGLSNIMTDGNFLRTSCGSPNYAAPEVISGKLYAGPEVDVWSCGVILYVLLVGKLPFDDEYIPNLFRKISAGNFYMPSYISTGAANLIRRMLQVHPVHRITIPEIRRDSWFKKDLPQYLQHPAEEFVATGADPNKAIDLRSIAPGKPAAVRERIRENAVSKLERRMGYGKEDIQEALRKPEPSAIKDAFFIVVENEMMQTNSPTELDGCPSSPQPREGQDASSQGPGTAARPGFSTPRDTPITPLTPYRVTPINTPESRVSHVRILPTSLPYVHDQIMDQRTKDMTARAASPPQDYSQHIEVADLSGTPRERSPEEQAATARALKPHSRSVVDLEKLQYEPPEMLTQVPSQPKRSRKWQFGIRSRNLPYEAMLCLYKAIQAEGGVWEIQPAEPDNHDDDRVPEMTSEIPGPLQRKYRDVPSEYYIPKDLWFIRARLLKQGVLAPGPASSAHSSRSDLEELRRRVSLKGGVLHQEDRSVSGSAGFGAGLSAASSLSSHSATLSYGVWVFIDIQLYQLERDNYMVDFKCDGYQNVVRIEGDGSATEWRPISKRFRNKEKEITSPYPFLDVASDLVAQLAAAT

SEQ ID NO: 53448 - protein, 157 aa, Triticum aestivum
  misc_feature (114)..(114): Xaa can be any naturally occurring amino acid
  misc_feature (132)..(132): Xaa can be any naturally occurring amino acid
  misc_feature (135)..(135): Xaa can be any naturally occurring amino acid
  misc_feature (139)..(139): Xaa can be any naturally occurring amino acid
  misc_feature (142)..(142): Xaa can be any naturally occurring amino acid
  misc_feature (147)..(147): Xaa can be any naturally occurring amino acid
  misc_feature (150)..(150): Xaa can be any naturally occurring amino acid
  misc_feature (152)..(153): Xaa can be any naturally occurring amino acid
GFGGSCFQKDILNLVYICECNGLPEVANYWKQVIKINDYQKSRFVNRVVSSMFNTVAGKKIAVLGFAFKKDTGDTRETPAIDVCKGLLGDKAQFSIYDPQVTEDQFKRDLTMNXFDWGPPRCTLQPTSPTAXKQXSAFXDAXYEATXGPXGXXLTDW

SEQ ID NO: 53449 - protein, 149 aa, Aspergillus nidulans FGSC A4
MPSKRPSATPSSSAPASASTSGTSTPLPTLSSGPKTLSANSSVSDIAVHVWHQYLTSTPQRTMLLDAFMAFLVLVGGVQLAYCVLAGNYPFNAFLSGFCAAVGQFVLTASLRMQTSSVEEGPGSSKGKGSGGKVVEYGEGVNGGVSHER

SEQ ID NO: 53450 - protein, 109 aa, Zea mays
MCHVNLHFSSLHCTDQTQCFFVSSLWTCYCHIMWNDFFNDSEQTTSRRLADRKIARFEKNITKRGSVPETVKKANDYPVGPILLGFFVFVVVGSSLFQIIKTASNAGLF

SEQ ID NO: 53451 - protein, 410 aa, Buchnera aphidicola (Baizongia pistaciae)
MPDIGTDLVEVIEILVKIGDQVKKDDSLITVEGQKASIEIPASHTGTIKNIIVHIGEKITTGSLIAILNGIDDNVKSKNDSSSYSFKNSKNTSTNSNLGNVNNNINNRTILVHATPTVRRLARKFDIKLENITGTGRKGRILKEDVISYKNISLFNDIKKSLKKTNVNYYKDNVTCDDFKSIELTRTQIRSSKNLLKSWLTIPHVTQFDESDITELENFRQKYNSDLKDKSKKLTILIFVIKAVSKALEMFPKFNGRLINKDNRIAIVLNEHINIGIVVDTDDGLLVPVINRVNKKNISSISNDLRIISERARSRKLNFSDIKEYGSFTISNLGGIGGTNFTPIIKYPELAILGISRALIKPYWNSHAFIPKLMLPLSLSYDHRAIDGVAAVRFITFVKKMLTDIRFLMI

SEQ ID NO: 53452 - protein, 149 aa, Brassica napus
MAGGLVKCSKIRHIVSLKQMLRRWRNKARLSSVSRCVPSDVPSGHVAVCIGSSCRRFVVRASYLNHPILSNLLVQAEEEFGFANQGPLVIPCEESVFEEAIRFISRSDSSRSSRFTCPDDLQKCHGGIKSMLIESRPLLHAAVVEKVVW

SEQ ID NO: 53453 - protein, 236 aa, Glycine max
MAATEIGLLEWVRVGGEEEEAEQAKGCLSKFVDNGSVESHRYYLSRRTTLEMLKDRGYSIPSHEIDLSLSDFRDMHGQFPDPDRLRLSLTHATNSSKRILVIFCGPGVVKVTAIRNIAGQIINRDTLTGLILIVENHITSQALKAVNLFSFKVEIFQITDLLVNITKHVLKPKHQVLTDKQKINLLKKYNIEEKQLPRMLQTDAIARYYGLERGQVVKVTYSGEVTQMHVTYRCVW

SEQ ID NO: 53454 - protein, 374 aa, Simkania negevensis
VVTAPGGGAEVIPFLKFWAVLPCAVIFMLIYAKLSNKLSKPQLFYTAVLPFLIFFALFATVLYPARDYLHPNALCDTLQNTLPAGASGFIAIIRNWTYSIFYVMAELWGSVALSLLFWGFANDITKVSESKRFYSLFGLFANFSLIISGWLIQWASKIRASLPVGADPWQVSLNYLMGMVVLSGLIIVGVYWWINRYVLTDPRFYSQDERKKQKKSKPKLSIKESFLYLTRSKYLGCIAILVLCYGIAINLIEVTWKSQLKIQFPDPNAYSTFMGRFSQITGVVTIFMMLFVGGNVIRRFGWGRAALVTPVVLLITGIAFFSFIIFRDNLTGFIASIGTTPLMLAVIFGTAQNIMSKSAKYSLFDPTKEMAYIP

SEQ ID NO: 53455 - protein, 378 aa, Pisum sativum
ATQGQVITCKAAVAWEPNKPLTIEDVEVAPPQANEVRIQILFTALCHTDAYTLGGKDPEGLFPCILGHEAAGIVESVGEGVTDVKPGDHVIPSYQAECGECKFCKSPKTNLCGKVRAATGVGVMMADRKSRFSVKGKPIYHFMGTSTFSQYTVVHDVSVAKIHPDAPLDKVCLLGCGVPTGLGAVWNTAKVEPGSIVAIFGLGTVGLAVAEGAKSAGASRIIGIDIDSNKYDTAKNFGVTEFINPKDHEKPIQQVIIDLTDGGVDYSFECLGNVSVMRSALECCHKGWGTSVIVGVAASGQEISTRPFQLVTGRVWKGTAFGGFKSRSQVPWLVEKYLKKEIKVDEYITHNLTLLEINKAFDLLHEGQCLRCVLAVHD

SEQ ID NO: 53456 - protein, 506 aa, Orychophragmus violaceus
MTSVNVKLLYHYIITNFFTLCFFPLTAIVAGKASRLTTNDLHHFYYSHLQHSLITITLLFAFTVFGSVLYIITRPKPVYLVDYSCYLPPPHQKASVSKVMDIFYHLRKADPLRNVACDDSSWLEFLRKIQERSGMGDETYVPAGLLEVPPRKTFSASREESEQVINGAIENLFKNTKVNPKEIGLLVVNSSIFNPTPSLSAMVVNTFKLRSNIRSFNLGGMGCSAGAIAIDLAKDLLHVHKNTYALVVSTENITDHIYAGDNRSMMVSNCLFRVGGAAILLSNKPRDRRRSKYELVHTVRTHTGADDKCYRCVQQGDDESGKNGVSLSKDITAVAGKAIKINISTLGPLVLPLSEKILVFVSFIGKKLLKDKIKNLYVPDFKLVIDHFCIHAGGRAVIDVLEKNLGLEPVDVEPSRSTLHRFGNTSSSSIWYELAYIEAKGRMKKGNKVWQIALGSGFKCNSAVWVALRNVKASTNSPWEHCIDRYPVNIDSDSAESVTRVQNGRS

SEQ ID NO: 53457 - protein, 558 aa, Triticum aestivum
SRFICSLREAPSQNLSGLLSPSIGNLTNLEIVLLQNNNINGRIPAEIGRLTKLRTLDLSSNHFSGEIPGSVSRLRDLQYLRLNNNTLSGAFPSSSANLSHLVFLDLSYNNLSGPVPGSLARTFNIVGNPLICGAATEQDCYGTLPMPMSYSLNNTQGTVLPAKSKSHKAAIAFGSTIGCISILFPVTGLLFWWRHRKNRQILFDVDDQHIENVNLENLKRFQFRELQAATENFSSKNMIGKGGFGNVYRGKLPDGTIVAVKRLKDGNAAGGELQFQTEVEMISLAVHRNLLRLCGFCMTATERLLIYPYMSNGSVASRLKGKPPLNWITRKGIALGAARGLLYLHEQCDPKIIHRDVKAANVLLDDFCEAIVGDFGLAKLLDHRDSHVTTAVRGTVGHIAPEYLSTGQSSEKTDVFGFGILLLELITGQTALEFGKSSNQKGAMLDWVRSLSSYSYGTEKKLDVLVDKGLGSSYDHIELEEMVQVALLCTQYLPSHRPKMSEVVRMLEGDGLAERWEASQRTDSHKFKVPDFTFGRCYSDLTDDSSLLVQAVELSGPR

SEQ ID NO: 53458 - protein, 350 aa, Raphanus sativus var. niger
MGFSPSFSCIMGALVLGCLLLQASNSNAQPLSPDFYSRTCPRVFDIIRRTIVAELRSDPRIAASILRLHFHDCFVNGCDASILLDSSTSFRTEKDAAPNANSARGFDVIDRMKAEIEIACPRTVSCADVLTIASQISVILSGGPGWQVPLGRRDSLRAFFDLANTALPSPFFTLAQLNASFAAVGLNRPSDLVALSGGHTFGKAQCQFVTPRLYNFNGTNRPDPSLNPTYLTQLRGLCPQNGIGTVLVNFDPVTPGGFDNQYYTNLRNGRGLIQSDQELFSTPRAFTIPLVEQYSNNRLVFFQAFAEAMIRMGNLKPLTGTQGEIRRNCRVVNSRIRSVENEDDGVVSSI

SEQ ID NO: 53459 - protein, 506 aa, Brassica napus
MTSVNVKLLYHYVITNLFNLCFFPLTAIVAGKAYRLTIDDLHHLYYSYLQHNLITIAPLFAFTVFGSVLYIATRPKPVYLVEYSCYLPPTHCRSSISKVMDIFYQVRKADPSRNGTCDDSSWLDFLRKIQERSGLGDETHGPEGLLQVPPRKTFAAAREETEQVIIGALENLFKNTNVNPKDIGILVVNSSMFNPTPSLSAMVVNTFKLRSNVRSFNLGGMGCSAGVIAIDLAKDLLHVHKNTYALVVSTENITYNIYAGDNRSMMVSNCLFRVGGAAILLFNKPGDRRRSKYELVHTVRTHTGADDKSFRCVQQGDDENGKIGVSLSKDITDVAGRTVKKNIATLGPLILPLSEKLLFFVTFMGKKLFKDKIKHYYVPDFKLAIDHFCIHAGGRAVIDVLEKNLALAPIDVEASRSTLHRFGNTSSSSIWYELAYIEAKGRMKKGNKVWQIALGSGFKCNSAVWVALNNVKASTNSPWEHCIDRYPVKIDSDSGKSETRVQNGRS

SEQ ID NO: 53460 - protein, 284 aa, Raphanus sativus var. niger
RLHFHDCFVNGCDASVLLDNSTSFRTEKEALPNLNSARGFDVVDRMKAEIERACPRTVSCADVLAIAAQISVLLSGGPWWPVSLGRKDGFEAFFDLSNTALPSPFATLAELKTVFSDAGLNRTSDLVALSGAHTFGRAQCIVITPRLYNFNGTNKPDPSINPTFLTELRNLCPENGNPTVLANLDRATPNTFDSHYYTNLRQGKGVIQSDQELFSTPGADTIRLVELYSKNTFEFFTAFSKSMVRMGKLKPSTGTQGEVRLNCRVVNSRTRGVENEDDGVVSSI

SEQ ID NO: 53461 - protein, 466 aa, Brassica napus
MTSVNVKLLYHYVITNLFNLCFFPLTAIVAGKAYRLTIDDLHHLYYSYLQHNLITIAPLFAFTVFGSVLYIATRPKPVYLVEYSCYLPPTHCRSSISKVMDIFYQVRKADPSRNGTCDDSSWLDFLRKIQERSGLGDETHGPEGLLQVPPRKTFAAAREETEQVIIGALENLFKNTNVNPKDIGILVVNSSMFNPTPSLSAMVVNTFKLRSNVRSFNLGGMGCSAGVIAIDLAKDLLHVHKNTYALVVSTENITYNIYAGDNRSMMVSNCLFRVGGAAILLFNKPGDRRRSKYELVHTVRTHTGADDKSFRCVQQGDDENGKIGVSLSKDITDVAGRTVKKNIATLGPLILPLSEKLLFFVTFMGKKLFKDKIKHYYVPDFKLAIDHFCIHAGGRAVIDVLEKNLALAPIDVEASRSTLHRFGNTSSSSIWYELAYIEAKGRMKKGNKVWQIALGALSVTVQFGWL

SEQ ID NO: 53462 - protein, 318 aa, Aspergillus nidulans FGSC A4
MSADFGVDHFNSLSGHCFLHHGPVSQSSRVRSRVTRLLVECRGLGIALVAAQKAQVPVTLVDNSQASLDKGLKFADKLLEKDVSKDRITKEAADAARGRITSSLSLDDLSSVDFVIEAVPEIPDLKTSIFSKLAQIAPEHVILATNTSSISITKIAAATTTDPTNLQAPSRVISTHFMNPVPVQKGVEIIAGLQTSKETIDTAIAFVQRMGKIASVSADSPGFLANRILMPYINEAIICLETGIGSREDIDSIMKNGTNVPMGPLTLADFIGLDTCLAIMNVLHQESGDSKYRPSGLLKNMVNAGWLGKKSGKGFYDY

SEQ ID NO: 53463 - protein, 249 aa, Synechocystis sp. PCC 6803
MLNSLIADFRIIFERDPAARNWLEVLFCYPGLQALLIHRFSHRLYTLGLPFFPRLMSHLARFFTGIEIHPGAQIGQGVFSDHGMGVVIGETAIVGDYSLIYQGVTLGGTGKESGKRHPTLGENVVVGAGAKVLGNIAIGDNVRIGAGSVVLRDVPADFTVVGVPGRMVHPSGERVNPLEHGKLPDSEGKVIRLLLERIELLEQQVATLQQQQSEQAWESDYRSCSETDREPVLCRLGDREIEEFLGGTL

SEQ ID NO: 53464 - protein, 331 aa, Corynebacterium diphtheriae NCTC 13129
MFHVKLTLTTMLDTMNSSAHRPVVVADVDTGIDDALAITYLGYLHRRGLIELRITTSAGNCTAEQAAANSAEIMNSLTLSDVPITPGAPKPRALPLTTTPETHGPTGLGYHTTRATIPQLSNAAAAVDLWKGADYLLVAGPATNVAWAAENAPEVLNAIPHVTFMTGAFHYPGNTTPTAEWNAWVDPHALKEALAHYRGHAVRPTICPLNVTESVLLTPQRLKQWCQRSQEPVLPILSDALRFYFEFHESVGVGYMAQIHDLAAAMVLLNRVPHTTRPGFVDVEADAELTRGTTVVDWDSNYGDHPANAQILTALQSEDVFAEFERVVLEY

SEQ ID NO: 53465 - protein, 611 aa, Synechococcus sp. WH 7803
MVRSCNRSLPTTLSSAGARLGWSLFRSRPTLMIGALLLLLSLSPVSAAPVSRDDPEQADTRKSRISTAAGSAVVVTANPLASKAALNVLASGGHAVDALVAAQAVLAVAEPQSSGLGGGGFLLHWDARRQALEVFDGRETAPERSRSDDLLKPSGDPLSYRAATRNPDAIGIPGTVALLWEAHQQMGQRPWSSTLQPAIRLAREGFLPSPRLRSSVALAQRLGATHNLAFQQLYLPGGKPLPAGRLFRNPALARTLETLAQHGGRAFYEGPLAQRIQSGVNALTAQAPNFKGWSANDLASYAVVRRSPLCRVLMKHRVCTVPPPSSGGLAVLQTLALLEATGGFNDPDNPQSWRDLALAESWADADRLYWVHDPIDGSVPTQGLLNPSYVQARAQAMQASPGRLPQPGLPPGLKRFPFGRPGPGPELGTSHVTIVDGAGNIASYTTTVETVFGSRNLVEGMVMNNQLTDFDWRPVVGGLAVANRRRPGRRPVSSMAPTIVFNNQQPVLALGSPGGKRIPHFISRVLLAALQWAEPPKRSVGLPLLSPQGDSLVIEKDPPLPWPINPNQLNVPGRKLRSQTLGSGIGLLQRIGDRWHGAADPRREGTALALP

SEQ ID NO: 53466 - protein, 279 aa, Prochlorococcus marinus str. MIT 9313
MNLFADLLASTSEARATATGPRIQQRRGVEIKSSRELAIMRKASHIVATVLREIMEMAEPGQTTADLDVYAERRIREMGATPSFKGYHGFPASICASINNEVVHGIPGPKRVIKSGDLLKVDTGAYYEGYHGDSCITICVGEVPESGQKLSRVAQESLMAGLSKIRAGNTLLDIAGAVEDHVKAHGYSVVEDYTGHGVGRNLHEEPSVFNFRTDDLPNITLRSGMTLAVEPILNAGSKACRTLKDRWTVVTQDGSLSAQWEHTIVVTSDGCDILTDRGD

SEQ ID NO: 53467 - protein, 562 aa, Synechococcus sp. WH 7803
MPPSVVTYVLDRLADLGIGHVFGVPGDYSFPLNDAVEVHPRLQWVPSANELNAAYAADGYARRRGAGIVCTTYGVGELSALNGVMGSMAERLPVFHLVGTPSVRIVRQGLICHHTLGDTRYDRFEAISAAAGCVSARLTPENAVVELERVIDKALEDSRPAYLTVPMDLALMPITGTPIQGTPIGSIDQHASVTVELDAVLDLVMERLAKATRPLVMPTVTLKRFGLVETFATFLEVSGLAYATTPMDKALLSEGHPAFLGMYNGVRSTPAALQSVVEGADVLLDVGGLVMEDLNTGLWSGYLDSRRVISLHADWVQAGDQVFTSVSLSEVLAGLIKRFQAADAKPSQWGEQRPVQPEPLIPLAGEGDQPTASANVYPRLQRFLRPTDLLMSDTGTSLLKLNAMRLPDGVAIETQTLWGSIGWATPAALGCALADAERRVVLVTGDGAHQLTVQEIGVMGFMKVKPVVIVLNNGLYGVEALLSETGHAYNDLPPWRYAQLPEAFGCQGWWCGKASTVAELEQALAAINAHNGAAYLEVSIPPEESLPLPEAMIETLHQTATP

SEQ ID NO: 53468 - protein, 474 aa, Oryza sativa Indica Group
MDKAYIAVFSIVILFLLVDYLRRLRGGGTSNGKNKGMRLPPGLPAVPIIGHLHLVKKPMHATLSRLAARHGPVFSLRLGSRRAVVVSSPGCARECFTEHDVAFANRPRFESQLLMSFDGTALAMASYGPHWRNLRRVAAVQLLSARRVGLMSGLIAGESKATRPETTDTDTDMSMEAQEYKQVVEEILERIGTGNLCDYLPALRWFDVFGVRNRILAAVSRRDAFLRRLIYAARWRMDDGEKKSMIAVLLTLQKTQPEVYTDNMITALCSNLLGAGTETTSTTIEWAMSLLLNHPETLKKAQAEIDASVGNSRLITADDVPRITYLQCIVRETLRLYPAAPMLIPHESSADCEVGGYSVPRGTMLLVNAYAIHRDPAAWEEPERFVPERFEGGGCDGNLSMPFGMGRRRCPGETLALHTVGLVLGTLIQCFDWERVDGVEVDMAEGGGLTMPKVVPLEAVCRPRDAMGGVLREL

SEQ ID NO: 53469 - protein, 421 aa, Prochlorococcus marinus str. MIT 9313
MTPERLGLLWGITVFAGAGARILSALSGLPGVVLLLLSGLLIGRSGLGLVEPLDLGQGLETIVGLLVSLVLFDGGLNLRLPGDTIKSTVLRILLIRLVISLAAGLLAAHWLAGLGWSVAAVYSAIVLATGPTVVTPLVQQIRLASPLGDVLEAEGLVLEPVGAVLALLLLELLLGDLHGWREVAFGLLARLGGGVLMGAAAGWLLSEGLRRLKPDPSVGLRLQLTLGVLFLLYAVCEWLLPESGLPASVAAGVVVGRRPVTQSDQLDELIRELARLAITMLFPLLAADVSWGELSPLGWGGVSCVLVLMLVVRPVAVSLATIGLPLDFRQRLFLGWLAPRGIVTAAVASLFAIRLEQAGILGAGRLQGLVFLTILMTVGIQGLTAQPLAKALGLIAPEDSNEDDCSETTTQPVQVLPDPGQ

SEQ ID NO: 53470 - protein, 367 aa, Glycine max
MADGLHSQHPSVVQKLSGQSYLVSRLAPNHSRNCSTTGSYFNGGLQSSGLVPVTAHAPAEKGVSGFLLDFLMGGVSAAVSKTAAAPIERVKLLIQNQDEMIKSGRLSEPYKGIGDCFTRTMKDEGVIALWRGNTANVIRYFPTQALNFAFKDYFKRLFNFKKDKDGYWKWFAGNLASGGAAGASSLLFVYSLDYARTRLANDAKAAKKGGERQFNGLIDVYRKTIKSDGIAGLYRGFNISCVGIIVYRGLYFGMYDSLKPVVLVGGLQDSFFASFLLGWGITIGAGLASYPIDTVRRRMMMTSGEAVKYKSSLEAFKIIVAKEGTKSLFKGAGANILRAVAGAGVLAGYDKLQLVLFGKKYGSGGGG

SEQ ID NO: 53471 - protein, 186 aa, Brassica napus
MIGSFLTRGLVMVFGYAYPAYECYKAVEKNKPEIQQLRFWCQYWILVAALTVFERVGDTFASWVPLYSEAKLAFFIYLWFPKTRGTTYVYDSFFRPYVSKHENEIDRNLVELRTRAGDMAVIYCRKAVCYGQTRVTDILQFVALQSTPKPKPKEKKQTPPEAEEQKQPDLKGGSRAGSSPQARSNP

SEQ ID NO: 53472 - protein, 228 aa, Rhodospirillum rubrum ATCC 11170
MTRAIRIAPSLLSADFAFLGRDAQAMADGGADILHFDVMDNHYVPNLTVGPLVCAALRPHTSLPIDVHLMTRPVDPLIDSFAEAGADMITFHPEASDHVHRSVQMIRKRGLKAGVALNPASPLSLLDHILEDLDLVLIMSVNPGFGGQSFIPSALPKIAALRKRIDDAGLPVAIEVDGGVNPANARALGAAGADILVAGSAIFGASDRAKAIASIRGAAESGLGQEAA

SEQ ID NO: 53473 - protein, 369 aa, Rhodospirillum rubrum ATCC 11170
MSVLSQDRPRERPPMLATDRTTLAQFLVEECRGRAGDDSELLGLLLDVAQACKTISKMTAMGSLAGVHGYNGDVNPQGENQARLDLMSNQAFVRATERTGHAAGLASEEMEEVLGFPESYARGTLLLVFDPLDGSSNIDINGTVGSIFSILPMPRPGEAPQTADFLQSGRQQVAAGYALYGPSTMFVLTIGSGVHGFTLDPLLGDFILTHPSMTVIPESGEFAINSSNSRFWEPPIRAYVDELLAGRSGPRSKDYNMRWIAALVADVHRILLRGGIYLYPRDTKTPDLAGRLRLLYEAAPVAFLMEQAGGRCTTGTRTMLDLVPGSLHERVPLIFGSAVEVERVETLYREPQRREFATPLFNQRGLFRD

SEQ ID NO: 53474 - protein, 292 aa, Rhodospirillum rubrum ATCC 11170
MSVKHPIIAITGSSGAGTTSVTRTFEQIFRREGVNAAVVEGDSFHRNDRKAMKIAMAEAQKAGNANFSHFGPEANLFEELETLFRTYGETGGGRRRLYLHNDEEAAPFAQEPGTFTPWEDLPESDLLFYEGLHGAVVTDTVDVAQHADLKIGVVPVINVEWIQKLHRDRAARGYSTEAVTDTILRRMPDYVHYICPQFTRTDVNFQRVPLVDTSNPFVARHVPSADESFVVIRFRDPKGIDFPYLLNMLNDSFMSRPNTIVVPGGKMELSMQLIFTPFIWRFMDKRARALGR

SEQ ID NO: 53475 - protein, 256 aa, Actinobacillus pleuropneumoniae serovar 1 str. 4074
MARRPLVMGNWKLNGSKAFTKELIAGLKAELADVKGCDVAIAPPVMYLAEAEAALAGQSVIALGAQNVDVNVQGAFTGDISTEMLKDFGAKYIIIGHSERRTYHKECDTFIAKKFAALKAAGLVPVLCIGETEAENEAGQTEAVCAKQIDAVIDALGVEAFNGAVIAYEPIWAIGTGKSATPAQAQAVHAFIRGHIAAKSQAVADQVIIQYGGSVNDANAAELFTQPDIDGALVGGASLKAPAFAVIVKAAEKAKA

SEQ ID NO: 53476 - protein, 149 aa, Pisum sativum
MAEQTFIMIKPDGVQRGLVGEIISRFEKKGFYLKGLKFVNVERAFAEKHYADLSAKPFFSGLVDYIISGPVVAMIWEGKNVVTTGRKIIGATNPAQSEPGTIRGDFAIDIGRNVIHGSDAVESANKEIALWFPEGAANWQSSLHSWIYE

SEQ ID NO: 53477 - protein, 443 aa, unidentified eubacterium SCB49
MARFELKLPKMGESVAEATVTNWLKNIGDTIEADEAVLEIATDKVDSEVPSEVDGVLVEIFFNADDVVQVGQTLAIIETDGEESEPSSQESADAKTETASPQEVSAVENTVTAAQEVVKTEIVNSDDRFYSPLVKNMAAAEGITQAQLDGIVGSGKDGRVTKNDMLAYIENGGGQQAEVATAKTEVKDKPASTAKAPATKSTPVSVNGGDEVIEMTRMGKIIAHHMVDSVQTSAHVQSFIEADVTNIWNWRKKVKADFAKREGENLTFTPIFMEAVAKALKDFPMMNIAVDGDSIIKRKNINLGMAAALPDGNLIVPVIKNADQLNLVGMSKAVNDLAGRARNGALKPDDIQGGTYTVTNVGTFGSIMGTPIINQPQVGILALGAIRKVPAVIETPDGDFIGIRYKMFLSHSYDHRVVNGALGGQFVKQVADYLEAWDMNREI

SEQ ID NO: 53478 - protein, 403 aa, Medicago sativa
MFGSKPYQAKTQPAQEVVLTTQESLPAPKKAILVLADGSVFRGTAIGAEGLSVGEVVFNTAITGYQEILTDPSYAQQIVTLTYPHIGNTGTNTEDEECERIWATGLVIRDLPLLASNFRNQESLSDYLKARNVIGIADIDTRRLTRLLRDKGAQNGCLMAGDDVDEAKALAAAKAFGGLKGLDLAKEVTVSESYSWNESSWKLGEGHTALTGAKKFKVVAYDFGVKRNILRMLADRGCDLTVVPAKTTAAEVLALNPDGIFLSNGPGDPEPCTYAIDAIKAFLETDIPVFGICLGHQLLALASGAQTIKMKFGHHGGNHPVQNLDTKRVLITAQNHGFAVEESSLPANLRATHKSLFDGSLQGIHRTDKPAFSFQGHPEASPGPHEADTLFDHFIELMQARKG

SEQ ID NO: 53479 - protein, 381 aa, Mycobacterium avium 104
MARDYYGLLGVSRGASDAEIKRAYRKLARELHPDVNPDEAAQAKFKEISVAYEVLSDPEKRRIVDLGGDPLEGAAAAGGGFGGFGGLGDVFEAFFGGGFGGGTTSRGPIGRVRPGSDSLLRMRLDLEECATGVTKQVTVDTAVLCDRCHGKGTNGDSAPVPCDTCGGRGEVQTVQRSLLGQVMTSRPCPTCRGVGVVIPDPCHQCMGDGRVRARREISVKIPAGVGDGMRVRLAAQGEVGPGGGPAGDLYVEVHEQPHDVFVREGDDLHCTVSVPMVDAALGATVTVDAILDGVSEITIPPGTQPGSVITLRGHGMPHLRSGTRGDLHVHVEVVVPSRLDARDTELLREFKARRGREVPEVRSTHAGGGLFSRLRETFTGR

SEQ ID NO: 53480 - protein, 341 aa, Brassica napus
  misc_feature (90)..(90): Xaa can be any naturally occurring amino acid
  misc_feature (122)..(122): Xaa can be any naturally occurring amino acid
  misc_feature (132)..(132): Xaa can be any naturally occurring amino acid
MAGGKIKIGINGFGRIGRLVARVVLQRDDVELVAVNDPFITTEYMTYMFKYDSVHGQWKHHELKVKDEKTLLFGEKPVTVFGIRNPEDIXPWGEAGADFVVESTGVFTDKDKAAAHLKGGAXKKVVISAPSXKDAPMFVVGVNEHEYKSDLDIVSNASCTTNCLAPLAKVINDRFGIVEGLMTTVHSITATQKTVDGPSMKDWRGGRAASFNIIPSSTGAAKAVGKVLPQLNGKLTGMSFRVPTVDVSVVDLTVRLEKAATYDEIKKAIKEESEGKLKGILGYTEDDVVSTDFVGDSRSSIFDAKAGIALSDNFVKLVSWYDNEWGYSTRVVDLIVHMSKA

SEQ ID NO: 53481 - protein, 635 aa, Roseovarius nubinhibens ISM
MEGMLFQATIYLVAAVIAVPLASRLGLGSVLGYIAAGILIGPVLGLVGHETHDLQHVGEFGVVMMLFLIGLELEPKALWDMRHKLIGLGGMQVVLTTLAVMVVAMQLGQVWSVALAIGMIFALSSTAIVLQTLSEKGLMRTGGGRSSFSVLLTQDIAVIPMLAFIPLLALPQTPESVLGDALKKLMAGEGKHEVAPAHEAAVHFIESLPSWGVTLVTFGAVAGIIVFGVYLTRPIFRFIHAAKLREMYTALALLIVVSISFLMNLLGLSPALGAFLAGVVLANSEFRHELESDIEPFKGLLLGLFFITVGAGINFAVLFALPALILGLTLAVIVIKGIVLYCLGRVFGLRRRDLWLFTLSLAQAGEFGFVLISFSKQQNVLPRQIDEVLLLVVALTMLITPLLFLLYDWMSRRMTETNDLPEPDQIDDKGQVIIVGIGRFGQIVHRLVRSAGFSTVVLDRDLSAIQRMRRFGIKSFFGDPTRPEMLIAAGLREARVLVVAIDDPQASVRLVHFARRERPDLHIICRARDRTHVFRLYQAGANDIVREMFDASLRAGRYALENLGLSEFEAAELETTFYHHDRHSVKELAALWNPDIPTVENAAYIARAKELESELETMLLSAMEEAAATEDKKTA

SEQ ID NO: 53482 - protein, 505 aa, Thiobacillus denitrificans ATCC 25259
MSHPDDYLERILTSRVYDVAIESPLEVAHNLSRRLDNQILLKREDLQPVFSFKCRGAYNKMAKLTAAQLARGVVAASAGNHAQGVALAAEKLGATATIVMPATTPRIKVDAVAARGARVILHGDNYDEAYEHAMQLAKEAKATFVHPYDDPDVIAGQGTVAMELLRQHPGPIHSVYIPVGGGGLIAGMAAYIKRLRPQIKIVGVEPEDADAMARSLCKNTRVTLPRVGIFADGVAVKKVGKETFRLAQLYVDEIIRVNNDAICAAIKDVFEDTRSILEPAGALSIAGMKAAIAGDRLKGKTLAAVASGANMNFDRLRHIAERAELGEKREAILAVTIPETPGSFKTFCGLLGARNITEFNYRYADPRVARVFVGLSVPGEGESKRVVELLGRHGLEAIDLSDNEMAKLHIRHLVGGRAPDAVNEVLYRFEFPERPGALMQFLQSMSRGWNISLFHYRNHGTDYGRVLVGIQVPDKEKPVFQKFLEGLGYRYWDESRNPAYTLFLG

SEQ ID NO: 53483 - protein, 218 aa, Thiobacillus denitrificans ATCC 25259
MTQDEMKRAVARAAVDYAKGGIIGVGTGSTANHFIDALAEVKGRIEGTVASSEATAARLKSHGIQVLDLNSVGELEVYVDGADEITQHFAMIKGGGGALTREKIVAACSKQFVCIADDSKLVDVLGKFPLPVEVIPMARSHVARELVKLGGQPRLREGFTTDNGNVILDVHNLSIIDPVSLETAINQIVGVVTNGLFARRGADVLLLGTSTGVKTFTR

SEQ ID NO: 53484 - protein, 507 aa, Nectria haematococca mpVI
MAKSKTKESKKAKAAEPLAAVKAGGITKPSKTTKAKSKELAKSAAKKLVKEKDSKKKKKAEPESESSESESESEAESSDDSDSSSEEEKKVTKKATTNGKAKAKAPTPSSDSESESDSGSDDSDDSDSESEEEEKPKAKATKVNGTAKAAAKKAESSDSSDSESDSDSDSDDESEEKEEKKPAAKVAEKKAASSDDSDDSDDSEEDSDDSDDSSEESDAKAKTEEAPSKKRKAEDDIDSDEAKKTKTDAPTTLFAGSLSWNIDDDALYEAFKEFNGLVGARVVTEKGTGRSRGFGYVDFNDPEGCTKAYEAMQGFELDGRALNLDYANARPADANPAGRAADRAKRHGDTLSPESDTLFVGNLPIDVDQDAVREFFGEVAEVASVRLPTDPDSGNLKGFGYVSFNSVEDAKAVIDAKNGAPIGNGRMSRSVRLDFASSRPQQGGGGGGFGGGRGGGRGGGRGGFGGRGGGGRGGGRGRGGRGGGRGGFGTGANSTPASYSGTKISFD

SEQ ID NO: 53485 - protein, 368 aa, Campylobacter jejuni subsp. jejuni NCTC 11168
MKEQILEKLKTVKYPGFEKDIVSFNFVKDIKIQDDGVFIDIEIVSANPEVANEIRKNTIEALSSLALKNIELNIITPKIPEEKSNSRSGKNIAPQVKNFIMVSSGKGGVGKSTTTVNLAISMAKMGKRVGILDADIYGPNIPRMLGETKTQPEVVGQRLKPILTHGVYMMSMGVLIEEGQGLMWRGAMIMKAIEQLLADVIWPELDVLFLDMPPGTGDAQITSAQSIPIAAGVCVSTPQTVSLDDSKRALDMFNKLHIPIAGVIENMSGFLCPDNGKEYDIFGKGTAEDMAKAYKSEVLAQIPIEMIVREGGDEGKPVSFYHPESVSSKRYLMAAEKIWSFIEKINNEGGADNSAIQPVMNGKSACSH

SEQ ID NO: 53486 - protein, 370 aa, Synechococcus sp. WH 7803
MIRARAAVAWAPGEPLDVTEIDVAPPQPGEVLLKVVATGVCHTDAYTLSGADPEGLFPAVLGHEGGAVVVEVGEGVSSVAAGDHVIPLYTPECGSCRFCRSGKTNLCQAIRSTQGRGLMPDGTSRFSKNGRMIHHYMGTSTFSEYTVLPEIAVARINPEAPLEKVCLLGCGVTTGIGAVRNTAKVEPGSSVAVFGLGGIGLAVIIGAVQAGAERIIGIDINPAKFAIAEQLGATECINPQDHNAPIQEVLIERTDGGVDYSFECIGNVEVMRAALESCHKGWGESTIIGVAGAGQEISTRPFQLVTGRVWRGSAFGGVRGRSELPGFVESFQNGEIPLDTFITHTMGLEAINNAFALMHKGESIRSVVHF

SEQ ID NO: 53487 - protein, 371 aa, Campylobacter jejuni subsp. jejuni NCTC 11168
MSEMSLIMLAAGNSTRFNTKVKKQFLRLGNDPLWLYATKNLSSFYPFKKIVVTSSNITYMKKFTKNYEFIEGGDTRAESLKKALELIDSEFVMVSDVARVLVSKNLFDRLIENLDKADCITPALKVADTTLFDNEALQREKIKLIQTPQISKTKLLKKALDQNLEFTDDSTAIAAMGGKIWFVEGEENARKLTFKEDLKKLDLPTPSFEIFTGNGFDVHEFGENRPLLLAGVQIHPTMGLKAHSDGDVLAHSLTDAILGAAGLGDIGELYPDTDMKFKNANSMELLKQAYDKVREIGFELINIDICVMAQSPKLKDFKQAMQSNIAHTLDLDEFRINVKATTTEKLGFIGRKEGMAVLSSVNLKYFDWTRL

SEQ ID NO: 53488 - protein, 94 aa, Arabidopsis thaliana
SQSDVRSRPRDTLSDEPGVVWNDTSPTQTTRAPPLVGHKLLLEDINDLLEIGKRIPRCLTGEGVSCFMWGYAYWDLALCFLELCCCGSSSCGRT

SEQ ID NO: 53489 - protein, 222 aa, Zea mays
MRRKIAQRMQDATRRAAHFSYVEEIDVTALDELRVHLNEKHGATRGKLTLLPFIVRAMVVALRDFPQINARYDDEAQVITRLGAVHVGVATQSDVGLMVPVVRHAEARSLWGNAEEIARLATAARNGKASRDELSGSTITLTSLGALGGIVSTPVLNLPEVAIVGVNRIVERPMVIKGQIVVRKMMNLSSSFDHRVVDGMDAAQFIQAIRGLLEQPASLFLE

SEQ ID NO: 53490 - protein, 639 aa, Debaryomyces hansenii CBS767
MVALEKRRRGIEDQYLENFRKFRRFVVLTFVLFGIGWLVLKPVRQHEFDYSIFYNVNRDPVGDPIGQPTLDPSNEHLRIGSKAMVSSDVPLCSTMGKEILQRGGNAADAGVTVALCIGSINLHSSGIGGGGYIVSSLKEKQEVISIDARETAPQKAFKEMFHKSMVLSKIGGLAVGVPGELKGLYELYTRHGSGNLSWEALIEPVVELNQKGFKCSEILDRAIKFQMGLVFPLLPSLAEDWDFVFKNNTKSKPLIDEGDIITRPALADTLSMIAQNGSSDVFYDPNGPIVKSLIETSSRFGGIITAEDFANYDVKVENALTLNFTVHNETYKVYTSGGVSSGLALLSGLNLYEKLGGSNDHVLQTHRIIECMKWMASARSNFGDFTLHTSNSTFREDLINQYTSDKWAEHIITSGAYSDNNTFPWKHYGPKYELTEPHGTSHFSIIDSDDNTMAMTTTVNLVFGSMVYDNQTGIILNNEMDDFSIPGAPNAFDLSPSVYNYIEPFKRPLSSTSPTIIMSLVNDTFRPDLVIGAAGGSRITTAVFQAIVRILCEKLPLLEALSYPRLHHQLIPQYIMVENLTVFELHHNITERMHELGHDFFSSGPLTAMNGIKRILLDHDSQWHGVSDYWRKRGQADGY

SEQ ID NO: 53491 - protein, 218 aa, Triticum aestivum
TKFVQKSRLYRSGIPGISSTHASGEWEAGFASLQGEDFEYYMQTYSIMLGRNSKKSTVDVDLSSLGGGMNISRHHARIFYDFQRRRFALDVIGKNGCLVEGVLHLPGNPPVKLDSQDLLQIGDKKFYFLLPTRSIFASFAAQEVPGALRHQHEIQGQGDLGVRLAGFLALLTSEVRLSPKLCLGIVLHPCRRRQSVGSFMSGRSSGVLICLCSFASVK

SEQ ID NO: 53492 - protein, 817 aa, Zea mays
MATRAGRLPTTPAPALLLLLAFPFLLQGVLPSRAGDTVAAGRPLSGGQSLVSKRGKFRLGFFRPGATDNSSQRWYLGIWYNQLSVHTTVWVANRGTPISDPESSQLSISKDGNMVVLDHSRSSTAVWSTNVTTGVSSTSTVGVIRDNGNLVLADASNTSAVLWQSFDHSGDTWLPGGKLGRNKRTGEVTRLVAWKGRDDPTPSLFALELDPRGSSQYLLNWNDSERYWTSGNWTGTAFAAVPEMTSTGASPVSDYTFGYVDGANESYFTYDVADESVVTRFQVDVTGQIQFLTWVAAAAQWVLFWSEPKRQCDVYANALPSCTCPRGFRERDLAEWMQDDHTAGCARNTALQPCGAGAAARDGQKRRRDDDRFYTMPDVRLPSDARSAAAASAHDCELACLRNCSCTAYSYSGGCSLWYGDLINLQDTTSAGSGTGGGSISIRLAASEFSSNGNTKKLVIGLVVAGSSFVAAVTAIVLATVLVLRNRRIKSLRTVQGSLVAFTYRDLQLVTNNFSEKLGGGAFGSVFKGVLPDATLVAVKKLEGVRQGEKQFRAEVSTIGTIQHVNLIRLLGFCSEGSRRLLVYEHMPSGSLDRHLFDRDQQPGVLSWDARYQIALGVARGLDYLHEKCRDCIIHCDIKPENILLDDAFVPRVADFGLAKLMGRDFSRVLTTMRGTVGYLAPEWIAGTAVTTKADVFSYGMMLFEIISGRRNVGQRADGTVDFFPSTAVNRLLDGDVRSAVDSQLGGNADVAEVERACKVACWCVQDAESLRPSMGMVVQVLEGLVDVNAPPVPRSLMVLADPSKYAVEFFSGLPST

SEQ ID NO: 53493 - protein, 363 aa, Prochlorococcus marinus str. NATL1A
MLKAGIVGLPNVGKSTLFNALVANAQAQAANFPFCTIEPNVGSVSVPDQRLNLLGELSNSKQIIPTRMEFVDIAGLVKGASKGEGLGNKFLANIREVDAIVHVIRCFRDDDVIHVSGSVDPSRDIEIINLELALSDLNQIEKRRTRLKKQISTIKEAKLEDDVLEKLSEALENENAVRSVSLTDEEKKLIKPLGLLTEKPIIYATNLGEDELAKGNSFSDEVNTLATKEGSECVKISAQVEAELIELGEEERDDYLNGLGVEEGGLISLIKATYRLLGLSTYFTTGEKETKAWTISDGMTAPQAAGVIHTDFEKGFIRAQTISYKKLLEAGSLVEARNKGWLRSEGKEYVVNEGDVMEFLFNV

SEQ ID NO: 53494 - protein, 413 aa, Rhodospirillum rubrum ATCC 11170
MDHDFYRIKRLPPYVFAEVNAMKARARAAGDDIIDLGMGNPDQPTPQHIVDKLCEAATNPRAHGYSMSRGIPGLRKALAGYYARRFNVELDPETEAIVTLGSKEGLANLAQAITSPGDIVLAPNPSYPIHAFGFIIAGGAVRHIPAKPGPEFLEAMERGVRHSVPKPVAVLINFPSNPTAYVADLDFYGQVVDFCRHHGIWILSDIAYSEIYFDHKPPPSVLQIPGAKEVAIEFTSLSKTYNMPGWRIGFAAGNRHLIGALTRIKSYLDYGAFTPVQVAATAALNGPQDCVEDIRTLYRERRDVLIDGLAQAGWDIPSPPASMFAWAPLPKGFEHLGSLEFSKLLMREAKVAVSPGVGFGEYGDSHVRIALVENKHRIRQAVRNIKAFLGGGQGGETGLGAKGEDKQKADEAV

SEQ ID NO: 53495 - protein, 371 aa, Acinetobacter calcoaceticus
MSELKDIIAAVTPCKGADFELQALKIRQPQGDEVLVKVVATGMCHTDLIVRDQKYPVPLPAVLGHEGSGIIEAIGPNVTELQVGDHVVLSYGYCGKCTQCNTGNPAYCSEFFGRNFSGADSEGNHALCTHDQGVVNDHFFAQSSFATYALSRENNTVKVTKDVPIELLGPLGCGIQTGAGACINALKVTPASSFVTWGAGAVGLSALLAAKVCGASIIIAVDIVESRLELAKQLGATHVINSKTQDPVAAIKEITDGGVNFALESTGSPEILKQGVDALGILGKIAVVGAPQLGTTAQFDVNDLLLGGKTILGVVEGSGSPKKFIPELVRLYQQGKFPFDQLVKFYAFDEINQAAIDSRKGITLKPIIKIA

SEQ ID NO: 53496 - protein, 498 aa, Opitutaceae bacterium TAV2
MGKPTGFLEYMREIPVDRSPLDRLNDWSEFHLHMDEKKLRNQGARCMDCGVPFCHTGRLISGMAAGCPIHNLIPEFNDLVFRGLWQQAYERLSKTNNFPEFTGRVCPAPCEGSCVLGIHNPPVAIKNNEYSIIERAWEEGWVLPREPRMRTGKKVVVIGSGPSGLAAAAQLNTAGHTVTVYERADRPGGLLMYGIPNMKLDKRDVVLRRVELMKQEGITFICNAEVGTKIDAHELLSSHDAVVVCTGATQPRDLPIEGRQLKGVHFAMDFLTAGTKALLATPAGSPPAASAITARDKHVIVIGGGDTGTDCVGTSLRQGCRSVTQIEIMPKPPLERQPSNPWPEWPKIYKMDYGQEEAAARQGSDPRIYLTTVKKFIGDAEGRIEKLVTVQIKWEKNDKGQFVPVEQPGTEKTLPAQLVLLAMGFLGPEQPLLKKLGLETDTRSNIKAEHERHTTSNPKVFAAGDCRRGQSLVVWAINEGRAAARECDRALMGATQLP

SEQ ID NO: 53497 - protein, 308 aa, Oryza sativa Japonica Group
MAEAVASGAAGRWTLRGKTALVTGGTRGIGYSPQHPSLVLPYRYPVRSETSTAEPLLLFHDQRGEFMRRHAVVDELAALGAAVHTCSRKEAELGERLREWEGKGFRVTGSVCDVSVREQRERMLREVAGLYGGKLDILVNNVGTNFSKQTTEYSADDYSFIMATNLESAYHLCQLAHPLLKSSGSGSVVFISSVSGVVAVSSGSVYAMTKGAMNQLAKNLACEWAKDNIRTNSVAPWYMKTSLVEDELARKDFADSVVRRTALKRVGEPEEVSSLVAFLCMPGASYITGQTISVDGGMTINGLYPTQD

SEQ ID NO: 53498 - protein, 751 aa, Triticum aestivum
MTVTPQITVSDGRLAVRGRTVLSGVPDNVTAAHASGAGLVDGAFVGATAGEAKSHHVFTFGTLRDCRFMCLFRFKLWWMTQRMGTSGRDVPLETQFILIEVPAAAGNDDGDSEPVYLVMLPLLEGQFRTVLQGNDQDQLQICIESGDKAVQTEQGMNSVYIHAGTNPFDTITQAVKAVEKHMQTFHHREKKKVPSFVDWFGWCTWDAFYTDVTADGVKQGLRSLAEGGAPPRFLIIDDGWQQIGSENKEDPSVAVQEGAQFASRLTGIKENTKFQSEQQEETPGLKRLVEETKKEHGVKSVYVWHAMAGYWGGVKPSAAGMEHYESALAYPVQSPGVTGNQPDIVMDSLSVLGLGLVHPRKVYSFYDELHAYLAACGVDGVKVDVQNIVETLGAGHGGRVALTRAYHRALEASVARNFPDNGCISCMCHNTDMLYSAKQTAVVRASDDFYPRDPASHTVHISSVAYNTLFLGEFMQPDWDMFHSLHPAAEYHGAARAIGGCPIYVSDKPGNHNFDLLKKLVLPDGSVLRAQLPGRPTRDCLFSDPARDGASLLKIWNMNKCAGVVGVFNCQGAGWCRVVKKTRIHDEAPGTLTGSVRAEDVEGITQATGTDDCTGDAVVYTHRAGELVRLPRGATLPVTLKRLEYELFHVCPVRAVAPDISFAPIGLLHMFNAGGAVEECVVRTNEDDKAVVALRVRGCGRFGAYCSRRPAKCSLDSADVEFGYDADTGLVTVDVPVPEEEMYRWTLEIRV

SEQ ID NO: 53499 - protein, 536 aa, Opitutaceae bacterium TAV2
MLKKIIAKIRAKIAPSSPAKPAKKTNGGPSVSKSKSTRSDSAPRGERTERPARGPREQRGGERRDDSQRSGGRGSRNDGGRSGGRSGGRGGRGGFGSQRGERRERPMRDETFEHPRSEPIKPVTPVEIPPQDTAFSKLGLNDALAFAVTEMGYTEPTPIQAQAVPAVLAGRDVTGSAQTGTGKTAAFALPILHKLGAHERRLRCLVLEPTRELALQVEEAFQKYSKYTDLTATVVYGGVGYGKQREDLQRGVDVVAATPGRLLDHIEQGTMTLADVEILVLDEVDRMLDMGFLPDVKRIVQQCPQARQTLFFSATLPPELAQLASWALRDPVEIKIGQRRSPAETISHAFYPVVASQKFDLLIDLLSRTEFKSVIIFTRTKMGADRIAHRLQREGHTVGVIHSDRNQRERVEALEGFKSGKFEVLVATDIAARGLDIAGVSHVINYDVPENPEDYVHRIGRTGRANASGDAFTLVTEDDVRDARSIERYINAEIERKKIDGFDYIYSALFDENAAGAAAPAKPAGRLVRGMRGGRR

SEQ ID NO: 53500 - protein, 343 aa, Roseovarius nubinhibens ISM
MTQESSPVTEPRQKKVERHARLSVAPMMDWTDRHCRYLHRLLSREALLYTEMVTAPALVRGGAMHLLDHAPEEHPVALQLGGSDPEELAEAARLGAEAGYDEINLNCGCPSDRVQSGTFGAVLMTDPGRVADCCAAMIAATDVEVTVKCRIGVDDQDPEEVLPEFLARVGAAGVGRFTIHARKAWLKGLSPKENRDIPPLDYDLARRMIGLFPSLHLSINGGIATLDHAVELLDQGFDGVMLGRAAYHQPADILCAADRRIFGHDGPDSTAEDAVQAMLPYIEAHLAAGGRLNQITRHMLGLFAGRPGARAWRRMLSEGASRPGAGPELVEEALTQIAPDLAA

SEQ ID NO: 53501 - protein, 128 aa, Oryza sativa
MTALRIGNGYDIHRLVGDRPLILGGVTIAHHLGLDGHSDADVLTHALMDALLGALSLGDIGHYFPPSDARWQGADSLKLLAQVHQLILERGWRINNLDNVIVAEQPKLKPHIQAMKENLAKVSLLSSE

SEQ ID NO: 53502 - protein, 346 aa, Glycine max
MAHPTSSSGQSHDLKKEDCKETRSLVVCFGEMLIDFVPTVGGVSLAEAPAFKKAPGGAPANVAVGISRLGGSSAFIGKVGADEFGYMLGNILKQNNVETSGMRFDSNARTALAFVTLRADGEREFLFFRNPSADMLLQESELDKDILKQARIFHYGSISLIDEPCKSAHLAAMSIAKNSGCILSYDPNLRLALWPSADSARKGIMDIWDQADVIKISEDEITFLTGGDDPYDDNVVLKKLFHPNLKLLIVTEGSQGCRYYTKAFKGRVAGVKVKPVDTTGAGDAFVSGILYCIASDQTIFQDEKRLRKALYFANVCGALTVTERGAIPALPTKEAILQFLLEAAVI

SEQ ID NO: 53503 - protein, 523 aa, Zea mays
MASPPPALEILVREPDGVTVWSGPPYPPGTTSPPQRLPKTACSATSFSTDGARLLATVASASATVYDCRTLAVVKCFELPGLLAAALSPTGAYLQTFQKSSSPQEKNVTVWHVDTAAALYQHYQKSMSKTTWPMVQFSADESVACRMMPNEIQFFDPKDFAKGILYRIRMPGIATMKLATAPGSHVAGFVPEAKGVPASVQIFSCNKDAQNQVVARRSFFRCSTVQLQWNKGSTGLLILAQADVDKTNQSYYGETKLNYLTTDRAFEGIVPLKKDGPVHDVQWSSSGSEFAVVYGVMPPKATIFNKKCNPLVEFGEGPYNTIRWNPKGRFVVLAGFGNLPGDMAFWDYSEKKLVAKTKAECSVTSEWSPDGRHFMTATTAPRLQIDNCIKIFDHNGSLQFKKMFERLYQADWKPEAAERFTDIADLTTSLSTLKIEETKKQVSAQGSKSAQTSSKAPAITAPKPTAYRPPHAKGSAELQDKLFGGLAPAGGEMSKNALRNKKRREKQKEKKAAEASGSPADES

SEQ ID NO: 53504 - protein, 560 aa, Salmonella enterica subsp. enterica serovar Kentucky
MSTLKITGMTCDSCAVHVKDALEKVPGVQSADVSYAKGSAKLAIEVGTSPDALTAAVAGLGYRATLADAPSVSTPGGLLDKMRDLLGRNDKTGSSGALHIAVIGSGGAAMAAALKAVEQGARVTLIERGTIGGTCVNVGCVPSKIMIRAAHIAHLRRESPFDGGIAATVPTIDRSKLLAQQQARVDELRHAKYEGILGGNPAITVVHGEARFKDDQSLTVRLNEGGERVVMFDRCLVATGASPAVPPIPGLKESPYWTSTEALASDTIPERLAVIGSSVVALELAQAFARLGSKVTVLARNTLFFREDPAIGEAVTAAFRAEGIEVLEHTQASQVAHMDGEFVLTTTHGELRADKLLVATGRTPNTRSLALDAAGVTVNAQGAIVIDQGMRTSNPNIYAAGDCTDQPQFVYVAAAAGTRAAINMTGGDAALDLTAMPAVVFTDPQVATVGYSEAEAHHDGIETDSRTLTLDNVPRALANFDTRGFIKLVIEEGSHRLIGVQAVAPEAGELIQTAALAIRNRMTVQELADQLFPYLTMVEGLKLAAQTFNKDVKQLSCCAG

SEQ ID NO: 53505 - protein, 270 aa, Clostridium acetobutylicum ATCC 824
MDSKVGFIGCGNMAQAIIKGMVKAKVVPNENIIVSNPSNEKLEKISKECGVLTTNDNKQVALKADIIVLSVKPNKYEKVISEIKDLVQQSVIIVAIAAGVSIEKTRIMFKNSNIRVVRAMPNTPALVGEAMTAISPCEEIDKGELKNVTEIFESFGKCEVVDEALMNAVTGVSGSSPAYVYMFVEAMADAAVLNGMTREKAYKFAAQSVLGAAKMILETGEHPGKLKDDVCSPSGTTIEAVYALEKSGFRASVIAAVDACIKKSKLMSSK

SEQ ID NO: 53506 - protein, 150 aa, Oryza sativa
RMEQSFIMIKPDGVQRGLIGDIISRFEKKGFYLRGMKFMNVERSFAQQHYADLSDKPFFPGLVEYIISGPVVAMVWEGKDVVATGRRIIGATRPWEAAPGTIRADYAVEVGRNVIHGSDSVDNGKKEIALWFPEGLAEWRSNLHPWIYES

SEQ ID NO: 53507 - protein, 189 aa, Rhodospirillum rubrum ATCC 11170
MSASEPPAVPLGTPAAAGPIILPHRGIWPRIASDAFIAPGAVVIGDVEIGARTSVWFGCVLRGDVHHIRIGARTNIQDGTIVHVTGGHLGTLIGDDITIGHRALLHACTLESNCFVGMGAIVMDGAVVESWAMVAAGALVTPGKRVESRSLWAGSPAARKRDLSAEDIAFFPESARKYADLADIYVEEM

SEQ ID NO: 53508 - protein, 458 aa, Listeria innocua Clip11262
MEEQKEELQRGLKNRHIQLIAIGGAIGTGLFLGAGKSIHLAGPSIMLVYLIIGAILFFVMRALGELLIHNPTTGSFTEFAEQFIGPWAGFITGWTYWFCWIVTGIAEITAVGMYVKFWVPDLPQWIPALGCVLILLLFNLATVKAFGEIEFWFAIIKVVVIIALIVIGFVLVFIGYKHGTSTASFSNLIDYGGFFPNGVAGFLLAFQMATFSFVGIELVGVTAGEADDPERTLPKAINNIPIRILIFYIGALLVLMSIYPWSNIDPDTSPFVSVFTMIGIPAAAGIINFVVLTAAMSSCNSGIFSTSRMLYTLSAEGKAPKKMHHLSSNGVPATALITSTACLLIGVFLNYILPEQVFILVTSIATICFIWVWGIILVAHLRFRHKHPEISAKSKFKMPLSPFMNWVSLIFFAGLLIILGFAADTRIALFVTPVWFLILAIAYQILKASNRKTKIRHN

SEQ ID NO: 53509 - protein, 395 aa, Rhodospirillum rubrum ATCC 11170
MALFCVECGSMALKVARRGLIPPFIVMDVMRAAAEREATGAEVMHLEVGQPSTGLPEQALDEVARRLHSGPMGYTVALGLDALREAIALHYQRTQGVAVDPGRIIVTTGSSAGFILAFLAAFEAGDRVGLAAPGYPAYRHILKALGCEPVILPTGPETRYQPTVAVLEEAGMDLDGLIVASPANPTGTVMPAADLKALVAYCGERGIRLISDEIYHGITYGEAALSTVGLAEHPVVVNSFSKYFCMTGWRLGWLVLPPDLLRPVECLTQNLFISPPALSQYAGLAALRHHGAFEENIRRYARNRQILLDALPAAGFGAFAPADGAFYLYGDVSGLTDDSLGFCARMLAETGVAATPGLDFDDARGAHFVRFSFSGATETIEKAARRLLEWKGGRG

SEQ ID NO: 53510 - protein, 409 aa, Rhodospirillum rubrum ATCC 11170
MVAGCADDRQIGVVGYIEGFSGVVAADEPQAVLAGRDILSAGGRAADAAVAMAFTLAVTLPSAAGLGGGGLCVVYDAKANKAETLDFLPGPASGGMAAYGAPGGAFGGGRAVAVPALGRGMFALNAKYGTLRWEGLLAAPENLARFGFPVSRAFGQRLADLPRGPGVDRRLSARFAGVSEGGRYSDVDLAGLIGRLRQRGPGEMHDGQLAREIAQAAQAEGIGLTVEDLRRQLPRWLPTTTAERGNEIVHTATTPGAAGGSGGAAPGATGFVVADSYGNAVSCALTLGRPFGSGRIMPNQGFVLADASAVAGGGEALATLLMINPNVHEFHLAIAGAGAGAAALQSAVARPLLENEGDAQAAIAGAISAVASGARVNVASCPQGIPPKPASCRAATDPRGAGYALRAGS

SEQ ID NO: 53511 - protein, 282 aa, Listeria innocua Clip11262
MNISVYVASAFSKNNNGGNKAGVVLNEPTLTTQQKMAIAKQLGYAETAFVTDSKIADYKLEYFTPKEEVDLCGHATIGSFAILMHLNKLHKNQYTIETNSGVLTITLKDGTIFMEQNRPNFYDIIPPNELTECFDLNKVNTHYQVQIVSTGLKDILIPIKSEIDLHALEPNFEKIREVSATYDVVGMHLYTFNNDRIICRNFAPLYDINEEAATGTSNAALACYLYKNHYLRKENYLFEQGYSLDSPSEVLVNLALSNNDEIEKVFVGGKGYYCEKKNLTIE

SEQ ID NO: 53512 - protein, 566 aa, Mycobacterium avium 104
MTLPDSSTEAASPTFADLQIHPSVLRAIADVGYETPTGIQAATIPALMAGSDVVGLAQTGTGKTAAFAIPILSKIDVASTATQALVLAPTRELALQVAEAFSRYGAHLPKINVLPIYGGSSYAVQLAGLKRGAHVVVGTPGRVIDHLERGTLDLSHVDYLVLDEADEMLTMGFAEEVDRILSETPEYKQVALFSATMPPAIRKLTAKYLHDPLEVSTKAKTTTAENISQRYIQVAGPRKMDALTRVLEVEPFEAMIVFVRTKQATEEVAERLRARGFSAAAINGDIPQGQRERTVAALKDGGIDILVATDVAARGLDVERISHVLNYDIPHDTESYVHRIGRTGRAGRSGTALLFVSPRERHLLKAIEKATRQPLTEAELPTVEDVNAQRVAKFADSITAALGAPGIDLFRKLVQDYEREHDVPMADIAAALAVQSRDGEEFLMAPEPPRERRERHTERRERTEKPRSTRPLATYRIAVGKRHKIGPGAIVGAIANEGGLHRSDFGHIAIGPDFSLVELPAKLPKSTLKRLEQTRISGVLINLQPDRAAAKARGRDGGKPRRKYGG

SEQ ID NO: 53513 - protein, 315 aa, Arabidopsis thaliana
MRIDLSVPKVGAELELNKVLGKGSSGSVSLIKYKSRLDGQTLYAAVKTSNIIHADSLLKEFQILSEFKGCSRIVQCYGTKVQETINEEGDVEFTIPMEYASGGSLRHFMSRFKDMKLPDALIRRFTRMILEGLAVIHGHGYVHCDLKPENILVFPSFELKISDFGLSKREGDSKWWLPSHPFAGTPVYMSPESISNGETRRGLDLWSLGCVVLEMYTGKRPWWDKNYDLGDLKKGSMPLISKDIPCDAKLFVMTCFASETNKRKNAFTLLRHCFLRGDVNKIIEPLVKSKNSNDIALELENIEHRLSQLRCISGG

SEQ ID NO: 53514 - protein, 567 aa, Oryza sativa
  misc_feature (484)..(484): Xaa can be any naturally occurring amino acid
MNELCDLKVHINGHHTLLLHQSVMCAFSGRLRTMVTQEKKKRKTSRAESLSVKLADFPGGGEGFELVARFCYNNGRVPLCPSNLPLLHCAAVFLEMTEEVCTCNLLTQAEAFVDGLYYWTWADVLAAVKSCEPFAAAADASGLLERLISALFSKITANPETPVAAGAVGTPNRSSSSCSSSPDTLGFGRSSSTKTPESMKPCFAREWWFDDMTSLCPQTIEKAMRVLGCYGIENKNLILTRFLLHYLRAATRRPALCREGGGGLAGLADTAVHGVALVGGTAFSCRGLFWVLRIVSAVGLSKECRHKLERLMGLMLDQATLDDLLVSGDDGGVYDVNLVMRLVRVFVGSEEEADLPSQRMRKVGRLVDKYLGEISPDHGLRVSKFLAVAESLPDSARECYDGVYRALDIYLESHPTLTIEERTTLCRCLNYEKLTLEACKDLAKNRRIPPGIAVQALASQQSKLQIRPAAAAAKGTGGCRPDPXSQTPRKIIVSGSRARSVDLDAMDEKELLKLNLQKMQNRVVELERACKEMRGQMSKMAKGGRPSSSFGAAACHQTGGRGLPRLC

SEQ ID NO: 53515 - protein, 406 aa, Escherichia coli
  misc_feature (364)..(364): Xaa can be any naturally occurring amino acid
MIFSVDKVRADFPVLSREVNGLPLAYLDSAASAQKPSQVIDAEAEFYRHGYAAVHRGIHTLSAQATEKMENVRKRASLFINARSAEELVFVRGTTEGINLVANSWGNSNVRAGDNIIISQMEHHANIVPWQMLCARVGAELRVIPLNPDGTLQLETLPTLFDEKTRLLAITHVSNVLGTENPLAEMITLAHQHGAKVLVDGAQAVMHHPVDVQALDCDFYVFSGHKLYGPTGIGILYVKEALLQEMPPWEGGGSMIATVSLSEGTTWTKAPWRFEAGTPNTGGIIGLGAALEYVSALGLNNIAEYEQNLMHYALSQLESVPDLTLYGPQNRLGVIAFNLGKHHAYDVGSFLDNYGIAVRTGHHXAMPLMAYYNVPAMCRASLAMYNTHEEVDRLVTGLQRIHRLLG

SEQ ID NO: 53516 - protein, 403 aa, Debaryomyces hansenii CBS767
MMALQWFGKEDVAVGKVPIPAITNDTDVIAKVTGTTICGSDLHLYHGEIMELKKGDVLGHEWCGIIEDVGPSVQNFKKGDRVVSSFQIACGECFYCRDNLSSMCDKTSTSRVQELMYGTAVSGIYGYSHFTGGYAGGQAEYVRAPRADYNLLKIPDKVPDEKALYLSDIVPTSYHSVVCADVKKGDTVAIWGLGPIGLCALRWAQLRGAKRVVGIDNVESRLAKAQSMGCKVLNFKDIDVVKEILNIVPGGVDSSIDAAGFRYANKLTHNIQRTLGLETDTSEVINEAIKATRKFGTIALVADYAGFANQFLIGGLMEKGITLRGCGQAPVQKYWHELLEKVEAGLFDPTFILTHRFPIEEFKELYQAFDKKKGGIGKVFVQTRFSSPPSEGTPSLSHVNELL

SEQ ID NO: 53517 - protein, 177 aa, Glycine max
MGNDEGNDKKKRVVFVTVGTTCFDALVRAVDSNNVKQALFAKGYTHLLIQMGRGSYLPTKSEGDGSLAVDYFTFSSSIADHLRSASLVISHAGSGSIFETLQLGKPLIVVVNEDLMDNHQSELAEELADRKHLYCASPQTLHQTIANMDLSSLFPYSPGDATPVAKHINNLLGFPDD

SEQ ID NO: 53518 - protein, 522 aa, Ceratopteris richardii
MGNCCGTDGFKHERPLPAHPNRQGEDKTGAPKVISHTKLSSCGEQSVNEKYHLGRELGRGEFGITYLCTDRETDEVLACKSISKGKLRTPIDIEDVRREVDIMRHLPKHPNIVTLEGVYEDENAVHLVMELCEGGELFDRIVARGHYSERAAAAVMRTILEVVQVCHRHGVMHRDLKPENFLFANKKENSPLKAIDFGLSIFFKPGEKFTEIVGSPYYMAPEVLKRSYGPEVDIWSAGVILYILLCGSPPFWAETEQLVAQAILRGNVDFNRDPWPNVSENAKALVRQMLEPDPSKRLTAQQVLDHSWLVNARKAPDVPLGDAVCARLKQFSAMNKLKKRALRVIAELLTGEEVEGIRAMFNMMDVERTGSLTFGQLKAGLYKLGSQLPESEIQQLMEAADVNGNGTLDYGEFVAITVHLQRMDNDECLRKAFNFFDLNGDGFIDRSELHEMLEADLGEVGTDIIDDIIQEVDIDKDGRISYDEFASMMRTGTDWRKVSRNFSRERYASLSIKLMQEGSLKL

SEQ ID NO: 53519 - protein, 389 aa, Solanum lycopersicum
MASTKQYFSAAGKPIRCKAAVARKAGEPLVIEEVIVAPPKAHEVRVKIICTSLCHTDITLWKLKEFPGCFPRILGHEAFGVVESVGEDVDELKEGDSVVPIFLPDCMDCVDCKSKKSNLCSKFPIQVSPLLHRNDTSRFSNAAGETLHHFLYISSFSEYTVVDVVNVTKIDPEIPPNRACLLSCGVSTGVGAAWKTANVEPGSTVVIFGLGSIGLAVAEGARLCGATRIIGVDINSNKFEIGKQFGITEFVNSKSCVDKPISQVIIEMTDGGADYCFECVGLATLVQEAFTCCRKGWGKTVVLGVDKPDAHLNLNSFEVLQSQKTLTGALFGGLKPKSDVPILVKRYLDKELQLNKFVTHEVNFEDINKAFDLLIQGKSLRCVIWMDKL

SEQ ID NO: 53520 - protein, 321 aa, Rhodococcus sp. X309
AAAGGKIDATADANKLALDVIGLAGFGYDFASFDGDEHPFVGAMSRVLEHVNRTSNDIPFLRKLRGNGADLQYEKDIAFVRTVVDDVITERQAKPGEHQDDLLDLMLNNIDDETGEKLDPVNIRNQVLTFLVAGNETTAGAIAFALYFLSRHPEIADAARAEVADITGGETPAFEDVARMRYLRRVVDETLRLWPSAPGYFRKVRTDTTLGGRYAMPKGSWVFVLLPQLHRDPVWGENPDSFDPDRFKPENVKKRPAHAYRPFGTGPRSCIGRQFALHEAVLSLATILQRYSFQSDPEYKLDVREALTLKPVGLELSLQRL

SEQ ID NO: 53521 - protein, 826 aa, Kluyveromyces lactis NRRL Y-1140
MSSNGKQQGNKAGDAAGGASGATAPGAGGSSGNGNSSAAGNASANANAGGSGASGNAPAASKPGFSASDLNRIVLEYLNKKGYHRTEQMLRAESSRTLTPPNKNAAASNTIPASSASATAITGSTTTAKPVSNPSMPLKRDNNGQLIKPQQVTPLHYFRAYSMLKNWIDSSLELYKPELSRIIYPIFIYVFLQLVIKDPLQARRFFDKYSVDYKALHGSEINRLFSVNSVDHIKENELAQGFQTNKYKITISRTTLNLLLYFLNENESVGGSLLISIINQNLDPNIVDVVKSEDILTDGIKDISTGDIDVDTYNSVPVKLGPYPKDEEFTKEVEIELQKKDEQEAAENKDKPVGKTLVEEYREMNGNQNKPEGTEKADDNTVKEENENKEPEAEEGGEEVDATADTEEKGTPTLSVESSAAERKKRDSKNKDEEEKPEASIGSMMESPAKDSLPLPVKTTLDLKMEIQKVRESRDSIQLKNLQTSAPSVCMYTFHNTNGNMTCVEFSDDARLTAAGFQDSTIKVWYLDGSPLQSILPSKAKDQSNSATLVGHSGPVYSVAFSPDNRYLLSASEDKTVRLWSLDTFTCLVCYKGHNHPVWYVKFSPLGHYFITASHDQTARLWSCDHIYPLRIFSGHLNDVDCSTFHPNGCYVFTGSSDKTCRMWDIQTGDSVRLFLGHTSPVTALEVSPDGRWLTTGSEDGTIIVWDIGTGKRIKQMKGHGKNPIYSITFNKEGNCLVTGGADQSVRVWDIKRFTNEPGMEPEQQFNTYSGDMELSVNNDIKEFGRRRAVIPTQDLMASFHTKKTAIHKVKFTRTNLVLAGGAFIE

SEQ ID NO: 53522 - protein, 390 aa, Solanum lycopersicum
MASTVQSGISKTAGKPIRCRAAVARKAGEPLVIEEVIVAPPKAHEVRLKIICTSLCHTDITLWKLKEFPGCFPRILGHEAFGVVESVGEDVDHLKEGDSVVPIFLPDCMDCVDCKSKKSNLCSKFPIQSSLLLHRDDTSRFTNADGETLHHYLYISSFSEYTVVDVVNVTKIDPEIPPNRACLLSCGVSTGVGAAWKTANVEPGSTVVIFGLGSVGLAVAEGARLCGATRIIGVGRNSDKFEIGKQFGVTEFVNSKSCGDKPVSQVIIEMTNGGADYCNECVGLGRVVQEAFACCRKGWGKTIVLGVDKPDARLNLNSFEVLQSNKTLMGSFFGGLKPKSDVHTSLKRYLDKELELDKFVTHEVNLEDINKAFDLLIQLKTLRCVIWMEK

SEQ ID NO: 53523 - protein, 127 aa, Vitis vinifera
MKGDKLILRGLRFHGFHGVKPEERKLGQKFLVDVDAWMDLQAAGRSDCLSDTISYTDIYRIVKEIVEGPPQNLLESVAQLIASTSLTKHSRISAIRVKVGKPHVAVQGPVDYLGVEILRYRSVDAQI

SEQ ID NO: 53524 - protein, 555 aa, Kluyveromyces lactis NRRL Y-1140
MASKNTYSDFKLATELPAWNQLQSLYEQKGKKLNVKDEFAKDNSRYEKFAKTFVNYDGSKILFDFSKNLVDDEILKSLIQLAKEAKVTSLRDAMFNGEPINFTEGRAVYHVALRNRSLKPMYVDGTNVTPEVDAVLQHMKEFTEEVRSGAWKGYTGKSITDVVNIGIGGSDLGPVMVTEALKHYATNLKVHFVSNIDGTHIAETLKDLDHETTLFLIASKTFTTAETITNATSAKNWFLSKNGGDQSHISKHFAALSTNATEVEKFGIDTKNMFGFENWVGGRYSVWSAIGLSVALYIGFDNFEAFLKGAEAVDKHFVETPLEDNIPLLGGLLSVWYNNFFDAQTHLVAPFDQYLHRFPAYLQQLSMESNGKSVTRGNVFANYSTGSILFGEPATNAQHSFFQLIHQGTKLIPSDFILAAQSHNPIENNLHQKMLASNFFAQAEALMVGKDEEQVKSEGATGGLVPHKVFSGNRPTTSILAQKITPATLGALIAYYEHVTFTEGAIWNINSFDQWGVELGKVLAKVIGSELATDNKISSHDSSTNGLINQFKEWI

SEQ ID NO: 53525 - protein, 486 aa, Listeria innocua Clip11262
MKKETHGEIRRDLKTRHLSMIAIGGSIGTGLFLASGNAIHTAGPGGALVAYIAIGIMVYFLMTSLGEMATYMPVSGSFSTYASRFVDPAFGFALGWNYWFNWAITLAVDISTAAIIVQFWLPNTPAWLWSAIFLLLIFGLNALSVKAYGESEYWFSIIKVATVIIFLIVGVLTIVGILGGEVIGFSNFTAGDAPFKGGFFAILGTFLIAGFSFQGTEMVGIAAGESATPEKSVPKAIKQVFWRILLFYIFAIFIIGMIIPYTNPNLLSAEATDVAISPFTLVFEKAGLAFAASVMNAVILTSVLSAGNSGLYASTRMLWAMARDKKAPKFLGKVNRRGIPMAALIVTTIVGAMTFITTLTENGTVIYTWLLSASGLTGFIAWVGIAISHYRFRKAFIKQGHDLNELKYKAKFFPFGPILALILCILVIVGQDYAAFLKPEFTNPAWWQKIGISYIGLPIFLIFWLSFKFTNKTKVIPLEDCKFDQK

SEQ ID NO: 53526 - protein, 252 aa, Nitrosomonas europaea
MASIHIETTGNGPDLVMLHGWAMHSGVWDGVVESLSQRFRLHQVDLPGHGASRDCALDSLDQMTEVIADRLPGRYSVCGWSLGGQVAIRLALQAPERVQQLVLVASTPCFVRRADWPWGMEDSTLTLFMENLARDYTQTLNRFLTLQVSGSEDQARVLAWLRKSILRGQPPTPATLQAGLKILQTSDLRAELNQVSQPVLLIHGRNDVITPAGAADWMQQHLPRARLVLFPHCGHAPFLSFPEQFVSCFDAL

SEQ ID NO: 53527 - protein, 756 aa, Arabidopsis thaliana
MVKQHSVRLKHCVFTVKSSVPVYSEGVNDGIKLHSFGNLVKKKVFLDTSKRFYFQGRWSESSGRRVETYAGVDVASAVDVINDLGFDTLTFLMVTVIIVPAFRILKASPILGFFFAGVVLNQFGLIRNLTDVKVLSEWGILFLLFEMGLELSLARLKALAKFAFGMGLTQVLLCTAAFTAFELPPNGAIGTKILEFLFHSRPDLVNIRSIDEAVVIGAALSLSSSAFVLQLLAEKGELPTRFGSATLGILLLQDIAVVPLLVILPVLESQDIGGESIWPMLAKESAKALGGLGILSLGGKFFLRRIFEVVAETRSSEAFVALCLLTVAGTSLVTQWLGFSDTLGAFLAGALLAETNFRTQIEADIRPFRGLLLGLFFVTTGTSIDMEVLFREWPNVLSLLGGLIVIKTLIITAIGPRVGLTIQESVRVGFLLSQGGEFAFVVFSLANRLGVLPNELNKLLIIVVVLSMALTPYLNQLGRKAADFLDERLDPGEKIGEDVNFDVSESIVIIGFGQMGQVLANFLSTPLVSDSDLVGWPYIGFDLNPAVVKESRKLGFPILYGDGSRPSVLQSAGVSSPKAIMIMYKGKKRTTEAVQRLRLAFPGSPIYARAQDLPHLLELKKAGATDAILENAETSLQLGSKLLTGFGVMSDDVSFLSKVFRDSMEIQAQEEITASETNAGLKPMQMKASDINVVSAATQKQVQLMKPMQMKASDSNSDSAAEILQETAGLSQPPEIDDSSVNIDNGFVGKADKAQD

SEQ ID NO: 53528 - protein, 350 aa, Mycobacterium avium 104
MGLPNVGKSTLFNALTRNNVVAANYPFATIEPNEGVVPLPDPRLDKLAEMFKSERIVAAPVTFVDIAGLVKGASEGAGLGNKFLAHIRECDAICQVVRVFADDDVTHVAGQVDPRSDIEVVETELILADLQTLERAAGRLEKEARTSKERRPVYEAALAAQETLNGGKTLFSAGTDTSLLRELNLLTTKPFLYVFNADESVLTDPARIAELRELVAPADAVFLDAAIESELIELDDESAAELLESIGQTERGLDALARAGFHTLRLQTFLTAGPKEARAWVIHQGDTAPKAAGVIHSDFEKGFIKAEIVSYDDLIAAGSMAAAKAAGKVRMEGKDYVMADGDVVEFRFNV

SEQ ID NO: 53529 - protein, 365 aa, Desulfotalea psychrophila LSv54
MGFRCGIVGLPNVGKSTIFNALTAAGIDAENYPFCTIEPNVGIVPVLDSRLDVLSEIAKTKKTIHTQMEFVDIAGLVKGASQGEGLGNKFLGHIRQVEAIVHVVRCFEDDNIVHVDGSVDPVRDREVITMELVLSDLDTVEKRLKRTQSQAKSGDKAFKAQAVCLERLYDILDGGKVARVYEAQSELEEKLLAEMCLLTTKPVLYVANVSEDDVLEGNEHVRALQAAVAEEDASVVMIAGSIEQELSQLDAEEQAEFLNDMGMETSGLSRLVKAGYELLGLQTYFTVGVKETRAWTIPVGAKAPEAAGKIHTDFEHGFIRAEVIGYDDFVKCQGEAKAKEQGLMRVEGKEYVVADGDCMHFRFNV

SEQ ID NO: 53530 - protein, 472 aa, Mycobacterium avium 104
MPIATINPATGETVKTFTPASDAEVDAAIARAYERFLDYRHSTTFAQRAQWANATADLLEAEADEVAAMMTLEMGKTLKSAKAEALKCAKGFRYYAQNAEQLLADEPADAGKVGAARAYIRYQPLGVVLAVMPWNFPLWQAVRFAAPALMAGNVGILKHASNVPQSALYLADVITRGGFPEGCFQTLLVPSSAVERILRDPRVAAATLTGSEPAGQSVAAIAGDEIKPTVLELGGSDPFIVMPSADLDEAVKTAVTARVQNNGQSCIAAKRFIVHTDIYDTFVDKFVEQMKALKVGDPTDPATDVGPLATESGRDEIAKQVDDAVAAGATLRCGGKPLDGPGWFYPPTVVTDITKDMALYTEEVFGPVASMYRAADIDEAIEIANATTFGLGSNAWTNDAAEQQRFIDDIEAGQVFINGMTVSYPELGFGGVKRSGYGRELAGLGIRAFCNAKTVWIGSSKSGDAGGGSKVE

SEQ ID NO: 53531 - protein, 403 aa, Hordeum brevisubulatum
MKGGLTDQIKREISVMKLVKHPNIVQMYEVMATKTKIYFVLEHVKGGELFNKVQRGRLKEDAARKYFQQLICAVDFCHSRGVYHRDLKPENLLLDENSNLKVSDFGLSTISECRRLDGLLHTSCGTPAYVAPEVINRKGYDGAKADIWSCGVILFVLLAGYLPFQDKNLMNMYKKIGKAEFKCPSWFSSDIRRLLLRILDPNPSTRISIERIMEHPWFRKGLDAKLLRYNLQAKDAVPAADMTVTSDSPSSSNSAIEGKEQEAKKLSNLNAFDIISLSNGLDLSGMFEDNDKKRESKFTSTNSASTIVSKIEDIAKGMRLKLVKKDGGMLKMEGSKPGRKGVMSIDAEIFEVTPDFHLVELKKTNGDTLEYQRVLNQEMRPALKDIVWAWQGEPQPQPQQQPC

SEQ ID NO: 53532 - protein, 624 aa, Oryza sativa Japonica Group
MSGHLDRLARPCFEGSSSNDDKRDHKSDVENSEDDKRTRMGSLKKKAIDASTKIRHSLKKKKRRSGSRVLSVSIEDVRDLEELQAVEAFRQALILDELLPARHDDYHMMLRFLKARRFDIEKAKQMWTDMLKWRKEYGTDTIVEDFDYNELDAVLQYYPHGYHGVDKDGRPVYIERLGKVDPNKLMHVTTMDRYVRYHVKEFERSFLIKFPACSLAAKRHIDSSTTILDVQGVGLKNFSKTARELIVRLQKIDNDNYPETLYQMFIVNAGPGFRLLWNTVKSFLDPKTTSKIHVLGNKYQSKLLEVIDASELPEFLGGACTCPEYGGCLKAEKGPWKDQNILNIVLSGEAQCARQIVTVSNGEEKIISYAKSKHHTIRGSDTSTAESGSEAEDVTSPKVLRSYISHPKLTPVREEVKMVRATSFSTRMPEYDVPVVDKAVDATWKREVTRKTAFSSKDSSLTSTESSSNGSLDRIVAVLLAVFMAIITLVRSVKDLAAKRLPDKNESEQKYSTLYPDSMPKEEFRPPSPTPGFVEAELFSSVLQRLGDLEEKFLMLQDKPSEMPCEKEELLNAAVRRVDALEAELIVTKKALHEALIRQEELLAYIDSKEVAKAQKKKKAMFCY

SEQ ID NO: 53533 - protein, 648 aa, Capsicum annuum
MFRSWGDDSQHIFGAASGVTDTADDENVTVSYPEGMPSYIAPLDVYKTARSMGPTAQVNLQYNLSWVFSVDPGFSYLVRLHFCEITRNISKVNQRVFVIFMNNQTAEPAADVIAWAGSNGVPFHKDYVVSVPSGASQQDLWLALHPNVASKSNWYDAILNGIEIFKVSDTNGNLAGPNPVPVAEPDHIDPLPSKKGQSKNNTSAIGGGIGGGIAAAILIGLIVCLVTRLRKRGKVQSPSDGPSGWLPLSLYGNSHTSGSAKTNTTGSYASSLPSNLCRHFSFAEIKAATNNFDEALLLGVGGFGKVYQGEIDGGTKVAIKRGNPLSEQGVHEFQTEIEMLSKLRHRHLVSLIGYCEENCEMILVYDYMAHGTLREHLYKTQKPPLPWKQRLEICIGAARGLHYLHTGAKHTIIHRDVKTTNILLDEKWVAKVSDFGLSKTGPTLDHTHVSTVVKGSFGYLDPEYFRRQQLTDKSDVYSFGVVLFEILCARPALNPTLPKEQVSLAEWAFHCYKKGTFDQIIDPYLNGKLAPECLKKFTETAVKCVSDVGADRPSMGDVLWNLEFALQLQESVEECCKGFGKMDIEEGFDVTCKGKKDLNAFPGYDESMTDSRSSGISMSIGGHSLASENSDGLTPSAVFSQIMNPKGR

SEQ ID NO: 53534 - protein, 457 aa, Panicum miliaceum
MASAAFALTSPAAPAIAARSKVLGWGKNQGRNGCRVGITRKNFGRVLMALAVDVSRFEGVPMAPPDPILGVSEAFKADKNDLKLNLGVGAYRTEELQPYVLNVVKKAENLMLEKGENKEYLPIEGLAAFNKATAELLLGADNPVIKQGLVATLQSLSGTGSLRLAAAFIQRYFPEAKVLISSPTWGNHKNIFNDARVPWSEYRYYDPKTVGLDFEGMIADIEAAPEGSFVLLHGCAHNPTGIDPTPEQWEKIADVIQEKKHMPFFDVAYQGFASGSLDEDAFSVRLFVKRGMEVFVAQSYSKNLGLYAERIGAINVVCSAPEVADRVKSQLKRLARPMYSNPPIHGARIVANIVGDPTMFGEWKQEMEQMAGRIKNVRQKLYDSLSAKDKSGKDWSFILRQIGMFSYTGLNKAQSDNMTDKWHVYMTKDGRISLAGLSLAKCDYLADAIIDSFHNVS

SEQ ID NO: 53535 - protein, 216 aa, Picea sitchensis
MMSTGLTLPSTPFATTDQQHNFNNNNALHRLPTHLFPFKTHAVIANRRRGRRLSICSAIQESNKVVDKPSSSSSNGGGESAEEVTKRFGLEAGLWKIFTSKDDDTGENAKGKKKNQAKELLTRYGGAYLATSISLSLVSFSVCYLLINAGVDVQSLLDKVGIHTDETGEKVGTFALAYAAHKAASPIRFPPTVALTPIVAGWFGKNNKEEEGESKQ

SEQ ID NO: 53536 - protein, 78 aa, Oceanicola granulosus HTCC2516
MSDVADRVRKIVVEHLGVEEDKVTENASFIDDLGADSLDTVELVMAFEEEFGIEIPDDAAETIQTFGDAVKFIKEAQQ

SEQ ID NO: 53537 - protein, 248 aa, Acidobacteria bacterium Ellin345
MTVRSPEELEGLKRVGKLVAEAIQHMTEAAKPGVTTRELDEVGANFLREHGARSGPQIVYKFPGFNCISVNDQIVHGVPNKRMLRPGDAVKLDVTAELDGFYADSATTVVLDGEGGDEGRKMLECARSAFQQAMKVAKADTRVNEIGRAIEREVRRHGFSVVKDLTGHGVGRSIHEPPSVPNFYHPLNSDILREGMVIAVEPIISAKPARTVTGEDGWTISTHNKALAAHYEHTIVITTGDPIIVTAA

SEQ ID NO: 53538 - protein, 369 aa, Microcystis aeruginosa PCC 7806
MSAKNKFLLLLLIFVPITLAAEWLKLSPVLVFVLSAVAIVPLAAFIAEATEVIAAIIGPTLGGLLNATFGNLTEMVVSVVALRAGLVEVVKASILGAIIANLLLGLGLAMLLGGLRFQQQNFAPEIARLNASSLLLSVLVLLTPSAIHFTSDGLPKAAIQNFSYAAAILLLIFYGLSLIFSLKSQQDVKRLNGLEARENQPQPVSGRNALATRDRRLAKFGKPVTILLICTVALVVISEILVGSLEETVKVLGWTELFTGIILLPLFGGVVEYITCVTTALKNKMDLTVAVSIGSTLQVVLFVAPILVLVSLFFPTPLSLEFNVFGMFAATAAVLITSSISSDGQSNWLEGVLLLILYAVLGTAFYLHP

SEQ ID NO: 53539 - protein, 281 aa, Campylobacter jejuni subsp. jejuni NCTC 11168
MNLKELFIHHLEKNLPKVESFHPFFNEALALMLKAGGKHFRAQLLLSVVQSNKPELLNQALDVALALEFIHTYSLIHDDLPAMDNADFRRGIPTLHKSYDETTAILVGDALNTEAFLVLSHAHLKDEIKIKLIKTLAFNAGLNGMVIGQAIDCFFEDKRLSLNELEFLHTHKTARLIAAALKMGCEICELNNEESNQIYKLGLKLGLIFQINDDIIDVTTSQEQSGKPTNNDIHKNSFVNLLGLEQAIKTKENLLSECEQDLEKLNEKLAQMIQNLIIQYL

SEQ ID NO: 53540 - protein, 151 aa, Zea mays
ALRTNGGDEGGFAPNIPENQEGLELLKASIEKGGYPGKGGIGMDGGASEFFREKDPTHDPNLKGENNDGSNKNSCDSLKDLFQSFGSEYPIESNEDPFDQEDWSTHAKLTDEIGQKVPNGGDELLVTHPTKGGKGINEKTCHALLLKGNPI

SEQ ID NO: 53541 - protein, 231 aa, Desulfotalea psychrophila LSv54
MKRYIIANWKCQKREVEALQWLDGFLRAYRPVQGREVILAPSFLCLSSFAKRIADSGLPGLSLAAQDVSPYPRGSYTGALSADLIGDYARVAIVGHSERRKYFHETNHEVTNKVAELADADMTPLVCLDDSNMDGQLAALQDSECAEMILAYCPAYALNSNVAEPLDSVARAVAQIRKYQAKYPIVYGGAVRLENAAGYWNLDGLSGIFIGGASLELESFMAILDQCHSPS

SEQ ID NO: 53542 - protein, 564 aa, Herminiimonas arsenicoxydans
MYRYDQYDHQIVKERIAQYRDQVRRRLSDELAEDEFRILRLQNGLYMQRHAYMLRVAVPYGLLSSAQMRMFGHIARKYDRGYGHFTTRQNIQFNWINLEETPDILTELASVEMHAIQTSGNCIRNTTSDELAGVAADEIVDPRPYAEIIREWSTFHPEFAYLPRKFKIGINGAVEDRVATAIHDIGLHVIKNEQGEIGFRVLVGGGMGRTPIIGSVICEFLPWQHIMTYLEAILRVYNQYGRRDNIYKARIKILVKAIGIDEYRRQVEQEWLDIKDGPGTLTAEELSRVAAFFTMPAYAALPATDAEFEKNKTENKAFKNWLSRNVKQHKVPGYAAVVLSLKKTGVPPGDATAEQLDFMAELADRYSFGELRVTHEQNVVLADVRIADLYAVWEAAKSHGLATPNIGLLTDMICCPGGDFCSLANAKSLPIAAAIAERFDNLDFQHDIGDIELNISGCINACGHHHVGNIGILGVDKDGAEWYQVSIGGAQGNESSIGKIIGPSFSAYQMPTVIERLLQVYVRDRIEDERFIDTARRIGIAPFKEHVYATPIKVVQATGEDAYA

SEQ ID NO: 53543 - protein, 228 aa, Desulfotalea psychrophila LSv54
MQSIKIAPSILSADFTRLGEEIEAVDRAGAEVIHIDVMDGHFVPNITIGPLVVEAARRVTDKVLDVHLMISDADRYVDSFVKAGADWVTVHVETCTHLHRTVSRIKELGAKAGAVLNPATSLASLDFILEDLDLVMLMSVNPGFGGQSFIPSTLEKSWQLHQRIQSLGLEIGIEIDGGINAATIADATEAGANIFVAGSAVYGSSDYSETIAELKKLAAVGLTKRREK

SEQ ID NO: 53544 - protein, 87 aa, Glycine max
MDSFSSPSMSSSGSSPNPEALMEQIKAQLAQAYAQELLETVGNKCFAKCVTKPGSSMSGSESSCVSRCVDRYIEATGIVGRALFSHR

SEQ ID NO: 53545 - protein, 549 aa, Desulfotalea psychrophila LSv54
MALPSEGKNSFWGERMFASYKSIQETCAFEKLSELAQSPYDLTQPGALQADNRLQRYQVAGQAFKLFYATEQVDDRVLAGLQAVADECQLVSQYRAMRTGAVMNKIDGFVSENRRVLHTATRDLFSGEPAEASMNSRAKRELEKLSHFLDALDAGEIVNEAGEAFTTIVQVGIGGSDLGPRAVYEALKSYTIVGRRAAFISNVDPDDVSMALADLDLGKTIFNIVSKSGSTLETVTNEAFVRRALLENGYDSARHCISITGEGSPMDDPDSYLASFYLYDCIGGRYSTTSMVGCVLLGFTLGFEQVMAFLRGAANMDNSADEVDILKNIPLLMALIGIWNRNFLDLSSLAIIPYSQALYRFPAHLQQCDMESNGKSVDRQGRAVQGKTGPIIWGETGSNSQHAFFQHIYQGTSPVPIEFIGFSESQRGKDIEVQGCTSQQKLLANLFAQMVALACGKKDQNLNKFFAGNRPSCLLFAKKLTPYVMGSLLACYEAKIVFQGFAWNINSFDQEGVQLGKELAKRFLREIGGEEEGFHGIESAFLNEVQRGV

SEQ ID NO: 53546 - protein, 284 aa, Echinacea angustifolia
PKSQITPYRVVIIIRLVILGLFFHYRITNPVGSSYGLWLTSVICEIWFAISWVLDQFPKWYPINRITFTDELSARFEKEGEPSQLAAVDFFVSTVDPLKEPPLITANTVLSILAVDYPVEKASCYVSDDGAAMLSFESLVETAEFARKWVPFCKKFSIEPRAPEFYFSQKIDYLKDKVQPSFVKERRAMKRDYEEYKVRVNALVAKAQKTLEEGWTMQDGTPWPGNNTRDHPGMIQVFLGNSGAHDIEGNELPRLVYVSREKRPGYQHHKKAGAENALVRVSAV

SEQ ID NO: 53547 - protein, 474 aa, Oryza sativa
MGRGCGRWWWVAVALVVVAAAAAAEGAREEAAVAVAVAPRRHAYAAMMYMGTPRDYEFYVATRVMMRSLGRLGSDADRVVIASLDVPPRWVQALKDDGVKVVSVENLKNPYEKQGNFNMRFKLTLNKLYAWSLVSYDRVVMLDSDNIFLQNTDELFQCGQFCAVFINPCIFHTGLFVLQPSMDVFKNMLHELAVGRDNPDGADQGFLASYFPDLLDRPMFHPPVNGTKLEGTYRLPLGYQMDASYYYLKLRWSIPCGPNSVITFPSAPWFKPWYWWSWPVLPLGLSWHEQRRENLGYSSELPVVLIQALFYIGVIAVTRLARPSLSKMCYNRRMEKSTIVLLTTLRVVAAWSILAAYTIPFFLIPRTVHPLLGWPLYLLGAFSFSSIVINVFLLHPLAVLTTWLGIIGALFVMAFPWYLNGVVRALAVFAYAFCCAPLIWGSLVKTMSSLQILIERDAFRLGEPNQTAEFTKLY

SEQ ID NO: 53548 - protein, 284 aa, Echinacea angustifolia
PKSQITPYRVVIIIRLVILGLFFHYRITNPVESSYGLWLTSVICEIWFAISWVLDQFPKWYPINRITFTDELSARFEKEGEPSQLAAVDFFVSTVDPLKEPPLITANTVLSILAVDYPVDKVSCYVSDDGAAMLSFESLVETAEFARRWVPFCKKFPIEPRAPEFYFSQKIDYLKDKVQPSFVKERRAMKRDYEEYKVRVNALVAKALKTPEEGWTMQDGTPWPGNNTRDHPGMIQVFLGSSGAVDIEGNELPRLVYVSREKRPGYQHHKKAGAENALVRVSAV

SEQ ID NO: 53549 - protein, 277 aa, Roseovarius nubinhibens ISM
MTGTIAFQGELGAYSHQACRDTYPDMTPLPCRTFEDAIEAVRSGEAELAMLPVENSTFGRVADIHHLLPESGLHIINEAFVRVRIALMALPGVPLSEVREAMSHTMLLGQCRNFLAKHNIRRVTGADTAGSARQVAEDALPHRAALASELAGEIYGLEVLARDIEDEGNNTTRFVVMSRDPDHSERGDHGMITSFVFQVRNIPAALYKAMGGFATNGINMTKLESYMVGDTFTATQFYADIEGHPEDAAVARALDELDYFTTEVKILGVYPADPRRG

SEQ ID NO: 53550 - protein, 203 aa, Zea mays
MARQQSVHALCVLAALLFAASLPSPAAAGVHLSSLPKALDVTTSAKPGQVLHAGVDSLTVTWSLNATEPAGADAGYKGVKVKLCYAPASQKDRGWRKSEDDISKDKACQFKVTEQAYAAAAPGSFQYAVARDVPSGSYYLRAFATDASGAEVAYGQTAPTAAFDVAGITGIHASLKIAAGVFSAFSVVALAFFFVIETRKKNK

SEQ ID NO: 53551 - protein, 505 aa, Yarrowia lipolytica CLIB122
MIRADRHTYKVFNQEFTIDKRFQVTKELGHGAYGIVCAAKYTGTPDGPGVAIKKVTNIFSKNILCKRALRELKLLNHFRGHKNITCLYDMDIVDTNNFNELYLYEELMECDMHQIIRSGQPLTDAHYQSFVYQILAGVKYIHSADVLHRDLKPGNLLVNADCELKICDFGLARGFSSDDEKNAGFLTEYVATRWYRAPEIMLSFQSYTKAIDIWSVGCILAELLGGKPLFKGKNYVDQLNQILHYLGTPSEETLKRIGSPRAQEYVRGLPFMPKIPFSTLFPTANPEALDLLEKMLAFDPAERVTVEEALEHPYLKIWHDPRDEPVCPTPFDFSFEEVNDMEAMKQMILDEVVDFRAMVRKPVDEQTRIRDEQIEEQRREEEKQEVERQQKEAERQKQHQQEAERQQHQQQQHHPQQQDSPSTLSGFSDSDQSANPHFYEYAGFGVGSQTSDMGQPPVIQRKDSLGIPEEDFKYQDPPPKPQESGRQGDGDLELELEYGLDGWRS

SEQ ID NO: 53552 - protein, 351 aa, Flavobacteria bacterium BBFL7
METQFKLEGDFTLMDHLSTKWQAPSNIALVKYWGKYGMQLPANPSISFTLNACRTITTVTASKGTHGFNISYDGEPKPEFAPKIEAYFKRIADYCPWIANYHFDIDTHNTFPHSSGIASSASSMAAMSVCMMDFESTLTGQEMDFHKASFLARLGSGSACRSLKGSAVVWGTHDEVDGSSQYFGIDKSDYLHPVFQDFQDTILLVDKGEKVVSSTVGHELMNGHAFAKARFEQAHENLSTLKIALQDGDLETFIKITESEALTLHAMMMTSHPYFILMKPKTLSIIEEIWAFRKETGIPVCFTLDAGANVHMLYPNENNEAVQGLINSKLAGYCQNGHYICDQVGTGAKKC

SEQ ID NO: 53553 - protein, 132 aa, Kluyveromyces lactis
  misc_feature (78)..(78): Xaa can be any naturally occurring amino acid
LEQIVGEASAFSGSSVKYIAGARPWVHVGKVDVALPCATQNEVSGAEAEHLVSNGVKFVAEGSNMGSTQEAIDVFEGXRLQTASTSAPAVWYAPGKASNMGGVAVSGLEMAQNSARVSWTRETVDAELKKIM

SEQ ID NO: 53554 - protein, 162 aa, Bordetella petrii
MNVPFRVGQGYDVHALVAGRPLIIGGVTIPHTHGLQGHSDADVLLHAVTDALLGAAGLGDIGRHFPDTDPAYRGADSRVLLRDAVAKVRAAGWAPVNIDATVHAQAPKIGPHAGAMVANIAADAGIDSASVNIKAKTNEGLGYLGRKEGIAATVVALLARAS

SEQ ID NO: 53555 - protein, 601 aa, Schizosaccharomyces pombe 972h-
MSGRRNETAIRELVQSVSGNNLCADCSTRGVQWASWNLGIFLCLRCATIHRKLGTHVSKVKSISLDEWSNDQIEKMKHWGNINANRYWNPNPLSHPLPTNALSDEHVMEKYIRDKYERKLFLDENHSTNSKPPSLPPRTKSSSQSSPMASTSTSKSRYADSLSTLHDMGFSDDSVNTHALEETNGDVTRAIEKIVQHGSSKPQKPSTLTSTKSTIKLVSARLKKRNKNLSVHFEDGTKPGDAYEVTGDTRAASPTLNPFEQMMAMTNQGMSVSPGVETTSSPFFTAPVEPNQPLQPLRPSMTGPVPSSMGSEATLNMPSTYGIDSNLYTNSNSSSIVQNPLQPARTGPAAINYNYTTNYSVSSPSVTNPFFDVGSSTQNASLMGSTGYPSSANNVYYENSYQGVGTSMSDNYQLPDMSKLSLNEQPAAPSNSNSQYMNTSMPTLDSTNMYGQSNQDPYSMSNGVYGSNYSAQPSTMQMQATGIAPPQPNMSMQMPMSMQSTGYQMPMENTWVDYNGMSQQGNGMQPATMNYSNSMGYDTNVPADNGYYQQGYGNVMMPPDASYTGTGSYVQPMNQPSGGMGAPADSSKADSYIQRIMQGKQ

SEQ ID NO: 53556 - protein, 252 aa, Campylobacter jejuni subsp. jejuni NCTC 11168
MIELKKPDEIEKLRIANQIVAKTLNFLENEIKIGMSLKQIDKMAEDYILSLGAKPSFKGLYGFPGAICTSLNQVCIHGIPDDKIIKEGDILGLDVGSLIDGYYGDAARTIAIGEVSPADKALISCAKDALYHAIDIIRDGMRFKELSAALGEFIHVRGFVPLRGYCGHGIGRKPHGEPEILNYLEKGASAKSGPKIKNGMVFCIEPMICQKDGTPKHYNGKWDAGSIDGLNAAHYEHCVAVINGRAEILSMI

SEQ ID NO: 53557 - protein, 182 aa, Physcomitrella patens subsp. patens
MASITAASTMVAPAAFTAASSAASTSESASVKAFSGLKSNTLFASKAQSLSSVQNGSRVQCMQVWNPIGMTKFETFSYLPPLSDDSIAKQVEYMIQQGLIPCLEFDVNADGVSRTNNSSPGYYDGRYWTMWKLPMFGCQDSSQVLREIEECKKTFPGCFVRILGFDNVKQVQICGFLVARPN

SEQ ID NO: 53558 - protein, 182 aa, Bordetella petrii
MKTVGDKLEPFKVTGVKPGFNQHEENGVSAFEDITESSFPGKWKVIYFYPKDFTFVCPTEIVGFNKLAKDFEDRDAVLLGGSVDNEFVKLAWRREHPDLNKLGHYQFGDTTGSLVDQLGVRDKNEGVALRATFIVDPDNTIQHVSVNNLNVGRNPEEVLRLLDGLQTDELCPCNRTVGGATL

SEQ ID NO: 53559 - protein, 454 aa, Physcomitrella patens subsp. patens
MENQRWPYFDPDYETTSSSFNPPRVTIENEAYENATVVQVHSANRHGILLNVVQVLTDLDLVITKSDMFSDGGWFLDVFHVVDDSGNKVRDQSVLDYIQKVCGGHSIPTQLEQSSADLLRRSSGLTTADHTVVELTGPDRPGLLSEISAVLTSMECNVNAAEVWTHNHRVACVIYFTNTNTGGPIESQSLLELIKEQLSRVLKGDHDEQHARCKIEYASEITHVERRLHQLMYEDRLHGEQDCDRNSQGRPKIQIKKSERGYSMVSIQCKDRPKLLFDIVCTLTDMQYVIHHALINSPGPETTQEFFIRHENGCVLDTAAEQHLKVCLEAAINRRTTEGLRLELCMNDRVGLLSDVTKIFRENGLSVARADVTTRDDKAVNVFYVVDASGCTVDMKVVEAMRKSIGHAILQVKGVPRQEPELSSSKLSLGGLFRTSERFIYGLTSMNWRSTAIA

SEQ ID NO: 53560 - protein, 233 aa, Listeria innocua Clip11262
MTKEKVLWGYDEKTGPEMWGHICSDFEIAHTGKAQSPVNIEQADVVKLKPSTMKFYYKETDYTIKRIEQSVHVFPHDKEQGLRFNGEYYPLVSFHAHIPAEHLLDGYVYPIEWHFVHEKPDGTTLVMSAWMEIDNTNNVEFKDLPTYFPEVFADFETEREITLDVNEFMPEERVFYTYQGSRTTPPTVEGVTWIVLKNAKTLGQEDFTEFEKAIGNTSRPVQDLNGREITFYN

SEQ ID NO: 53561 - protein, 142 aa, Physcomitrella patens subsp. patens
MGSNPPIGSEQWSSGLCDCFQDCGTCCCAWCCPCVVVGQLVEIIDQGITSCSSAGCLYCLLQSCTGMGCLYTCGYRARLRAKYGLSPEPCGDVCVDWCCLPCSLSQQYRELAARGVQADLGWAANRQAYEQSAPPAQKMAGY

SEQ ID NO: 53562 - protein, 420 aa, Vitis vinifera
MQHQRLKQQQQALMQQALLQQQSLYHPGLLAPPQIEPIPSGNLPPGFDSSTCRSVYVGNIHTQVSEPLLQEVFASTGPVEGCKLVRKEKSSYGFIHYFDRRSAALAILSLNGRHLFGQPIKVNWAYASGQREDTSGHFNIFVGDLSPEVTDATLFACFSVFPSCSDARVMWDQKTGRSRGFGFVSFRNQQVAQSAINDITGKWLGSRQIRCNWATKGAGSNDDKQSSDAKSVVELTNGSSEDGKETATNEAPDNNPQYTTVYVGNLAPEVTQLDLHRHFHTFGAGVIEEVRVQRDKGFGFVRYNTHAEAALAIQMGNTQSILCGKPIKCSWGSKPTPPGTSSNPLPPPAAAPLPGLSATDLLAYERQLAMSKMGHALMHPQGQHPLKQAAMGMGAAGASQAIYDGGFQNVAAAQQLMYYQ

SEQ ID NO: 53563 - protein, 483 aa, Pseudomonas putida
MTMHTRLAESNSSTESHSVIDIFNAQKKASSARRGKFSLAERIAALNILKEIIQRRESEIIAALAADFRKPASEVKLTEIFPVLQEISHAKRNLKTWMMPRRVKAALSVLGTKARLSFEPKGVCLIIAPWNYPFNLSFGPLVSALAAGNSVIIKPSELTPHTASLIGSIIREAFSVDLVTVVEGDAAVSQELLTLPFDHIFFTGSPRVGKLVMEAAAKTLASVTLELGGKSPTIIGPTANLKKAARNIVWGKFSNNGQTCIAPDHVFVHRSIAHDFHKIIMEEVTRVYGKDFEAQKKSPDYCRIVNDQHLNRLYELIGDAKSKGAKILQGGEIDALDRFVAPTIISKVTPEMDISREEIFGPLLPIIEYDDIDHVIKQINDNAKPLALYIFSEDKEFAQDIVGRTSSGSVGINLSVVQFLHPNLPFGGVNNSGIGSAHGFYGFQAFSHEKPILLDRFSITHLLFPPYTGKVKRLISMTVRYLS

SEQ ID NO: 53564 - protein, 262 aa, Candida albicans SC5314
MFTFTRNIPRSLLHCKPITKRTPLITTTIRNLFIQTSETPNEQALKFLPSIKILQDNQTKEFLSGREAASSPLALKLFSIDGIRSVMFGSDFITIEKSNNFDWSLLKPEIFSILTEYLTNGTPILLEDNVDEYGNSLLTNDMAINEDDDEVVSMIKELIFTRIRPAIQDDGGDIEFVNFNEEDGTVYLRLKGACRSCDSSSVTLKNGIESMLKHYIEEVNSVEPIEEEQQQEEINVESSTIKPINRDEPSSSVSSSSSPPSL

SEQ ID NO: 53565 - protein, 360 aa, Candida magnoliae
MSYAKKFKACVVGSGNWGTAVAKLVAENAREKTDLFEPKVNMWVFEEMLDGKKLTETINEKHENVKYLPDIKLPENLVANPDLRNVVEDADIVVINIPHQFLGNIIKQLDGIDFSKKYAVSCLKGLNVSPKGPELLSDVVQDKLGMHCGVLSGANIATEVAKEKWCETTVAFPVPKNFQKGDPDAALMRQLFERPYFHVQVSDDTAGVSIGGALKNVVALGAGLVEGAGWGDNAKAGIMRHGIIEMVKFGKTFYPTFKAETICYESAGVADLITTCSSGRNVRVAREAIRQGKSVEVIEKELLNGQSAQGVVTCKEVYELLSEQKMLDDYPLFKAIYDVLENGLAVEGLVESACSRIACK

SEQ ID NO: 53566 - protein, 208 aa, Azospirillum brasilense
MKLAEALLRALKDRGAQAMFGIPGDSACPSLGGGGNADPAAPHAEHEPPVGFAADAAARYSSTLGVAAVTYGSGAFNMVNAVAGAYAEKSPVVVISGAPGTTEGNPGLLLHHQDRTLDTQFQVFKEITVAQARLDDPAKAPAEIARVLGAARALSRPVYLEIPRNMVNAEVEPVGDDPAWPVDRDALAACADEVLAAMRSATSPVQMV

SEQ ID NO: 53567 - protein, 284 aa, Lactuca sativa
PKSQITPYRVVIIIRLVILGLFFHYRITNPVESSYGLWLTSVICEIWFAISWVLDQFPKWYPTNRITFTDELSARFKKEGEPSQLAAVDFFVSTVDPLKEPPLITANTVLSILAVDYPVEKVSCYVSDDGAAMLSFESLVETAEFARKWVPFCKKFSIEPRAPEFYFSQKIDYLKDKVQPSFVKGRRAMKRDYEEYKVRVNALVAKAQKTPEEGWTMQDGTPWPGNNTRDHPGMIQVFLGNSGAHDIEGNELPRLVYVPREKRLGYQHHKKAGAENALVRVSAV

SEQ ID NO: 53568 - protein, 284 aa, Lactuca sativa
PKSQITPYRVVIIIRLVILGLFFHYRITNPVESSYGLWLTSVICEIWFAISWVLDQFPKWYPINRITFTDELSARFEREGEPSQLAAVDFFVSTVDPLKEPPLITANTVLSILAVDYPVEKVSCYVSDDGAAMLSFESLVETAEFARKWVPFCKKFSIEPRAPEFYFSQKIDYLKDKVQPSFVKERRAMKRDYEEYKVRVNALVAKAQKTLEEGWTMQDGTPWPGNNTRDHPGMIQVFLGNSGAHDIEGNELPRLVYVSREKRPGYQHHKKAGAENALVRVSAV

SEQ ID NO: 53569 - protein, 282 aa, Brassica napus
  misc_feature (236)..(236): Xaa can be any naturally occurring amino acid
MSTENIQHSSLPTQRLLGKVALITGGATGIGESIARLFHKHGAKVCIVDVQDDLGDRVLKTLLANSEESACFIHGDVTQEDDISNAVDFAVKRFGTLDILINNAGVSEAPCPDIRNNSLTEFEMVFDVNVKGAFLGMKHAARVMIPAKKGSIVSLCSVGGVVGGVGPHAYVGSKHAVLGLTRSVAAELGQHGIRVNCVSPYAVLTNLALAHLPEDGRTEGVVAGFRSFAAANANLXGVELTVDDVANAVLFLASDESRYVSGDNLMVDGGFTCTNHSFKVFR

SEQ ID NO: 53570 - protein, 285 aa, Mycobacterium leprae TN
MPARTALSPGFLSPTLPVPAWIPRPEYVGKPTAQEGSESWVQTPEVVEKMRVAGRIAAGALTEAGKAVAPGVTTDELDRIVHEYMVNHGAYPSTLGYKGYPKSCCTSLNEVICHGIPDSTVIADGDIVNIDVTAYIDGVHGDTNATFLSGDVSESHRLLVERTREATMRAINAVKPGRALSIIGRVIESYANRFGYNVVRHFTGHGIGTTFHNGLVVLHYDQPFVTTIMQPGMTFTIEPMINLGTLDYEVWDDGWTVVTKDRKWTAQFEHTLLVTDTGVEILTVQ

SEQ ID NO: 53571 - protein, 284 aa, Jacobaea maritima
PKSQITPYRVVIIVRLVILGLFFHYRITNPVESSYGLWLTSVICEIWFAISWVLDQFPKWYPINRITFTDELSARFEKEGEPSQLAAVDFFVSTVDPLKEPPLITANTVLSILAVDYPVDKVSCYVSDDGAAMLSFESLVETAEFARKWVPFCKKFSIEPRAPEFYFSQKIDYLKDKVQPSFVKERRAMKRDYEEYKVRVNALVAKAQKTPEEGWTMQDGTPWPGNNTRDHPGMIQVFLGNSGAHDIEGNEPPRLVYVSREKRPGYQHHKKAGAENALVRVSAV

SEQ ID NO: 53572 - protein, 284 aa, Jacobaea maritima
PKSQITPYRVVTIVRLVILGLFFHYRITNPVESSYGLWLTSVICEIWFAISWVLDQFPKWYPINRITFTDELSARFEKEGEPSQLAAVDFFVSTVDPLKEPPLITANTVLSILAVDYPVDKVSCYVSDDGAAMLSFESLVETAEFARKWVPFCKKFSIEPRAPEFYFSQKIDYLKDKVQPSFVKERRAMKRDYEEYKVRVNALVAKAQKTPEEGWTMQDGTPWPGNNTRDHPGMIQVFLGNSGAHGIEGNELPRLVYVSREKRPGYQHHKKAGAENALVRVSAV

SEQ ID NO: 53573 - protein, 527 aa, Coprinopsis cinerea okayama7#130
MKSFDEDPLDRLIRPPPNETPEERADRERKEAEARRVSDEIDNDIRKERAALKKQQSTVRVLLLGQSESGKSTTLKNFRMRFAPEEWQAELVSWRAVIQLNLIRSVLSILDAIKAELDNEPNQPFLTGDEDDETEFLFSDSEPGHEPQSSSANSNTRPLLTGQHQLLKLRLAPLRRVEADLKKQLGASAEDELADGAASDEYGTLGRFGGDGGLAPAGGALSKKMTRSREFSVRRLKDALTRNTSGTGTRSPRSHSRSRPNSDGSGSDNDDVDEATDVIANCREDIKTLWSDPAVGEVLKKRDIRLEDSAGFFLDDVDRIATREYVPSDDDVVRARLRTMGVQEYKIKVYQPTPFLVGSGITDWSLYDVGGSRTCRHAWVPYFDNVTAIIFLAPVSCFDERLLEDSRINRLEDSFLLWRDVCSNKLLEKTSLILFMNKCDLLKRKLKMGVQVKDHLPSYGDRPNEAPSVVKYLKDKFRDIVRANTTDGGRVAYYYATSVTDIKTTYATLKTVKDIILRDHLKSADFV

SEQ ID NO: 53574 - protein, 284 aa, Jacobaea maritima
PKSQITPYRVVIIVRLVILGLFFHYRITNPVESSYGLWLTSVICEIWFAISWVLDQFPKWYPINRITFTDELSARFEKEGEPSQLAAVDFFVSTVDPLKEPPLITANTVLSILAVDYPVDKVTCYVSDDGAAMLSFESLVETAEFARKWVPFCKKFSIEPRAPEFYFSQKIDYLKDKVQPSFVKERRAMKRDYEEYKVRVNALVAKAQKTPEEGWTMQDGTPWPGNNTRDHPGMIQVFLGNSGAHDIEGNELPRLVYVSREKRPGYQHHKKAGAENALVRVSAV

SEQ ID NO: 53575 - protein, 398 aa, Yarrowia lipolytica CLIB122
MSALLRSSLRFKHMSAVNRLTQQLRLLTASAPLSAANTAGKAPFKVAVVGSGNWGTTVAKIVAENCTAHPELFEPEVRVWVREEKVNGKNLTDIFNAEHENVRYLPKIKLPHNLIAEPDLLKAVEGANIIVFNLPHQFLAGVCKQLKGHVNPKARAISCLKGLDVTPQGVYLLSDVIENETGLHCGVLSGANLATEIALEKYSETTVAYNRPKDFFGEGDVTNDVLKALFHRPYFHVRCVQDVAGVSIGGALKNVVALCAGFVEGKNWGDNAKAAIMRRGMLEMINFSKRFFPETDINTLTVESAGVADLITSCAGGRNFKVGRAFGKESGSGKTIQDVEKELLNGQSAQGVITCNEVHELLKNKNMQKDFPLFESTWGIIHGELKIDDLPEILYHAN

SEQ ID NO: 53576 - protein, 469 aa, Bacillus anthracis str. Ames
MNKGRVTQIMGPVVDVKFDGGKLPEIYNALTVKQSNENGTSINLTFEVALHLGDDTVRTVAMSSTDGLVRGTEVEDTGKAISVPVGDATLGRVFNVLGDAIDLDGEVPADVRRDPIHRQAPAFEELSTKVEILETGIKVVDLLAPYIKGGKIGLFGGAGVGKTVLIQELINNIAQEHGGISVFAGVGERTREGNDLYHEMSDSGVIKKTAMVFGQMNEPPGARQRVALTGLTMAEHFRDEQGQDVLLFIDNIFRFTQAGSEVSALLGRMPSAVGYQPTLATEMGQLQERITSTNKGSITSIQAVYVPADDYTDPAPATTFAHLDATTNLERRLTQMGIYPAVDPLASTSRALSPEIVGEEHYEVARQVQQTLQRYKELQDIIAILGMDELSEEDKLVVHRARRIQFFLSQNFHVAEQFTGQKGSYVPVKETVRGFKEILEGKYDDLPEDAFRLVGGIEEVIENAKKMMA

SEQ ID NO: 53577 - protein, 353 aa, Leptosphaeria maculans
MGCGMSTEEKEGKQRNEEIENQLKRDKMMQRNEIKMLLLGAGESGKSTILKQMKLIHEGGYSRDERESFKEIIFSNTVQSMRVILEAMESLELPLDDQRAEYHVQTIFMQPAQIEGDSLPPEVGNAISVLWKDAGVQQCFQRSREYQLNDSAKYYFDSIDRIAAPDYIPNDQDVLRSRVKTTGITETTFIIGDLTYRMFDVGGQRSERKKWIHCFENVTTILFLVAISEYDQLLFEDETVNRMQEALTLFDSICNSRWFVKTSIILFLNKIDRFKEKLPVSPMKNYFPDYEGGADYAAACDYILNRFVSLNQHETKQIYTHFTCATDTMQIRFVMAAVNDIIIQENLRLCGLI

SEQ ID NO: 53578 - protein, 144 aa, Triticum aestivum
  misc_feature (2)..(2): Xaa can be any naturally occurring amino acid
  misc_feature (17)..(17): Xaa can be any naturally occurring amino acid
  misc_feature (22)..(22): Xaa can be any naturally occurring amino acid
  misc_feature (28)..(28): Xaa can be any naturally occurring amino acid
  misc_feature (33)..(33): Xaa can be any naturally occurring amino acid
  misc_feature (35)..(35): Xaa can be any naturally occurring amino acid
  misc_feature (37)..(37): Xaa can be any naturally occurring amino acid
  misc_feature (43)..(43): Xaa can be any naturally occurring amino acid
  misc_feature (54)..(54): Xaa can be any naturally occurring amino acid
  misc_feature (57)..(57): Xaa can be any naturally occurring amino acid
  misc_feature (90)..(90): Xaa can be any naturally occurring amino acid
  misc_feature (95)..(95): Xaa can be any naturally occurring amino acid
  misc_feature (103)..(103): Xaa can be any naturally occurring amino acid
  misc_feature (113)..(113): Xaa can be any naturally occurring amino acid
  misc_feature (119)..(119): Xaa can be any naturally occurring amino acid
  misc_feature (134)..(134): Xaa can be any naturally occurring amino acid
MXPNVMGSSGTSVAPFXGLKSXAGLPVXRRSNXAXSXASSNGXRIRCMQVWAIXGIXKFETLSYLPTLNTEALLKQVDYLIRSKWVPCLXEFNKXGFIFREHXNASPGYYDGXRYWTMXETAYVPGCTDPHKVXKPSGRSKKEP

SEQ ID NO: 53579 - protein, 367 aa, Zea mays
VEVKRIHNCRRLSHECLTFISVKGIYYQAEVQGQKITWLTPHALQQVLTDDVDFNVMLSFLEFYETLLGFVNFKIYHSINVNYPPILDPRLEALAVELYALCRYISAGSRRMIGNSQTDEVMEDKDEKSKAEEVIEEEKVVKNKASSKADESEFRLAQLQHQLPTNEPGALMNLVEESTADDADDDDTKDCKGLFKNLKFYLSREVPRESLLFIIPAFGGTVSWEGEGAPFKEIDEDITHQRLKDVFHSIGASSEKFTLSAENLPNTLEYIEGEVEALDEVIGSHADFCALVASRGTATAFLKAGCTHGKIVNRPNYSLSSSDLIDIPSLARSIGNRFMTQIWVNGGRKMTGDEARSHLKPDDEAEV

SEQ ID NO: 53580 - protein, 198 aa, Physcomitrella patens subsp. patens
MEDKDAECEELGRELVQVLVDQLFNMPLTLDKTGRLVKLPKPTLQLPREKPLKQEKVLISLTSWLIVKDVSNCTLQLAATSLAITGSKQLGQRLSRNDLGDVAGLTSTATASIGMFDKKLPGEKPSKKLGKHRKWLMEKSKKKVLITNVTKKVLAENDFSGLDVNKAVRVHNVEESGQTGEEFIWEKRWQVWRAEGFE

SEQ ID NO: 53581 - protein, 66 aa, Glycine max
MAEYESSIQHQPHLKKTAFQALNTIIQLHFEKKRAIDLQKKELYKLFQIFFIFLALAQSPCLQCRP

SEQ ID NO: 53582 - protein, 475 aa, Hyphomonas neptunium ATCC 15444
MSTPANGKGRISQVIGAVVDVEFDGELPSILNALETFNNGSRLVLEVAQHLGENTVRTIAMDSTEGLVRGQPVSDIGTPITVPVGPATLGRIMNVIGEPIDERGPVNADTYMPIHAQAPAFVDQATESEVLVTGIKVIDLLCPYAKGGKIGLFGGAGVGKTVLIMELVNNIAKLFGGYSVFAGVGERTREGNDLYHEMIESNVINLEGESRMSLVYGQMNEPPGARARVALTGLTQAEYFRDVEGKDVLFFVDNIFRFTQAGSEVSALLGRIPSAVGYQPTLATDMGALQERITSTNKGSITSVQAVYVPADDLTDPAPATSFAHLDATTVLNRAISEKGIYPAVDPLDSTSRILDPMVVGEEHYEVARGVQQILQKYKELQDIIAILGMDELSEDDKVTVARARKVERFLSQPFDVAQVFTGSPGVQVKLEDTIKGFKGLISGEFDHLPEPAFYMVGNIEEAKAKAAKLMADAA

SEQ ID NO: 53583 - protein, 90 aa, Oryza sativa Japonica Group
MAQPAFLSALRSRLRSPQPQAPALPHLQPPRRGFHVELGAREKALLEEDTALKRFKSYKNSVKQVSKVGNILTGVVLFACAYEIVALANS

SEQ ID NO: 53584 - protein, 341 aa, Streptomyces sp. AM-7161
MLSVVMEEFGGPEVLRARQVEDPEPGPGQVLVDVAYASVTFVETQVRSGNGPFGRPALPRVPGNGVGGRVVALGPGADPALLGTVVVTTTGGEGGYAERALARADEVVPVPPGLALKDAVALLADGRTALLLFRQAEVKPGEKVLVEAAAGGVGSLLVQLAVHAGARVVGAARGDRKAELVVSLGASYVDYSREAWLRQVRETAGGGDLDVVFDGVGGAIGTAAAGALRPGGRISLYGMASGADATLDEDDLAARGIRTLGLFAAPGPAETHPLIGEALRLAADGVLAPVVGQVFPLAAAAEAHAAIEARATVGKTLLAVGAQEGDTYGTGAAGGATNGDR

SEQ ID NO: 53585 - protein, 121 aa, Synechococcus sp. WH 5701
MAESGGEVERRSERPWGWFEILISAKGYLIKRLWLHPSSRISLQRHHHRSEHWVVVEGDGVLECEGGQLSASPGVTLTIPKRAVHRASAGEQGLMIVEVQRGDDLNDDDIERFADDYGRLG

SEQ ID NO: 53586 - protein, 274 aa, Listeria innocua Clip11262
MNLKDTVKLANGVEMPRLGFGVWKVQDGDEAVNSVKWAIEAGYISIDTAAAYKNEEGVGQAIKESGVKREDLFVTTKLWNAEQGYESTLAAFDESLRKLELDYVDLYLIHWPVEGKFKDTWRAFEKLYKDKRVRAIGVCNFHEHHLKELMEDAEIAPMVNQIELHPQLTQEPLRKFCAENNIVVEAWSPLGNGKLLANPEIKAIADAHGKSVAQVILRWDLQIGVVTIPKSVHQERIIQNADIFDFELSDEEVAKISGLNKDERTGPDPDNFNF

SEQ ID NO: 53587 - protein, 539 aa, Schizosaccharomyces pombe 972h-
MTSNRSTRSSTKREEVSKNGVEKRELDESDVMKNGKKPVKRAKVSSLPKPVRVPGSAKRINKIPELPTERLNVYVFGSGSMNELGMGEEEMDVVYRPRLNPILSTDKVGVVDLAVGGMHSAALSHDGRVYTWGVNDDYALGRLTKDQKDENGDKVDNDLLEGTPSKVEGALSHLRVTKVICSDNLTAAITDNGCCFTWGTFRCSDGVLGYSDSQKRTAEPTQMRLPEICQLATGTDHIIALTTTGKVYTWGNGQQFQLGRRMLERRRLQGLTPQPLALKNIISVGAGSYHSFAIDNKGRVYAWGLNITRQCGIEVEDEEEGAVITKPTLVDALEGYNVKSITGGEHHTLALLEDGRVLAWGRDDRHQLGIPDNALPETVVKDEKGNNYYLSTPTIIPGLTNVIQVVCGTHHNLAVTSDGKVYSWGSAENYEVGQGDNDEDVAVPTLVRSKAIKEVAIRVAGAGGQFSIIAGIPNASEEPVANGIKSEPENEKKLKTEETSKTDDSPVTDAKPDVTSNGEPSTATSESKDSVLEPSSTTA

SEQ ID NO: 53588 - protein, 327 aa, Methanocaldococcus jannaschii DSM 2661
MKELFKRGGIMLFDKNILQKIDEELKTYVDKDDKLYNASKHLLFAGGKRIRPYLTVVTYMLKKDDIEEVLPAAAAVELIHNYTLIHDDIMDNDDERRGKPTVHVVYGEPMAILAGDLLYAKAFEAVSRIKDNKKAHEVLKILSKACVEVCEGQAMDMEFENYYPTMEEYLDMIRKKTGALLEASVGIGAVMADCNEEEREALKEYAKRIGLTFQIQDDVLDLIGDQKKLGKPVGSDIREGKKTIIVIHALKTLDEDKKKRLLEILGNKNVKDEEIKEAIEILKPSIEYAKELMKQKTEEAKEYLKIFNKDRRKVLEDLADFIMSRIY

SEQ ID NO: 53589 - protein, 498 aa, Phormium tenax
MRINPTTSGSAVSTVEEKKLGRIAQIIGPVLDVVFPPGKMPNIYNALVVKGRDTASQQINVTCEVQQLLGNNRVRAVAMSATDGLTRGMEVIDTGAPLSVPVGGATLGRIFNVLGEPVDNLGPVDTRTTSPIHRSAPAFIQLDTKLSIFETGIKVVDLLAPYRRGRKIGLFGGAGVGKTVLIMELINNIAKAHGGVSVFGGVGERTREGNDLYMEMKESGVINEKNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPWIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEVTAKAMNLEKESNLKK

SEQ ID NO: 53590 - protein, 238 aa, Brassica napus
MSSLSRLLRGAFNTCTIRRFSSAAASETTAAISPPPKKSLSSIVNEERNPKRIVDKFKMACESERFRANIAVYDRTVRRLVAAKRLHFVKEILEEQKKYPDMSKEGFAARIISLYGKAGLVENAQKVFDEMPERNCKRSVLSFNALLSAYGVSKRFDEVEQLFNDLPKKLSIKPDIVSYNTLIKALCEKGSLSEAVALLGDIENKGGLKPDIITFNTLLLSSYLTGEFEQGEEIWAKM

SEQ ID NO: 53591 - protein, 107 aa, Vitis vinifera
MAKNVAGSPLERNGLASFDQKLAMAKRCSHEGVVAGAKAAVVASIATAIPTMASARWLPWAKANLNHTAQALIISTGRSGLFHSCGQDSVGVGSPQLPQETLLLRRM

SEQ ID NO: 53592 - protein, 146 aa, Pisum sativum
MAFCNKLGNLLRQGATQSSHAPVSSMLNYLRHMSSSKLFIGGLSYGVDDQSLKDAFASYGEVVEARVITDRDTGRSRGFGFVNFTSDESATSALSAMDGQDLNGRNIRVSYANDRPSAPRGGGGGYGGGYGDGFSNRGGGGGGGGW

SEQ ID NO: 53593 - protein, 366 aa, Pisum sativum
MTNNKEAFNISDLSSALNEEDRADLVNALKSKIQSLAGQHSDVLESLSPVVRKRVEVLREIQGEHDELEAKFLEERAALEAKYQILYQPLYTKRYDIVNGVAEVVGVRVETAVAEEDKEKGVPSFWLNAMKNNDVGGEEITERDEGALKFLKDIKWTRIEEPKGFKLEFFFDSNPYFSNSVLTKIYHMVDEDEPILEKAIGTEIQWLPGKCLTQKVLKKKPKKGAKNAKPITKTETCESFFNFFNPPEVPEDDEDIDEDMAEELQNQMEQDYDIGSTIRDKIIPMSWFTGEAAQGEEFGDLDDEDEDEDDDAEEDDEEEDEDEDDDDEEEEETKTKKKSSASKKRIGIAQLGDGQQGERPPECKQQ

SEQ ID NO: 53594 - protein, 318 aa, Saccharomyces cerevisiae
MSSNAQVKTPLPPAPAPKKESNFLIDFLMGGVSAAVAKTAASPIERVKLLIQNQDEMIKQGTLDKKYSGIVDCFKRTAKQEGLISFWRGNTANVIRYFPTQALNFAFKDKIKLMFGFKKEEGYGKWFAGNLASGGAAGALSLLFVYSLDYARTRLAADSKSSKKGGARQFNGLIDVYKKTLKSDGVAGLYRGFLPSVVGIVVYRGLYFGMYDSLKPLLLTGSLEGSFLASFLLGWVVTTGASTCSYPLDTVRRRMMMTSGQAVKYDGAFDCLRKIVAAEGVGSLFKGCGANILRGVAGAGVISMYDQLQMILFGKKFK

SEQ ID NO: 53595 - protein, 149 aa, Zea mays
MGVRAAAAAVALVAVMGMLAPRAAAQTPNCAAKLVPCSSYMNTTGTPPDTCCGPLKDAVKNDLKCLCDLYATPEIFKAFNISLDEALGLSKRCGLSDTTAACKGLSPTQSPPGSPSGGGSGSNSGHHTLSVGFSGFMSFLSLALWSVLA

SEQ ID NO: 53596 - protein, 195 aa, Yarrowia lipolytica CLIB122
MNDSSTSNRKALFEEDKDLKVNKRADALLERKQQEAEFELEKLQAEERGEDFDRKRAWDWTVKETEEWKEKKERKRERESQSGVHDMSSTAQRAYEKDLASFKPDLETYEKEKETGLHHTPSFNHKPTPEALDRLVNGLTKGDKQRMKRRKQAGADDQHATYISDKNKQFNEKLNRQYDKYTKEIRDNFERGTAL

SEQ ID NO: 53597 - protein, 351 aa, Prochlorococcus marinus str. MIT 9312
MYDLYRKNFKVMKIGINGFGRIGRLVFRALWDRADIEITHINEIAGDSNAAAHLLEFDSVHGRWEKDIKVKEEGIIIDGMKLTYTSFKNYLDVPWEKSSVDIILECTGKNKKPDKLNPYFDSLGMKRVIVACPVKGIVTGEEALNIVYGINQSLYDPSKHKLVTAASCTTNCLAPIVKVINENFSIKHGAITTIHDVTNTQVPVDFYKSDLRRARGCMQSLIPTTTGSAKAIAEIFPELKGKLNGHAVRVPLLNGSLTDAVFELNKEVTTEQVNMALKEASETYLKGILGYEERPLVSADYVNDSRSSIVDSLSTMVVNSNLLKIYAWYDNEWGYSCRLADLTEYVIKKEI

SEQ ID NO: 53598 - protein, 134 aa, Staphylococcus aureus
HETDEEINKKAHAIFKHGMTPIICVGETDEERESGKANDVVGEQVKKAVAGLSEEQLKSVVIAYEPIWAIGTGKSSTSEDANEMCTFVRQTIADLSSKEVSEATRIQYGGSVKPNNIKEYMAQTDIDGALVGGA

SEQ ID NO: 53599 - protein, 151 aa, Triticum aestivum
SHLSHTPLLILPPTSLLLFLLLPLATSSLSSLASYKFTSFVTKLSPAKMSTVTRAYLDQRLAAANRCSKEAAMAGAKAAAVASVAAAVPTLASVRMLPWARAHLNPTGQALIISTVAGMAYFIVADKTILSMARKHSFEDAPDHLKNTSFN

SEQ ID NO: 53600 - protein, 538 aa, Streptomyces sp. AM-7161
MPTTESRPSTTDNPDDRTDRTDRSVSALRDELHVLRERALRGPSERATEAQHAKGKLTARERIELLLDPGSFNEVEQLRRHRAQGFGLEARKPYTDGVITGWGTVEGRTVFVYAHDFRIFGGALGEAHATKIHKIMDMAIAAGAPLVSLNDGAGARIQEGVSALAGYGGIFQRNTRASGVIPQISVMLGPCAGGAAYSPALTDFVFMVRETSQMFITGPDVVKAVTGEEITQNGLGGADVHAETSGVAHFAYDDEETCIAEVRYLLSMLPQNNRENPPAVVPDDSPDRATPALLDLVPADAVRSYDVRAVIEELVDDEEHMEVHSGWAANLVCTLARLDGRVVGIVANQPSVMAGVLDIDASEKGARFVQMCDAFSIPIVTLVDVPGFLPGVGQEHHGVIRRGAKLLYAYCNATVPRISVILRKAYGGAYIVMDSQSIGADLTYAWPTNEIAVMGAEGAANVIFRRQIAEAPDPEAERLQKIKEYRTELMHPYYAVERGLVDDVIDPSDTRRVLVRGLEMLRAKHAELPSRKHGNPPQ

SEQ ID NO: 53601 - protein, 766 aa, Zea mays
MGSACQAGTDGPSRKDVLGIGNAALENGHHQAEADADEWREKEEDLANNGHSAPPPGMQQVDEHKEEQRQSIHWERFLPVKTLRVLLVENDDSTRQVVSALLRKCCYEVIPAENGLHAWRYLEDLQNNIDLVLTEVFMPCLSGIGLLSKITSHKICKDIPVIMMSTNDSMSMVFKCLSKGAVDFLVKPLRKNELKNLWQHVWRRCHSSSGSESGIQTQKCAKLNTGDEYENGSDSNHDDEENDDGDDDDFSVGLNARDGSDNGSGTQSSWTKRAVEIDSPQPISPDQLVDPPDSTCAQVIHPRSEICSNKWLPTANKRNVKKQKENKDESMGRYLGIGAPRNSSAEYQSSLNDVSVNPIEKGHENHMSKCKSKKETMAEDDCTNMPSATNAETADLISSIARNTEGQQAVQAVDAPDGPSKMANGNDKNHDSHIEVTPHELGLKRSRTNGATAEIHDERNILKRSDQSAFTRYHTSVASNQGGARYGESSSPQDNSSEAMKTDSTCKMKSNSDAAPIKQGSNGSSNNDVGSSTKNVAARPSGDRERVASPLAIKSTQHASAFHTIQNQTSPANLIGEDKADEGISNTVKMSHPTEVPQGCVQHHHHVHYYLHVMTQKQPSTDRGSSDVHCGSSNVFDPPVEGHAANYSVNGGVSVGHNGCNGQNGSSAVPNIARPNIESINGTMSQNIAGGGIVSGSGSGNDMYQNRFLQREAALNKFRLKRKDRNFGKKVRYQSRKRLAEQRPRVRGQFVRQSEQEDQTAQGSER

SEQ ID NO: 53602 - protein, 318 aa, Brassica napus
  misc_feature (171)..(171): Xaa can be any naturally occurring amino acid
  misc_feature (187)..(187): Xaa can be any naturally occurring amino acid
  misc_feature (202)..(202): Xaa can be any naturally occurring amino acid
MSSFTYASAFNLSEKSPPFSPAIASSSSSSAFDDDDTDDACSICLESFTPQDPATVTSCKHEYHLQCIIEWSQRSKECPICWQFFVLKDPVSQELLAAVDKERLMKTTNMRSPSSPRSSIPHEDFHSEEEESSFDEQFLRHLTEAAHRRCLLRTRDTPIPSDDPTPCSLSXLLVVVAMSVLGECLTXPKPLFNTSSSSLVSXIRISRGPSLSEASSLPEAIKSKLAAASARYKESISKSKQGLKEKLLARNNSVKELSKGVQREMNAGIAGVTRMMERFDIASKRFGGSTTSGFNFSFKGKREEAEATSNNGNKNRIP

SEQ ID NO: 53603 - protein, 392 aa, Microcystis aeruginosa PCC 7806
MNNLTLAHRLQALQSNVFADMDRAKAASRESGNTIIDLSLGSSDLGAAPHVVDAIERSLHDPHTHGYLLHNGTRDFRITAANWYSDRFGVPIDPETEVLPLIGSQEGTAHLPLAILNPGDFALLLDPGYPSHLRGVALAGGQIYGMPILAKNDFLPVLEDIPELVLAQSKLMVLSYPHNPTTAIAPLAFFQKAVNFCRQHNLVLIHDFPYLDIFFEGTSPPPSILQADRAKTNSIEFFTFSKSYNMGGFRIGFAIGNPQLIMALRQIKAMVDFNQYLGILNGAIAALTGNQDSVKETVAIFQKRRDVFINALNRIGWPVATPAATMYVWAKIPPSWPGNSVDFCRQLVAQTGVAVSPGSGFGKGGEGYVRFALVHDPDILEASVEKIGAFLG

SEQ ID NO: 53604 - protein, 458 aa, Oceanicola granulosus HTCC2516
MIVIGAGPGGYVAAIRGAQLGMNVLCIEREHLGGICLNWGCIPTKALLRSSEVFHLMHRAKEFGLKAEGVGYDLDAVVKRSRGVAKQLSGGIGHLFKKNKVTSLMGEARIAGKGRVVVKTDQGEEEVSAPAIVVATGARARELPGLEADGDLVWTYKHALQPPRMPKKLLVIGSGAIGIEFASFYNTLGAETTVVEVMDRILPVEDAEISAFAKKQFKKQGMKILEKAMVKKLDRAKGKVTAHIESGGKVETQEFDAVISAVGIVGNTEGLGLEELGVKVDRSHVIVDEYCRTGVEGVYAIGDIAGAPWLAHKASHEGVMVAELIHGKNKVHPVRPESIAGCTYCQPQVASVGFTEAQAREKGYDIKVGKFPFIGNGKAIALGEPEGIVKTVFDAKTGELLGAHMVGAEVTELIQGYVVGRQLETTEEDLMETVFPHPTLSEMMHESVLDAYGKAIHF

SEQ ID NO: 53605 - protein, 134 aa, Staphylococcus aureus
HETDEEINKKAHAIFKHGMTPIICVGETDEERESDKANDVVGEQVKKAVAGLSEEQLKSVVIAYEPIWAIGTGKSSTSEDANEMCTFVRQTIADLSSKEVSEATRIQYGGSVKPNNIKEYMAQTDIDGALVGGA

SEQ ID NO: 53606 - protein, 462 aa, Bacillus cereus ATCC 14579
MTINSKTIEKSSYTYEELAEKNKAYVWHPFTQMKDYLEEDPVIIERGEGRKLYDVNGNEYWDGVSSIWLNVHGHQVPELDEAIREQLNKIAHSTMLGLANVPSILLAEKISEVVPDGLKKVFYSDSGSTAVEIAIKMAFQYWQHKGKPKKQRFVTLKEAYHGDTIGAVSVGAIDLFHQVYSSLLFDAIKMPYPYTYRSPYGNNKEEIVKSHLEEMEELLKEKHEEVAAIIVEPLMQGAGGMITMPKGYLKGLRDLCTKYNVLFITDEVATGFGRTGKMFACEHENVTPDILTAGKGLTGGYLPIAVTVTTDEIYNAFLGEYEEQKTFFHGHSYTGNPLGCAVAIANLELYEKTNLIEEVARKTDYVAAQLEKLFAYKHVGDIRQCGLMVGIELVKNKETKEAFDWTERVGVQVCKRSRELGMILRPLGNTIVFMPPLASTFEEIDDMLRILYKAISDVTEGE

SEQ ID NO: 53607 - protein, 414 aa, Campylobacter jejuni subsp. jejuni NCTC 11168 [sequence omitted]

SEQ ID NO: 53608 - protein, 102 aa, Synechocystis sp. PCC 6803
MGDRLTLTGSLTIHGEDRSITRQATGTEEIDCNSYGDPSSNAEAMALRRCCAKFGLGRDLWRKDKPQPLKMEQRQQQEKQPVLTPGTISREEWLKRKAGKAR

SEQ ID NO: 53609 - protein, 538 aa, Amanita muscaria
MASEELEKQSPVYDKPGPEAESLQGVANDGLSRQLKNRHIAMISIGGVIGTGLFLGTATALRNGGPVGMLLGYALMGLICFCVMISLGEMVAFLPIPGGHIKLAERFVDPAFSFTMGWNYWYNWSIVLPAELSASSVIVGFWNHNINPAVWVIICLVVVVTINMLGAGVYGEAEFWFASIKVITITGLIILGIVLDLGGGPNHDRLGFRYWKNPGPFVQFGGISGTTGQFLGFWAVLTQAAFSYIGTEIVAIAAGETKNPRRNLPRAIKRVYIRILLSYICGTLIIGLLVPSNDSGLNLGDGTAASSPFVIAIERAGINSLPHIINACLLTSAWSAASSDLYTSSRALFGLAVSGNAPKIFLTTTSSGLPYVSIAFECMLLRLLAFMATSSGAGKVFGWFANMTAIAGLMTWFGICVSYIRFYNALKVQGYDRKTLPFSSRLQPFAAYFAAGFILVACFFSGFAVFLKGKWATDTFVTNYLPFVLFPIMYGLARLYYKQGPKPYDEIDLVTGLKEIEQQTYDEPPPNNFLERVWQWVM

SEQ ID NO: 53610 - protein, 502 aa, Oryza sativa Japonica Group
MTCKIVDFGNACWADKQFTDFIQTRQYRAPEVILGSGYSFPVDMWSFACIAFELATGEMLFTPKEGQGYSEDEDHLALMMEILGKIPKKIATMGTKSKEYFDRHGDLKRIRRLKFSSIERVLVDKYKISESDAREFAEFLCPLFDFAPEKRPTAAQCLQHKWLQYSDGKNYGTLNISDVKNASVTCSPGTTASSDSKSIDVTRNIGDKPDSYAERADAKCNTSKKSIINSNSENSNVQPNTASVGNRNSKIDDVNSNTGSITNKDSKNTVIKPSIGSFVNRNAETVDVKPNIGSITSRGDSSSDTKSNIGSVASKDAKTIDAKPSTSSITSQDSKIGDGRSNIDGIANRDAKTADVKHNIRSVVNTYLRNFDVKHNTGNIVDGGVKHSDLKPGTVSAANVDSKSISAKPSTGSFENSDAKSISAKTSTGSFDNSDARNIMKANTGIVANNDIKDTDVQTNTESVTSGDDLNDIDRKPNIGRVAASIQRLESSIGKVQSGKYR

SEQ ID NO: 53611 - protein, 338 aa, Herminiimonas arsenicoxydans
MKPVIDKKRRVSVAPMMDWTDRHCRMFHRQITRHTWFYTEMVTTGALLHGDVSRHLDFNHEEHPVALQLGGSEPADLAKSAKLGEQWGYDEINLNCGCPSERVQKGAFGACLMNEAALVADCVKAMRDAVQIDVTVKHRIGIDDIASYDFVRDFVGTVAEAGCNTFIVHARNAVLKGLSPKENREIPPLRYEFAYQLKQDFPQLEIIINGGIKTLAEIDTHLVHVDGVMLGREAYHNPYLMSAFDARYYGDIAAPKSRAQVLHAMLPYIRAQLELHGKSEKGGGLRLNSITRHMLGLMAGLPNARGFRQSLSDSKKLALGDPDLLLQALARMQQPGAY

SEQ ID NO: 53612 - protein, 334 aa, Desulfotalea psychrophila LSv54
MTIKIGINGFGRIGRNIFRALSKDEAFADIEIVAINDLSDNATLAHLLKYDSIMGVYDREVGSDADGIIVDGRHIAVSSHRTPADIPWGEVGADYIAECTGIFRDAESAQGHIDAGASKVVISAPAKGAVKTIVMGVNEDEYDATLHHIVSAASCTTNCLAPFAKVILDNFGISRGLMTTIHAYTGDQRLLDSPHADPRRARAAALSMIPTKTGAAAAVSLVIPELKGKFDGLAVRVPTANVSLVDAVMEVEKETSVAEVNQVLKEAANRYLGYTDLPLVSIDFQGNPHSSIIDAQSTKVIGKSVKVMSWYDNEWAYSNRMLDLILHMDARRAL

SEQ ID NO: 53613 - protein, 1421 aa, Desulfotalea psychrophila LSv54
MDRHDVGQVLQSDALKANLLETAGTVEIDSELLLLLSAVKKYRGLHKTLEKLLYEICHPFRNWKLILPQFRSYTLKNTGHYLKDESGPEAVGLFARLFFEAIEDVRRDPVLLAQAVAALLIWLEKLAKDLPEGRQEAFEPVLTDIFSRLTRFDEEDEAAMMQMVYGQCSLAGLVRARLSSSETEGADCSSLVRLYEMVLHRTYAYWLLEDDPLQWFLMRCKMVANDLTARETFKDISHLSMQSRLTELKRIRQETAGVATLRAMLGLASHIDIVRFYRAIPDKLAELDIVSDCFAKEDAASSNFNENRKILFLFKIMDTEGLHLVHEETLREINRSLVQLIRQQTFEEIEEFLLATFELLEVNVRKYPHTSLQCIQVLGGEVFDRSNSRMVEAFLWGVVRFGFQHANVVGVDENWQPLTNPAHLANIRVWLHLIMREPKWCATLFSALIIHIKLSGTCIKDTDLFQRDITELLNHPIKPVYNLCKQFAKLMPVFFNEIGSEGELRDVSTELDEMHRRKDVLIHFLRKQGHVESSNLIVDFIKAIFLFWQTKDKSKLQPHVPDEVYVQVSSEGRYVDEAHRLTLRLWQEQNLKNVSDLLGVDEETMAEFLLRQQDIDPREVRRFELLVRMFKLLHAKYQLSFQDLRPELLAAAKNGFPQMRDLLDRLDQKDVRQSLSALLQSLLALKEIILSEESFEAREDIYYKRHIAVDIPSVYGRYKERKFDALSLSFRLENHANIYLEKLAGTINLAMITQATFYDIIGCLKLYIQALSVDGISSRKLVTSLSLLKNSLKVRRFSYTQYLDIFKGMSEGVKDIIYAFYTNIHQNNLSIIIPQLSREEVMQKYRSLYDEDMGISVHRVSEAFLRELISSTFGLQHLDNFILQILATLENQREMLSERNLDLLMTYNPNRAISELHNPNPLASNLIYLGNKGFNLATLAADNKPIPPAFVITTEVFRCRNIVFGYSEARQQFMGKIRRSLTELEDSQDKFFGSSDRPLLLSVRSGGAISMPGMMATVHNVGFNQEIIREYARKHGEGYFAWDNYRRFLQSWAMICDVDREDFQALMDSAKQRHGVRLKRDFTSAQMEELALSYYQLVCEKGVVIPDNPWLQLVGAIELVLDSWHTTKATDYRRVMDLSESWGTAVIVQTMIYGNKSSRSGSGVVFTSHPYRKVQRVALWGDYAYGSQGEDIVSGLVTSYAISMEQAQLDGRSAENTLERKFPKIYAELLSMSRELVYGKGWNPQEIEFTFEGEEADQLYILQSRDMITIKKKEHLQVFEESVALQEAYLGHGVGVSGSALSGLAVFTEEHIAEIRARDADVPLILIRQDTVPEDIKIVDLADGLLTSRGGQTSHASVVAVRLEKTCVVGCRRLKVFETLGYCEIRGKRIHFADPVSIDGRSGQLLVGIHPIKEEYHILPI

SEQ ID NO: 53614 - protein, 713 aa, Opitutaceae bacterium TAV2
MHSHCDRANGLQKLKTYLIPAAPRQNQNDRPCAKNGGRVSRPARRGRSRAHPEKEEKKEEEENPPPVLESPPHNRGGGGEATRRLPPPARLAHAVRFMNADASASSASTAPVPPVSPDTGAPAAAVAPTDFIRDVVAADVSAGRYPQIVTRFPPEPNGYLHLGHAKSICLNFGIALENGGRCNLRMDDTNPTKEEVEYVESITTDVRWLIDGWAGHTLGLTPLGQRPAPATIDGKPDYYAAPAPVADNDKPNATEPFFASDYFDALYAFAEQLILNGKAYICDLTPEETDAYRGAPDQPGKDSPWRNRSIEESLDLFRRMKAGEFPDGARTLRARIDMASPNVWLRDPLLYRIRHAAHHHAGDGWCIYPLYDFAHCLSDYIEGITHSICTLEFVVHRPLYDWLLEALDLPRPLPHQYEFAKLNLAYTLFSKRRLMRLVKENVVNGWDDPRMPTISGIRRRGVPAAALRNFAYNIGITKFDSLTELAVYENAVRDELNRLAHRRLAVLHPIKIVLTNIAEGEAIECDATNHPGNPALGTRKVALTREVFIDADDFAEVPPPKYFRLKPGGEVRLKYACIIKLDEIVKDAAGNLAELRCTADLTTRTGQPNATRKVKGTIHWVSATRAIDAEVRLYDRLFTVPEPGADDNYLDHLNPKSVEIITAKLEPTLADATLEDRFQFERLGYFAPDPKDNAPGKPLVFNRTITLKDSWAK

SEQ ID NO: 53615 - protein, 468 aa, Synechocystis sp. PCC 6803
MNPSSSPSQSTANVKFVLLISGVAALGGFLFGFDTAVINGAVAALQKHFQTDSLLTGLSVSLALLGSALGAFGAGPIADRHGRIKTMILAAVLFTLSSIGSGLPFTIWDFIFWRVLGGIGVGAASVIAPAYIAEVSPAHLRGRLGSLQQLAIVSGIFIALLSNWFIALMAGGSAQNPWLFGAAAWRWMFWTELIPALLYGVCAFLIPESPRYLVAQGQGEKAAAILWKVEGGDVPSRIEEIQATVSLDHKPRFSDLLSRRGGLLPIVWIGMGLSALQQFVGINVIFYYSSVLWRSVGFTEEKSLLITVITGFINILTTIVAIAFVDKFGRKPLLLMGSIGMTITLGILSVVFGGATVVNGQPTLTGAAGIIALVTANLYVFSFGFSWGPIVWVLLGEMFNNKIRAAALSVAAGVQWIANFIISTTFPPLLDTVGLGPAYGLYATSAAISIFFIWFFVKETKGKTLEQM

SEQ ID NO: 53616 - protein, 784 aa, Roseovarius nubinhibens ISM
MTDTPRDDIPRDPARQAALDYHEFPTPGKLEIRATKPMANGRDLSRAYSPGVAEACLEIKADPTTASRYTARGNLVAVVTNGSAVLGLGNIGALASKPVMEGKAVLFKKFAGIDCFDIEVNESDPEKLADIVCALEPSFGAINLEDIKAPDCFVVEKLCRERMGIPVFHDDQHGTAIVVGAAATNALHVAGKRFEDIKIVSTGGGAAGIACLNLLLKLGVKRDNIWLCDIHGLVYEGRTEDMNPQKSCFAQKTDKRTLADVMDGADLFLGLSGPNVLSPELVAKMAPKPIIFALANPTPEIMPDAARAVAPDAIIATGRSDFPNQVNNVLCFPFIFRGALDVGATEINDAMQLACVEGIAELARATTSAEAAAAYKGEQLTFGADYLIPKPFDPRLVGIVSTAVARAAMETGVATRPIEDIAAYKAKLNASVFKSALLMRPVFEAARHESRRIVFAEGEDERVLRAAQAMLEETSEQPILIGRPEVIETRCERLGLVIRPGAITVVNPENDPRYRDYWGSYHAIMQRRGVTPDLARAVMRTNTTAIAAVMVHREEADSMICGTFGEYRWHLNYVTQVLGDAHHHPHGALSLMILEDGPLFIADTHVRVFPTPEELAETAIGAARHVRRFGIEPKIAFCSQSQFGNQGSDSGKRLRAAIALLDAKPRDFCYEGEMNIDAALDADLRARLLPDNRMEGAANVLIFSNADAASGVRNILKMKAGGLEVGPILMGMGNRANIVTPGVTARGLLNMSAIAGTPVPNTAEHIKRGGRVSPKNGRSLLHTL

SEQ ID NO: 53617 - protein, 218 aa, Cryptococcus neoformans var. neoformans JEC21
MPSNFPPVQPKPKLKVCEVLANQIYTVDDFFSPSELRAVLAWAQSLELEGPKKPGKGEAERTGRRASLHSPEIASSLLRLLHPLLPSLSPPYTSHPGLSANIRVYHYPPHTFFGQHYDMPQLDHASRRLSCWTVLVYLSDGVTGGGTTFYPHEETGKKGKKGSKTGLKYGQKEKVTVEPKAGRMLLHWHGVSGGGCMKHEGDEVLSGDKWVLRTDVLA

SEQ ID NO: 53618 - protein, 198 aa, Triticum aestivum
RLGIVAYTGILFGESATKGAHFIELCGQRGIPLLFLQNISGFMVGRQYESGGIAKDGAKMVMAVACANVPKLTVVMGGSFGAGNYGMCGRAYSPRFMWMWPNARISVMGGDQAAAVLSTIQRDNAEKAGKKFSAEAQAKFEAPIKAKYDKEGSAYFSSARLWDDGVIDPADTRRVLGQALSAALNAPAKPTKFGVFRM

SEQ ID NO: 53619 - protein, 309 aa, Arabidopsis thaliana
MEITLNSGFKMPIVGLGVWRMEKEGIRDLILNAIKIGYRHLDCAADYRNETEVGDALTEAFKTGLVKREDLFITTKLWNSDHGHVIEACKDSLKKLQLDYLDLFLVHFPVATKHTGVGTTDSALGDDGVLDIDTTISLETTWHDMEKLVSMGLVRSIGISNYDVFLTRDCLAYSKIKPAVNQIETHPYFQRDSLVKFCQKHGICVTAHTPLGGATANAEWFGTVSCLDDPVLKDVAEKYKETVAQVVLRWGIQRKTVVIPKTSKPARLEENFQVFDFELSKEDMEVIKSMERKYHANQPAKFWNIDLYA

SEQ ID NO: 53620 - protein, 95 aa, Oryza sativa
  misc_feature (36)..(36): Xaa can be any naturally occurring amino acid
  misc_feature (48)..(48): Xaa can be any naturally occurring amino acid
MAASAADSTADDGRSFWRGRRGDRGWRPCWRRGPRXKEEKWLPVTKLXRLAKEGRVSRIEEIYLHSLPAKEHQIADTFAPTLKDEAITITPAQKE

SEQ ID NO: 53621 - protein, 476 aa, Silicibacter pomeroyi DSS-3
MAPKNEPSFRQSVDMMFNRAVALMDLPPGLEEKIRVCNATYTVRFGVRLRGQIQTFVGYRSVHSEHMEPVKGGIRYAMSVNQDEVEALAALMTYKCALVEAPFGGSKGGLCIDPRQYEEHELEQITRRFAYELAKRDLINPSQNVPAPDMGTGEREMAWIADQYARMNTTDINARACVTGKPLNAGGIHGRVEATGRGVQYALQEFFRDRVGVGKSGLDGKLDGKRVIVQGLGNVGYHAAKFLSEEDGCVITGIIERDGALVSDEGLDVEAVHNWIVKHGGVTGFPDGTFVAEGAKVLEEPCDILIPAAMEGVINLANADRIKAPLIIEAANGPVTAGADEILRKKGCVIIPDMYANAGGVTVSYFEWVKNLSHIRFGRMQRRQEEARHQLVIDELERLDRYLGDAWSMTPQFKEKYLRGADELELVRSGLDDTMRIAYQAMRDVWHERGDVEDLRTAAYLVSIDRVAKSYRAKGL

SEQ ID NO: 53622 - protein, 338 aa, Streptomyces sp. AM-7161
MRIAVTGSIATDHLLTFPGRFGEQLIEGELDKVSLSFLADELDVRRGGVAANIAFGLGALGLRPLLVGSVGRDFAEYGRLLAAHGVDTGSVHVSETRHTARFICTTDADQNQIGTFYAGAMSEARHIALAPVRDRAGGLDLVLVSPNDPEAMLRHTREAAALGVAFSADPSQQLARLGRDEVRLLLRGPRHLFTNAYEAQLVQERTGWTERQVLERVGTWVITRGADGVRILASGRPAVDVAAVPADGPVEPTGAGDAFRAGFLAATARADDPVRAARLGAALATTALESVGPQAYTLDGAPLLARIADAYGPEAAADLEPEVKAVRPAETAVGAEPS

SEQ ID NO: 53623 - protein, 350 aa, Medicago sativa
MLDAVNEPENTELRHHDRRKCTHDRFMGSNFQLKDSDRPSSSIDSITNRADQILDDADVGECEIPWEDLVIGERIGLGSYGEVYRADWNGTEVAVKKFLDQDFSGAALSEFKREVRIMRRLRHPNVVLFMGAVTRPPNLSIISEFLPRGSLYRILHRPNCQIDEKQRIKMALDVARGMNCLHASTPTIVHRDLKSPNLLVDNNWNVKECDFGLSRLKHNTFLSSKSTAGTPEWMAPEVLRNEPSNEKCDVYSFGVILWELATLRLPWSGMNPMQVVGAVGFQNRRLEIPKELDPLVARIIWECWQQDPNLRPSFAQLTVAFKPLQGLVIPSHQDQVASPLPQEISVNSTP

SEQ ID NO: 53624 - protein, 316 aa, Bacillus cereus ATCC 14579
MSTVQVPKLNTKDLLTLEELTKEEIISLIEFAIYLKKNKQEPLLQGKILGLIFDKHSTRTRVSFEAGMVQLGGHGMFLSGKEMQMGRGETVSDTAKVLSQYIDGIMIRTFSHADVEELAKESSIPVINGLTDDHHPCQALADLMTIYEETNTFKGIKLAYVGDGNNVCHSLLLASAKVGMHMTVATPVGYEPNEEIVKKALAIAKETGAEIEVLHDPELAVNEADFIYTDVWMSMGQEGEEEKYSLFQPYQINNELVKHAKQTYRFLHCLPAHREEEVTGKIIDGPQSIVFEQAGNRLHAQKALLVSLFKNVEEPS

SEQ ID NO: 53625 - protein, 320 aa, Yarrowia lipolytica CLIB122
MSSLQKHLPMESKTKPAEIPLSAVPPSAKIHYPFWYGGFASVVAGVFTHPLDLAKVRLQTAKTRGQGLFGTLVNVVKHEGITGVYSGLSASMLRLSTYSTMRFGMYEYLKESIAPYYYNPNKRDQNPPMYVLLPISIIAGISGGIVGNPADIINIRMQNDQSLPKDQRRNYKHAFDGLIRMYKEEGVRAMFRGLGPNCTRGVLMTSSQMVSYDSFKALLVNHLGMNPDKKATHFSASLLAGLMATTVCSPVDVVKTRIMNAHAHHSKDSAFTIFFNALKQEGPLFMFRGWLPSFVRLGPQTILTYIVLEQLKFYKIGMRH

SEQ ID NO: 53626 - protein, 243 aa, Microcystis aeruginosa PCC 7806
MLPNREGQRVPDVTFPVRQNNQWVNITSEELFKGKTVVLFALPGAFTPTCSTSHLPGYNELAPVFRENGVDTIVCLSVNDTFVMNEWAKDQECDNVVLIPDGNGEFSAGMGMLVDKADLGFGKRSWRYSMLVKDGVIEKMFIEPEEPGDPFKVSDAETMLHYINPEAKKPPLVSLFSKVGCPYCLRAKKTLEEKGLQYEEIILGRDATSRSLRAMSGNTTTPQVFINGQLIGGSEELAAYLGA

SEQ ID NO: 53627 - protein, 543 aa, Synechococcus sp. WH 7805
MNAVDRLAGHHKQRLSVAPVVLAILDGWGDCDGSDFNAIRSAETPVMDALKHAYPNTLIQASGSHVGLPDGQMGNSEVGHLTIGAGRIIRQELVRIGDTVRTNQLPAVPALRSLAERLRESGRTLHLFGLCSDGGVHSHVDHLCGLLRWAAAEGIQTVAIHAITDGRDTPRQSAPRYIHAIEEAMQASGIGEIVSLCGRYWAMDRDQRWERTSRAHSLLTDPEFPVSTESPTAVLEASYAAGTTDEFLEPTRLSACHVQEGDSLLMFNFRPDRARQIIQSLTLEDFEGFSRPHHPKLDVVTFTQYESGLPVKVAFPPESLDDLLGQVVAADGLKQYRTAETEKYPHVTYFMNGGIEQPLEGEDRHLVPSPRVATYDQAPAMAAETLTDSCIAAIEKGVYSLVVINYANPDMVGHTGVMEAATKAIETVDHCIGRLLDAVGRAGGTLMITADHGNAECMRGDDGQAWTAHTTNPVPVILVEGEKRKMVGMGNSLRLRNEGGLADIAPTLLQLLGLEKPDAMTGHSLIEAIDAAAPSTARLPQPV

SEQ ID NO: 53628 - protein, 255 aa, Bacillus cereus ATCC 14579
MSDYIVVKCGGSMLNQLNDVFFECIKKLQQKYKVVIVHGGGPEIDAKLKDCNINVEKRDGLRITPKEVMDVVQMVLCGSTNKKLVMNLQKHNLLAVGCSGCDGNLLQIQPVSEEIGYVGEVSYVETALLKGLINMEYIPVIAPIGVNGNEIYNINADNAAAGIAAALGAKELVFITDVDGILHEGNLVKETDESEIATFIETGVITGGMIPKVQAALASLKMGVQKISIVNGTKDFTEVTGECIGTTVTKGVSIA

SEQ ID NO: 53629 - protein, 339 aa, Streptomyces sp. AM-7161
MPCALSESMSTAARMVRTEEVPIPEPGPGQVLIEAEAISVFAQTQMRRNVFPAPMWRPEFPITLGGDVVGEVVAVGPGVTGNAPATGSAPSPWHGAYAEYVVVDADTVLPVPAALDAAQATALPAPGPIAMGTMGTASLAPGESVLVQRPSGGIGHLAVQLARLAGAGTVIATAGTPEKCAYARSLGADVAVDYSRADWPDAVREATGGRGVDVILDSVGGDVLRQGVGLLAPFGRLVFYGSAGGGLGIPAVSPMELIGMRFLTGFALSAWRNARPERYRADHDALTAHLLAGTVRQTVHATLPLEDVGKAHEIVESRAQLGRIVLLTGRGTRTAGGGA

SEQ ID NO: 53630 - protein, 328 aa, Triticum aestivum
MAANGHQIQPAEEAMKLIIDTDPGIDDSVAIMMAFQAPGVEVLGLTTIFGNCTTAYATRNALILCEKAGRPDVPVAEGSAEPLKGGKPQVADFVHGSDGLGNVSVPEPTTKKAEQTAAEFLVDKVSQFPGEVSVLALGPLTNLALAIKMDPSFVSKVKKIVVLGGAFFAAGNATPSAEANIHSDPEAADMVFTSGADIAVVGLNITTQVSFTEADLSELRRSGGKQAQFLCDICKFYSDWHLHSYGDPAVFLHDPVSLAALVRPELFTFRKGVVRVETQGICRGHTSMDMGLKKFKSENAWSGYTPISVAWTVDKAKVVAFVKELLKN

SEQ ID NO: 53631 - protein, 388 aa, Saccharomyces cerevisiae
MNCTLTDNTRAINVASNLGAPQQRTIFAKERISIPGYYEIIQFLGKGAYGTVCSVKFKGRSPAARIAVKKISNIFNKEILLKRAIRELKFMNFFKGHKNIVNLIDLEIVTSSPYDGLYCYQELIDYDLAKVIHSSVQLSEFHIKYFLYQILCGLKYIHSADVIHRDLKPGNILCTLNGCLKICDFGLARGIHAGFFKCHSTVQPHITNYVATRWYRAPELLLSNQPYSKSVDIWAVGCILAEFYARKPVFMGRDSMHQIFEIIKVLGTPDKDILIKFGTIKAWNLGKNSNNPVYKKIPWSNIFPFASHEAINLIESLLHWDSTHRLNVEQAISHPFLNEVRKPDDEPVCLQGPFDFTYESELNSMSKLRDYLVEEVKNFKTDLSSSSL

SEQ ID NO: 53632 - protein, 532 aa, Coccidioides immitis RS
MSEHPQTNGHIDDGQITRLTNGVPGSPPSDWIVQKFGGTSVGKFALEIVDKVIKPNIEDHRVAVVCSARSSSSKADGTTNRLLRAAREAENPKSSNYLSLIEAVKQEHIDVAREYVQNPDLKAELIAQVEAECLRILKILDAAQTLGETSSRCVDMVISAGEKLSCRFMTILLKDRGVDAQYVDLSDIIDFAAGIQALDQDFYDRLAELFGCKVQECTAKVPVVTGYFGVVPGGLLDKIGRGYTDLCAALVAVGVHAEELQVWKEVDGIFTADPRKVPTARLLSMITPAEAAELTFYGSEVIHPFTMEQVIRAKIPIRIKNVMKPKGRGTVIFPDSTSELEKTAPGHDPKLFRTRGPQFWSQQPGPKRPTAVTAKHKILVINVHSNKRSLSHGFFAGIFSVLDKWRLSIDLISTSEVHVSLALHSEIPLLNGVGHDEYQIIDEDLRGAIQDLRKYGTVDIIPEMAILSLVGKQMKNMVGVAGRMFTVLGEHNVNIEMISQGASEINISCVIEERDADRAINILHTNLFTFLD

SEQ ID NO: 53633 - protein, 323 aa, Acidobacteria bacterium Ellin345
MKAIRVHEFGGPEVLKLEEVPEPKPGAHEVVVQIKAAGVNPVETYQRSGKYPSLPKLPWTPGNDGAGIVHSVGGDVKSVKAGDRVYLAGSSTGTYAEYSLSSESQVHLLPKNVSFAQGAAVGIPYGTAYRGLFQRAKSLPNEIVFINGASGAVGLAAVQLARAYGCLVIGTAGSDKGLSLVQEHGAHYAFNHSAEDLAQRVANICNLRGKQGPDVILEMLANKNLAKDMQMLGRHGRIVVIGNRGSIEVNPRDIMAKDGAILGMSLPTASDVEKSAIYSAIGSALEIGVAKPVVSKEYPLADAAKAQVDVIESSSHGKLVLVP

SEQ ID NO: 53634 - protein, 279 aa, Bacillus cereus ATCC 14579
MSIQNISFLGAGSIAEAIIGGLLHANVVKGEQITVSNRSNETRLQELHKKYGVKGTHNKKELLTDANILFLAMKPKDVAEALTPFKEYINNNVLIISLLAGVSTDSIRKLLQKDVPIIRAMPNTSAAILKSATAISPSKHATAEHIRTATSLFETIGLVSVVEEEDMHAVTALSGSGPAYIYYVVEAMEEAAKKIGLKEDVAKSLILQTMIGAAEMLKASDKHPSILRKEITSPGGTTEAGIEVLQEHKFQQALISCITQATKRSHNLGKTLEQLTKEK

SEQ ID NO: 53635 - protein, 261 aa, Streptomyces sp. AM-7161
MTQANGRVAVVTGATSGIGWEIAVRLAETGHRVYLCARSADRLAEAVKQLQDRGFDADGSTCDVADPAQVTAFVTAAVARYGPIDVLVNNAGRSGGGITADVTDELWLDVVNTNLNSVFRMTKAVLTVGGMQGKKRGRIVNIASTGGKQGVLHGAPYSASKHGVVGLTKAWGLELAKTGITVNAVCPGFVETPMAEKVRTHYAGIWGTTEEEAFERVTARVPIGRYVEPSEVAAMVDYLVGDGAAAVTAQALNVCGGLGNY

SEQ ID NO: 53636 - protein, 254 aa, Campylobacter jejuni subsp. jejuni NCTC 11168
MLNLDKFLEIAINASNQASKAILEERKNFKTWEKEDKSPLTSADLASNKILNDILGSTDIKILSEEKLLSKEECEELKTFWLIDPLDGTSGFLKGSDEFCVMISLVHDNRPVLSLIQNPSKGDIFYAHAKTKVYKNDKPLQIDQQEYEKNKYKALLSVNHLSKEDEDFAKEHQLEAINIGSGLKFCAILEARAGVYKRFEKLNIWDIVAGDFLINQNGGFMGDFSKKYILYNPLSYKSNPFICVSSRNFLQDFL

SEQ ID NO: 53637 - protein, 547 aa, Lactococcus lactis
MYTVGDYLLDRLHELGIEEIFGVPGDYNLQFLDQIISREDMKWIGNANELNASYMADGYARTKKAAAFLTTFGVGELSAINGLAGSYAENLPVVEIVGSPTSKVQNDGKFVHHTLADGDFKHFMKMHEPVTAARTLLTAENATYEIDRVLSQLLKERKPVYINLPVDVAAAKAEKPALSLEKESSTTNTTEQVILSKIEESLKNAQKPVVIAGHEVISFGLEKTVTQFVSETKLPITTLNFGKSAVDESLPSFLGIYNGKLSEISLKNFVESADFILMLGVKLTDSSTGAFTHHLDENKMISLNIDEGIIFNKVVEDFDFRAVVSSLSELKGIEYEGQYIDKQYEEFIPSSAPLSQDRLWQAVESLTQSNETIVAEQGTSFFGASTIFLKSNSRFIGQPLWGSIGYTFPAALGSQIADKESRHLLFIGDGSLQLTVQELGLSIREKLNPICFIINNDGYTVEREIHGPTQSYNDIPMWNYSKLPETFGATEDRVVSKIVRTENEFVSVMKEAQADVNRMYWIELVLEKEDAPKLLKKMGKLFAEQNK

SEQ ID NO: 53638 - protein, 355 aa, Schizosaccharomyces pombe 972h-
MTGVHEGTVLVTGGAGYIGSHTCVVLLEKGYDVVIVDNLCNSRVEAVHRIEKLTGKKVIFHQVDLLDEPALDKVFANQNISAVIHFAGLKAVGESVQVPLSYYKNNISGTINLIECMKKYNVRDFVFSSSATVYGDPTRPGGTIPIPESCPREGTSPYGRTKLFIENIIEDETKVNKSLNAALLRYFNPGGAHPSGELGEDPLGIPNNLLPYIAQVAVGRLDHLNVFGDDYPTSDGTPIRDYIHVCDLAEAHVAALDYLRQHFVSCRPWNLGSGTGSTVFQVLNAFSKAVGRDLPYKVTPRRAGDVVNLTANPTRANEELKWKTSRSIYEICVDTWRWQQKYPYGFDLTHTKTYK

SEQ ID NO: 53639 - protein, 784 aa, Schizosaccharomyces pombe 972h-
MVRSISSVLAKEESENGSPIPALEEGSVYHVSLKSEGVSPFSDRIQLNYLYDGKTFSDPSNLNIHQQEACLINELLNAFMGMEGVFVHLQDMKASSEFETIIMPPSFYILPGFDLGIKDIASEMLEMGSHYLSITAFIESRSHFEYGFVNHALCAALRKFVMDYVVLIMQCENQSRIDPNFSLQTLRLYTLPTSRSLRQVYLILRDLLLSMEKNASSSDDLGLSNIDDLLEQLNEGNDISHVVNATRSKKKVCKGGQVISFLTESLTKYAGDPVARKILTYLLREASRPYTKMLNEWIHLGLVNDPYDEFMIKIHKGITSMQLDEDYTDEYWEKRYVIREDQVPPQLLDLQNKVLFAGKYLNVVLECRKGVNNLASLNAKDDTQNQLLWPSTFDDDNFTLNIMNAYVYANESLLQLLQSSQSLYAHLYSLKHYFFLDQSDFFTTFLDNAQHELRKPAKYISITKLQSQLDLALRQPGTITATDPHKEYVTVEVNQTSLIDWLMHIVSISGLEEGTSSQGNEVWNESITKQADVGNETRNFESEHNRSTQGTSKVGSDKDINGFETMQLCYKVPFPLSLILSRKAIIRYQLLFRYFLLLRHVEMQLENSWVQHSKNSAWRLNSSNAKIEQWKRNSWLLRTRMLSFVQKIIYYTTSEVIETHWGKFMGELENARTVDNLMQEHIDFLDTCLKECMLTNSRLLKVQSKLLNTCAMFASYTSTFTRSLYLLENSEESFDEGRMDKMEEILRRYEDSFSRHLKSLVNACNYFASTETAALLSLVMKLTG

SEQ ID NO: 53640 - protein, 167 aa, Synechococcus sp. WH 5701
MSSFVWPEPSVHPEAWVAPSAVLIGDVSLGPGASLWPMAVARGDLCSIQIGANSNVQDGAVLHGDPGQPVLIGAGVTIGHRAVVHGATLGDGCLIGIGAIVLNGVQVGEGALVAAGAVVTRDVPARTLVAGIPAKAKRSLSELEAAEQLQHALRYSQLAAAHAGRGT

SEQ ID NO: 53641 - protein, 305 aa, Methanocaldococcus jannaschii DSM 2661
MHLLDLDVLSREDVLKIIEYGIYFKKNRRKHEKILEGKSVAILFEKPSTRTRMSFDIAVYELGGHPLIMNQNEIHLGKKESIKDTAKVMGRYVDTIVARVYKHRHLEEMAKYSSVPVINALSDLAHPCQILADLMTIKEYKGKFKGLKIAYLGDGNNVCNSLILGSALVGMDTYVGTPKGYEPNAKVVLKAKEIINNYGEGSLTLTNDPIEAAEDADVLYTDVWISMGDDKDKEEVLKIFPPFQINSKLLEYAKDDVIVMHCLPANRGYEITDDVIDGEHSVVYDEAENRLHVQKGVFKFIFERK

SEQ ID NO: 53642 - protein, 295 aa, Physcomitrella patens subsp. patens
MAMAMTGAAVVGGCAVKSPAAVLPQQTTMQSSLWGEKAPVGKAIAATSGRVHRPVVEATSRVDKFSKNDIIVSPSILSANFSKLGEQITAVEKAGCDWIHVDVMDGRFVPNITIGPLVVDAIRPVTDLPLDVHLMIVEPEQRVPDFIKAGADIVSVHCENASTIHLHRTINQIKSLGAKAGVVLNPGTSLAQIEYVLDCVDLILIMSVNPGFGGQSFIESQVKKIRDLRKMCEILGVNPWIEVDGGVTPKNAYKVTEAGANALVAGSAVFGAKDYAKAISGIKTSKRPQETSVAV

SEQ ID NO: 53643 - protein, 623 aa, Arabidopsis thaliana
MKLGLFTLSFLLILNLAMGRFVVEKNNLKVTSPDSIKGIYECAIGNFGVPQYGGTLVGTVVYPKSNQKACKSYSDFDISFKSKPGRLPTFVLIDRGDCYFTLKAWIAQQAGAAAILVADSKAEPLITMDTPEEDKSDADYLQNITIPSALITKTLGDSIKSALSGGDMGNMKLDWTESVPHPDERVEYELWTNSNDECGKKCDTQIEFLKNFKGAAQILEKGGHTQFTPHYITWYCPEAFTLSKQCKSQCINHGRYCAPDPEQDFTKGYDGKDVVVQNLRQACVYRVMNDTGKPWVWWDYVTDFAIRCPMKEKKYTKECADGIIKSLGIDLKKVDKCIGDPEADVENPVLKAEQESQIGKGSRGDVTILPTLVVNNRQYRGKLEKGAVLKAMCSGFQESTEPAICLTEDLETNECLENNGGCWQDKAANITACRDTFRGRLCECPTVQGVKFVGDGYTHCKASGALHCGINNGGCWRESRGGFTYSACVDDHSKDCKCPLGFKGDGVKNCEDVDECKEKTVCQCPECKCKNTWGSYECSCSNGLLYMREHDTCIGSGKVGTTKLSWSFLWILIIGVGVAGLSGYAVYKYRIRSYMDAEIRGIMAQYMPLESQPPNTSGHHMDI

SEQ ID NO: 53644 - protein, 416 aa, Arabidopsis thaliana
MSSTFRAPAGAATVFTADQKIRLGRLDALRSSHSVFLGRYGRGGVPVPPSASSSSSSPIQAVSTPAKPETATKRSKVEIIKEKSNFIRYPLNEELLTEAPNVNESAVQLIKFHGSYQQYNREERGGRSYSFMLRTKNPSGKVPNQLYLTMDDLADEFGIGTLRLTTRQTFQLHGVLKQNLKTVMSSIIKNMGSTLGACGDLNKNVLAPAAPYVKKDYLFAQETADNIAALLSPQSGFYYDMWVDGEQFMTAEPPEVVKARNDNSHGTNFVDSPEPIYGTQFLPRKFKVAVTVPTDNSVDLLTNDIGVVVVSDENGEPQGFNIYVGGGMGRTHRMESTFARLAEPIGYVPKEDILYAVKAIVVTQREHGRRDDRKYSRMKYLISSWGIEKFRDVVEQYYGKKFEPSRELPEWEFKSY

SEQ ID NO: 53645 - protein, 481 aa, Opitutaceae bacterium TAV2
MHGSPSSAPNSQTHNADGTLKRGLKNRHIQLIALGGAIGTGLFLGSAGVIKLAGPAMMLGYLIGGIIEFLIMRQLGEMIVEEPVAGSFSHFAYKYWSGFAGFMSGWNYWVLYVLVGMTELTAVAKYIHYWVPDMPQWIPVLVFFVLINAINLANVKIFGEAEFWFAIIKVLAVIGMIVFGGWLLFSGGAGPEAKVSNMWEHGGFFANGFKEFCIALVIIMFSFGGLELVGVSAAETAEPYKTIPKAINQVIFRILIFYVGAVAVMLMLKPWTQMAADIVAAGQAGDSYGASPFVLILKQMHIPNAAHILNFVILTAALSVYNSGVYCNSRMLYGLAMKGNAPRAMLKLDKRGVPVVAIAVSAAGTGIGVLINYAMPAKALEYLIALVVAALVLNWALISFTHLKFRQAKQREAHVSRFPSWGAPFTNYLCLAFVGFILVIMATLAGMWTSVVLIPPWLLLLWIGWKIRSSKQDAIGLADAK

SEQ ID NO: 53646 - protein, 473 aa, uncultured crenarchaeote
MGTVTVMKFGGSTLGEDGVCIDKILQRIRNKIEGQNKVVAVFSAPLIRYRDKLSSMTDAAIHIGKNYAQSNPIEIDVLREVYETIASNNLSQEYRKNFSNDIDKFHKQVIVSLKQAAENRRFVDVTRSRTLAYSGEIPMAYLMDYVLRSNQIKSDHVDIEQWPIITDDNFEAANFLIEESRQRSNHFYELIEKNSVVTIGGFIGKTSDGLETTYERGGSDRSAADVAILLNEKYKAELDFEKDNAVLSADPKIVKEELDSIKFLSYNEARLAGMFGMKILDPLAIKEIDNNKMDIPIVITNMNDPSNTTTISKISVDQSDNLVKIVTGKRNCAIVRMETIAASHLLASLESYRQYHDFLKLSPFKKDGIEITRVLFLDGDYVRRNEHHFKAYYPKTEIVYDRGVVTLIGDNMWKMPKIASTTSSTVGEHGINILNLDAQEETSRILIIVDDSKVADAIRAIHDKRNRIDRDEI

SEQ ID NO: 53647 - protein, 334 aa, Arabidopsis thaliana
MSNYAAGLGKPGSGKRRIRDLLNQPDNRVCADCGASDPKWASANIGVFICLKCCGVHRSLGTHISKVLSVTLDEWSDEEVDSMIEIGGNASANSIYEAFLPDTCSKPGPDVNHDQRMRFIRAKYELQEFLKPSLRITSGKGSTKSSAFLTSSLSRKIMDSFRTNSSSQTMEGMVEFIGLLKVTIKKGTNLAIRDMMSSDPYVVLNLGKQKLQTTVMNSNLNPVWNQELMLSVPESYGPVKLQVYDYDTFSADDIMGEADIDIQPLITSAMAFGDPEMFGDMQIGKWLKSHDNPLIDDSIINIVDGKVKQEVQIKLQNVESGELELEMEWLPLDQ

SEQ ID NO: 53648 - protein, 337 aa, Streptococcus agalactiae A909
MTQVFQGRSFLAEKDFSREEFEYLIDFSAHLKDLKKRGVPHHYLEGKNIALLFEKTSTRTRAAFTTAAIDLGAHPEYLGANDIQLGKKESTEDTAKVLGRMFDGIEFRGFSQRMVEELAEFSGVPVWNGLTDEWHPTQMLADYLTIKENFGKLEGITLVYCGDGRNNVANSLLVAGTLMGVNVHIFSPKELFPAEEIVKLAEGYAKESGAHVLVTDNVDEAVKGADVFYTDVWVSMGEEDKFKERVELLQPYQVNMDLIKKANNDNLIFLHCLPAFHDTNTVYGKDVAEKFGVKEMEVTDEVFRSKYARHFDQAENRMHTIKAVMAATLGNLFIPKV

SEQ ID NO: 53649 - protein, 434 aa, Oryza sativa Japonica Group
MQVLNTMVNKHFLSLSVLIVLLGLSSNLTAGQVLFQGFNWESWKENGGWYNFLMGKVDDIAAAGITHVWLPPPSHSVGEQGYMPGRLYDLDASKYGNEAQLKSLIEAFHGKGVQVIADIVINHRTAEHKDGRGIYCLFEGGTPDSRLDWGPHMICRDDPYGDGTGNPDTGADFAAAPDIDHLNKRVQRELIGWLDWLKMDIGFDAWRLDFAKGYSADMAKIYIDATEPSFAVAEIWTSMANGGDGKPNYDQNAHRQELVNWVDRVGGANSNATAFDFTTKGILNVAVEGELWRLRGEDGKAPGMIGWWPAKATTFVDNHDTGSTQHLWPFPSDKVMQGYAYILTHPGNPCIFYDHFFDWGLKEEIERLVSIRNRQGIHPASELRIMEADSDLYLAEIDGKVITKIGPRYDVEHLIPEGFQVVAHGDGYAIWEKI

SEQ ID NO: 53650 - protein, 215 aa, Oryza sativa
  misc_feature (207)..(207): Xaa can be any naturally occurring amino acid
MNALAAPTRHFLQALMLLLLHANLDKSHRQPLPEIKAEGTIPKDEGALASFIGFGAHLDHAHGPVKRGIRYHPEGDPHEVNALAQLKTWKTGAGAIPYGGAHGGIECAHDELITSELERWTRVFTQKIHDLIGAHTDVPAPDMGTNSQTMAWILNEYSKFHGHSPAVVTGKPIDLGGSLSRDAATGRGVMDATEALLAEHGKSIFGXTFGIQGFG

SEQ ID NO: 53651 - protein, 254 aa, Rhodobacter sphaeroides 2.4.1
MDYRTVFRLDGACAAVTGAGSGIGLEICRAFAASGARLILIDREGAALDRAAEELGAAVASRIVADVTDAEAMTAAAAAAEAVAPVSILVNSAGIARLHDALETDDATWRQVMAVNVDGMFWASRAFGRAMVARGAGAIVNLGSMSGTIVNRPQFASSYMASKGAVHQLTRALAAEWAGRGVRVNALAPGYVATEMTLKMRERPELFGTWLDMTPMGRCGEPSEIAAAALFLASPAASYVTGAILAVDGGYTVW

SEQ ID NO: 53652 - protein, 615 aa, Ostreococcus tauri
MALGAREDLGDARFVGIETLSDSGSTPDACVRRALTRGFDFVSVSVAIDEFATSVDPSTYPAKPLTHGDRALSGSEWSTRVVLRCSPEVERLAGAGDARGTRALNRELKWAAHVGAHAVAMNINAGDPTLIGRLLGSHVASVGETTRVWARTRMSGDKAFDDDAYRRWAATSAACDENSNVRAYLHITGAPKERREWERWLGERVAACALSVDSFVPNARGFPVLPKELQALVRAMFERGIQVVLTDYNESGVAAKKITPESVENEGERVSGDAAHSFRLYWEYLVYIFRGIEPLSEQALAEVPYRDHLQAPLQPLMDNLESVTYETFERDASKYIQYEEAVRCALLDVVDEDQEGTVMVVGAGRGPLVRASLRAAERARRKIIVYALEKNPNAIVTLQHLLVEEGWQEAVHIIPGDMRTAKLDAKADVLVSELLGSFGDNELSPECLDGAQRFLKPTGVSIPRSYESFIAPIVSAKLHDAVVAHSVWRPETFWKFEHPNHDGCIDNEPTFPRTLHGFAAYFDSTLYNGPAGHVRCQYSSRKPHDGPTGAPMFSWFPMYFPIRSPILIDSRSASSIEFVIWRRVDVHKMWYEWAVTAPSRGHVHNLNGQSYWIGL

SEQ ID NO: 53653 - protein, 341 aa, Triticum aestivum
  misc_feature (108)..(108): Xaa can be any naturally occurring amino acid
MDLSVTLALNSPTEHGEQLRRRQHSLSELSYARDEDATKLETTRARLLNVLKRHEDLKERLSRDSDKLIFERLQKEFEAARVAQTEEISIDDEQWNDGLLATIREKTXVHIEAERKAMINLANVPTDSQFQSRTTYRIRNKVIYCLDGARIGIQYETFFAGEPCEIYHCVLESKSFLEKMTVTEHTLPFFLPIREVETDHLSSNAIKFIDHLEEILQSYIDRREQVRLIKELYGNQIGELFYSLPYTLIEFTLEDFECKVTVSIRYSDLILTLPSQARVLAWPLRSAKRISAADRRAQPVPSRLSYAESALKTLSLPEAYAEIVLELPRALKQMFYSQESD

SEQ ID NO: 53654 - protein, 172 aa, Glycine max
MANPKVYFDMTIGGQPAGRIVMELYADTTPRTAENFRALCTGEKGVGRSGKPLHYKGSTFHRVIPNFMCQGGDFTAGNGTGGESIYGSKFADENFIKKHTGPGILSMANAGPGTNGSQFFICTVKTEWLDGKHVVFGQVVEGLDVVKDIEKVGSSSGKTSKPVVVADSGQLS

SEQ ID NO: 53655 - protein, 587 aa, Yarrowia lipolytica CLIB122
MQFLPTLVLLAQCPDNVVCMLPLRSFKLRLLLASAVDPVALQDIHDDLPTLAEFVDSLRHLASLIPIGLHLARSTQENQTIIDHLSVPVLSGFLQRLTMPAVKPVTPVDAAPAGLAPTRTPTAPLDLEKIALSPDVFDHSPIFTLKTHTSFSSVGSSSLTGSASSCTTMVSSPTWNAKVSRSHLAELLDEPLASSTMFTFENEIKQLVNEPSAVFLLSLAKAQLSPMKTHIELCPHASLDECSSDCLNKVRFVPQIMAHTERPLEDCSYLDKCYKSKSCRFLHYQVKMPDYSSSPQRQNRAKNHNSAPVEQPRSYFYSTDPMLSVVLPPQWITCNLKEIGLPVFGDFAAIIADPPWDIHMNSQKLIINDSDLQALDMGCLQKEGVFLLWVTGRTSEVGRKCLAKWGYTDVQEIVWCKTNQLGRTICTGRTGHWLNHSKEHVLIGVKGNPEWLTRGLDVDTVVSNARDKSQKPDELYDIVERMVGKSCRKLELFGRENNLRPGWLTVGSQLNGVNILEPDLAERYERWRVAHQVAIPGDQREGHAPPKEREQRELLSKGGHSSGHHNGKDSPGRNNNKSRGMGRRRRS

SEQ ID NO: 53656 - protein, 422 aa, Methanococcoides burtonii DSM 6242
MTEISSMVITHAKATVEEMEDSWHGDIDLVLSQLYSNELVYECAVLKTCNRVEIYVVSSKGSSVLFHYAKEMGVSAKIVEFYDHDESLRHLLRLACGLESMIIGEDQILGQIKDFFLMAKGAGTVGKVLSTAFSKAIQVGKRVRTETFINRGAVSIASAAVDLAEDILDGLNDKHILVIGTGEMGTLVTRALSHRDMHVIYLANRTYEKARDLAEELGGEAVMFDQLEKYVRAADVVISATSAPHYVLKGDLVAKVMEGRENELLLIDIASPRDIDPAVEEIPHVILRNIDGLRVINEKNLQMRMVEAKKAEIIIDDELDMVKAQYKRQKADAIISNLYSQSHGLRHNEMEHAINKLSAYHTIGEIERKVLEDLTHAITNKILAEPTKKLRNAAEYDDDKFLDSVSRLFDIRPIKKNDGITK

SEQ ID NO: 53657 - protein, 147 aa, Campylobacter jejuni subsp. jejuni NCTC 11168
MEKYNREEFEEVIVDIGRVTKVVKGGRRFRFTALVIVGNRKGLVGVGYGKAKEVPDAIRKAVDDAFKNIVEVKTKGSTIAHDVEVKYNASRILLKPASEGTGVIAGGSTRPIVELAGIKDILTKSLGSNNSANVVRATIKALTMLKG

SEQ ID NO: 53658 - protein, 492 aa, Physcomitrella patens subsp. patens
MRRAGLNLIPGLSFTHSVLQRQTENLKDLYRLERKLGQGQFGTTYLCVEKATGREYACKSIAKRKLISQEDVDDVRRELHIMHHLSGHPNIVTIKGAYEDQMAVHLVMELCAGGELFDRIIQRGHYSEAQAAELCRVIVGVVETCHSLGVMHRDLKPENFLLSDQSEGAALKTTDFGLSVFFKPGEVFTDVVGSPYYVAPEVLRKHYGPEADVWSAGVILYILLSGVPPFWAETEQGIFEQVLKGELDFVSEPWPSISDSAKDLIRRMLDPNAKRRLKAHQVLSHPWIGEEGVAPDRPMDPAVQSRLKQFSAMNKLKKVAIRVIAELLSEEEIAGLREMFKMIDTDHSGTITFEELKSGLERVGSNLVESEIRQLMDAADVDQNGTIDYGEFLAATLHLNKIEREENLFAAFSWLDKDNSGYLTVDELQQACSKYNMGETSIEDLIREVDQDNDGRIDYNEFVTMMRKGNGAVGRTTLRNSLSLSDALMNPQ

SEQ ID NO: 53659 - protein, 373 aa, Silicibacter pomeroyi DSS-3
MSFETPGPVEARLRDAISPIEEIIDEARKGRMYILVDHEDRENEGDLCIAAEFADAAAINFMATHGRGLICLPMTADRIDRLGLPMMAVNNSSRHETAFTVSIEAREGVSTGISAADRALTVATAINEQNTMASLATPGHIFPLRAKRGGVLVRAGHTEAAVDISRLAGLNPSGVICEIMKEDGTMARLPDLVDFAERHGMKIGTISDLISYRARNDNLVDETARSTVTSEYGGDWEMRIFTDQTHGIEHVVLVKGDISTPEPVLTRTHALHEASDVLGLGPKPTQELPRAMEKIAAEGRGVVCLFRQPRNALYASDEDGVRTIKQTGLGAQILSKMGLHELILLTDSPQTRYLGLDAYGLTIVGTRPILKDA

SEQ ID NO: 53660 - protein, 589 aa, Oryza sativa Japonica Group
MASKAMPRAPPAAPNLQSLKLCSQNDSSLETTSPSKRSALVPGRSAESSKPNPEVVQKEQKSTQHQNESIDLTGSNDPAEVKAEGNLVPKRLADEEKGVVEDGIANGSLKSSSALGKEHGIASASGSARLVGRSETGERGFSSSRCRPSTSSDVSDESACSSISSVTKPHKANDSRWEAIQMIRTRDGILGLSHFKLLKKLGCGDIGSVYLSELSGTKSYFAMKVMDKASLASRKKLLRAQTEKEILQCLDHPFLPTLYTHFETDKFSCLVMEFCPGGDLHTLRQRQRGKYFPEQAVKFYVAEILLAMEYLHMLGIIYRDLKPENVLVREDGHIMLSDFDLSLRCAVSPTLIRSSNPDAEALRKNNQAYCVQPACVEPSCMIQPSCATPTTCFGPRFFSKSKKDRKPKPEVVNQVSPWPELIAEPSDARSMSFVGTHEYLAPEIIKGEGHGSAVDWWTFGIFLYELLFGKTPFKGSGNRATLFNVIGQPLRFPEYPVVSFSARDLIRGLLVKEPQQRLGCKRGATEIKQHPFFEGVNWALIRCASPPEVPRPVEIERPPKQPVSTSEPAAAPSDAAQKSSDSYLEFDFF

SEQ ID NO: 53661 - protein, 183 aa, Silicibacter pomeroyi DSS-3
MAGHETHYTLPRPEFDKPVKLLIVVAPYYKDIADNLVAGAKAEIEGVGGSWDLVEVPGALEVPTAIAMADRQSNFDGYVALGCVIRGETTHYDTVCNDSSRAIQLMGLQGLCIGNGILTVETRPQAEVRADPGAMNKGGGAAAAALHLIALGRKWGASRKDVGFRPKADDILLAEDKNGSRTA

SEQ ID NO: 53662 - protein, 312 aa, uncultured crenarchaeote
MKNNRFFNRDVVSIKDFQRDDLEYLFKKTDEIKKLNPKEKDELGKARIMGYLFYEPSTRTRMSFEAAMASIGGSSIGISDLKSSSIEKGESLQDTVRVMDLYSDIMILRHQLDGSSKFAAEISDHPIINGGSGSEEHPTQAMLDLYTMTKEKKKIDGLKICILGDLKYGRTIYSLLYGLSNYDVEIILVSPPTLQIRQESIYGLKNKMKIVELVEMDEKVFRDTDILYVTRIQKERFSDPQEYEKVKGAYTIDSNILKQFQSDIAIMHPLPRIDEISQDVDSKTNAIYFKQASYGKDLRSALLALILNESPL

SEQ ID NO: 53663 - protein, 702 aa, Kluyveromyces lactis NRRL Y-1140
MTESGNGIVNTRQPKLFLDVPDMTSEAKKTYAELDVCTYTPKNLGDSKHEFMECDCFEEFRDGLNHACGEDSDCINRATLIECVNGLCKHSCGTDCQNQRFQKKAYADISVFKTERKGFGVRANSDIEPHNFIYEYIGEVIQEEEFRNRMVKYDQMGFKHFYFMMLQTGQFIDATLKGCIARFCNHSCNPNAYVNKWVVNGKLKMGIFANRHISKGEEVTFDYNVDRYGANAQPCYCEEPNCIGFLGGKTQTDAASLLPQSFADALGIRPSMEKKWINMMKAKGEKIAKSDTTTVNVDFVNSLSLEPCTKTEDVNRVMSVLLQIDDAFIAEKLLERITLTEDEAMHYQFIKLHGYLIFSRLITMFEDKPDIIWKILNFLLVLPKTTKNGIIHSGIDKKVEQLKNTPKFEVICEDLLEKWSKYETYTRISKKDISENSKVIDLRRIRLPIGWEIIHENGRPVYYNAQRQIKQANPPTDSAYRSNSSHNLSGVSDPKSRSATPSSNTSRYSGSVKYIPTPTYGQMQQKRTLSPEEYEKRKKSRIEWEQKELELRKLMEQETLKAKLDQETQKKSELERIIEEANKQKELERLQKLKQQQEDEERKKVKKQASHVNAIENKWVKFFAQHVPNLIKNYQKDVGKDVLKESARNIVKSLAQKELKKDSSRSPPEELSKEKRAKVKTFSMQYMDRLVAKMKEKKEKKR

SEQ ID NO: 53664 - protein, 685 aa, Ostreococcus tauri
MLRLHHGASALRFARPRPRFGRSARAVTPTKAGLLDSFRNVSKRSQNGAKSATGTTSEVDVAALERAVKLETAPVRQGEKNEANTKRRAVMAGNWKLNPKTAADAKTLAALVGAARRDVDADVDVFVCPPAPFLADVNSSSSEFLEGSGVAVGCQNIYWKDSGAFTGEMTAEMAKSVGCTHVLVGHSERRELFGETDEHTRLKTRKAIDCGMTAVLCIGETKTEYEAGQARRVCSRQLEAALEGVQADELSQVIVAYEPVWAIGTGLTATPAIAQSVHAGIRQWFREKYGDGAASKIRIQYGGSVKPETVDELMQAPDVDGCLVGGASLVAEQFGRIFNFDPTPEGPRKLWAEEVVPCGNQLGESPIWSEERQTLYWVDAPAGTLFSWDLKSAPVRTNFGEVLGCVGLRSGGTLILGLESGLHAFDPATKKLKLLSEFEPGLNTRPNDGRVDRFGNFVIGSYNNAHRVDAAPIGGLWRLRAKGQELEEILDYKFRCSNCICFTKSGTTMFFCDTPTRKIYQFDYDPRVGPMNRRLLYELPSSVPGGPDGAQCDDDGNLWAAISGAGKVIRITPEGKVNLEIELPVKQPTSVTIGGPMLDTVFITTRAENGRNDAGSLFACRVDDTRGIPEPEYADSTSLANAETLTPGLTRAEQSAAKSKFCSDCGVAFASKTARFCANCGARRS

SEQ ID NO: 53665 - protein, 337 aa, Coccidioides immitis RS
MKHHLWLAMALLQSGALSALPKPRVAFLGPLGSFSHEAAVASFGSEATILPQASFQDAFAALQANESDYAAIPLENSSNGAVVQVLDLLADRKGLYGDVAICGEHYLPVHHCLLVKKADGGQTSPPPVDITTDPRYEAITKLYTHPQAWGQCEVFLSKYFKGVERQDVSATSKAAEIISKEPGNSSAAIASRFAAEQHGVDILAENIEDDSENTTRFLLFRNRKSDTPKLCGHEDQKKPDESDKNAMRKALISFTIDHSSPGALANALFIFKKFSMNLTAINSRPSGIRPWQYIFFVECQGPAKRNDRNVEKIMAGLTSVTHSSQHLGSWDDMLGSN

SEQ ID NO: 53666 - protein, 385 aa, Bacillus halodurans C-125
MIRIFQTVLLAIVSAIVGFMIISITFVEYWSHTEAGKVPPKTAVLLHAIHHNLVTPDMRPPKFLTQSNGHSRFKTELIQIPVSDGASIPARVYQPKASGPHPIILYYHGGAFLEGYGDINTHDNIVRALAVRTGSIVVAVGYRVAPGHPFPTAIEDSYDALDWISKNAELFNGDPANVAVVGDSAGGNIATVVSLMARDREGPEISAQVLLYPLTTFQDVAFPSRDHYDSGYYLLSRAVMVQAREKYTPQQESWLNPYTSPLNADLEGVPPAFVVTAEFDPLRDEGEMYAQSLADAGVPVQAIRYNGVMHGFVSFYEVMERGDDALHQASMFLKKSFYDDMDAKPYELVIDDVPSAQVAIKDRLEAYAIGGFLIGKQSLSLFSGW

SEQ ID NO: 53667 - protein, 145 aa, Ostreococcus tauri
MGRCARGKGNGRRRRTSRARGPILTDDAIVARCAAAKAKQVRRGVKEVVKALKKDVKGFAVIAGDISPIDVITHVPILCEEADVPYVYVHSKEELGAAGMTKRPTSVMLVLKEGAKGSVKMSSEDKKEFDEMYAKCVEKIQAMSK

SEQ ID NO: 53668 - protein, 382 aa, Magnetospirillum magnetotacticum MS-1
MSKQDYYDLLGVEKGASPDDIKKAYRKQAMQFHPDRNPGNAEAEQKFKEINEAYDVLKDEQKRAAYDRFGHAAFEQGGPGGGGGGGFGGFGGGGFSDIFDEMFGEFMGGGRRGQSTGRGADLRYNMDISLEDAFAGKTTTVKVPSSAPCEDCKGTGGKDGAAPVTCSACHGHGKIRQQQGFFTIERTCPTCQGMGKIIKDPCRSCGGSGRTRKEKTLQVNIPAGVEDGTRIRLAGEGEAGMRGAPPGDLYIFLSIAAHRIFQRDGANIFCRVPIPMTTAVLGGTIEVPTIDGSKAKVTIPEGTQTGNQFRLRSKGMSVLRSPARGDMFIQAVVETPVNLTKRQKELLHEFNEAGEGEKAKNSPESQGFFAKVKELWEDLKEG

SEQ ID NO: 53669 - protein, 263 aa, Streptococcus pneumoniae TIGR4
MVRPEQGLMALRKELNLYANIRPVKIFDSLKHLSPLKLERIAGVDFVVVRELTGGIYFGYHILEERNARDINDYSYEEVERIIRKAFEIARNRRKIVTSIDKQNVLATSKLWRKVAEEVAQDFPDVTLEHQLVDSAAMLMITNPAKFDVIVTENLFGDILSDESSVLSGTLGVMPSASHSENGPSLYEPIHGSAPDIAGQGIANPISMILSVSMMLRDSFGRYEDAERIKRAVETSLAAGILTRDIGGQASTKEMTEAIIARL

SEQ ID NO: 53670 - protein, 467 aa, Physcomitrella patens subsp. patens
SEDERSEEYCEGGYHPIRIGDCFDHGRYVVHRKLGWGHFSTVWLAWDSDSKQYVALKVQKSAQHYTEAAMDEITILKQVAEGDWNGRGGVVKLLDHFKHGGPNGTHVCMVFEYLGDNLLTLIKAYNYRGIPLPMVKKLAKGILIGLDYLHRKLSIIHTDLKPENILLLAPLDPTQDPRNSDYVPVDLPASPLPSSSLGSSPNLSKNQKKKVKRKAKKASGSSNDRDRQNVDTSPCLRVSEVSYEEPRNDGIVEETDKLLKDENGEGVCEEQSTVSEVPKSEHRSALPVDLENLDLRCKLVDLGNACWTYKQFTADIQTRQYRCPEVLLGSRYSTPADMWSFACIIFELATGDVLFDPQSGEDCDRDEDHLALMMELLGRMPRKVALSGKYSKDFFNRHGDLRHVRKLRYWPLDKVLMEKYEFDEEDAVQFAKFLVPLLDFVPEKRPTAAQCLKQPWLASVTPSAEEE

SEQ ID NO: 53671 - protein, 469 aa, Oryza sativa Japonica Group
MGGCFSLEEHRLQGKTEAGGPDGLRKCKSDSKATASVLAPPKDVEDLQIEGYGNVNIFTYNELRAATKNFRPDQILGEGGFGVVYKGVIDENVRAGFPSTQVAVKELNPEGFQGDKEWLAEVNYLGQLSHPNLVELIGYCCEGSHRLLVYEYMACGSLEKHLFRRVCLNMPWSTRMKIALGAARGLEYLHGAERSIIYRDFKTSNILLDADYNAKLSDFGLARTGPSGDQTHVSTRVMGTYGYAAPEYVMTGHLTARSDVYGFGVVLLEMIIGRRAVDKSRPSREHNLVEWARPLLVHNRKLFRIIDPRMEGQYSTKAAIEVAGLAYRCLSQNPKGRPTMSQVVETFEAVQNMPECQDILLQNCMTGAVTLYEVAKDPTESVEPEKIKQEQPAAKTVTVAPAPVNGKPVPQSRRTRPGNGRSKSEPSLECKLYIPSPDSDGQQPGLEALSSPSRDGSIKDPPDEDLYKI

SEQ ID NO: 53672 - protein, 371 aa, Mycobacterium leprae TN
MKVIIEADGGSRGNPGPAGYGAVVWIADRSAVLTETKQAIGRATNNVAEYRALIAGLDDAVKMGATEAEVLMDSKLVVEQMSGRWKVKHPDLIELYVHAQTLASRLASVSYTWIPRTRNSRADRLANEAMDAASCAEGRVDQAATQLAQSTKAVAKESQTAPGWTGARGTPTRLLLLRHGQTELSVQRRYSGRGNPALNNVGWRQARAAARYFAQRGGIAGVVSSPLQRAYDTAATVADLLGANLTVDDDLIEIDFGAWEGLTFAEAAARDPQLHHCWLHDTATLPPGGESFDDVLGRVCSARARIIAEYQGETVLVVSHVTPIKMLLRLALDAGAGILYRLHLDLGSLSIAEFYPDGASSVRLVNQTGYL

SEQ ID NO: 53673 - protein, 210 aa, Brassica napus
MEGKEEDVRVGANKFPERQPIGTSAQSDKDYKEPPPAPLFEPGELASWSFWRAGIAEFIATFLFLYITVLTVMGVKRSPNMCASVGIQGIAWAFGGMIFALVYCTAGISGGHINPAVTFGLFLARKLSLTRAVAPGYTKGSGLGAEIIGTFVLVYTVFSATDAKRNARDSHVPILAPLPIGFAVFLVHLATIPITGTGINPARSLGAAII

SEQ ID NO: 53674 - protein, 316 aa, Rhodobacter sphaeroides 2.4.1
MPTYDVSSIGFYVCDILGRPVTRIPDGGRADYIQEIRMTVAGTAGATAADCAILGLKTLAVTTVGEDEMGDFMVAKLTRFGVDCAMVARDGSVQTSATILPVRPNGERPALHVPGTAATFRIPEGRLDAALDARIVHVGGTGLLKSFDGAPTVEALRRAKELGRITTFDLIQATPETFELVRPCLPYIDYFVPSIEEASEMAGTTDPAEVARFFKGLGVKNAILTMGGEGVYVSPEAGEDFRLPAHAIEVVDTTGCGDSFTAGVIVGLARGWDLRDCCRFASAVAARVAMGLGSDGKLVSFEDTIEAMNTLPLRAN

SEQ ID NO: 53675 - protein, 472 aa, Rhodobacter sphaeroides 2.4.1
MRNIDRFFIGGAWTAPLGTDRHRLVNPATEEEIAAIPMASTEDVDRAVTAARAAFEGWQASSKEERLLLLRRLLDLYNEAYDELAELMTREMGTVARFSREAQAWVGRAHLEAAIEALEAESFEEMRGSTLISKEPIGVCALITPWNWPMNQLVVKVAPALAAGCTVVAKPSEFSPLSSIRFAELVEAAGFPPGVYNHITGAGPVAGEALARHPDVDMISITGSTRAGIAVARAAADTVKRVTQELGGKSANIILPDADLATAVRQGVLDCFGNAGQACKAPARMLVPAERMEEAAALAGAAAEALTVGAPEGEVDLGPVVNESQWRRIQSLIEAGIAEGARLVTGGPGRPDHLPRGWYVRPTVFADVAHGSTIATEEIFGPVVALIPYRDEEEAVRIANDSIYGLAGYIQTGDPETARRIARKLRVGMVYINGAGWDARAPFGGYKQSGNGREHGAWGLADYLETKATAGL

SEQ ID NO: 53676 - protein, 438 aa, Lysinibacillus sphaericus
MRKTKIVCTIGPASESSETLEKLIEAGMNVARLNFSHGSHEEHAGRIHLIREVAQKLNKPVGILLDTKGPEIRTHNMKNGELHLTAGQVIDISMTEVEGTETSFSVTYEQLVEDVEQNSIILLDDGLIQLRVLATDVEKGLIHTIVENAGVLKNKKGVNVPGVSVQLPGITEKDAQDILFGIEQGVDFIAASFVRRAKDVLEIRELLEQNGGGHIQIIPKIENQEGVDNIDEIILVSDGLMVARGDLGVEIPAEEVPLVQKKLILKCNQVGKPVITATQMLDSMQRNPRPTRAEASDVANAIIDGTDAIMLSGETGAGLYPVESVQTMNKIAQRTENSLDYKSIVSTRSREKEANMTEAISQAVAYTSINLGVKAVLAPTESGNTARMIAKYRPGVPIVAVTGSTNTAQTLTLVWGVHPIVCQRVTTTDEILELAVDE

SEQ ID NO: 53677 - protein, 778 aa, Yarrowia lipolytica CLIB122
MKMTTQRGKIKAPRAKTSSSVSFDKSWEILASAMTKIQDHESSPLSFELLYRTSYQLVISKMSAQLYDAVKCHISAHLDKVQAGFDPYVVVARDDLSLAPKFLEGLNKQWSDHQTCTKMIGDVMMYLDRVYCLDNTSSPPKLADLGLHLFRDHVVGTGPFAEYLYKVLINEIQREREGEMVDRIVIKNVLSMLDLLPQSKSNKESVLVHCFSDQLVAATTNFYSQAARDLLDGNKDPVVYVTKVSGWLEDEEKRSKYYALESQAYSPLVSDLTVKLVSTKLPEVMALPGSEIRKWYQAKKFDELKTLYRLISKGFPQRSLLHHLLKEQIVSEGQNLNSASNSAVEAARKEKKPSAQQTALAHKWVTDVLTMRDEFAEITAKCFDNDVEVVKSIDEAFVEFVNKHARVAEYLSLYIDNLMKKALKGKSDEEVAAILDSTVACFNFITDKDRFENYYKAHLGKRLLNSKSLSDDAERQLISRFKMAAGGAFTSKFEGMFKDIATSADEMEFFRKSRASITADSEPSSAKKVELTVALLSGTYWPTSIAQGANYTLIHCADAENAKEQFEQYYSKAHSGRKLEWVPNLGNADIRIKFKKKFHDVNVPNPVMPILMLFQDVGDQSISFHRIQMETGIPIPDLKRHLQSVSVAPKTRLLKKVPMSKDVNETDEFFFNENFEAPMTKIRVLAINATRAETDVERDATMVQIDKSRQNEIDAAIVRVMKSRKTLNHNNLVGEVTKQLASRFKPPIPTIKHCIESLLEREYLRRDDNDTTLFHYEA

SEQ ID NO: 53678 - protein, 106 aa, Brassica napus
MAHQEASTSPGAEVVGRAFVEQYYHILHQSPGLVHRFYQDSSLLTRPDVTGSVTTVTTMQAINEKIMSLKYEDYTAEIETADAQESYERGVIVLVTGCLTGSDNVG

SEQ ID NO: 53679 - protein, 404 aa, Zea mays
MASAATTLLKSSFLPKKAEWGSKHQLVAAHPRPATVVVSMVARASAYADELVQTAFAILLIIFLQKTIASPGRGILAMDESNATCGKRLDSIGLENTEANRQAYRTLLVSAPGLGQYISGAILFEETLYQSTVDGKKIVDVLSEQGIVPGIKVDKGLVPLAGSNNESWCQGLDGLASREAAYYQAGARFAKWRTVVSIPNGPSQLAVKEAAWGLARYAAISQENGLVPIVEPEILLDGEHGIERTFEVAQKVWAETFFYMAENSVMFEGILLKPSMVTPGAECEEKATPEQVAEYTLRLLRTRIPPAVPGIMFLSGGQSEVEATQNLNAMNQSPNPWHVSFSYARALQNTCLKTWGGRPENVKAAQDALLLRAKANSLAQLGKYTGDGEAAAAKEGMFVKNYSY

SEQ ID NO: 53680 - protein, 300 aa, Methanococcoides burtonii DSM 6242
MNIEQWDEYRQITDAMNEMISDMDDSPQMKKVVGHICRSGGKKVRPIILLLASRICGKGSENCTNAALAIELIHSASLIHDDILDEGVMRRGVESAHKKFGPAAAMLAGDYMISKSIELISIYSTPVVQEFGRAGMAMAEGETIDIKSTSEDFAEMNYFDCIDKKTASLFAASAVMGAYIAGADEKTASKLKNYGRKLGRAYQIVDDLLEYTQNIDNKKSDNKSISILQIYRRTMPYESAVEKAILLAMENVRMAKDILEEFDPSDSRSKLMTVTDHITMEMLPKTLKNLSDPGEQYAGI

SEQ ID NO: 53681 - protein, 505 aa, Zea mays
MGLRVAATAPAPAGVRVLGRGAARVTPRPWAAVGGRRRFSVRMSVATTEATTTIAVGASEDQALEARNSKTVVAVILGGGAGTRLFPLTRRRAKPAVPIGGAYRLIDVPMSNCINSGINKVYILTQFNSQSLNRHLSRAYDFSNGVAIGDGFVEVLAATQRPGTEGKRWFQGTADAVRQFDWLFDDAKSKDIEDVLILSGDHLYRMDYMDFVQSHRQRGAGISICCLPIDGSRASDFGLMKIDDTGRVISFSEKPKGDELKAMQVDTTVLGLSKEEAENKPYIASMGIYIFKKDILLNLLRWRFPTANDFGSEIIPASAKEIDVKAYLFNDYWEDIGTIKSFFEANLALAEQPPRFSFYDADKPMYTSRRNLPPSMVNNSKITDSIISHGCFLDNCRIEHSVVGVRSRIGSNVHLKDTVMLGADYYETAVERGELLAEGKVPIGIGENTTIQKCIIDKNARIGKKVVISNSEGVDEADRTSEGFYIRSGITVVLKNAIIADGLVI

SEQ ID NO: 53682 - protein, 474 aa, Hyphomonas neptunium ATCC 15444
MIKSHLQGENAKIVATLGPGSRSPREVRALAEAGVDVFRLNFSHGEHAAHLEALKAVRAAEAAVGWPLATLADLQGPKVRVGKFDGGSLKLGFRKEYRIIVGETAPDPETIPVPHAEIVAILEEGDTILADDGKLIFTVISGGSEPRVRAEVPGKLGDKKGFTVRGKALPVRALTEKDRADLDFALEIGVDIVALSFVQTVEDVEEVKAIIAGRAPLVAKLEKPAAIIHLEAIVAAADAVMVARGDLGVEFAPEEVPVIQRRIVRVARALGRPVIVATQMLESMIENSAPTRAEASDVATAIYQGADAVMLSAETAVGRHPATAVAIMSRIIRATEGADDYRRSLAEFCGEAQAENAIDIVAQAALTMAEAEGAAALALRTGAFERLARFARVRGCVPILYGSLDDQRLRQACLLWGVHPQRLNAGTENWYRDLMKAAGLEGRVTYARWSGDEERFAWEIGVGRGADGKPITGV

SEQ ID NO: 53683 - protein, 419 aa, Zea mays
MAATSMIRAPIGPNPRLACYAPARGGGVVRCSLQGAVVGGRAEWQSSCAMLSSKVAALGTHSINGHVAPAPAPAPAVLDLVPVSSMNGAVAKNLPQPLRIADLSPAPMHGSELRVAYQGVPGAYSEKAAGKAYPGCDAIPCDQFEVAFQAVELWIADRAVLPVENSLGGSIHRNYDLLLRHRLHIVGEVQLPVHHCLLALPGVRKECLTRVISHPQALAQCEHTLTGMGLNVVREAFDDTAGAAEHVAANGLRDTAAIASSRAAELYGMEVLADGIQDDSGNVTRFVTLAREPIVPRTDRPFKTSIVFAHDREGTSVLFKVLSAFAFRGISLTKIESRPHRRRPIRLVDDGNIGTAKHFEYMFYVDFQASLAEPRAQNALAEVQEYTSFLRVLGSYPMDMTPMTAGSSSTVSSSDPSSS

SEQ ID NO: 53684 - protein, 519 aa, Oceanicola granulosus HTCC2516
MDQHDTLLIIDFGSQVTQLIARRLRELNVYCEIHPFQNVTPALLAETAPKAVILSGGPASVIDAGSPRPPAEVFELGVPVLGICYGQQVMMEMLGGRVERGDGTSEFGRAWVERKGDKHPDLLTGWFLEAREQVWMSHGDHVAKLAPGFEVLGTSPGAPFAITGDRARHFYAVQFHPEVHHTPNGRTFLENFVKIAGFTGDWTMAAYKDEAIRLIREQVGDARVICGLSGGVDSSVAAVLIHEAIGDQLTCVFVDHGLLRQNEAEEVVGMFRDAYNIPLIHADEADLFLGELEGVSDPEVKRKTIGRLFIDVFQREANKIEGASFLAQGTLYPDVIESVSFSGGPSVTIKSHHNVGGLPEKMGLKLVEPLRELFKDEVRALGHELGLPASFIGRHPFPGPGLAIRCPGEITRDKLEILRKADAVYIDQIRKHGLYDEIWQAFVALLPVRTVGVMGDGRTYDYACALRAVTSVDGMTADYYPFSHDFLGETATRIINEVRGINRVTYDITSKPPGTIEWE

SEQ ID NO: 53685 - protein, 509 aa, Triticum aestivum
MEVWSIRAAQLLLFFFLLSERHGSCAALGEEGRAMGFREEHPSGWLWNLEEKKVFSAAATPLVKGKKLSIEIPNELQERIMISEVLTDGRQESCRKCLTKTIESNTLRQLLQARGLQESAPSSKAPDQFHESQAPMSSPPSHSQAETNDSSSVLHWVIYALCVSGALGLVIIASVVYLLVSRRKKDNTVNPWATGLSGQLRKAFVTGVPSLGRAELEAACENFSNVIGTVSDSALYKGTLSSGVEIAVASSPVKSAKEWSDRSEEQFRNKISELSKVNHKNFMNLLGYCTCDDPFTRMMVFEYAPCGSLFEHLHVREAEHLDWPTRLRIIMGVTYCLEHMNQLDPPVTPRTLNSSSIYLTEDYAAKFSDTEFWKDDDADASAPTRSAGQDSIVYKFGILLLEVISGRLPFSEDHGLLVLWASSYLDGKRPIGSMADPVLRASSPVPEEDLAALCDVVRLCINREAAKRPSMGEVAGLMKGAVRLSPEQTTPRNNPLWWAELEIMSTAST

SEQ ID NO: 53686 - protein, 505 aa, Arabidopsis thaliana
CEPFVKQSLQASCLLFIFFCCFNQRSLQSEALLMMESVKPLDVVSSGKGKLRRTFAKVINMKKLTGVVPEGNNKVERVKKSQEKVKLDKDLAKNAANLSESFDKLEEEYEKRLAMEALLAKLFATISSIKSGYAQLQYAQSPYDPNGIQKADNLVVAELKTLSELKQSFLKKQLDPNPDRTLVLAEIQELRSVLKTYEIMGKKLECQLKLKDSEIIFLKEKFQESMTQNKLMEKRLNQSGQLCNPLDHNLHLSAVSSTHFVTYLHHTVKSIRGFVKLMVEQMKLAAWDIDMAAELIQPDVLYYKQDHKCFALEHYVCKIMLEAFQLPYFSNESSKKTSREDKAMFFERFTELRSMKPREYLASRPKSRLAKFCRTKYLQLIHPKMEQAFFGHLHQRNQVTAGEFPETSLCTAFLEMAKRVWLLHCLAFSFDPEASIFQVSRGCRFSEVYMKSVSEEAFFSPEQEESSSETEPGVAFTVVPGFRIGKTTIQCEVYLSRSCQRRQSR

SEQ ID NO: 53687 - protein, 140 aa, Oryza sativa
VLTAMAWTEAYGGFSSALVWLLVMHSAQREIRERHHYTVDCIVAIYVGILLWKMTGFIWSREATSSNRRLNKFEKIQSRLIQASKDSDIDEVRELLKEFELSSEESKNQIGIKYARLFRSATIVFALTIVVLAFTLPSDG

SEQ ID NO: 53688 - protein, 160 aa, Oryza sativa Japonica Group
MEAAVPSRCGALREPALQPPPPRGERYAIYRGRCPNPAIPMALAAAAAPGKGGGVLDRPIEKVTPGRQSEFDVRKSRKMTPPYRVLLHNDNYNRREYVVQVLMKVIPGMTVDNAVNIMQEAHVNGLSVVIICSQSEAEEHCTSLRGNGLRSSIEPASGGC

SEQ ID NO: 53689 - protein, 175 aa, Lactobacillus delbrueckii subsp. lactis
MLYGDRSIENTDGTIRSLSNRHVQMIAIGGTIGTGLFLGAGTTISATGPSVIFIYAIMGLFFFFLLRALGEMFYFDSNSHTFVSFITRYLGEAAGRFAGWTYWIGILFACMAELTAVSTYVQYWLPGLPAWLIEVSVLGLLTLLNLTAAKLFGETEFWFAMIKIIAIISLVVTGI

SEQ ID NO: 53690 - protein, 402 aa, Coccidioides immitis RS
MAVELTSIKLNPENHLLLDQPLLRVPHELARRNFKSVQRIVEREKDYVLPALKETANASLSGSKNPTETIEALDAMITRMQGLKRKMEVLHEEEKKIATQSQKRIQYIQDLYKIPSLADVKYEQWSRTRLNRLLADHMLRSGYLESAKQLAEDKGIADLVDLSVFAQCQRIAHSLRRGETKEALQWCGENKVALKKIQNRLEFELRLQQYIEVLRVGDKAEARQHAKKFLTPHSETQSHDIQRAAGLLAYPPDTRAEPYMSMYSLERWKHLSDLFIRTHHDLLSLSSRPLLQIALSAGLSALKTPSCHSAIASSRASPLSLSTSICPICSTELNELARHVPYAHHTKSSVENDPVVLPNRRVYGMDRLSDMSKKAGVPEGKVKDPITGEIFDVSEVKKVYIS

SEQ ID NO: 53691 - protein, 128 aa, Panax ginseng
EGEDHQNKSKVVKVDSKDSWDFYVTQAATIQGCPIVAHFTAAWCMPSVMMNPYIEELASTHQNVLFLTVDVDEVKEVAAKYEIKAMPTFLMMKGGGQLVDKKLVGANPDEIKKWIAGLPHSSPISVVA

SEQ ID NO: 53692 - protein, 445 aa, Bacillus halodurans C-125; identical to SEQ ID NO: 1274

SEQ ID NO: 53693 - protein, 287 aa, Crocosphaera watsonii WH 8501
MNFLTELFSAPKSTEKSRKETEQIGLPRTKKGRRGVQIKSPEEVTIMRQSSLIVATVLKEIQEIVKPGMTTGDLDNYAEQRIREMGATPSFKGYYGFPGSICASINHEVVHGIPNAKRRIRRGDVLKVDTGAYYQGYHGDSCITIAVDKVSSKTSRLIRAAEDALYAGIREVKAGKYLADIAGAIEDVVHKYGYSVVEDYTGHGVGQNLHEEPPVFNYRTREIPNIKLKEGMTLAIEPIVNEGSKYTKTLRDRWTVVTVDNRLSAQFEHTVLVTATGYEILTDRTHI

SEQ ID NO: 53694 - protein, 130 aa, Panax ginseng
KHNGFLVFKFVDYNCTVEYYRAPFLVLQGRPPAKSPPKLRLTLKLDVVDWSSLKWRNADILVLNTGHWWNFEKTIRGGGYFQEGTKVKLEMQVDTTYRKSLETVVDYINRKVTTSKTLAFFRTYAPVHFR

SEQ ID NO: 53695 - protein, 159 aa, Oryza sativa Indica Group
MGVQWTPPFRRATIRPGTLQLCAGHRCLVFQLAHADAAVPAALRRFLADERVVFVGYGVRSDCRKLEEQHGLEVARTVELRSLAGMGNTSMQRMAEEHLGWDGVTTKPRKVGTSRWDARRLSKEQVQYACVDAYLSFRLAVHVVAAPEPDATSSTSSSE

SEQ ID NO: 53696 - protein, 517 aa, Synechococcus sp. WH 5701
MESLETQVERHWQAFLSLRNDLERFRFAVALRQANLTLFHRFLADHIEAVMPIVYTPTVGAAIQRFSLDYRTPSGGVFLAAPDLERIESVLSQAATGPVDLILITDSQGILGIGDQGIGGIEICLGKLAVYTLCAGLDPARVLPLVLDVGTDRVELLENPLYPGWRHPRLDGLDYDRFLARSVEALQRQFPGALLHWEDFGTGHAHQLLERYRLQLPSFNDDIQGTRGVACAVVKAASHGAGLPLEDHRIVVFGAGTAGCGIAEGLVRLLTRAGLSEPEARRRIWAIDREGLVLADQPGLSPMALALARDPSERSLFEHDTQGRIGLLEVVRAIQPTVLIGTSTVTGAFSREVVDTMAAAVERPIILPLSNPTRLAEATPADLYAWTGGRALVASGSPFEPVSWQGSLRRIGQCNNCFLFPGLGFASVAVGATQVSEGMIDAGLDALADRIPAFRDPEAPLMPELTQVQAVSRAVAEAVALAAVHEGLASRAASAEEAIERLDQATWTAAYRELEAI

SEQ ID NO: 53697 - protein, 102 aa, Synechococcus sp. WH 5701
MGNSELFPAMASFTITLEDGKSFSCPDDQYILDAAEEQGIDLPYSCRAGACSTCAGKILSGSVDQSDQSFLDDDQIGEGFALLCVSYPLADCTIKPNVEDDL

SEQ ID NO: 53698 - protein, 408 aa, uncultured crenarchaeote
MGSIRFLKCRECGAEYTPVFKYICDECFGPLDVIYDIPSNLTKETFTSRQDKTYWRYFELLPIADKNHIVNIHAGFTPLQHAEDLGTRMGNLKNLFIKNDSVNPTFSFKDRPAGVAISRSREIDLKAVGCASTGNLASATAAHAAKAHLPCYIFAPSDIEKVKIAQALSYGAKFVAVEGTYDDANRVASIIGDSKGIGIVNINMRPYYVEGSKTLAFEVAEQLDWQVPDHLIIPVGSGAMLNAICKGFEELHEIGLIDDVSNLKITAAQPHGCAPIVDAFKNKTGEIVPVERPETIAKSLAIGDPGDGVYVLRRLKQYGGIAEEANDNEIVEGILTLCRTEGIFTEPAGGVSIAVLKKLVDDGFIERNEKVVCYVTGNGLKSTEAIMSALPKLDVVKPDVQTVSAMIS

SEQ ID NO: 53699 - protein, 207 aa, Oryza sativa
  misc_feature (59)..(59): Xaa can be any naturally occurring amino acid
  misc_feature (122)..(122): Xaa can be any naturally occurring amino acid
  misc_feature (148)..(148): Xaa can be any naturally occurring amino acid
MAVATQSGGIAAEYKHKKKKEKKKSLSSGLVGDGKLRFSWTLPDHPKLPKGKPVTVVVXLDGWGEADADQYNCIHVAETPTMDSLKKGAPEKWQLVKAHGTAVGLPSDDDMGNSDVGHNALXGAGRITAQGATLVDTALATGKIPEGXGFKYIKESTDQGTLHLIGSSSDGRVHSPIAQMHILLTGASATGAKQIRDQILRKDEMNG

SEQ ID NO: 53700 - protein, 327 aa, Rubrobacter xylanophilus DSM 9941
MQTRKLVKEVRMAAPGLSESVLEAIGDTPLIEVEEGIYAKLEYLNPSGSIKARIARYIVEKAEREGLLLPGHTIVEATSGNTGNAFSMVAAIKGYRMVVLMPEGLSTERVAISRAFGAHIEHVGEFYVTEALKRARELGKKEGYFCPAQFDSEWNVEENREWLGKEILGQLEEGGVGAPDALVMGVGTGGTLIGVGQAFREKNAEAKLIAVEPEESCTLLCGESGVHKIEGISDGFVPGIYERHAERLGVDEVYAVGSEEALGAMRWLARRRGLFVGPSSGANLVAARRLKEAHPELKSIVTLFCDEGEKYISEHFPATREVEAEAR

SEQ ID NO: 53701 - protein, 481 aa, Rhodobacter sphaeroides 2.4.1
MTFRFDNSYARDLEGFYVDWPAAPVPAPRLLRLNRPLAEELGLDPDLLEREGAEIFSGRRLPEGAHPLAQAYAGHQFGGFSPQLGDGRALLIGEITDRAGRRRDLQLKGSGRTPFSRGADGKAALGPVLREYLVGEAMHGLGIPTTRALAAVATGEPLLRQEGERPGAILTRVAASHIRVGTFQFFAARSDIDRVRRLADYAIARHYPELASAPEPYLAFYEAVAEAQAQLVARWMLVGFIHGVMNTDNMTISGETIDYGPCAFMEGYDPGTVFSSIDLQGRYAYGNQPYILAWNLARLGEALLPLLDGDPVRAADKATSVLETVGARYQGHWLAGMRAKLGLAGAEEGDARLAEDLLEAMRSQRADWTLTFRRLAEAVTDEGALRPLFRDPAALAGWLPRWRARLAPDAAERMRATNPIYIARNHRVEEALAAAHAGDLAPFDRLLEALADPFTERADRELFALPAPEGFDDSYRTFCGT

SEQ ID NO: 53702 - protein, 289 aa, Vitis vinifera
METVYLNRNPTAKSVLELVRSVDNDRICYDHLAFRTFGVNGYGIDSMAQFFLDFGYKPREELRFPAKKLRALWFSPPRISHTDTGTGVHGPLPRIFISELLVDQMSPPAQEIIRKYTEISGSGNKHAALASAQGFLTWEKPLYSEFQQLARESEYAAWTLVNGYAVNHVTISTHQLKSHLRNIEMLNQFIEENGFKLNSEGGVLKVSPDGLLLQSSTVADSVSFQFSDGVTESVPCSYIEFAERLVLPQYKNLPDKEVKEYHRRDGFEVGNADKIFESTSKDQLTRRAA

SEQ ID NO: 53703 - protein, 80 aa, Glycine max
KAGKKVSKVSKIQRLVPPFPLQKKRPRNRDKKKSIGKAKFKAAEFQKLLASRFKEQKVRRSESLVKRRSKLSSDAKAAAV

SEQ ID NO: 53704 - protein, 343 aa, Magnaporthe grisea 70-15
MAPSLEEPEAVQEVINNPLKAKPQLVAPEPEHCPGPESERAGTADSCAGCPNQKICASAPKGPDPDIPLISARLAGVKHKILVLSGKGGVGKSTFTSLLAHAFATNPESSVGIMDTDICGPSIPKMMGAEAETIHISGAGWSPVYVMDNLGVMSIQFMLPNRDDAIIWRGPKKNGLIKQFLKDVEWGDLDFLLVDTPPGTSDEHLSVNTYLRESGIDGAVVVTTPQEVSLLDVRKEIDFCHKAGIRVLGLVENMSGFVCPGCKHTSQIFRPTTGGGRALAKEMGIRFLGSVPLDPSIGMACDYGESFFDSFPDSPTCASVENVVRELAEELGLAVDNVLPPKQ

SEQ ID NO: 53705 - protein, 473 aa, Mycobacterium leprae TN
MTITAPKVVGKSIDPRDPLLRLSNFFDDGRVEPLHERNQSGVFAATGTVNGLRTIAFCTDGTVMGGAMGIEGCAHIVNAYDTAIEEQSPIVGIWHSGGARLAEGVRALHAVGQVFEAMIRASGYIPQISVVVGFAAGGAAYGPALTDVVIMAPEGRVFVTGPDVVRSVTGEDVDMASLGGPETHHKKSGVCHIVANDELDAYERGRRLVGLFCQQGHFDRSKAEAGDTNIQALLPESSRRAYDVHPVVTAILDENTPFDEFQANWAPSMVVGLGRLSGRTVGVLANNPLRLGGCLNSESAEKAARFVRLCDAFGIPLVVIVDVPGYLPGVDQEWGGVVRRGAKLLHAFGECTVPRVTLVTRKTYGGAYIAMNSRSLNATKVFAWPDAEVAVMGAKAAVGILHKRKLAAAPNDEREALHDDLAAEHERIAGGVDSAIDIGVVDEKINPAHTRSKLTEALAQSPVRRGRHKNIPL

SEQ ID NO: 53706 - protein, 325 aa, Zea mays
MATIQNKPTPTAPSTTTGGGLRAMDLYEKLEKVGEGTYGKVYKAREKATGRIVALKKTRLPEDDEGVPPTALREVSLLRMLSQDPHVVRLLDLKQGVNKEGQTILYLVFEYMDTDLKKFIRGYRANHEKIPAQTVKILMYQLCKGVGFVHGRGVLHRDLKPHNLLMDRKTMALKIADLGLSRAITVPVKKYTHEILTLWYRAPEVLLGATHYSTPVDIWSVGCIFAELVTNQPLFPGDSELQQLLHIFKLLGTPNEEMWPGVGKLPNWHVYPQWKPTKLSTLVPGLDSDGYDLLEKMLAYEPGKRVSAKKALEHPYFNDVNKEVY

SEQ ID NO: 53707 - protein, 539 aa, Flavobacteria bacterium BBFL7
MAEIVNMPRLSDTMEEGVVAAWLKNVGDKVEEGDILAEIETDKATMEFESFQEGVLLHIGVQEGETAPVDQLLCIIGEEGEDISSLLNGDNSTSESKEDTSKKEESNDSSENDSSNDELPEGVIIVTMPRLSDTMEEGTVASWLKSEGDTVEEGDILAEIETDKATMEFESFNEGTLLKIGIQEGETAKVDALLAIIGPAGTDVSGINLEASAKAPAPKKEEKKVEAPKAEPKKDKAPVAASSSSNANSSSSSKGGRIFASPLAKKMADDKGIDLSQVSGSGENGRIVKSDIVNFKPSAGGSASASSFVAVGTETFEEVPNSQMRKTIAKRLGESKFTAPHYYLGLDLDMDNAIASRKAINELPDTKISFNDMVIKAAAMALRLHPKVNTQWTDKNTIVAKHIHVGVAVAVDDGLLVPVLPFADQMSMQQIGAKVRELAGKARNKKLQPDEMQGSTFTISNLGMFGITEFTSIINQPNSAIMSVGAIVQKPVVKNGQIVVGNVMKITLACDHRTVDGATGAAFLQTFKSYIENPIVMYV

SEQ ID NO: 53708 - protein, 489 aa, Ostreococcus tauri
MMSWVGDGFHEEFGAGRYETTLSERTATWGRERVGDDAVIALTSSETGRLIDCDGSEIERVARRLTEGGAGTATARAYAGHQFGTFAGALGDGRVVSLGWVKSLDGTTREVQVKGGGKTTRTRDGGDGRCTLRSTIREFLCAEILAALDVPTTRLMCVISTNEGVVRRTKANSARLEYGGMSVRVCEAPLVRFGTFELPASRRDFDCVRALADHVIASDLFVGEIDDVDRHGALLCAAARRNAITVARWMSIGFVHGVMNTDNTTVCGTTIDLGRFGFMEAYDEEFCSNPDDETKMYAFGRQRSVARWNVERLCDAFERVVPASAHRSALCAFDDAFENETKRLNERKFGVRDDDGVVSSAFHRVLRVGGFDFTRAHRALGEIASTLVESSSSSSERVVRNVFARLFDVDAEQLDRSVDDFARAYASALSSDARDARRRRLTQDATNPVFILRERDVTEAIDAALEDDWTLARTLAHRCATPFRDEILS

SEQ ID NO: 53709 - protein, 439 aa, Bacillus cereus ATCC 14579
MAVENITMPQLGESVTEGTISKWLVNVGDHVNKYDPLAEVMTDKVNAEVPSSFTGIVKELIAGEGDTLAVGEVVCVIQVEGADEVAATAVEEKTKEEPKAEVATSEKAPKVKQPTDGKPRFSPAVLKLAGEHNVDLDLVEGTGANGRITRKDILKLVESGNIPQAGAAKKEEAVAAVVEARPEAPKAAPVAQKVEAAKPVSVPTMPGDIEIPVTGVRKAIAANMLRSKHEAPHAWMMIEVDVTNLVSYRNSIKGDFKKREGFNLTFFAFFVKAVAQALKEYPQINSMWAGDKIVQKKDINLSIAVATEEELFVPVIKQADEKTIKGIAREITELAGKVRTKSLKADEMQGGTFTINNTGSFGSVQSMGIINYPQAAILQVESIVKRPVIMDNGMFGARDMVNLCLSLDHRVLDGLICGKFLGRVKEILENMSENNTSVY

SEQ ID NO: 53710 - protein, 445 aa, Silicibacter pomeroyi DSS-3
MMAQGQMAPGIVAGRLSSEELAANFDDLHPAYAPHEAAVAADRCYFCYDAPCQTACPTEIDIPLFIRQIQTGHPEAAARTILEQNILGGMCARVCPTETLCEEACVREAAEGKPVEIGRLQRYATDTLMARGVHPFTRAAPSGKRVAVVGAGPAGLACAHRLALLGHDVVIHEARPKAGGLNEFGIAAYKATGGFAGTEVDWLLQIGGITVEQGSALGQGLTLDALRAGYDAVFLSIGLAGVNALRAAGEDKDGVRDAVDFIAELRQAGDLSALPVGRNVVVIGGGMTAIDAAVQSKLLGAENVTVAYRRSRAEMGASGFEQDLAASKGVRLMFNVMPVAVHGNGAAVEIELEYTTSAGGSVTGTGETVRLAADQVFKAIGQTLEGVPEGLELEGRKIKVDGSGRTSVPGVWAGGDCASGGEDLTVTAVAEGRDAAMDIHARLSA

SEQ ID NO: 53711 - protein, 473 aa, Bacillus cereus ATCC 14579
MAKEYDLVIVGGGTGGYVAAIRASQLGLKTALVEKENLGGTCLHKGCIPSKALLRSAEVYATAKKSEEFGVIASNVELNFAKVQERKEKIVTQLHKGVQHLMKQGKIDVFEGIGRILGPSIFSPMPGTISVELASGEENEMLIPKNVLIATGSRPNSLPGLELDGEYVMSSDHALKMETLPSSIIIVGGGVIGIEWASMLADFGVEVTVLEYAKTILPLEDQDVSKEMQRLFKKKGIKVVTGAKVLPETLVKDNGVTIQAEHNGENKEFKAEKMLVSVGRQANTQNIGLENTDIVVEKGYIQTNEFYQTKESHIYAIGDVIGGLQLAHVASHEGIAAVEHIAGKEVTPIDYSMVSKCVYSSPEVASVGLTEQEAKEKGYKLKVGKFSFRAIGKALVYGESDGFVKLVVDEETNDILGVHMIGPHVTDMISEAGLARVLDATPWEVAHTIHPHPSLSEAIGEAALAVDGRALHA

SEQ ID NO: 53712 - protein, 79 aa, Bordetella petrii
MESIEQRVKKIVAEQLGVNEAEIKNESSFLDDLGADSLDMVELVMALEDEFETEIPDEEAEKITTVQQAVDYINSHGKQ

SEQ ID NO: 53713 - protein, 408 aa, Coccidioides immitis RS
MADTKKNDNYAIDMDKLDAESDRFRPPPQPQPRHSSSSHSQSISNSPVLPILSYCASSILMTVTNKYVLSGVQFNLNFFLLCVQSVVCIIAIQTCKSMGLINYRDFNSDEAKKWFPISLLLIGMIYTGTKALKFLSIPVYTIFKNLTIILIAYGEVLWFGGSVTGMALFSFGLMVLSSVIAAWADIKHALDTSGFSGAEATSKISTLNAGYIWMLINCLCTSTYILGMRKRIKLTNFKDFDTMFYNNLLSIPILMIGSFIVEDWSSENINKNFPIETRNSLIFAMIFSGLSSVFISYTSAWCVRVTSSTTYSMVGALNKLPIALSGLIFFGDPVTVPSVSAIVVGFISGIVYSLAKVKQNAKPRTGVLPTTNPATAGPAPNVRTFFFNRDIDYFKIDSHFSGHKYAIQ

SEQ ID NO: 53714 - protein, 486 aa, Ostreococcus tauri
MPREVSRVGAYALKRSLGKGAFGFVKLGVQDKTGRKVAVKDGARETDASCATWGQILDRENLLRVDEQEQLKAEIKALADLFHPCIVDLIEVLTNETSVFMVMTYCPGGELYDVIRAKGALNEEQARRHFQRLIQGVDFCHKKRIYHRDLKPENLFLDENGDLCIGDFGLAALREDEEDNNLRTICGTPHFAAPEVMGGSRRLVGNKNFKTVNTKTRTEGYDGAPADVWSCGCILYFLLTGVFPFDGQNFVQLQMLVQKTEPYFAPQRISKPCEKLIRGMLVKDPAKRWTIEQVMKSSWFKTDYEPVQVQESKKDSRHYDDEDPALEEFWSPDTGLVVKTAGESSMSEVDKMRPIKQLNAFELINLAAFDVESIFDEDENTVSNATRFMSKESIDKVQAAVIKRAEQDLNTVAKRKTLSRVTFEDVNNGVVVTMRTYQVIPGVCVYDFSRDEGGRDRFHAWFQKLRDPSGPVGALINIDDAQHTAP

SEQ ID NO: 53715 - protein, 252 aa, Oryza sativa
RAAGIGTRKALSYHLHSYYWLDFQRLNEIYRYKTEEYSETALNKFNVIPESIPDWIFDFMPSRGGYFIGNVSPARMDFRWFCLGNFIAILSSLTTGEQAEAILDLVEERWEELIGEMPMKVCYPAMENQEWQIVTGCDPKNTRWSYHNGGSWPVLLWLLVAVSVKLGRPHIARRAVEVMEKRLVKDEFPEYYDGKAGRYVGKQARKFQTWSVAGYLVAKMLLDDPSNLRAVSLADDCHIRSAPVLKRSNSFP

SEQ ID NO: 53716 - protein, 409 aa, Taxus cuspidata
MASIGAILKHPEDVPALLKMKFAAAHASKQIPLDPDLAFCYTMLQKVSRSFAFVIQQLGLELRNAVCVFYLVLRGLDTVEDDMSIPVDTKLPILTNFHQHIYDPSWHFSCGVNDYKELMDQFHHVSTAFLALGKRYQEGIEEITKRMGAGMAKFIRQEVESVEDYDEYCHYVAGLVGLGLSRLFRAACLEDLAPDFLSNSMGLFLQKTNIIRDYLEDINEIPKSRMFWPHEIWSKYVPNLEDLKEEECSKEAVQCLNEMITNALKHANDCLKYMAALKNPAIFRFCAIPQIMALATLEICYNNLQVFRRVVKIRRGLTAKIMDRTKSMADVYEAFFDFSGSLASKVPKDDPNATVTLKYIDEIQRTCNASGLMAKRRSFTIDSKKGHEAFLAICVLLLAIVLAILTFKL

SEQ ID NO: 53717 - protein, 328 aa, Campylobacter coli RM2228
MKILISGGAGYIGSHTLRQFLKTNHEICVLDNLSKGSKIAIDDLQNIREFKFFEQDLSDFEGVKALFEREKFDAVVHFAASIEVFESMQNPLKYYMNNTINTTNLIQTCIQTGVGKFIFSSTAATYGEPTTPVVSENSPLAPINPYGRSKLMSEEVLRDANMAHPEFKYCILRYFNVAGACMDYKLGQRYPKATLLIKVAAECAAGKRDKLFIFGDDYDTKDGTCIRDFIHVDDISSAHLAALDYLENNESNIFNVGYGHGFSVKEVIDAMKRVSGVDFKVELAPRRAGDPSVLISDASKIRNLTSWQPKFDDLDLICKSAFDWEKQC

SEQ ID NO: 53718 - protein, 401 aa, Escherichia coli K12
MNVFNPAQFRAQFPALQDAGVYLDSAATALKPEAVVEATQQFYSLSAGNVHRSQFAEAQRLTARYEAAREKVAQLLNAPDDKTIVWTRGTTESINMVAQCYARPRLQPGDEIIVSVAEHHANLVPWLMVAQQTGAKVVKLPLNAQRLPDVDLLPELITPRSRILALGQMSNVTGGCPDLARAITFAHSAGMVVMVDGAQGAVHFPADVQQLDIDFYAFSGHKLYGPTGIGVLYGKSELLEAMSPWLGGGKMVHEVSFDGFTTQSAPWKLEAGTPNVAGVIGLSAALEWLADYDINQAESWSRSLATLAEDALAKRPGFRSFRCQDSSLLAFDFAGVHHSDMVTLLAEYGIALRAGQHCAQPLLAELGVTGTLRASFAPYNTKSDVDALVNAVDRALELLVD

SEQ ID NO: 53719 - protein, 467 aa, Pseudomonas aeruginosa PAO1
MGLNADWMQRDLNVLWHPCTQMKDHERLPVIPIRRGEGVWLEDFEGKRYIDAVSSWWVNVFGHANPRINQRIKDQVDQLEHVILAGFSHQPVIELSERLVKITPPGLDRVFYADSGSAGIEVALKMSYHFWLNSGRPRKKRFVTLTNSYHGETIAAMSVGDVALFTETYKSLLLDTIKVPSPDCFLRPDGMCWEEHSRNMFAHMERTLAEGHDEIAAVIVEPLIQGAGGMRMYHPVYLKLLREACDRYGVHLIHDEIAVGFGRTGTMFACEQAGIAPDFLCLSKALTGGYLPMSAVLTSETIYRGFYDDYQTLRAFLHSHTYTGNPLACAAALATLDIFEEDKVIEANRALSTHMARATAHLADHPHVAEVRQTGMVLAIEMVQDKASRTPYPWQERRGLKVFQHGLERGALLRPLGSVVYFLPPYVITPEQIDFLAEVASEGIDIATRDAVSVAVSDFHPDHRDPG

SEQ ID NO: 53720 - protein, 597 aa, Magnetospirillum magnetotacticum MS-1
MIESMNFAILIVSGLVALSIFSSLLSFRIGAPLLLVFLCVGLVAGENGLGRIKFDDVRAAYMIGSIALAIILFDSGFHTSLKAFRAALWPAMAMATGGVVVTTAVVAVPVHYLLGFDWLEAGLMGAILSSTDAAAVFFLLRVGGIHVRDRVRSTLEVESGSNDPMAIFLTMALVGLLVAKGPISPVSIGMEFITKFGIGAAAGMFGGGLIVLAVNKMGFERGLQPLAAISLAMVLFAATEELHGSGFLAVYIAGLVAGNARINAPETMRRFQDGLTWLAQIVMFLTLGLLATPSEFPAFAWQSLMVAAVLIFVARPLAAWICLFPYGFNRNETAFVAWVGLRGSVSVLLSIVPMVVGLPHGRDYFILAFLVVLLSLGLQGWTIGAVARFLSQIVPKRIGPVERMELEIPGARHELVSYRIVADSLVARGHRLPRWAEPSLVVRDKKSYSNHAAKGLKPGDTVFLFARPERVPHLDRLFASAAPAAEADSRFFGDFALEPGAHMKDLALLYGLPVDEADYDMSAANWLVRELGHEPGIGDRAALGEVELIVRALDWDDRISEIGLAVEPTRIDAPRLPVFQSRTELKAMLKRWMRKTT

SEQ ID NO: 53721 - protein, 510 aa, uncultured crenarchaeote
MDKIVVLDFGSQYSHLICRRIRESNVYCELLPYNSPISLIKKLEPKGIVLSGGPSSVYLEGSPKPDKKIFDMGIPVLGICYGHQLIVNEFDGKIKRFDNREYGLADLEIDDNSDLFKGINKKIRCWMSHADAAETIPNDFNILAHTNNSNSAAIANRNRGFYGIQFHPEVSHTEEGNRILRNFSHSISNAKPDWTMEGFVDFSIKDIRSKVQEDRVLCAISGGIDSTTLAVLLNKAISKNLACVFVNNGLLRQDEETLVPELISKHLGIDTITIDAEQRFLSRLNGITDPEQKRKIIGEEFAQVFLKVTKDYGPFQWLAQGTLYPDVIESGFSKGPAAVIKTHHNVGGLPDWLNLKVLEPFRSLYKDEVRKIALLLDIPNEFIKRHPFPGPGLAVRIIGEVTNEKIRIVRHASSLVESELMAAGWYDKVWQAYAAVGDDLAVGVLGDERVYGHIVTIRIVESLDAMTADWSRIPHELISKISNRITNEVNGVTWVTYSVSSKPPATIEPQ

SEQ ID NO: 53722 - protein, 587 aa, Kluyveromyces lactis NRRL Y-1140
MSQEKKLDYSIDQETQLESGEFHEQNSYVSQSDASPVEGTRWERFRDSFKRADTQDLDPNLTDAEKMAILTANAPLKRTLKSRHLQMIAIGGAIGTGLFVGSGKALATAGPAGILIGWALTGTMIYCMVMAMGELAVTFPIAGGFTTYASRFVDESFGFAFNTIYMLQWLVVLPLEIVAASITVNYWGTPDKYRDGFVALFYVVIVAINFFGVKGYGEAEFIFSFIKVITVIGYIILGVILVCGGGPQGGYIGGRLWHNPGAFANGFKGVCSVFVTAAFSFAGSELVGLAAAETANPRKSLPSAAKQVFWRITLFYILALLMVGLLVPYTSDRLIGQSSVDAAASPFVISIQNAGIKGLPSVINVVILIAVLSVGNSAVFACSRSMAALANQGSLPKIFGYIDRTGRPLVGIIVTCVFGLLSFIAASPKEGEVFDWLLALSGLSSLFTWGGIMLCHIRVRRALAAQNRTTAELSFTAPTGVWGSVYGFVLIILILMAQFWIALFPIGDKPSASAFFEAYLSFPILIAFYIGHKIWKKNWKLFIRAKNIDIDTGRRETDIEALKQEIAEEKAFIASKPFYYRMYKFWC

SEQ ID NO: 53723 - protein, 268 aa, Escherichia coli K12
MSVVISDAWRQRFGGTARLYGEKALQLFADAHICVVGIGGVGSWAAEALARTGIGAITLIDMDDVCVTNTNRQIHALRDNVGLAKAEVMAERIRQINPECRVTVVDDFVTPDNVAQYMSVGYSYVIDAIDSVRPKAALIAYCRRNKIPLVTTGGAGGQIDPTQIQVTDLAKTIQDPLAAKLRERLKSDFGVVKNSKGKLGVDCVFSTEALVYPQSDGTVCAMKATAEGPKRMDCASGFGAATMVTATFGFVAVSHALKKMMAKAARQG

SEQ ID NO: 53724 - protein, 223 aa, Zea mays
  misc_feature (196)..(196): Xaa can be any naturally occurring amino acid
  misc_feature (199)..(199): Xaa can be any naturally occurring amino acid
MENGSSKGDVTEDANAHCPGTQSDEAGKADSCAGCPNQQICATAPKGPDPDLVAIAERMATVKHKILVLSGKGGVGKSTFSAQLSFALAEMDHQVGLLDIDICGPSIPKMLGVEGQDIHQSNLGWSPIYVESNLGVMSIGFMLPNPDDAVIWRGPRKNRLIKQFLKDVDWGEIDYLVVDAPPGTSDEHISIVQYLXATXVDGAIIVTTPQQVSLMDVRKEIIS

SEQ ID NO: 53725 - protein, 449 aa, Sinorhizobium meliloti 1021
MQHMNTGPDAEKLLNRIRTRDFTIGIMGLGYVGLPLAMSSLEAGFRVIGFDIDQSRVALLNRGESGIKHLPGPAIQQAVESKRFRATSDFSELSMPDAILIAVPTPLTRNREPNLSFVENSARSIAERLRPGQLVVLESTTWPGTTREIVRPLLEATNLVVGKDFFLAYSPEREDPGNEVHTTTSVPKVIGADEPSSLEVAQALYSQIIVRTVPVTSTATAEAVKLTENIFRSVNIALVNELKVIFDRMGIDVWEVIEAAKTKPFGYMAFYPGPGLGGHCIPIDPFYLTWKAREYEVATRFIELAGEVNTNMPHYVVDRLVEALDRRARRGLNESRILLIGMAYKKNVGDTRESPSLRLIDLMERRGAVVDYHDPYVPEIPATREYAELAGRRSVDISADRLASFDAVVITTDHDAIDWKTVVEGAKLVVDTRNVCARFHVSAPNVVKA

SEQ ID NO: 53726 - protein, 439 aa, Ochrobactrum anthropi
MQTPLSLRERDARVIAEIGRLRFSPLSLIGGKGNRLIEEGGRSILDLSGSAGPAALGYGHPAIVEAVEKSVRDMAGASLLLYPNEAAVSLAEDLLRITPGNGERRVWFGHSGSDANDCAVRVLTAATKRSRIISFIGSYHGNLTGSMGISGHTAMTHTLPRPGVLLLPYPDPFRPRFSAEAVLELLDYHFATSCPPEQVAAVFIEPILSDGGLVVPPPAFLEALQDRCRKHGILVVVDEVKVGLGRTGLMHCFQHEGLEPDMVVFGKGLGGGLPLSAVVGPQWVMDHAPAFVLQTTAGNPVATAAGRAVLNTIERQGLAQRSERVGGIFADRLRRLSDKHSIIGDVRGRGLAIGVDLVSDRGSREPAPVTTTAKIIYRGYQLGAAFTYVGLNANVLEFMPPLTLTEPEIDEAADIVDQAIGDVLDGKVADSDVAHFMMW

SEQ ID NO: 53727 - protein, 238 aa, Oryza sativa Indica Group
MAGGVVIGVAPPAAAEEPEPHVERLPADLLAHVLSLLPSFHDLAMAGGVSRRWRRAVERSLAGRRRMSFAGQRTGDDSTARFVRAAVNLRDLDISRSCWGCQITDQGLIRISTADCVKNLTSISLWGLAGITDNGVIQLVSRAHSLQHLNIGGTFITDESLYAVAKSCINLKSIIVWSCRHVTEAGLVALVGGCRRLECINVGGMRVPPESFAGLLAIRPALQIRSIPQILNANVQVS

SEQ ID NO: 53728 - protein, 515 aa, Candida albicans SC5314
MLEEISFESWYLYLIICGVLYFCTNYLYIQYLNKKLGAKSPGSCKSDGCFGFRSGFEMLKAKKIGRQVDLLHERFNDLSNPEVNDTFTSYNFGFPMIITKDPENIKALLATQFNDFSLGRRYDFFKPLLGKGIFTLDGEGWKHSRSMLRPQFAREQIAHVKALEPHFQLLKKHITKNKGQFFDIQELFFRFTVDSATEFLFGESVSSLKDESIGYNQDEFDFAGRKDFPEAFNKSQIYLSTRSLLQNLYWLVNPKDFQNCNAIVHKFSDYYVNKALNATPEELEKNSGYVFLYELVKQTRDPQVLRDQALNILLAGRDTTAGLLSFAVFELARNPQVWKKLREEIIERYADGATEISFETLKQCEYLKAVINETLRLYPSVPRNGRFANKNTTLPRGGGPDGMSPILIKQGQAVMYSIYSTQRDPKYYGKDADVFRPERWFEPETRKLGWAFLPFNGGPRICLGQQFALTEASYVLVRLAQCCENLQLTEGIEYPPAKLTHLTMCMFDGVPIKVD

SEQ ID NO: 53729 - protein, 391 aa, Streptococcus agalactiae A909
MTLEKRFNKYLDRIEVSLIRQFDQSISDIPGMVKLTLGEPDFTTPDHVKEAAKSAIDANQSYYTGMSGLLALRQAAADFAKDKYNLTYNPDSEILVTIGATEALSASLIAILEAGDVVLLPAPAYPGYEPIVNLVGADIVEIDTRENDFRLTPEMLETAIIQQGEKLKAVLLNYPTNPTGITYSRQEIAALAEVLKKYDIFVISDEVYSELTYTGQQHVSIAEYLPNQTILINGLSKSHAMTGWRVGLVYAPEAFTAQIIKSHQYMVTAASTISQFAGVEALSVGKNDTLPMRQEYIKRRDYIIDKMSKLGFKIIKPSGAFYIFAKIPDSYPQDSFKFCQDFAYQQAVAIIPGVAFGKYGEGYIRLSYAASMEVIETAMARLKVFMESYEG

SEQ ID NO: 53730 - protein, 174 aa, Oryza sativa Japonica Group
MGKYGVELDAVALNSLLSVMCRGDDRAQAAQDLFEHTCRSYHPHRSAPGSCKAATCNPNTPSRIVVRAAEGRWMLTDAKVEFSNYWLQSKKLNRLLMLLGAAKEEAEREIAEYRAQMEAEFQRKVAESSGDSGANVKRLEQETDTKIAQLKEQAANVSPEVIQMLLRHVTTVKN

SEQ ID NO: 53731 - protein, 282 aa, Mycobacterium leprae TN
MMPSTPRTSIPSITLNDENTMPLLGLGVAELSEDETERAVLAALEIGCRLIDTAAAYGNEAAVSRAIAASGIPRAQLFVTTKLATPDQGFTKSQDACNASLDRLGMDYVDLYLIHWPAPPVGQYVDAWGGMIQSRGEGHARSIGVCNFTEEHLSAIIDLTFVTPAVNQIELHPLLNQDEMRKSNAQHNVITQSYTPLVLGRLMDNSTLTAIAAEYGKTPAQVLLRWNLQLGNAVVFRSAKAEHIASNFDVFDFELAVNHMDAMNELHDGTRLRPDPETYAGS

SEQ ID NO: 53732 - protein, 595 aa, Prochlorococcus marinus str. MIT 9312
MIKVEKVKKKKDSAKEETVCLANGLEVSKFENFKKSSQFLKEPLATELVNESDHFTNDAVQLLKFHGSYQQDNRENRKPGKSKDWQMMLRLRSPGGEIPGKLFLALNELSDKLGNGSLRATTRQAFQMHGIRKENLKEVIQTIVNSMGSTLAACGDINRNVMAPAAPIDSPEYNIARALAKKVADLLTPLAGQGTFLELWADGDLEYTIKPDKDIEAIRRLQFKDNVFSGIKDEPLYGSTYLPRKFKCAVTVPGDNSVDLLTNDIGIVAFTSEEGKLEGCNFYVGGGMGRTHNNEETFARIADPLGYVEEQDIYELIQCIVAIQRDYGDRKSRKNSRMKYLIHRKGIKWFKKLLLGKYFKKEIKKIRKEPNQVLIDYLGWHKQNKTSYFVGLPLLSGRLSGEKKNTITSIVKKYNLDLRLTPNQDILLCNIANKNKSEIKKALSKIGYDNLEDINEIQRHALACPALPLCGLAMTEAERILPDVLKRIEKLLLDLKIEKTILFRMTGCPNGCTRPYMAELALVGSGQNKYQLWLGGSKNLQRLAKPFLQRMELNDLEKTLQPLFDHWKSSSDLDFGDFINKQEESSILNLINEIH

SEQ ID NO: 53733 - protein, 182 aa, Streptomyces coelicolor A3(2)
MTEPTGITELLLSRIRDVADYPEPGVVFKDITPLLADPGAFAALTDALAEAAGRTGATKVVGLEARGFILGAPVALRAGLGFIPVRKAGKLPGATLSQAYDLEVSSAEIEVHAEDLTAGDRVLVVDDVLATGGTAKASLELIRRAGAEVAGLAVLMELGFLGGRARLEPALAGAPLEALLTV

SEQ ID NO: 53734 - protein, 914 aa, Treponema denticola ATCC 35405
MSKKDKPKKILYAVDYKPKRKSPFLLEFANHLNRTKPGSKRSITYDDPEYYVMENIVTDEMAKVGMFLKIRTPLSAQDISPLCGKTVEETEKILWDLAYVGCCITNTIDGVNKYWTEIWVPGIMEMINNNKELTSKHPEITIAFDAYGKKKGEIAPGILPMGVSPMRVIPIESAIESDTHHASYEEISHYLNQHTLFSVSDCSCRTVREKMGEGCGHLKEDMCIQMGHAAEYYIKTGRARQITREEAFEIIKRAEENGLMHDIPNLDGEGKTHAICNCCGCGCLAIRNAIMYRNTDFSRSNYISVIDEEKCVACGECVEHCPSNALRLGQKICSSKPIPEEKTVKTPRDHRWGPEDWNPDYRTNRQVVVKTGTSPCKANCPAHIGVQGYIKLAAQGKYREALELIKLENPFPAVCGHVCPRYCEQGCSRLGLDEAVAVDDIKKFIAEQDLNSEHRYVPKKKRYYHDKKIAIIGGGPAGLSCAYYLAIDNYDVTVFEKEKSLGGMLKFGIPSFRLEKNVLDAEIDVLKELGVNFKTGVEVGKDVSLDELRAQGFKAFYLAIGAQKGRLLGIEGEDAAGVITGVDFLREENLNESKSLSGKVIVIGGGNVAIDVARMAVRAGGEEVSMFCLEKREEMPALPEEIHEAEEEGIKITNSWGPKRILVTNGKVSGVEFKKCLSVFDKDGRFSPSYDENDTMTVECSFVITSVGQAIDLGSILEGSACEINRNQTVKADPITYQSAQKDIFVGGDVLTGPKFAIDAIAQGKEGAISIHRFVHPGQSLVMGRTRRDYKPLDRENLELAGFDRLPRQRAEEPSGEEGKKTFRDLRKTLTEEQVKAETERCLKCGAVKVDEYMCIGCGMCTTRCRFGAISLKRVYDAHPSTLEKLKGVVIRNMVKREGKILFNKIFKSSPKNK

SEQ ID NO: 53735 - protein, 933 aa, Ostreococcus tauri
MARRGRRRGRRARWPCAGASADGDGTSTAIFHFERGCAYGTKEMKDLLGSKGSGLAEMALLGLNVPAGFTISAACNERFAARGSTYVQSELWPDVLEAVSSLERTAKRTVFRSGCSLVGRAPLLLSVRSGAAASMPGMMDTVLNLGLSDACVAACVEAGFDERWVYDSYRRLLAMFGDVVEGIPKMDFEVALSQARSANEVRFDSELPAEALKKLCDEYKDIYVKHGKTFEQDPMNQLSKSILAVFSSWNNPRAVEYRDINRLSGLLGTAVNVQQMVFGNFNDNSGSGVCFSRNPADGTDKVYGEFLQKAQGEDVVSGVRTPMMISDLAGTQASAAEELNEVCKELEKDYKDMMDIEWTIEDGNLYILQCRVGKRTGTAAVRIATEMAAEGIITRDEALMQVNAKQIEQVLHPVFVIDETSAEYSGKIVAKGKPASPGAAVGAICFSAKEAKEMKAKGTPVILVREETCADDIGGMFAAEGILTARGGMTSHAAVVARGWGKPCVSGCGDIVFKNDREIRFGSSDKTFRSGNVISINGTTGEVLNASFPVAPSTIETFLPLKTFMQWVDQKRGIEIRANADTPEDADAAIRNGASGIGLVRTEHMFFSTTDRVHAIREFIMAQDETSSTIALEKLEKYHYEDFRGILKAAAGRKVTVRLIDPPLHEFLPSEKQLREGGAQEMSRYIGKSTHDIMEIAENMREHNPMLGLRGCRLGILRPSMSKMQVRAFAQAAIDLTSEGFPVTPSIMVPLVSTVDEFHNQRDLVWGVMKELAKENQQPPIRMEIGAMIETPRCALIAGDLARAGASFFSFGTNDLTQMTYGFSRDDSDAFIKPYIAKGLLRDDPFVTLDPVAVAELMDIAIHRARDIRNDIEVGVCGEHGGDPASLRTIDALDVDYASCSPSRVLVARLAAAQAACSRKEKVKTKPFAVTAA

SEQ ID NO: 53736 - protein, 338 aa, Flavobacteria bacterium BBFL7
MEYVENILGTIGNTPLVKMNKLVEDLPCLVLAKYETFNPGNSTKDRMGLKMVEDAEADGRLKPGGTIIEGTSGNTGMGLALAAIMKGYKLICVLADKQSKEKMDILRAVGAEVYVCPTNVEPDDPRSYYSTSKRLSEEIPNSWYVNQYDNPSNAQAHYESTGPEIWKQTDGKITHFVVGVGTGGTISGVGKYLKEQNPNIKIHGIDTYGSVFKKYHETGIFDENEIYSYVTEGIGEDILPKNVNFEIIDHFTKVTDKDAAIYTRRLAKEEGMFLGNSAGSAIKGLRQIHKEYGFTKDDVVVVLFHDHGSRYVGKFFNDDWMLEKGYINEDGSYPQEDN

SEQ ID NO: 53737 - protein, 360 aa, Ostreococcus tauri
  misc_feature (1)..(2): Xaa can be any naturally occurring amino acid
XXARDAHATIPELDGRTAFFAVFDGHGGKEVALYAARHLHESLKETEGFEGDGDALKGALEESFLALDRRMLSKEAASELRALRSGSGEEEDGALGGLVRTGANAEEQRNRRAEINAKLRAALIEQMKEQDPNIDERDIKFDFELEDSDFDEPQPSSSEDGGVDALDRWSGPQAGATSVVVCIRGNNAYCANAGDSRAVFSRKGGVAEDMSNDHKPMNEEERKRIMNAGGFVSEGRVNGSLALSRALGDFEYKRNKDLSEKEQAVTAFPEIREFELREGDEFMILACDGIWDVMSSQECVTFVRERLIAGAKSETFKISRVCEELCDACLAPDTRGSGLGCDNMSVVIVLLQKFWQPTSA

SEQ ID NO: 53738 - protein, 252 aa, Prochlorococcus marinus str. MIT 9312
MTESNQTKLAGVNRPIQIIPSVLPADWANMGACVKELEEAGVDRIQFDVMDGNFVPNLTFGPEMIAACRKYCNVPFETQLMVSQYNCETMLESYVNATKGANGEPGVVIAHAEANIHLHRVLGRIRDLGGSPSVALNPHTPFEMIENIMDMVDHVLVMTVNPGFGGQAYIPTMLNKIRKIRNFVIEKNLDVDIEVDGGIKANWTISQCADAGANCFIAGSGMFAYPTLKEGCDDLRKVAKEAQNGKVVSEPQ

SEQ ID NO: 53739 - protein, 556 aa, Yarrowia lipolytica CLIB122
MAPTSSEIHSARAITPACVCGFALRPKPPLLLATLGLLYLLRTAGTFFARGLISSRVGNNRPMTAQHSSHLTTHTHTHTNKRIHKLVTNPRTVIGAVVDVQFEQDNLPAILNALTIDRGEGNKLVLEVAQHLGENTVRTIAMDGTEGLVRGTSVADTGAPITIPVGRGTLGRIINVCGEPIDERGPIEATKFLPIHADPPTFAEQSTTAEVLETGIKVVDLLAPYARGGKIGLFGGAGVGKTVFIQELINNIAKAHGGFSVFCGVGERTREGNDLYREMKETGVINLEGESKVTLVFGQMNEPPGARARVALTGLTIAEYFRDEEGQDVLLFVDNIFRFTQAGSEVSALLGRIPSAVGYQPTLATDMGALQERITTTQKGSVTSVQAVYVPADDLTDPAPATTFAHLDATTVLSRGISELGIYPAVDPLDSKSRLLDIDVVGQEHYDVASNVQQTLQAYKSLQDIIAILGMDELSEQDKLTVERARKIQRFLSQPFTVAEVFTGIEGRLVSLKDTVRSFKEILDGKHDALPEAAFYMVGGIEEVVAKAEKLAAESK

SEQ ID NO: 53740 - protein, 226 aa, Yarrowia lipolytica CLIB122
MSELKDDAIYAAIAHGDTILCQHDFAKRDPKEVVQLVLAKISPGESKKASLMYQDLSIHYITTQATSDTPEGVTFILITKESCGRKAPFLCLLELEKKFNQQYSLQTIGSASKDSLNKFEGEMVTLVNSGKYEDVAKVAQSEINKVRDIMVENVEQILERGERISLLVNRTDEMTNNAVAFRKRSTQAKRNLWWKNVKMGALLGTGVAGLVYVAIGSVCGFGFQCV

SEQ ID NO: 53741 - protein, 306 aa, Salmonella enterica subsp. enterica serovar Typhi str. CT18
MDIAVIGSNMVDLITYTNQMPKEGETLEAPAFKIGCGGKGANQAVAAAKLNSKVLMLTKVGDDIFADNTIRNLESWGINTTYVEKVPCTSSGVAPIFVNANSSNSILIIKGANKFLSPEDIDRAAEDLKKCQLIVLQLEVQLETVYHAIEFGKKHGIEVLLNPAPALRELDMSYACKCDFFVPNETELEILTGMPVDTYDHIRAAARSLVDKGLNNIIVTMGEKGALWMTRDQEVHVPAFRVNAVDTSGAGDAFIGCFAHYYVQSGDVEAAMKKAVLFAAFSVTGKGTQSSYPSIEQFNEYLSLNE

SEQ ID NO: 53742 - protein, 507 aa, Populus trichocarpa
MGSGQWKVEKRSSFRSDSFSKEYETVPETGCLSIIVLGASGDLAKKKTFPALYNLYRRGFLQSNEVYIFGYARTKISDDDLRNRIRGDILAKMLQSTLKMYQQIKYVSGSYDTEDGFRLLDKEISEHEVSKNSAEGSSRRLFYLALPPSVYPPVCRMIRKCCMNRADLGGWTRIVIEKPFGKDLESAEKLSAQIGELFEEPQLYRIDHYLGKELVQNLLVLRFANRFFLPLWNRDNIQIVFREDFGTEGRGGYFDEYGIIRDIIQNHLLQLCLVAMEKPVSLKPEHIRDEKVKVLQSVLPIKDEEVVLGQYEGYRDDPTVPDHSNTPTFATVVLRIHNERWEGVPFILKAGKALNSRKAEIRVQFKDVPGDIFKCQKQGRNEFVIRLQPSEAMYMKLTVKQPGLEMSTVQSELDLSYKQRYQGVAIPEAYERLILDTIRGDQQHFVRRDELKAAWEIFTPLLHRIDDGEMKPLQYQPGSRGPVEADELLAKAGYVQTHGYIWIPPTL

SEQ ID NO: 53743 - protein, 463 aa, Schizosaccharomyces pombe 972h-
MRVPNEVCFNILSYLEADELRCKSTVCTSWRNFIIPTLWEKVVFQNEAQLNNFFDTLQYSKDVSYYFRYLRKLNCSRVRKFLTDKHLMLMTLATGISRLNLSGCTRISEPLIGKLLYQNLNLVTINFSNIFSLPANILEYISDNCPNLKALNIGNCGLVEDTGMVQIIKRCPYLNRLIIPNCRKLTDVSLQILSEKEDLIELDISGCEGFHNADTLSRLVSRNRGLKELSMDGCTELSHFITFLNLNCELDAMRALSLNNLPDLKDSDIELITCKFSKLNSLFLSKCIGLTDSSLLSLTKLSQSLTTLHLGHCYEITDIGVQCLLKSCKNITYIDFGGCLRLSDIAVSAIAKLPYLQRVGLVKCICLTDLSVILLSGSFSRNLERVHLSYCIGLTAKSVSYLMYNCKTLKHLSVTGINSILCTELRSFSRPIPDGINPSQVPVFCAFTKVEIDLFREFIRNRI

SEQ ID NO: 53744 - protein, 255 aa, Methanosarcina acetivorans C2A
MKNLFDLTGKVAIVTGASSGLGVEFARALANQGANIAIIARREEKLKEVQKEIEKLGVTCRYYLCDVMKTEQIKNAVEQVVKDFGRIDILVNNAGLGLVDAADKTTDEMWHNMIDTNLNGVYFFAREVGKIMLRQKHGRIINIGSIHSTVSMKGLPVTAYCSTKGGVLMLTKSLATEWAKEGITVNAIGPGYFALGMAEGVVADPEFAKIIEFMCPMGRAGQSGDLDTTVVYLASDESKYITGQIITVDGGWTAL

SEQ ID NO: 53745 - protein, 511 aa, Populus trichocarpa
MGSGQWKVEKRSGLENDSFLKEHETAPESGCLSIIVLGASGDLAKKKTFPALYHLYRQGFLHPDEVHIFGYARTRISDDELRDRIRGDILAKKLKLYQSSCNQIKYVSGSYDTEDGFQLLDKEISQHEVSKNSAEGSSRRLFYLALPPSVYPTVCRMIRKCCMNKADHGGWTRIVIEKPFGKDLESAENLSAHIGELFEEAQLFRIDHYLGKELVQNLLVLRFANRFFLPLWNRDNISNVQIVFRENFGTEGRGGYFDEYGIIRDIIQNHLLQILCLVAMEKPVSLKPEYIRDEKVKVLQSVLPIRDEDVVLGQYDGYRDDPTVPDQSNTPTFATVVLRIHNERWEGVPFILKAGKALNSSKAEIRVQFKDVPGDIFKCQKQGRNEFVIRLQPSEAMYMKLTVKQPGLEMSTVQSELDLSYMQRYQGVPIPEAYERLILDTIRGDQQHFVRRDELKAAWEIFTPLLHRIDNGEMKPKEYQPGSRGPVEADELLAKAGYVQTHGYIWIPPTL

SEQ ID NO: 53746 - protein, 630 aa, Bacillus cereus ATCC 14579
MDLTQIQNPSFLKDMSISELEGLSEDIRKFLIEELSQTGGHIAPNLGVVELTIALHKLFDSPQDKFLWDVGHQSYVHKILTGRAKEFGTLRQYQGLCGFPKRCESEHDVWETGHSSTSLSAAMGMALARDLKKTKEYVIPIIGDGALTGGMALEALNHIGHEKTDMIVILNDNEMSIAPNVGALHNVLGRLRTAGKYHWVKDELEYILKKIPAVGGKVAATAEKIKDSLKYLLVSGVFFEELGFTYLGPVDGHDYEKLFETLQYAKKTKGPVLVHVITKKGKGYKPAESDVIGTWHGTGPYKIESGDFVKPKEVAPAWSAVVSETVLKLARADERIVAITPAMPVGSKLEKFQKEFPDRMIDVGIAEQHATTMAAGMATQGMKPFLAIYSTFLQRAYDQVVHDICRQNLNVFIGIDRSGLVGADGETHQGVFDISFLRHLPNMVLMMPKDENEGQHLVYTAMQYEDGPIALRYARGNGLGVHMDEELKAIPIGTWETLKEGTQAAILTFGTTIPMAMEAAERLEKAGVSVKVVNARFIKPMDEAYLHDLLGKNIPILTIEEACLIGGFGTGVVEFASENGYHSALVERMGIPDRFIEHGSVTKLLEEIGLTTDAVVDRIHTMIPSKQKRA

SEQ ID NO: 53747 - protein, 511 aa, Populus trichocarpa
MGSGQRKVEKRSGLENDSFLKEHETAPESGCLSIIVLGASGDLAKKKTFPALYHLYRQGFLHPDEVHIFGYARTRISDDELRDRIRGDILAKKLKLYQSSCNQIKYVSGSYDTEDGFQLLDKEISQHEVSKNSAEGSSRRLFYLALPPSVYPTVCRMIRKCCMNKADHGGWTRIVIEKPFGKDLESAENLSAHIGELFEEAQLFRIDHYLGKELVQNLLVLRFANRFFLPLWNRDNISNVQIVFRENFGTEGRGGYFDEYGIIRDIIQNHLLQILCLVAMEKPVSLKPEYIRDEKVKVLQSVLPIRDEDVVLGQYDGYRDDPTVPDQSNTPTFATVVLRIHNERWEGVPFILKAGKALNSSKAEIRVQFKDVPGDIFKCQKQGRNEFVIRLQPSEAMYMKLTVKQPGLEMSTVQSELDLSYMQRYQGVPIPEAYERLILDTIRGDQQHFVRRDELKAAWEIFTPLLHRIDNGEMKPKEYQPGSRGPVEADELLAKAGYVQTHGYIWIPPTL

SEQ ID NO: 53748 - protein, 174 aa, Oryza sativa
  misc_feature (13)..(13): Xaa can be any naturally occurring amino acid
  misc_feature (33)..(33): Xaa can be any naturally occurring amino acid
  misc_feature (100)..(100): Xaa can be any naturally occurring amino acid
NSENAKSANIDRXILQETKAEQHIHKLLLLGAXESGKSTIFKQIKLLFQTGFDEAELRSYTSVIHANVYQTIKILYEGAKELSQVESDSSKYVISPDNQXDYPLLNKELVLDVKRLWQDPAIQETYLRGSILQLPDCAQYFMENLDRLAEADYVPTKLEGPLSIEPSRKEGEFW

SEQ ID NO: 53749 - protein, 639 aa, Pseudomonas aeruginosa PAO1
MSFSSLGLSEALARAVEAAGYSQPTPVQQRAIPAVLQGRDLMVAAQTGTGKTGGFALPVLERLFPAGHPDREHRHGPRQARVLVLTPTRELAAQVHDSFKVYARDLPLNSTCIFGGVGMNPQIQALAKGVDVLVACPGRLLDLAGQNKVDLSHVEILVLDEADRMLDMGFIHDVKKVLAKLPPKRQNLLFSATFSKDIVDLANKLLHNPERIEVTPPNTTVERIEQRVFRLPAPQKRALLAHLVTVGAWEQVLVFTRTKHGANRLAEYLTKHGLPAAAIHGNKSQNARTKALADFKANDVRILVATDIAARGLDIDQLPHVVNYELPNVEEDYVHRIGRTGRAGRSGEAISLVAPDEEKLLKAIEKMTRQRIPDGDAQGFDPEAVLPEVAQPEPREAPQKQPRRDKERRSSRERKPKDAQASNPDSNVAAAQDGTEKPAGKRRRRGGKNKENREAGQAQQPRQSREARPAKPNRPPEVDGNRDPEEFLDDDFDNFGNRADYVSPYQGQENKGRGRRGGQQKPQGGTGQQGRGQGQGQARGKSQGAAQGGARGQGAGQGKAKKPRAGKPRGQGRENASRMSDAPLREPSEYGTGKQPSRQPVVINKRDLVRMDRFPTAEQLDELEPRRKGERPALLTRNR

SEQ ID NO: 53750 - protein, 189 aa, Kluyveromyces lactis NRRL Y-1140
MGKAKKTRKFALVKRTLNAKKDSRLKSNQAKEVKKDDPELTKNIPQVSSALFFQYNEAIKPPYQVLIDTNFINFSIQKKIDIVKGMMDCLLAKCNILITDCVMAELEKLGPKYRIALKLARDPRIKRLSCSHKGTYADDCIVHRVLQHKCYIVATNDAGLKQRVRKVPGIPLMSVGGHSYVIEKLPGVF

SEQ ID NO: 53751 - protein, 270 aa, Magnetospirillum magnetotacticum MS-1
MLMIMVKTVLGLGGVYLLLVGFVALMQRDMIYHPGKTRTRPDEAGLPEMVPVPIKSADGWIATSWYAAPRSPGRPTVVFFHGNSGTLADRAHKARAFLDAGMGVLLVEYRGYGGNAGRPSERGLYADAEAAMRWLIGQGVSSRRLVLYGESLGSGIAMEMAIRYEVMMVVLESPFTSLADLAPAYVLPPLAQLLTWDRYDNLIKAPSLRVPLLVVHGGKDTLVPVIMGHAVLNAADTIKEGLFLPEAGHNDLWEHGASKKILDFIARRAL

SEQ ID NO: 53752 - protein, 463 aa, Arabidopsis thaliana
MRSCLLNLAALTEGSFSFSATQTSKFKGFLSLKTQVTINQEATSLTGVSGAGQPSAATPSDPPPPPVAPMFIPKTEPGICMSKKTKSKVSTLTQRKRQCTAASAKFRSKAHLQDGDVTEIAPPLFLSCYRENRRLLAVRDRKYPELKFPSETPYSSCFLTEEGLGRYKVIGNRCFNDMRFLPLDGNNTASTQQLLFNGGLLPTVTEIDSYVHEVVMEFYANLPDGEEGDNLAYSVFVRRNMYEFSLAIINQMFQLPNPSYPLDGMSEIQVPESMDEVAIALSNGKANSWKMLTSRLLSPELALLNKICCHNWSPTVNRSVLKPERMTLLYMVAKALPFNFGKLIFDENLGVFEFANPSSTLCLVLPNLIDQMLRFQRIVRSDEGDTTSSAPLKFTMEVKPVPLLQSDSPTLDAALETLIASLTTMHVRLAGGEYSDVSYSVPDDVGDEDVEEEDDDDELDDNT

SEQ ID NO: 53753 - protein, 351 aa, Mycobacterium leprae TN
MEMAGIVVRSESAVAVMGAGAWGTALAKVLIDAGGPEAGVVLWARRPDVAERINTTRCNRAYLPGTLLPPGIRATADPADALRGASTVLLGVPAQRMRANLERWGGLVADGATLVSLAKGIELGTLMRMSQVIVSVTGVDPAQVAVLSGPNLASEIAQCQPAATVIACSDLGRAVALQRMLSSGYFRPYTNSDVVGTEIGGVCKNVIALACGMAAGVGFGENTAATIITRGLAEIIRLGMALGAQVTTLAGLAGVGDLVATCTSPHSRNRSLGERLGRGEIMQSILHGMDGSDGGDGYVVEGVTSCASVLALASSYDVEMPLTDAVHRVCHKGLSVEKAMALLLGRSTKSE

SEQ ID NO: 53754 - protein, 514 aa, Camptotheca acuminata
MEMDALRQVLHPMPTALFFIAPLFFLFILSRLRRKLPYPPGPNGLPLVGNMMMMDQLTHRGLAKLAKQYGGIFHLRMGFLHMVAVSSPEIARQVLQVQDNIFSNRPATIAISYLTYDRADMAFAHYGPFWRQMRKLCVMKLFSRKRAESWESVRDEVDSMVRVVVSHTGKSVNIGELVFSLTRDIIYRAAFGSSSHEGQDEFIKILQEFSKLFGAFNIADFIPGLGWVDPQGLNARLVQARASLDGFIDSIIDDHIEKHRRRNVVDSDGDMVDDLLAFYSDEAKVTESDDLQNAIRLTRDNIKAIIMDVMFGGTETVASAIEWAMAELMKSPEDLKRVQQELAEVVGLDRRLEESDFDKLTYLKCALKETLRLHPPIPLLLHETAEDTEVAGYYIPARSRVMINAWAIGRDKNSWDEPETFKPSRFLKEGVPDFKGSNFEFIPFGSGRRSCPGMQLGLYALEMAVAHLLHCFTWTLPDGMKPSELDTDDVFGLTAPRATLFVAVPSPRLLCPLY

SEQ ID NO: 53755 - protein, 621 aa, Zea mays
  misc_feature (103)..(103): Xaa can be any naturally occurring amino acid
LGDTIEQVCTKKQAGTGPEFPGSPPPPLRSPFPRSRAPAPAPENPPHAGLVPRWRRRCASRGSRGSLCLWTRPSPPPSSGGSGARPPRARTRGRNAGGGGGAXAVRCQTGSTAPPVLRTEEAPAAAAGARNAQAGFTVVMKFGGSSLASAERMREVAGLILSFPDETPVVVLSAMGKTTNNLLLAGEKAVSCGAPKASEIPELAVIKDLHLRTVDELGLDRSIVSGLLDELEQLLKGVAMMKELTLRTRDYLVSFGECMSTRIFAAYLNKLGKKARQYDAFDIGFITTDDFTNADILEATYPAVAKRLHEDWMDDPAIPIVTGFLGKGCKSCAVTTLGRGGSDLTATTIGKALGLREIQVWKDVDGVLTCDPNIYANAIPVPYLTFDEAAELAYFGAQVLHPQSMRPARDGDIPVRVKNSYNRHAPGTVITKSRDMSKSILTSIVLKSNVTMLDIVSTRMLGQYGFLAKVFSIFEDLGISVDCVATSEVSISLTLDPSKLWSRELIQQELDHVVEELKKFAVVHLLQRRSIISLIGNVQRSSLILEKAFNVLRRNGVNVQMISQGASKVNISLVVNDSEAKQCVQALHSAFFENGFLSEVEGAEVPQNGASLNSNGAVYGN

SEQ ID NO: 53756 - protein, 499 aa, Oryza sativa Japonica Group
MAFFLVACLPWVCFILLSLYVFQLFADARRRLPPGPWPPKPLIGDLLALGKGDQQHRSLARLADRYGPVMSLRLGTVLTVVVSTPDAMREIFHKNKDNLAGRPTADAFNAMGHSANSLLGLEHPGVRWRAIRRFSTAELLAPRRLAALQPLCRDKVRGLVRGVSELAARGEPVHVRRVALDMALSLMLSAIYSVDLDPESTAVFRSVVEEAMLLIGTANLSDLFPAIAALDLQGVRRRVAELFTITYRQYDEQVARRRPERDAGEAGKNDLLNVVLDMEREWQQKGSVLSHDAMRVLFTDLYGAGASTTSVLIEWAIADLLQNPESMRKIKEEITNVIGTNAQIQEFDIARLPYLQAVVKETLRLRAVAPLVPRRAEATIEVQGFTIPKGTNVILNLWAINRDARAWNDPDKFMPERFIGNDINYLGQNFQFVPFGVGRRICLGLPLAQKVMYLVLGTLVHQFEWTLPEELKETGIDMTEKCGMVLCLANPLKVMAKKM

SEQ ID NO: 53757 - protein, 107 aa, Granulicatella elegans
MTQVFQGRSFLKEKDFSRAEIEYLIDFSAHVKDLKKRGVPHKFLEGKNIALLFEKTSTRTRAAFTTAAIDLGAHPEYLGKNDIQLGKKESVEDTAKVLGRMFDGIEF

SEQ ID NO: 53758 - protein, 436 aa, Prochlorococcus marinus str. MIT 9312
MHIVVVGLSHRTAPVEVREKLSIPDQSITKSLKALKAFSEVLEVSILSTCNRLEIYALVKDKNTGISSIKEFISDYSGIIFEDLNPHLFCFRQEDAVLHLMKVSAGLDSLVLGEGQILSQVKKMMRLGQENQSTGPILNRLLTQSVSTGKKVRSETNLGTGAVSISSAAVELAQLKIGQEKGFDTLVSLESEKVLVVGAGRMSRLLITHLKAKGCHKLILVNRNIDRALNLAIDFPDIEIVCKGLNELDENISISSLVFTSTASEEPIIDLAKIEKLNLNNKLKFIDIGVPRNISNDVKNHQFVKSFDVDDLQEVVSRNQEFRQKIAKEAESLVEEERIIFLEWWASLEAVPVINKLRSDLELIRKEELQKALSRMGPDFSARERKVVEALTKGIINKILHTPVTKLRSPQSREERQASLKIVEKLFSLVDEDKNS

SEQ ID NO: 53759 - protein, 266 aa, Arabidopsis thaliana
MASFVESGWQYLVTHFSDFQLACIGSFLFHESVFFLSGLPFIFLERQGFLSKYKIQTKNNTPAAQGKCITRLLLYHFSVNLPLMLASYPVFRAMGMRSSFPLPSWKEVSAQILFYFIIEDFVFYWGHRILHSKWLYKNVHSVHHEYATPFGLTSEYAHPAEILFLGFATIVGPALTGPHLITLWLWMVLRVLETVEAHCGYHFPWSLSNFLPLYGGADFHDYHHRLLYTKSGNYSSTFVYMDWIFGTDKGYRRLKTLKENGDMKQT

SEQ ID NO: 53760 - protein, 431 aa, Prochlorococcus marinus str. MIT 9312
MKRVLAIILGGGKGSRLYPLTKMRAKPAVPLAGKYRLIDIPISNCINSGIEKMYVLTQFNSASLNRHIGRTYNLNGPFGQGFVEVLAAQQTPDSPKWFEGTADAVRKYQWLFQEWDVDEYLILSGDQLYRMDYSLFVQHHRDNGADLTVAALPVDEAQAEGFGLMRTDDLGNIKEFSEKPTGEKLKAMAVDTSKFGLTKESAAEKPYLASMGIYVFSRNTLFDLLNKFPNYTDFGKDIIPEALKRGDTLKSYVFDDYWEDIGTIGAFFESNLALTEQPKPPFSFYDEKFPIYTRPRFLPPSKLVDAQITDSIVCEGTILKSCSILHCVLGVRSRIESDSILEDTLVMGADFFESPEERIELRKGGGTPLGVGEGTTVKRAILDKNTRIGDNVVIINKDRVEEADKPELGFYIRNGIVVVVKNATIANGTVI

SEQ ID NO: 53761 - protein, 472 aa, Prochlorococcus marinus str. MIT 9312
MSKAHFGLVGLGVMGENLVLNAERNGFSSVVFNRTYSKTEEFLQGRGLGKNIEGAETLQEFVNKLERPRRILMMVKAGPATDAVIENISGYLEEGDLLIDGGNSQFKDTERRVNTLESKSFGYIGMGVSGGAKGALEGPSMMPGGTKASYDAIESLLTKMAAKVEDGPCVAYVGPGGSGHFVKTVHNGIEYGIEQILAEAYDLMKRVKGMNGQQMSEVFGIWNNTDELASYLVEITEICLNTKDEITGDDVVEKILDKAGQKGTGLWTVVSALELGVSVPTIYASLNARVMSSLKEQRSEIEKTIPSKEIEDFDLGNISDGMKPLFDAVVLATIASYAQGMDILREASTVYNYGLNMPSIAQIWKGGCIIRSKLLSKIQDAYNKDPNLKNLIFDDWFNNEIATRLDNLAKVVSLSTKAGIPVPCLSSTLDYLNSYRTNRLPQNLVQAMRDCFGSHTYQRIDKEGSFHTEWMK

SEQ ID NO: 53762 - protein, 336 aa, Mycobacterium leprae TN
MKLAIIGGDGIGPEVVAQAVKILDVVLPGVQKTTYDLGARRYHTTGELLPESVLAELREHDAILLGAVGDPSVPSGVLERGLLLRLRFELDHHINLRPARLYPGVNSLLAGKPDIDFVVVREGTEGPYTGTGGAIRVGTPNEVATEVSVNTAFGVRRVVQDAFERARQRRKHLTLVHKNNVLTYAGTLWCRIVQEVGEKYPDVEVVYQHIDAATIYLVTEPSRFDVIVTDNLFGDIITDLAAAVCGGIALAASGNIDATRTNPSMFEPVHGSAPDIAGQGIADPTAAIMSLALLLAHLGEDEPAARLDQAVASYLATRGNGRFSTGEVGERIAAAL

SEQ ID NO: 53763 - protein, 263 aa, Streptococcus agalactiae A909
MLPYYVVNAFTNKAFSGNPAGVVVLNEPIKEDLMQKIAKENKLSETAFILKEKDLYKIRWFTPEKEVDLCGHATLASTYVISRYLEDDLSHITFSSKSGLLEVTISGEDITLFFTMVDVKQVPITAMMRESIEPTILEAYRTADEEHLVLYLENQESIENFKIDLEKISQLAPHGVTLTAQSSEKNIDYVLRYFAPNYGINEDPVTGSAQTRLAPIWTKKLGKEQLVSKQLSERQGLMMIELEENLVKISGQANLYLKGNIDI

SEQ ID NO: 53764 - protein, 505 aa, Vitis vinifera
MELAKPSSVFAIQDHQSSSPPTPIWKTVVVASIAAGIQFGWALQLSLLTPYVQLLGIPHKWAAFIWLCGPISGMIVQPVVGYHSDRCTSRFGRRRPFIAAGAVLVAIAVFLIGYAADIGRVSGDPLHNTIKTRAVAVFVVGFWILDVANNMLQGPCRALLADLSGTSARRTRTANALYSFFMAVGNVLGYAAGSFSKLHKMFPFARTQACDLYCANLKSCFFLSIALLLILTIIAFATVHETPLNRADIAVVEAGQPFYSQMMNAFRQLRRPMWVLLLVTCLNWIGWFPFLLFDTDWMGREVYGGTVGEGPRGRLYDLGVRAGSLGLMLNSVVLGLMSLGVEFFGRGVGGVKRLWGGVNFLLALCLALTVLVSKLAASWRHSLGGELHPPPIGIKAGALSLFAVMGVPLAITYSIPFALASIFCHSSGAGQGLSLGVLNLAIVVPQMMVSVASGPWDARFGGGNLPAFVVGAFAAALNGVLALTMLPAPPPDVPNTKDERTQPSS

SEQ ID NO: 53765 - protein, 448 aa, Triticum aestivum
  misc_feature (135)..(135): Xaa can be any naturally occurring amino acid
MADGANPNPTSTPRQKAVPDWLNSPIWSAPAPTPRHRSPPRAPSPPPPPPPKPQHDPTPPPPRQPARRDGASSDSDSDSGGGDEGAATSSRTHLVAEFKAALERKVVDLAELRRLACQGVPDDPAVRPVVWKLAXLLGYLPMDHALWAYELEKKRSQYSAFQDQLLVNPSEVTRRMEMTISKRKEHNSEGTGFLPRAEIVQDEHPLSLGKTSVWNQHFQESETVEQIDRDVKRTHPEMQFFNGGSSDALSNQESLKRILTIFAKLNPGIRYVQGMNEVLAPLYYVFKNDPDQSNSASAESDAFFCFVEVLSGFRDNFCKQLDNSVVGIRSTISKLSQLLKRHDEELWRHLEVVTKVNPQFYAFRWITLLLTQEFKFRDCIHLWDALLGDPEGPQATLLRICCAMLILVRRRLLAGDFTANLKLLQNYPPTNIDHLLHIANKLRGLVPC

SEQ ID NO: 53766 - protein, 296 aa, Bacillus cereus ATCC 14579
MTIAFDTFLKESKTFVEEKLVSYANGLQCPNVLREAMAYSLEAGGKRLRPLLLFATLQAFGKERNLGVGAACALEMIHTYSLVHDDLPCMDDDDLRRGKPTNHKVFGEAMAVLAGDGLLTYAFQVIMAYEQKEISAEKKVRLVLELAKAAGPEGMVGGQVADMEAEGKRLTIDELEYIHKHKAGKLLEFAVLAGAILSDATEEQEEKLLTFAKYIGLAFQIRDDILDVEGTEEEIGKPIGSDLSNEKSTYTTLFTVDRAKDILEETIAEAKGAISSLQLQDEYLLSICDLIAKRNN

SEQ ID NO: 53767 - protein, 163 aa, Melampsora medusae f. sp. deltoidis
STLTEIDSDHESSHQKVDINDTLGDDNLLMNKSERKARKTLAKLGLKKVLGINRVTMRKFKSQQFFVIANAEVFKSATANVYIVFGEAKTEETAPGLNLGGGGGGGGGGGFGAESMVSAGKQVAGKITDVNEDDQEPMDESGLDPNDIETVMTQVNCSRNKAV

SEQ ID NO: 53768 - protein, 369 aa, Magnaporthe grisea 70-15
MVRGTVLITGGTGYIGSFTSLALLENDYDVVIVDNLYNSSAVAIDRIELICGKRPAFHNVDITDEAALDKVFDAHPEIDSVIHFAALKAVGESGEIPLEYYRVNVGGSISLLRSMQKHNVCNIVFSSSATVYGDATRVPNMIPIPEHCPIGPTNTYGRTKSTIEDVISDHVNAQRNNLKKADKPFDMWNGALLRYFNPCGAHPSGLMGEDPQGVPFNLLPLLGQVATGQREKLLVFGDDYSSRDGTAIRDYIHVLDLAKGHLAALNYLRDNKPGVKAWNLGSGRGSTVFEMIKAFSSVVGRDLPYEVVPRRQGDVLDLTANPALANKELGWKTELRMEDACQDLWKWVKNNPQGYRQDPPQEFVAALKK

SEQ ID NO: 53769 - protein, 335 aa, Colwellia psychrerythraea 34H
MTKQTITVIPGDGIGPSIIDATIKILDKAGCGFDYEFADAGLTALEKHGELVPEETINLIEKNKITLKGPLTTPVGEGFTSINVTLRKQFKLYANLRPVLSFKGTKARYENIDILTVRENTQGMYSGAGQVTSEDGTEAQAMSIVTREGAEKILTFAYETAIKEGRKKITAVHKANILKSTSGLFLKVAREVAQRYPQIESTEMIVDNCCMQLVMNPEQFDVIVTTNLFGDILSDLCAGLVGGLGMAPGANIGEDCAIFEAVHGSAPDIAGKNLANPTSVILAAIQMLEYLDMGDKAEKIRAAITDVIASGDRTTGDLGGTHGTTDFTEAVLERL

SEQ ID NO: 53770 - protein, 252 aa, Geobacillus stearothermophilus
RKPIIAGNWKMHKTLAEAVQFVEDVKGHVPPADEVISVVCAPFLFLDRLVQAADGTDLKIGAQTMHFADQGAYTGEVSPVMLKDLGVTYVILGHSERRQMFAETDETVNKKVLAAFTRGLIPIICCGESLEEREAGQTNAVVASQVEKALAGLTPEQVKQAVIAYEPIWAIGTGKSSTPEDANSVCGHIRSVVSRLFGPEAAEAIRIQYGGSVKPDNIRDFLAQQQIDGPLVGGASLEPASFLQLVEAGRHE

SEQ ID NO: 53771 - protein, 936 aa, Saccharomyces cerevisiae
MDGEMAIIESSNHVGTSSPTTETQFTIDSSALKDQETKESITNSPTSEVPIETKLPKSSDIVTEEKHPQNTTTDIENEVENPVTDDNGNLKLELPDNLDNADFSKLLEFDAKNDEALFNSNELLSHTMDPVNNIDLTHDHSREVSSKEDINIEPVNPDEDEREKTQDNTAAVKTEGIRNSEDTSIQKDEPTADAIYTDVHKLSVNKDTETLPTLVDEKNNMLHMRNNSITPIMFQQHELVGQPPQNTVTENNSTDAETTQRKLSEPIDASLPLPNEQPTIFAYARLDFQSFTFYVQTLHAIIGRRSENDFSHKVDVNLGPSKSISRRHAQIFYNFGTGRFELSIIGKNGAFVDDIFVEKGNTVPLRNKTKIQIGQIPFQFILPEQERNDDSKSPENADIAESEINTRNLKKNEPKSKKKITTGAKPKKAQTKPAVKKEKKPPKIPKKVYTLEEIPVEYRTKPTVSYSAMLTTCIRKYSTAKGMSLSEIYAGIRELFPYYKYCPDGWQSSVRHNLSLNKSFRKVSKEGKGWLWGLDEEYIAERERQKKKQSEIAVAKAQAAQLKLEQQQHKLQQVPQRGKKDIVSQRSNVNARKQNISQTLAANRAASNRKNTASDNQRTMKYLQEQLVILTRDRKGLSKQVIAAILTQALAMTINQVTQAAKNKGITGNPLTALMDKNPQHLNLILAAAVNAATAKVTKGEVKQLVNPETTAAAALAAKAQHSKPIRQPIVQTPHVPDRPPSQLSASASSHPNNYLHDKQPGSFDPSSLSRFFQPRQNARATSSVAATSVPAAASQNVDAQPKPKPAQDNDLESESGTSSSSSSSSESGSESDSGSDDGSASGSGDNSSTSSESESESDSGSEVDEKNNKNEKIDSESIKNNESKDDIPSKDENSSNDNREISKTDEEGHDSKRRKVSEDINEGITEVNVSLEEKL

SEQ ID NO: 53772 - protein, 174 aa, Melampsora medusae f. sp. deltoidis
LTEIDSDHESSHQKVDINDTLGDDNLLMNKSERKARKTLAKLGLKKVLGINRVTMRKFKSQQFFVIANAEVFKSATANVYIVFGEAKTEETAPGLNLGGGGGGGGGGGFGAESMVSAGKQVAGKITDVNEDDQEPMDESGLDPNDIETVMTQVNCSRNKAVKALKENDGDLINA

SEQ ID NO: 53773 - protein, 76 aa, Pyrus pyrifolia
MITDAEQRGLIKPGQSVLVEPTSGNTGIGLAFIAATKGYRLILTMPASMSLERRVLLKAFGAELVLTDSAKGMKGA

SEQ ID NO: 53774 - protein, 497 aa, Bordetella petrii
MSEVPSVPLLIGGKLVQSKTTEWRDVIDPATQQVVARVPFATREELDLAVANAKEAFQTWRNTGQGARMRVMLKLQQLLRENTAKLAEMITREHGKTLPDAEGEVGRGLEVVEHACSIANLQLGEYAENAAGGIDVYTLIQPLGVCAGITAFNFPVMLPCFMFPIAVACGNTFVLKPSEQDPTSSLFLAQLALEAGLPPGVLNVVHGGPEIANGLCEHPDIKAVSFIGSTRVGSEIYQRASNAGKRCQAMMGAKNHCVILPDADPEVALNQLLGAAFGAAGQRCMAASVAVLVGEARNWLPDFVERAKGLKVNAGTDRKADLGPLVSPNAKKRVESLIQKGVDEGARLLLDGRNLKVPGFEQGNFVGPTVFDGVTENMTIYTEEIFGPVLSVVGVDTLEEAVAFINRNPNGNGVALFTQDGGAARYFQNNIDVGQVGINIPIPVPVAWFSFTGSRGSKLGDLGPNGKQAVQFWTQTKTVTARWSAHGRTVNTTISMR

SEQ ID NO: 53775 - protein, 159 aa, Melampsora medusae f. sp. deltoidis
  misc_feature (150)..(150): Xaa can be any naturally occurring amino acid
  misc_feature (152)..(152): Xaa can be any naturally occurring amino acid
QKVDINDTLGDDNLLMNKSERKARKTLAKLGLKKVLGINRVTMRKFKSQQFFVIANAEVFKSATANVYIVFGEAKTEETAPGLNLGGGGGGGGGGGFGAESMVSAGKQVAGKITDVNEDDQEPMDESGLDPNDIETVMTQVNCSRNKAVXAXKENDGDL

SEQ ID NO: 53776 - protein, 748 aa, Escherichia coli K12
MLTRLREIVEKVASAPRLNEALNILVTDICLAMDTEVCSVYLADHDRRCYYLMATRGLKKPRGRTVTLAFDEGIVGLVGRLAEPINLADAQKHPSFKYIPSVKEERFRAFLGVPIIQRRQLLGVLVVQQRELRQYDESEESFLVTLATQMAAILSQSQLTALFGQYRQTRIRALPAAPGVAIAEGWQDATLPLMEQVYQASTLDPALERERLTGALEEAANEFRRYSKRFAAGAQKETAAIFDLYSHLLSDTRLRRELFAEVDKGSVAEWAVKTVIEKFAEQFAALSDNYLKERAGDLRALGQRLLFHLDDANQGPNAWPERFILVADELSATTLAELPQDRLVGVVVRDGAANSHAAIMVRALGIPTVMGADIQPSVLHRRTLIVDGYRGELLVDPEPVLLQEYQRLISEEIELSRLAEDDVNLPAQLKSGERIKVMLNAGLSPEHEEKLGSRIDGIGLYRTEIPFMLQSGFPSEEEQVAQYQGMLQMFNDKPVTLRTLDVGADKQLPYMPISEENPCLGWRGIRITLDQPEIFLIQVRAMLRANAATGNLNILLPMVTSLDEVDEARRLIERAGREVEEMIGYEIPKPRIGIMLEVPSMVFMLPHLAKRVDFISVGTNDLTQYILAVDRNNTRVANIYDSLHPAMLRALAMIAREAEIHGIDLRLCGEMAGDPMCVAILIGLGYRHLSMNGRSVARAKYLLRRIDYAEAENLAQRSLEAQLATEVRHQVAAFMERRGMGGLIRGGL

SEQ ID NO: 53777 - protein, 105 aa, Triticum aestivum
  misc_feature (12)..(12): Xaa can be any naturally occurring amino acid
  misc_feature (50)..(50): Xaa can be any naturally occurring amino acid
  misc_feature (88)..(88): Xaa can be any naturally occurring amino acid
DGETTLSASGSXAPMRPVLSNLMYEEDHGNESELGDIHVCAWVGAFDDAXKHVADDVHITILDTEERSTLHWAVDRDHLDAVLVIANXNADVNAHDIERQTALHY

SEQ ID NO: 53778 - protein, 516 aa, Flammulina velutipes
MSRSLTAFITLSLLVLRSFAGIGPITDLVIANADVAPDGFTRTAALSGGTVNGALITGSRGDNFQINVVNNLNDNNILQSTSIHWHGMFMAGTSWADGPAFVNQCPIAKSNSFVYDFTALEQAGTFWYHSHLSSQYCDGIRGPMVIYDPDDPHAALYDVDNDDTVITLADWYHAFAKTLAFPTPDSTLINGLGRWAEDPTSDLAVINVEAGVRYRFRLVSMSCDPNFVFAIQGHTLNIIEADGVSTEPIEVDQITIFAGQRYSFVLTAEQAVDNYWIRAEPTPGPTGFEDGINSAILRYSGAAEAEPTDDTVESTNPLDENALVPLENPGADGTAEVGADDVFAINLALAFDLSTFKFTVNGATFEPPTTPVLLQLLSGAQTADTLLPAGSLFTLPANRVVELSIPSEGLIGGPHPFHLHGHVFDVIRGPGQTDYNFENPPRRDVVSIGAAGDNVTIRFTTDNPGPWFLHCHIDWHLEAGLALVFAEDTDNWDVSTPPTSWDELCPIYDALSEDDL

SEQ ID NO: 53779 - protein, 405 aa, Methanosarcina acetivorans C2A
MITNSRKGIHLTENIIESGDPQARYDSVIEKDSKYVMQTYGRQPLVLSKGKGAVVQDIYGKEYIDCVAGIAVNNVGHCHPTVVKAIQAQAENLIHVSNLYYTEIQAEFAETLASITGMERVFFCNSGAESVEAAMKLARVATGKSAFVAAEHSFHGRTIGALSVTHKSMYRDPFMPPVSSETTFVPYSDAEAIRQAISENTAAVILEPIQGEGGINIPDPGYLKEVREICDETGALLIFDEVQTGFGRTGTWFCKEQFGVEPDIMSMSKAIGGGFPMGAIAAHNGINFGRGQHASTFGGGPLACAAALASVKVIREEKLLERSKEMGAYFMKKLAGMVRDDVVEVRGKGLMIGVEIKYPCGKFVDFAREQGVLVNCTSDSVLRLVPPLVITKEQIDTVVDVLEQA

SEQ ID NO: 53780 - protein, 455 aa, Pseudomonas aeruginosa PAO1
MIDSLNHLPRPDAGADTLAERFADLAPPLNARQAALESARCLYCYDAPCVNACPTEIDIPGFIRSIAQENVQGAAQKILSANILGGSCARVCPTEILCQRACVRNNAQECAPVLIGQLQRYALDHAGFDEHPFKRSPATGKRIAVVGAGPAGLSCAHRLAMHGHDVVLFEARTKAGGLNEYGIARYKLVDDFARREVEFLLQIGGIELRHGQRLGDNLALGALHDEYDAVFLGIGLAASKRLGLEDEDAPGLLAATDYIRELRQSDDLLDLPVADRCIVIGAGNTAIDMAVQMSRLGARDVNLVYRRGFEEMGATGHEQEIAKASQVRLLTWARPERVLLDEHGRVRGMRFARTRLENGRLGDTGEHFELAADAIFKAIGQAFEGASLGDPLAAQLRRDGERIQVDGQMRTSIPGIYAGGDCVALGEDLTVQAVQHGKLAAEAIHAQLMLNVEAA

SEQ ID NO: 53781 - protein, 478 aa, Synechocystis sp. PCC 6803
MQATMSQDFDYDLVIIGAGVGGHGAALHAVKCGLKTAIIEAKDMGGTCVNRGCIPSKALLAASGRVREMSDQDHLQQLGIQINGVTFTREAIAAHANDLVSKIQSDLTNSLTRLKVDTIRGWGKVSGPQEVTVIGDNETRILKAKEIMLCPGSVPFVPPGIEIDHKTVFTSDEAVKLETLPQWIAIIGSGYIGLEFSDVYTALGCEVTMIEALPDLMPGFDPEIAKIAERVLIKSRDIETYTGVFATKIKAGSPVEIELTDAKTKEVIDTLEVDACLVATGRIPATKNLGLETVGVETDRRGFIEVNDQMQVIKDGKPVPHLWAVGDATGKMMLAHAASGQGVVAVENICGRKTEVDYRAIPAAAFTHPEISYVGLTEAQAKELGEKEGFVVSTAKTYFKGNSKALAEKETDGIAKVVYRQDTGELLGAHIIGIHASDLIQEAAQAIADRKSVRELAFHVHAHPTLSEVLDEAYKRAV

SEQ ID NO: 53782 - protein, 389 aa, Physcomitrella patens subsp. patens
MEIRAGELLDWGRNYSALSFVWTPISMSTITRPHIAFPVSVLAWWKCSASWFDFSSESSAKSGAGMTTGDFTILSHLKELGCGELLRKPREIHFSGCINESYAFHCSGGDFFVKINRLRRLVATQTLVVPSPLGCGNLPDGGSYIIMKHLRFRPFGMMQESSLSALGRDLARLHLADSGDLFGFPMTTRVGIVPLDNSWNSSWSEFFVEQRLRDRLERVYEILGGDKTDLEMKGAMVVERARSLLKDYNPKPSILHGDLWMGNSGLVATGEVAVFDPAGFIGDAEFDLAFEGWKPVPDFPGFSEAFYTAYHQLLPKIPGFEKRHQLYQFFHLLNHFVIWRTSSFYGDPRIARGRNGTRCSTEPDLDTSTLTSRAPTTPQEYFLVLDVIS

SEQ ID NO: 53783 - protein, 379 aa, Schizosaccharomyces pombe 972h-
MATEIAKHICCGIDCNNEADRLQCPKCLNDGVKSYFCGQECFRNSWNIHKHLHRPPNVEKREDGTYNPFPKFHFAGSLKPVYPLSPIRKVPPHIKRPDYAKTGVSRSEQIEGRSFKLKRLTPKEQEGMRKVCRLGREVLDAAAAAVRPGTTTDELDSIVHNACIERDCFPSTLNYYAFPKSVCTSVNEIICHGIPDQRPLEDGDIVNIDVSLYHNGFHGDLNETYYVGDKAKANPDLVCLVENTRIALDKAIAAVKPGVLFQEFGNIIEKHTNSITEKQISVVRTYCGHGINQLFHCSPSIPHYSHNKAPGIARPGMTFTIEPMLTLGPARDITWPDDWTSSTASGRCSAQFEHTLLVTETGCEVLTARLPNSPGGPLK

SEQ ID NO: 53784 - protein, 303 aa, Rubrobacter xylanophilus DSM 9941
MSAPRVIVVGDVLYDMVARVEGGLPVGADSFVRIQDSPGGSGANVAAWLASLGVEAHLVGRVGEDPLGDHLEAGLREAGVRTHLPRDPSLPTGRVFVLVDGSGERTMITDRGAGEALGPRDIPARLFAPGAHLHLTGYLFSGGGRREAALEALRLARSAAMSFSVDPSSVTLLRAVGVERFAGWTSGADLLFPNLSEAALLSGRAEPEEAARRLLERYRAVVLKLGPEGALYADREGRRARLPAPRVRRADATGAGDALCAAFLASWVRGEPPARALREGVRLAARVVGRTGARGFRRTRGPC

SEQ ID NO: 53785 - protein, 288 aa, Aegiceras corniculatum
  misc_feature (135)..(135): Xaa can be any naturally occurring amino acid
MEGKEEDVRLGANKFAERQPIGTAAQGAGDKDYKEPPAAPLFEPGELSSWSFYRAGIAEFMATFLFLYITVLTVMGVSRSGSKCASVGIQGIAWAFGGMIFALVYCTAGISGGHINPAVTFGLLLARKLSLTRAXFYMIMQCLGAICGAGVVKGFEGSSRFTIAGGGANVVQPGHTKGDGLGAEIVGTFVLVYTVFSATDAKRNARDSHVPILAPLPIGFAVFLVHLATIPITGTGINPARSLGAAIIYNKDQAWDEHWIFWVGPFIGAALAALYHQVVIRAIPFKSK

SEQ ID NO: 53786 - protein, 573 aa, Triticum aestivum
MIELEFIRSALFSPPPSPFLPTQHLGSNSPPSHRRARSPRARISVATGVLLKEGKIILFVMAGTDSSASSRQSSFNSLAKDLELPLEQGCLTIVVLGASGDLAKKKTFPALYHLFEQGFLQSGEVHIVGYARTNLSDDGLRGRIRAYLKGASEEHVSEFLQLIKYVSGSYDSGEGFEKLNKEISDYEMSNNSGSSRRLFYLALPPSVYPSVCKMIRTYCMSPTSRAGWTRVIVEKPFGRDLDSAEELSSQLGELFEEDQLYRIDHYLGKELVQNLLVLRFANRLFLPLWNRDNVDNIQIVFREDFGTDGRGGYFDQYGIIRDIIQNHLLQVFCLVAMEKPVSLKPEHIRDEKVKVLQSVNPIKDEEVVLGQYQGYKDDPTVPDDSNTPTFASIVLRVHNERWEGVPFILKAGKALNSRKAEIRVQFKDVPGDIFKCKKQGRNEFVIRLQPSEAMYMKLTEFVQVKKPGLEMATEQSELDLSYGMRYQDVKIPEAYERLILDTIRGDQQHFVRRDELKAAWQIFTPLLHDIDAGKLKAVSYKPGSRGPKEADELSEKVGYMQTHGYIWIPPTLA

SEQ ID NO: 53787 - protein, 284 aa, Aegiceras corniculatum
MAKDIEVGPGANAPKDYQDPPPAPLIDAEELTKWSLYRAVIAEFIATLLFLYITVLTVIGYSSQTDPDKNPDDCGGVGILGIAWAFGGMIFVLVYCTAGISGGHINPAVTLGLFLAQKVSLVRAMLYMMAQCLGAICGCGLVKAFQKSYYTKYGGGANYLHDGYNKGTGLGAEIIGTFVLVYTVFSATDPKRSARDSHVPVLAPLPIGFAVFMVHLATIPITGTGINPARSLGAAVIYGKKKTWDDQWIFWGGPFIGAPIAAFYHQFILRAGAIKALGSYRSNA

SEQ ID NO: 53788 - protein, 382 aa, Porphyra purpurea
MLNFRAKCTTYSLEEYTRYSKHLILPQIKLEGQERLKQSSILCVGAGGLGSPALIYLAASGIGKIGIVDNDIIDISNLQRQILYTVNDIGLSKAYIAKKKILEINPTCNVQIFNTRLQSINAIEIIRQYDIIIDGTDNFGSRYIISDSCLELNKIHIYGAIFQFEGQVSTFNYQGGPKYRDFHNNIETENNPEDTCSNAGVLGLLPGIIGTLQATEAIKIILGYKSVLSGIILKYNAMTISFEKFKIIHTQFILSQPKKKIKSLLVGNSSYPVQEIDVIELQNELYRNSFKYIILDVRSKEEYEESHLDKAVNLPIKDMKKRYYSDLNLQDKISFIYCSVDSRSIFAYNFLRKQEFKVIRVKGGLSSWTNIIGNEKLYVKSC

SEQ ID NO: 53789 - protein, 124 aa, Flavobacteria bacterium BBFL7
MADLKDFAEQLVNLTVKEVNELATILKDEYGIEPAAAAVAMAGPAGGGDAAADEQTEFDVILKAPGGAKLAVVKLVKELTGAGLKDAKDLVDNAPSPIKEGVSKDEAEALKAQLEEAGAEVELK

SEQ ID NO: 53790 - protein, 145 aa, Prochlorococcus marinus subsp. marinus str. CCMP1375
MLNPSRFRILAIGKVRKSWIQNGLEVYRKRLPGLSITEIRDGDIKKESRAIISSIKKDELLIALCEEGEKFTSMDFSHWLQNLGSSRIVFAIGGTNGLSQEVKTSADLCISLSALTFPHEMARLILAEQLYRAISIAKGSPYHRE

SEQ ID NO: 53791 - protein, 122 aa, Populus trichocarpa
MASKLAQLQSKACHASKFVSKHGGAYYKQLLEQNKQYIQDPPTVEKCNLLSKQLLYTRLASIPVRYEAFWKELDYAKHLWKHRQELKVEDAGIAALFGLECFAWYCAGEIVGRGFTFTGYYV

SEQ ID NO: 53792 - protein, 924 aa, Cryptococcus neoformans var. neoformans JEC21
MLRRSHIPRAALNINRAPAARAFTKPSLPLSASSQLTKKDSSNVLFEFDAHKVGNEIRKRGLGNLLGVQREGGMDRDTIIRLLYSLGSRHEVERYLRIFTQSSRASPGGVLPEAKFAVLKIGGAILSNELDDLALSLSFLNRLGLFPVVLHGAGPQLNEILESEGVIPDYEDGIRITDAKTLAIARRVFLQENLKLTTALERLGTRARPIPTGVFTADYLDKSKYGLVGKITRVDKAPIEAAIKAGCLPILTSLAENAEGQILNVNADVAAGELARVLEPMKIVYLNEKGGLFHGVTGKKISTINLDEEYDALMKESWVKFGTKLKIREIKELLDTLPRTSSVAIISTDMLQKELFTDAGAGTLIRRGYKLYKQPSVEAVGSTQLRQVFTERDPEVESGRKSVAEIFSELKNSPHTIYGDEPFDVVAVVSHPAGETPVMTKFLPSRNGILNKIVDNVFDAIKKDHKRLFWTAKADDENRAWHFERADGSFTRAGRSLFWYGVPNVKEVERIIEGFEENGRIERVFLPVGPSVPPHRRAAAAPAAGATPAGARAFSTSTRPHLAGTSNTGARGYATVADAAPRKRVALIGARGYTGQNLISLIDNHPHLDLTHVSSRELAGLPLKDYKKSAVNYSNLSVEDVGKMAEANEVDAWVMALPNGVCKPFVDAIDKASKKGGKSVIVDLSADYRFENDWTYGLPELYGRDHVKQANRVSNPGCYATNTQLLLAPLMPHLDKVQMPSVFGVSGFSGAGTKSGEKDAEGRPKTVPKISAEDLKGGIRPYSLTDHIHEREASRHLSSLIPSSTNPFSLAFIPNVAPWFSGILSVLTAPLDKSMRASEIIELYEEKYGKEPLIQVQKTVPDVTEVMGKHGWRVGGVQVHSSGKRVVVVGALDNLLKGAATQAMQNLNLALGYEELAGVPTDKF

SEQ ID NO: 53793 - protein, 106 aa, Vitis vinifera
MNESNKRKKEGRNTWNGRGRKRTATNGFHHSRLLFLSHLPHFRISLPLNCKPPTGGRLEGVQKFSATGDKNLPWRKILEFGRHVFDGTRTPVDLKDKWRKMLAKES

SEQ ID NO: 53794 - protein, 411 aa, Lactococcus lactis subsp. cremoris
MKRKISVAGIGYVGLSLAVLLAQKNHVTAVDIIQSKVDLINNKKSPIQDDYIEKYLAEKELDLTATVDGEKAYKEAEYVIIAAPTNYDSASHHFDTSAVEAVIELVMKVNPNAWMIIKSTIPVGYTESVRKKYGTNKILFSPEFLRESKALYDNLYPSRIIVSCDEESREAAETFAGLLQEGALKEDIDTLFMGFTEAEAVKLFANTYLALRVSYFNELDTYAEMKGLDTEAIIKGVGLDPRIGSHYNNPSFGYGGYCLPKDTKQLLANYADVPQNMMSAIVESNRTRKDFIADQVLKMAGYYDYFNRGDYSAVQEKECIVGIYRLTMKSNSDNFRQSAIQGVMKKIKAKGATVVIYEPTLESGSTFFGSKVIGDLDEFKRVSQAIITNRYDSCLDDVTDKVYTRDIFRRD

SEQ ID NO: 53795 - protein, 706 aa, Cryptococcus neoformans var. neoformans JEC21
MLRRSHIPRAALNINRAPAARAFTKPSLPLSASSQLTKKDSSNVLFEFDAHKVGNEIRKRGLGNLLGVQREGGMDRDTIIRLLYSLGSRHEVERYLRIFTQSSRASPGGVLPEAKFAVLKIGGAILSNELDDLALSLSFLNRLGLFPVVLHGAGPQLNEILESEGVIPDYEDGIRITDAKTLAIARRVFLQENLKLTTALERLGTRARPIPTGVFTADYLDKSKYGLVGKITRVDKAPIEAAIKAGCLPILTSLAENAEGQILNVNADVAAGELARVLEPMKIVYLNEKGGLFHGVTGKKISTINLDEEYDALMKESWVKFGTKLKIREIKELLDTLPRTSSVAIISTDMLQKELFTDAGAGTLIRRGYKLYKQPSVEAVGSTQLRQVFTERDPEVESGRKSVAEIFSELKNSPHTIYGDEPFDVVAVVSHPAGETPVMTKFLPSRNGILNKIVDNVFDAIKKDHKRLFWTAKADDENRAWHFERADGSFTRAGRSLFWYGVPNVKEVERIIEGFEENGRIERVFLPVGPSVPPHRRAAAAPAAGATPAGARAFSTSTRPHLAGTSNTGARGYATVADAAPRKRVALIGARGYTGQNLISLIDNHPHLDLTHVSSRELAGLPLKDYKKSAVNYSNLSVEDVGKMAEANEVDAWVMALPNGVCKPFVDAIDKASKKGGKSVIVDLSADYRFENDWTYGLPGEKAVSL

SEQ ID NO: 53796 - protein, 509 aa, Vitis vinifera
MASLSALGVTGVVPTSSKSRDLPSSHRTLSFSSRISGNKITWKASLGSHRRAPVIVSPKAVSDSRNSQTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEFLVLAGDHLYRMDYERFIQAHRETDADITVAALPMDEKRATAFGLMKIDEEGRIIEFAEKPKGEQLKAMKVDTTILGLDDERAKEMPYIASMGIYVVSKDVMLDLLRDQFPGANDFGSEVIPGATSLGLRVQAYLYDGYWEDIGTIEAFYNANLGITKKPVPDFSFYDRSSPIYTQPRYLPPSKMLDADVTDSVIGEGCVIKNCKIHHSVVGLRSCISEGAIIEDTLLMGADYYETDADRRFLMAKGSVPIGIGKNSHIKRAIIDKNARIGDNVKIINSDNVQEAARETDGYFIKSGIVTVIKDALLPSGTII

SEQ ID NO: 53797 - protein, 443 aa, Guillardia theta
MRAVLLAVAATCASAFMAPSPVSLSRRPLRLSQSRSAAVRVPRASPVMMANIKERTVRAPVFDEVCEQTGITLTRYMMEVSRANPELRDLESLISGIQQACKTISSLVDRATITGMVGYANGGGSINVQGEEQKKLDVVTNDVLKRALRFTGKVGIIASEEEDVPVFNKDAYKVPGGEGKYQDVTVDIGSKYVTVFDPLDGSSNVDANIPTGTIFGVYEEAESMENCMVNDDSVEGSCLLNTLQPGDALVASGYCLYSSSCMFVFTIGAGVNGFTYDRSIGEFVLTHPNIQLPKRGKIYSMNEANRWDWDKPLQDYVTAIQTGQGQTKAKYSSRYIGSMVGDVHRTLLYGGIFGYPADKKNKDGKLRLLYEAAPMSFLMEQAGGLSLTGKTRIMDLVPQKVHQRVPFLAGSYDDVMEMRSYYDACDDPEIIKRCLARLEGSAK

SEQ ID NO: 53798 - protein, 232 aa, Triticum aestivum
MAPSQEVAITKDPSTNGNGNGNGNGTAAPAPKTKTPALNERILSSITRRSVAAHPWHDLEIGPDAPTIFNCVIEIPKGSKVKYELDKKTGLIKVDRVLYSSVVYPHNYGFIPRTLCDDSDPIDVLVIMQEPVVPGCFLRAKAIGLMPMIDQGEADDKIIAVCADDPEYRHFNDIKELPPHRLAEIRRFFEDYKKNENKEVAVNDFLPSEDAYEAIQHSMDLYATYIVEGLRR

SEQ ID NO: 53799 - protein, 299 aa, Prochlorococcus marinus str. MIT 9312
MSKRHPVVAVTGSSGAGTSTVKRAFEHIFAREDIIPAVVEGDSYHRFERMPMKKAMAEALSKGENFSHFGPEANLFDKLEELFKIYGETGGGKKRYYLHSPEEAEEHNTRLGTSLEPGQFTPWEDIPKGTDVLFYEGLHGGVEGDGYNVASYADLLVGVVPITNLEWIQKIHRDNAERGYSAETIVDTILRRMPDYINHICPQFSKTDINFQRIPTIDTSNPFICRNIPTPDESFVIIHFRKGAREKWGIDFQYLLGMIHDSFMSSPTSIVVNGGKMGFAMELILTPIIHKMIEEKNKG

SEQ ID NO: 53800 - protein, 459 aa, Ostreococcus tauri
MSTTEDEDSACGSESSSAATGTTDGSESDDWDGSDADGGRRRSRRREHAGGDDDVVRAARTKRRKARKERERRRESGGEAKKAVTSKFAVCGTVFEVDAKYAPIKPVGKGAYGVVCSAREVETNRKVAIKKIVNVFENVVDAKRTLREIKLLRHLRHENVIDIIDCVRPEAMDAFEDVYLMYDLMDTDLYQIIRSSQSLTDEHCQYFLYQILRGLKYIHSADVLHRDLKPGNLLLNANCDLKICDFGLARTALVDAEASEFMTEYVVTRWYRAPELLLSCAEYTSAIDVWSVGCIFAELLGRKTLFPGKDYVHQLNLIMRVIGTPRDDSELDFINNEKARRYIKSLPVTARCNFRKLFPNASPKAVDLVDKMLVLDPARRITVEDALAHPYLESLHDEVDEPCAETPFTFNFEEDGRYLTGTDIRELIYTELCSLSDEFEVKMQQLSLRSDTDSSTFAV

SEQ ID NO: 53801 - protein, 357 aa, Prochlorococcus marinus str. MIT 9312
MKNYKIVLLSGDGIGPEISEVSKKVLKKLSRKHNFNIEIIEKLFGGIAYEKYGTPAPDETLDQCKKCDAVLLACVGDIKYDSLARELRPESGLLKLRSALGLFANIRPVKIRKSLVNTSTLKKEIVENVDLIVVRELIGGIYFGKPRGHITNTKIPKAFNTMVYDSAEIERITEIAIKIANQRNKKICSVDKSNVLEVSQLWRDTVLNITLKDKNISLSNMYVDNAAMQLVRDPSQFDVILTSNLFGDILSDLAAMLTGSIGMLPSASLNNNGPGVFEPVHGSAPDIAGKNIANPIAMLLSASMMLKIGLNEEEAAKNLETAVDKVLAEGFRTADLADGSSEVLSCSEIGDKIIDEI

SEQ ID NO: 53802 - protein, 410 aa, Ustilago maydis 521
MAIFKRNPRATDAGDAVQNGSSNDADSDASSAKGLRKFAQRKPANTAFKQQRLKAWQPILTPRTVLPAFFLVAIIFAPIGAVLYYFAEKVNEFSLDYTQCSTAPAVPTQAQIPSSKYDYQLHDKNTSNFQPPTWSWDASTRTCNLYFSVPARLDSSVFLYYKLTNYYQNHRRYVKSLDSDQLKGNAVAYGTISGGTCKPVDVDPSTQKIIYPCGLIANSVFNDTFGDPVLLNVAGSNSPNQTYVMSEKNIIWPGEKDKYSKTKYNADQIIPPPYWQGATGKYGYGSGYTDDNIFDPSQDEHFMVWMRIAGLPTFRKLYKRNDTAAMEPGRYLLQVVDNYPVAMFDGTKSVVFSTSSWVGGRNPFLGLSFIAVAAFAVLLGLVFTARHLIKPRKLGDMSYLSWNQPENKSS

SEQ ID NO: 53803 - protein, 507 aa, Nicotiana tabacum
MENGTKKLNVSSLAVEQPLPKSKLWKIIMVASIAAGVQFGWALQLSLLTPYVQLLGIPHKFASFIWLCGPISGMIVQPVVGYYSDNCSSRFGRRRGFIAAGAALVTIAVFLIGFAADLGHATGDPLGKGSKPRAIAVFVVGFWILDVANNMLQGPCRALLADLSGGKARMRTSNAFFSFFMAVGNVLGYAAGSYSRLCKIFPFSKTPACDIYCANLKSCFFIAVFLLLSLTILALTVVRENELPEKDEHEIDEKAGARKSKVPFFGEIFGALKDLPRPMWILLLVTSLNWIARFPFFLYDTDWMAKEVYGGKVGDGRLYDLGVHAGALGLLLNSVVLGFMSLSVEFLGKKIGGVKRLWGILNFVLAVCMALTVLVTKMAEKSRQYDAHGTLMAPTSGVKIGALTLFAVLGIPLAVTFSVPFALASIFSSNAGSGQGLSLGVLNLAIVVPQMLVSIAGGPWDDLFGGGNLPGFIVGAVAAAASGILALTMLPSPPADAKPATTMGGFH

SEQ ID NO: 53804 - protein, 214 aa, Magnetospirillum magnetotacticum MS-1
MIRRFDLTLPFGAGVPAWPGEPLPILTRLSDMDNGDACNVTRLNFAVHYGTHLDAPIHFIRDGADVASLALDVLMGPCSVVHVPDHVAEIGPAELEALAVPPGCERLLLATRNSALWNQPNHPFFTDFIAFTPAGAQWLVERGIKLVGIDYLSVQRFADAEPTTHRVLLGAGIVAVEGLDMRGIDPGEYELVCLPLKLIGADGSPCRVVLTRNS

SEQ ID NO: 53805 - protein, 588 aa, Yarrowia lipolytica CLIB122
MTDKWVPGQGQPMYGSQQPHNLMPPPSGLYQQNSNQSNTSLDQQQQFNQQQYNSQQQYQQQQHSQYQQQQQQHQQQQQQQQQQQQQQQQQQQQQQQQHQQHQQQQQQPQQQSVAQQQPSDYVNFTPRPDLLSKTARDRAHNTTQVISTYYKGIVQHAIERHQRRSAAEASVEQATSEERRNRVLTNYGKKETAYLRMRRTRMALEDFVTVKVIGKGAFGEVRLVQKRDNGKIYAMKTMLKKEMDMKEQWAHVKAERDVLADSDSPWIVSLYFSFQDDLYLYLIMEFLPGGDLMTMLIKYDVFSEDITRFYIAECVLAIEAIHKLGFIHRDIKPDNILIDKTGHIKLSDFGLSTGFHKTHSSAYWKKLKDGTSSNPATQMGPPQNTNRQSTYDSIHLTMRQQISTWRKNRRLMAYSTVGTPDYIAPEIFVHQGYGQECDWWSLGAIMFECLVGWPPFCSEQPRETYHKIINWRETLQFPDDVHLSPESEDLIRRLLTSSENRLGRIGGANEIKSHPFFRGVDWSSIREFNAPFVPKLSSITDTSYFPTDELGDVSEYPQQSSRSDRSSDLPFIGYTFSRFDNMTRRNAI

SEQ ID NO: 53806 - protein, 475 aa, Zea mays
  misc_feature (377)..(377): Xaa can be any naturally occurring amino acid
  misc_feature (386)..(386): Xaa can be any naturally occurring amino acid
MQFALALDTNSGPHQIRSCEGDGIDRLEKLSIGGRKQEKALRNRCFGGRVAATTQCILTSDACPETLVPVGGCYRLIDIPMSNCFNSGINKIFVMSQFNSTSLNRHIHRTYLEGGINFADGSVQVLAATQMPEEPAGWFQGTADSIRKFIWALEDHYSHKSIDNIAILSGDQLYRMNYMELVQKHVEDDADITISCAPVDESRASKNGLLKIDHTGRVLQFFEKPKGADLNSMRVETNFLSYAIDDAQKYPYLASMGIYVFKKDALLDLLKSKYTLLHDFGSEILPRAVLDHIVQVCIFAGYWEDVGTIKSFFDANLALTEQSNKIDFYDPKTPFFTALRCLPPTQLDKCKMKYAFISDGCLLRECSIEHSVIGVCXRVSSGCESXASVMMGAGIYEFVEEVSKLMLVGKVPVGIGRTTKIRDCIMDMNARLGKHVVIPNSKGIQEADHPEEGYYIRSGIVVILKNATINDGYVI

SEQ ID NO: 53807 - protein, 87 aa, Glycine max
  misc_feature (55)..(55): Xaa can be any naturally occurring amino acid
  misc_feature (68)..(68): Xaa can be any naturally occurring amino acid
MVADHYSPPLFSVAPMMDWTDHHYRTLARLISKHAWLYTEMLAAETIVYQKGNLXLAFSPDQHPIVLXIGGSYFLYLAKATELANAF

SEQ ID NO: 53808 - protein, 294 aa, Cytophaga hutchinsonii ATCC 33406
MATLLDFIGNTPLVEITRIFNKPNVKIFAKLEGHNPGGSVKDRAALGMIKGALERGEIKPGMKLIEATSGNTGIALAMIARLYNLDIELVMPDNSTRERVLTMEAFGAKVTLTPAAVSIEGSRDYAEAQVAKGGFFMLNQFANPDNYMAHYHSTGPEIWRDTNGTVTHFVSSMGTTGTIMGTSKFLKEKNSAVQIVGVQPTEGSKIPGIRRWPVEYLPKIYDDSRVDVKMDVSEEESVAMTRRLAREEGIFGGMSSGGAMAAAIKLGNEIESGIIVSIVCDRGDRYLSSDLFGA

SEQ ID NO: 53809 - protein, 518 aa, Campylobacter coli RM2228
MLQALAIKYRPKTFDELIGQKTVSTSLKYALNHNRLAHAYLFSGLRGSGKTSSARIFSRALVCDNGPSDTPCGTCKQCLAALEGKHIDIIEMDAASNRGLEDIQALIEQTKYTPSMARFKIFIIDEVHMLTPQAANALLKTLEEPPSYVKFILATTDPLKLPATVLSRTQHFRFKQIPQNEILNHLKEILNKENVKFEEEALKFVARSGNGSLRDTLTLLDQAIIFCQNDISTSKITDMLGFLDPAKIKEFYHAILTKNKDRVFDFLEELKDYEASSVIDEMLFYLKESFFAKSSEFSTLIYERFFRILARAKSLICDDDGFTLCVMAFMMMEASHLKEIDTQINEIQKNLTNTNSNLEKQEVKTPIVLEIQKSSTIKNAYEILLEKIYDRDYELGECFKQSTQFISYENEILTISSNAQGSNRDKLNKGFKLIQELFRNHFGSNAKIVVQKAIIIDESKLQSLTQELPQQNNEAQAPKKIDLHSSFNELKQGAKKFDPQEDTKEALREYFGEPKIEN

SEQ ID NO: 53810 - protein, 276 aa, Bordetella petrii
MTRRVLLAGCGDLGLRLARRLLADGAEVWALRRQPPANEPGGIHWLRADLTQPDTLAGLPAGITQLAYLPAPGARDPAVYQAVFREGLPALLAALDTRALQRVLFVSSSAVYGNHDGGWVDETTPPAPAGFNGRVLLDTENWLAAQALPSVSLRLAGLYGPGRLQLIERLRAGAARAPRHPPHWANRIHIDDAAAAAAHLLALPHPETVYIGCDDTPLPLYDLYAHLARLAGAPEPAPGPAPAAVGSKKLSNARLRASGLVLQWPDARDGYAALLA

SEQ ID NO: 53811 - protein, 641 aa, Bordetella pertussis Tohama I
MIRASGLTLRRGTKVLLDGADFVVHPGERVGIVGKNGAGKSSLFALLTGALDPDAGNLDLPAGWRIASVQQEIAADAQAAREFVIDGDTHLRALQAQRAALTDDQGTQIAETEAALIEAGAWSAASRAEQLLAGLGFKPSEWMQPVRSFSGGWRMRLVLARALMAPSELLLLDEPTNHLDLDAMLWLEKWLTAYPGTVLLISHDTEFLDAVARAILHFDQAKLQRYRGGYQDFLLQRAERLRQANIAYERQTREAARLQGFIDRFKAKASKAKQAQSRVKALARMEALAPIHAESGIDIRIPSPDHMPDPLLAMEHMDAGYGGAEPILRDVTLMVRAGSRIGVLGANGAGKSTLIKTLADELAPHAGTRRASRGLAIGYFHQHQLDMLDLDSTPLAHLARLAPEVREQELRNYLGGFGFSGDTVLSKVGPMSGGEKARLALSLIVWQKPNLLLLDEPSNHLDVETREALATALAEFSGSMLLVSHDRHLLRTTVDSFWIVADGGVREFDGDLEDYRDWLAARNAGERAAAREAAAGEPGVAVDRKAQRRLEAEQRQRLATLRKPLAAKLAKVEADMERARARLQELDAVIADADLYSDARRTERQQVMTEHGESGKRLNDLEEQWLEIQQALEEIEQDNAA

SEQ ID NO: 53812 - protein, 297 aa, Cytophaga hutchinsonii ATCC 33406
MNKHFLETLLQKHQQAGTFPSTSDICRLVTRILLVLFPEQTQAKYKDVADVEIQMGVYQKELTRLLGSMQKDLPAPANELSDAFMNELSVIYDKLLLDIQAILNGDPAARSEFEVIRAYPGFYAIAFYRMAHALYKLNIPLMPRIIMEYAHSKTGIDIHPGATIGKNFYIDHGTGIVIGETAHIGDNVKVYQGVTLGALSVSKDKADTKRHPTIEDNVIIYSGATILGGKTVVGHDSIIGGNVWLTESVQPFTRVYHKAQIEVIIKNADPSLNETENNEEAIRKMKKAESENTKKNS

SEQ ID NO: 53813 - protein, 229 aa, Schizosaccharomyces pombe 972h-
MDSPSHSREARVEKLKKIREQMRKSSHENRKEVVQEHSRMRIDPALERRLERKRMEAEEELAKIETEEEGGDFERRRAWDWTIEESEKWDQRLRKKKQTIQNVAFSDYHSQASKDYNRGIRDLKPDYEKYDKDKKEEKSKSRSVALYDEAERLDWVSNKPDKEHVERLVESIKKQDQRRLKNTKRRGTDEEDHITFINERNRKFNLKLQRFYSKYTKDIKEDLERGTAL

SEQ ID NO: 53814 - protein, 341 aa, uncultured crenarchaeote
MRAVPIYSHGDLNVLRYEQDFPTPIPNPSEILIRVKYCGLNHLDIWTRLGIPGITIGFPHICGSDIVGSVEEEYAEIPKGSRVLVYPGICCNDCDNCRNGTETLCRDFSIIGGLSKYNGGYAEYVTVPKTNIISLPREISDEQAATLSISYLTAWNIIKKLHLKENDTVLIYGASGGLGMAMIQISKALGIRTISTISDDSKLNFAYDIGSDYVINRKKKEIALEIEKITRGIGVDAVVDNAGQKTLNTSINSVRKGGKIALCGTTSGSEANFQIRTFYSKQIQLFGILIGSKLELLELINFVNEKNIVPKIDSVLPLAQVRQAHDKLEKGEQQGKILIKI

SEQ ID NO: 53815 - protein, 222 aa, Glycine max
SARAALVSLALFGAYVSRAGIKTVNVMTPKVFIGLIVGAMLPYWFSAMTMKSVGSAALKMVEEVRRQFNTIPGLLEGRAKPDYANCVKISTDASLKEMIPPGALVLLTPLIAGTFFGVETLAGVLAGSLISGVQVAISASNTGGAWDNAKKYIEAGTTPHAVSLGPKGSDAHKAAVIGDTVGDPLKDTSGPSLNILIKLMAVESLVFAPFFAAHGGLIFKLL

SEQ ID NO: 53816 - protein, 384 aa, Schizosaccharomyces pombe 972h-
MGNNTSRRSQSQKFKNIPSISAGSFSTMPVQHRGRRRRSKSIVGRAAQNAVLRSKEKTWIVPLILLTLLVGWYFVNPNGYIKYGIFLSYPIPGTNPAQYGKGRLDIAFCLFYALFFTFCREFIMQEIIARIGRHFNIRAPAKLRRFEEQAYTCLYFTVMGSWGLYVMKQTPMWFFNTDAFWEEYPHFYHVGSFKAFYLIEAAYWIQQALVLILQLEKPRKDFKELVVHHIITLLLIGLSYYFHFTWIGLAVFITMDTSDIWLALSKCLNYVNTVIVYPIFVIFVFVWIYMRHYLNFKIMWAVWGTMRTINSFDLDWAAEQYKCWISRDVTLILLTALQLVNIYWLILILRIGYRAFTTNDTHDERSEDEDEEVSDEKSSAKKND

SEQ ID NO: 53817 - protein, 403 aa, Ostreococcus tauri
MARIEDEGARDEEENGEDQDFEQSVDGAQVMAALQQLHGNSGLIGALQQKLDGLVGLRSGFLEELHPKVRARVRALEQLQESHDELHDAFVKERRALEAKYAALYEPLYKSRSEIVTGAKEAECEDEELRKEIEAHEEAAPAGVPEFWLIALKNHEEIAAMITERDEGALKHLVNVTTTRLEGEDEDGDEMCGFKIDFHFEPNDYFEDEVLTKTYHMDDEDEDVLRYIEASEINWKAGKNLTVKVLRKKPKPGAKNKKPITKTEPAESFFQFFYPPEVPDDEEQENMTEDDAEQLQEAMEQDYEIGSMIATNLIPDAVNWFTGEAFAEDDDEFDDEDEDDEDDDDDEDDEDEDDEDEDDEDDGEQEFVAGKKSPAQRANNRQSASSSKNFVINSLLSTISSTR

SEQ ID NO: 53818 - protein, 491 aa, Saccharomyces cerevisiae; identical to SEQ ID NO: 1191

SEQ ID NO: 53819 - protein, 435 aa, Saccharomyces cerevisiae
MGENHDHEQSIKRNSMIYNENERQLCNSNLKILQNKRALSKNDSSSKQQVQDSKPRRALTDVPVNNNPLSQNKRIVAGSKAAKVRREENIRPIVSAVQKRQIYNDRTAAEQEEEEEEEGEDDDAASIVNKKRRIDAEGVSEIVGWQDLDYVEKDDTAMVAEYSAEIFAFLYRRELETLPSHNYLLDKTSKYYLRPSMRTILVDWLVEVHEKFQCYPETLFLSINLMDRFLAKNKVTMNKLQLLAVTSLFIAAKFEEVNLPKLAEYAYITDGAASKNDIKNAEMFMLTSLEFNIGWPNPLNFLRRISKADDYDPVNRNIGKFILEYAYCCHQFIHLPPSTVSAMAMYIARRMTNRNKNELWNGTLQHYSGGIDPIHDEAFQSLCIDLVKDIASSKTHLDSLILKYKKPRYGSVYFQTFKWCTSEMHSNFQNLFNLK

SEQ ID NO: 53820 - protein, 623 aa, Ostreococcus tauri
MMSRARRAIVGRGGGSAEVARNASAQSASGRDAQTTSAETNASGGGGEGASIDGEISAPRLPGLRLTPAGRVLAAAAAAAASGRDRGPDAEMNDEFGGMRGDPEVEETPLPLPPPLGDIPRAHGGVVGKIKGQILPSSGYVPLEVQTHAEKVRLIQQQERTRRSHSITDAAVTTTAKTAGAAVGAISKMAAKLKESRHFKSASAPLTAVEIADDAPAARESHAEEAGEANARSAHTEPTSNPFVQDESRRPGRNSSELSDSGVPSSPHHRRASSAGNWSDMSYTTSDDGMLRMCHTSLAPTKPRRWTKGDNLGEGSFGSVWLALNGDTGELFALKEVRFGSSDKHREESIEQLEQEVDVLSRLVHPNIVRYIGVTREEAALYIFLEYVPGGSIASLVHRFGKFEENVIRVYTRQLLIGLSYLHSQRVLHRDIKGANILVEKSGRIKLADFGMAKVLENVSHGKSFKGSACWMAPEVIRQKNVGFEADIWSVGCTVYEMATGAPPWSDCSTQVQIIFKIASSEEIPVIPEHLSPDGQDFLRLCLQRDATRRPEAVALLDEPFVVDAHRSSNATNIPGLQYDTWASSSVLSFRDDEASVRSGDGTVGGMRSNQSSMRHVAWGDLE

SEQ ID NO: 53821 - protein, 891 aa, Schizosaccharomyces pombe 972h-
MEYRTNNVPVGNETKSAALNALPKIKISDSPNRHHNLVDAFMQSPSYSTQPKSAVEPLGLSFSPGYISPSSQSPHHGPVRSPSSRKPLPASPSRTRDHSLRVPVSGHSYSADEKPRERRKVIGNYVLGKTIGAGSMGKVKVAHHLKTGEQFAIKIVTRLHPDITKAKAAASAEATKAAQSEKNKEIRTVREAALSTLLRHPYICEARDVYITNSHYYMVFEFVDGGQMLDYIISHGKLKEKQARKFVRQIGSALSYLHQNSVVHRDLKIENILISKTGDIKIIDFGLSNLYRRQSRLRTFCGSLYFAAPELLNAQPYIGPEVDVWSFGIVLYVLVCGKVPFDDQNMSALHAKIKKGTVEYPSYLSSDCKGLLSRMLVTDPLKRATLEEVLNHPWMIRNYEGPPASFAPERSPITLPLDPEIIREMNGFDFGPPEKIVRELTKVISSEAYQSLAKTGFYSGPNSADKKKSFFEFRIRHAAHDIENPILPSLSMNTDIYDAFHPLISIYYLVSERRVYEKGGNWNRIAKTPVSSVPSSPVQPTSYNRTLPPMPEVVAYKGDEESPRVSRNTSLARRKPLPDTESHSPSPSATSSIKKNPSSIFRRFSSRRKQNKSSTSTLQISAPLETSQSPPTPRTKPSHKPPVSYKNKLVTQSAIGRSTSVREGRYAGISSQMDSLNMDSTGPSASNMANAPPSVRNNRVLNPRGASLGHGRMSTSTTNRQKQILNETMGNPVDKNSTSPSKSTDKLDPIKPVFLKGLFSVSTTSTKSTESIQRDLIRVMGMLDIEYKEIKGGYACLYKPQGIRTPTKSTSVHTRRKPSYGSNSTTDSYGSVPDTVPLDDNGESPASNLAFEIYIVKVPILSLRGVSFHRISGNSWQYKTLASRILNELKL

SEQ ID NO: 53822 - protein, 174 aa, Lactuca sativa
MASISSSAIATVNRTTSTQASLAAPFTGLKSNVAFPVTKKANNDFSSLPSNGGRVQCMKVWPPIGLKKYETLSCLPPLSDEALSKEIDYLIRNKWIPCLEFELEHGFVYREHHHSPGYYDGRYWTMWKLPMFGCTDSAQVMKEVGECKKEYAGTEFAKGSLKVKLLKWPRSPLQ

SEQ ID NO: 53823 - protein, 309 aa, Magnaporthe grisea 70-15
MEAFKNATIAAGATALNSSHGYFDVFEEVSKYHVQLSVLERLWAAWYLWWQNDTLATGIMSFAMHEIVYFGRSLPWIIIDAIPYFRQWKIQNQKIPTAKEQWDCTMLVLLGHFTVELPQIWVFHPLATYFGLDHGVPFPPAWKIAMQIAIFFVIEDLWHYLFHRALHYGPLYKNIHKLHHTYSAPFGLAAEYASPIEVMLLGFGVVGTPIVWTSITGDLHLFTMYLWIVLRLFQAIDAHSGYDFPWSLRKFLPFWGGADFHDLHHERFIGNYASSFRWWDWVFDTEAGDEPARKRREKKLAALKAKKAQ

SEQ ID NO: 53824 - protein, 273 aa, Bacillus halodurans C-125
MEIKKAIIPAAGYGTRCLPITKVVPKEMFPINGKAALHYIVEEAVAAGIEEIFIILSRNRTLIMDYFDRSIELETFLKKMNKQHLLEKLALPDVTIQFIRQPHANGLGDAIRLGERFVNGEPFAVLLPDDLFISPKHTSVLAELVNVYKQYNKSIIGLQEVESELLKRYGVIAGHPLSSDEYKIENVVEKPQTNPPSNLAIVGRYIFEPAIFQKLKNIGIGKGGEVQLTDAIKALLISHTVIGKIIEGCRYDIGIEEDYQRLIQEFSEKKSST

SEQ ID NO: 53825 - protein, 363 aa, Kineococcus radiotolerans SRS30216
MAHVWRGLIEEYRDRLPVTATTPVVTLGEGGTPLVPAHALSEKARGRVFLKVEGCNPTGSFKDRGMTMAMTRAKELGAEVVVCASTGNTSASAAAYAVAAGIRCAVLVPDGKIAMGKLSQAVAHGATLLQVDGNFDDCLNQARKLAEAYPVELVNSVNPYRIEGQKTGAFEVVDVLGDAPDIHALPVGNAGNITAYWKGYTEYAADGIATKTPKMWGFQAAGAAPIVKGHPVDEPETIATAIRIGHPASWTGATTARDTSGGRIDAVTDEQILAAHRWLSAREGVFVEPASAAGVAGLLAACEAGEVEPDQTIVITVTGHGLKDPQWALELAGEGADGRRHAVQPVRVQPDAVTIARAIGLDV

SEQ ID NO: 53826 - protein, 156 aa, Zea mays
MAATVMTTTTSKAGRKSLISRTLQRCKSGLSAGGGGGGGSCGRSSTSSPPGCFSVYVGAERERFVVRAECANHPLFRRLLDDTEREYGYAAQGPLALPGCDVDSFLDVLWQMERADGANEEVAAASSPMCGLHSGSKGRAAGYRMLSSPPMVGRRR

SEQ ID NO: 53827 - protein, 79 aa, Zea mays
GFSKRAPSGSWPPRGVGHLGKPSKKRGRKGRPNFKVGICGKNGGEPSSVAFFGKGGVGYVFCSPFRVPIDRQSPAQGFV

SEQ ID NO: 53828 - protein, 429 aa, Oryza sativa Japonica Group
MAAALARRGGGGLARALARGRGMCSATAAERAAGAALTSEELMRMERERSAHNYHPIPVVFSKGEGSHILDPEGNKYIDFLSAYSAVNQGHCHPKVLRALKEQAERLTLSSRAFYNDKFPIFAEYLTSMFGYEMMLPMNTGAEGVETAIKLVRKWGYEKKKIPKNEALIVSCCGCFHGRTLGVISMSCDNDATRGFGPLVPGHLKVDFGDTDGLEKIFKDHGERICGFLFEPIQGEAGVIIPPDGYLKAVRDLCSRHNILMIADEIQTGIARTGKMLACDWENIRPDVVILGKALGAGVVPVSAVLADKDIMLCIKPGEHGSTFGGNPLASAVAVASLKVVTDEGLVERAAKLGQEFRDQLQKVQQRFPQIIREVRGRGLLNAVDLSNEALSPASAYDICIKLKERGVLAKPTHDTIIRLAPPLSISQS

SEQ ID NO: 53829 - protein, 286 aa, Magnetospirillum magnetotacticum MS-1
MITQAALPLALAFIMFAMGLTLDAGDFRRVFAAPKAMVVGLAAKLVVLPVLALALVLVWRPEPDFAVGMILLAACPAGVTSALLTHHAGGRIALAATITALTSLAATLTVPLLVNLGLGLFAGYDRSVEIPVAKMTLGIFLVDTVPLALGLGLQRLRPRVAERLGRVARPVATLLFALIVVGAFVSQRQSLMDHVGDVVPAALLLNLAAMTGAWVLGTLARLDWADRIAVVMENGLQNGALGIFVAVTLLGSPAMMVPSIVYAFVMNLTAIAFIVAVRRRRRVVTG

SEQ ID NO: 53830 - protein, 178 aa, Prochlorococcus marinus str. MIT 9312
MKETNSNDNHEAQTLILNDSNGNEIFCYLEQLVSVEGEEYALLTPVDTPVSLFKMNEKDEPELIEKIDKNEQILKNAEAVLQEHDLRLIRSAVTLTVSGELEEPIFDELEEDCIDDDSESYELLVNFNLFDQEYGLYIPLDPFFIVGKLNENGALLIEDDEFDKIQPLIESELEKSNS

SEQ ID NO: 53831 - protein, 505 aa, Helicobacter pylori 26695
MKMILFNQNPMITKLLESVSKKLELPIENFNHYQELSARLKENQEWLLIADDECLEKLDQVDWLELKETISQNKNSVCMYKKGNEAQPFLEGFEVKIKKPFLPTEMLKVLQKKLGSNASELEPSQNLDPTQEVLETNWDELENLGDLEALVQEEPNNEEQLLPTLNDQEEKEEVKEEEKEEVKEEEKEEVKEEEKEEVKETPQEEKKPKDDETQEGETLKDKEVSKELEAPQELEIPKEETQEQDPIKEETQENKEEKQEKTQDSPSAQELEAMQELVKEIQENSNGQENKEKTQESAEIPQDKEIQEVVTEKTQAQELEVPKEKTQESAEALQETQAHELEKQEIAETPQDVEIPQSQDKEVQELEIPKEETQENTETPQDVETPQEKETQEDHYESIEDIPEPVMAKAMGEELPFLNEAVAKIPNNENDTETPKESVTETSKNENNTETPQEKEESDKTSSPLELRLNLQDLLKSLNQESLKSLLENKTLSIKITLEDKKPNA

SEQ ID NO: 53832 - protein, 279 aa, Arabidopsis thaliana
MGSQQAAISFLTNLAKAAFGLGVAATALNSSLYTVDGGERAVLFDRFRGVLDQTVGEGTHFLIPYLQTPHIYDIRTKPHTFSSKSGTKDLQMVNLTLRVLFRPEVSRLPYIFQTLGLEYDEKVLPSIGNEVLKAVVANFNADQLLTERPQVSALVREALIKRAREFNIELDDIAITHLSYGAEFSRAVEAKQVAQQEAERSKFVVMKADQERRAAVIRAEGESEAAQLISDATAKAGMGLIELRRIEASREVAATLARSPNVAYLPGGQSMLFNLNPGR

SEQ ID NO: 53833 - protein, 221 aa, Zea mays
MFIMADLQGRKIFKVFNQDFIVDERYNVTKELGQGAYGIVCAATNAHTGEGVAIKKVTNVFSKKILAKRALREIKLLQHFRGHRNITCLYDMDIPRPDNFNETYLYEELMECDLAAIIRSGQPLTDAHFQSFIYQILCGLKYIHSANVLHRDLKPGNLLVNADCELKICDFGLARGFSIDPEENAGYMTEYVATRWYRAPEIMLSFQSYTKAIDVWSVGCI

SEQ ID NO: 53834 - protein, 83 aa, Brassica napus
MVGSGAPQRGSAAAAASMRRRKPSGSSSGGGASGGGAAGSMLQFYTDDAPGLKISPNVVLVMSIGFIAFVAVLHVMGKLYFVK

SEQ ID NO: 53835 - protein, 798 aa, Ostreococcus tauri
MSRRSGAEDERAVKVPSRGTATRVRDARATLENAFGECEGRARARRARNAARGDDGDDRVLRDLEVVMELIEKMRAMRDDGLVRAALTLMDGLKAALRMSRESEDEARREVCVAALFGLSRLATAEREEMIRAGLDGLDGDGLLETLRVHCKAPGLSFEERMQSLKNYVETVGKSSRRPPALDIHESSSSDSERKGKKVVGGLARAFASRGHLGEDVCTPEMSDDEAEVERGNQLRALGSLCASPSKIFYAPEILSGKGASVDDTRAAPVGDVICRICEQPIPAAQLSEHTTTCAGYRPSPSSYDSSEFASPRISGTIPSPGAADETSDQVSIDDFRIIKLISGGAYGRVFLAQKRTTRDLFAVKAMRKDDLVYKNMIDQVVAERDALIKAANPFTIKLYYSFTSARHVYLVTEYANGGDLYSLLKQLGRLSEDHARQYCAEITLALEYVHSKGITHRDLKPGNCLIASDGHVKLADFGLSRMDRDIDYNSSGGEYSPDVFDGGSPVSHSSASMTIKVPGTREQLHTSSPIHRMTLLASTSKSPQQSPARKVHSRSSASWHGSGAKGTPDYLAPEILLCEPCGAGVDWWALGVMAYELVVGTPPFNASTPLAIFSKVIDGNIEWPNGECEFSEAYAHFVESLLVHDVEARLGARSADDVKAHEWFRTIEWDRVYDGTAASVFVPKPVDLQDTSYFIPASDMRQEYPTGRARRMSESSRRTERASASAESTSTNREDTFLEPTQGEMDDSEDDEDMAMRAFTYRNLAELALRNVDMSTPSAPMGLPRRGSVGKDLSNVE

SEQ ID NO: 53836 - protein, 630 aa, Pseudomonas syringae pv. syringae B728a
MPTTFKEIPRERPVTPLLDRADTPHGLRRLGEAELETLADELRLELLYSVGQTGGHFGAGLGVIELTIALHYVFDTPDDRLVWDVGHQAYPHKILTGRRARMSTLRQKEGVAAFPRRSESEYDTFGVGHSSTSISAALGMAIASRLQGSERKSIAVIGDGALTAGMAFEALNHAPEVAADMLVILNDNDMSISRNVGGLSNYLAKILSSRTYSSMREGSKKVLSRLPGAWEIARRTEEYAKGMLVPGTLFEELGWNYIGPIDGHDLPTLIATLRNMRDLKGPQFLHVVTKKGKGFAPAEVDPIGYHAITKLEPLNAPAAQKKISAPKYSGVFGQWICDMADADARLVGITPAMKEGSDLVAFSERFPERYFDVAIAEQHAVTLAAGMACEGSKPVVAIYSTFLQRGYDQLIHDVAVQNLDVLFAIDRAGLVGEDGPTHAGSFDLSYLRCIPGMLVMTPSDENELRKLLSTGYLHTGPAAVRYPRGTGPNAVIEASLDPLEIGKGVVRRQGQGVAILAFGVQLAEALVVAEKLDATVIDMRFVKPLDEALVSEAAANHELLVTLEENAVMGGAGAAVSEFLARANILKSVLHLGLPDVYVEHAKPAQMLTECGLDAQGIEAAINERLALIG

SEQ ID NO: 53837 - protein, 295 aa, Pseudomonas syringae pv. syringae B728a
MIASYQAQSQTRVNAALDGLFKAPGPELERLYQAMRYSVMNGGKRVRPLLAYAACEALGGVAEDANGAACAVELIHAYSLVHDDLPAMDDDDLRRGQPTTHKAFDEACAILAGDGLQSLAFTALLAPHLTSRDAETRLQMVTALATAAGPAGMVGGQAIDLGSVGLKLDQAALEYMHRHKTGALIEASVRLGALASGHADQPRLDALQVYARAIGLAFQVQDDILDVESDTATLGKRQGADIARDKPTYPALLGLEAAKHYALELRDQALQALSPFDAAAEPLRQLARYIVERRH

SEQ ID NO: 53838 - protein, 472 aa, Methanosarcina acetivorans C2A
MKIVMKFGGTSVGDGKKIRHVAQLLKRYHEEGNQIVVVTSALGGVTDRLLENARLASTKGKVSLVKEFKTELTNKHHEAVKDAIEDPRVAKEVLQVLDLRIEELEKALIGICYLGELTSRSIDYISSYGERLAAPIVSGAVRSLGAASIEYTGGEAGIVTTSDYGNARPLEKTYELVLKRLGCRLESHILVVTGFIGENEDGIITTLGRSGSDFSASILGAALKADEIWLWKEVNGIMTTDPRIVPEAKTIPQISYAEAMELSYFGANVLHPRTIEPAMREHIPVRVKNTFNPEFPGTLVVAEKFQCRHVVKAVSLIKNVALINISGAEMPGTVGTVARLFTALARAGVNIVMISQGSSESNLSFVVSESHVESALKALHAEFNREIVKEITSDRNVCVVAVVGAGMAGTPGVAKRVFGALGNSMINIIMISQGSSQYNISFVVREGDAFAAVKTLHDEFELYNGNGIEKKL

SEQ ID NO: 53839 - protein, 447 aa, Colwellia psychrerythraea 34H
MSAFDIQQSASMSREELEAYWMPYTANRQFKEKPRMIVGAKGAYYTDADGRKIFDGLSGLWTCGAGHNRPEIAEAVYKQLGQLDYAPAFQYGHKGAFELANRIKELTPDGLDHVFFTGSGSESADTSLKMARAYWRKKGKGTKIKLIGRSKGYHGVNFGGFSVGGIGANRTLYGPAVDCDHLPHTMLPENKFIRGMPETGAEKAEELLELIALHDASNIAAVIVEPLAGSAGVLPPPKGYLKRLREICDQHEILLIFDEVITAFGRMGSNTGAEEFGVVPDILNVAKQLTNGAVPMGAVIVNDDIYQTFMDNGGPEYMMELPHGYTYSGHPVACAAALASLDILKNDQLITRVREMSPVFEHALHSLKGTQYISDIRNYGLAGALTIESAPGEPALRPYQIAQKCWEKGFYVRYGGDTIQLGMPFIVEHQEIDDVINAVGESINELS

SEQ ID NO: 53840 - protein, 396 aa, Cytophaga hutchinsonii ATCC 33406
MTEQLLCSFLKKSMQQSYTSKLPDIGVNIFSTMSALAQQYKAVNLAQGFPDFAPSEELIRLVHDYMLKGFNQYAPLAGVRPLVVNLAEKTEKLYGLSYDPDTEITITCGATEACYTALTSILHEDDEVIIPEPCFDVYLPAIQLSKAKAVFVPLTLPDFSYDWELIRSKVTPRTKLIIINSPHNPTGSILTAKDVEQLQLLVEAYPGLYVLSDEVYEHIVFDGNKHISISGNPVLKERAFIIGSFGKTYHVTGWRLGFCLAPAYMMKEFKKVHQYNTFSPVAPMQFAVADFMKKTDEYESLPAFFQNKRDLFLRHIKESKFDVIPASGTYFQMLSYKNISDENDLDFAARLTREFGLASIPVSVFYNDKTDHKLLRFCIAKKEETLLKAAHILCKI

SEQ ID NO: 53841 - protein, 458 aa, Pseudomonas aeruginosa PAO1
MTSTAFSSLPLSADLLANLDSLGYREMTPIQAQSLPLILQGHDLIAQAKTGSGKTAAFGLALLSPLNPRYFGCQALVLCPTRELADQVAKEIRRLARAADNIKVLTLCGGVPYGPQVASLEHGAHVVVGTPGRIQEHLRKGTLVLDGLNTLVLDEADRMLDMGFYDSIAEIIGQLPERRQTLLFSATYPDGIEKLAKTFMRDPRQVRVESLHADSQIEQRFFEIDPKQRMDAVVRLLQHFRPQSCVAFCQTRQQCQELADALKAQRISALALHGDLEQRERDQVLTVFANRSCNVLVATDVAARGLDIAALETVINVELARDPEVHIHRIGRSGRAGEKGLALSLVAPAEASRAQAIEDLQKQPLAWYALGQLKASPEPLLPPMSTLCIAGGRKDKVRPGDLLGALTGDAGLPGSAVGKIAIFDFQAFVAIERGLAHQALKRLSEGKIKGRSFKVRLL

SEQ ID NO: 53842 - protein, 282 aa, Synechocystis sp. PCC 6803
MSKQPSFDGWQSIVGGLIAALLVLLSFNSFVVINPGQAGVLSVLGKAQDGALLEGIHFKPPLVSSVDIYDVTVQKFEVPAQSSTKDLQDLSASFAINFRLDPTEVVTIRRTQGTLQNIVAKIIAPQTQESFKIAAARRTVEEAITKRSELKEDFDNALNSRLEKYGIIVLDTSVVDLAFSPEFAKAVEEKQIAEQRAQRAVYVAQEAEQQAQADINRAKGKAEAQRLLAETLKAQGGELVLQKEAIEAWREGGAPMPKVLVMGGEGKGSAVPFMFNLTDLAN

SEQ ID NO: 53843 - protein, 181 aa, Kluyveromyces lactis NRRL Y-1140
MLSTKLFKPSLTRGFKTFTPTLFKAGDSIPTGLKGLHESSPGNSVDLGKEVAHGKYIIVGLPAAFSPACSASHVPGYIAHLKELKEKGVKQVFVTAVNDSFVTQAWAEDLGVPSDIRIIADTLGEFAKAGDHLFDSKQIFGNDRSIRYAVIVQDGKVVKEFAEPDKIGVDVSSAENVLKEL

SEQ ID NO: 53844 - protein, 279 aa, Triticum aestivum
WNIVGIEDEGERDPYILVRVHGLHGPLKVRCSTVERVTYGFAAGDWVRLREEDKKRSQVGILHSIGRDGAVTVGLIGMDTLWKGNYSDLQMAQAYCVGQFVRLKAHISNPRFEWQRKRGGGLVTGRISHIHPNGCLVVRFPGKFNLGEVCRCLADPYEVEVVSFDKCEGIVKKYEHLEDFHWAVRPLFIAIGFFTALKLGVFVGKSIARPRSRKVASISDQSSDYQQQQQVQNSANGAWLPPPVANMLFGDVVGTPTKKIKGPCEDGGLLKIASGNCGS

SEQ ID NO: 53845 - protein, 566 aa, Emericella nidulans
MADIATRDVRQPIDIAEYLFRRLHEVGIRSVHGVPGDYNLAALDYLPKCGLHWVGNCNELNAGYAADGYARVNGIAALVTTFGVGELSAINAIAGRYSEFVPIIHIVGQPHSRSQKDGLLLHHTLGNGDYNVFSSMNKGISVTTANLNDTYDAATLIDNAIRECWIHSRPVYLALPTDMITKKIEGERLKTPIDLSLPANDPEKEDYVLVDARAQVFARSAKNPVILVDDSCVFDDSTGLSLEEVHDLIEVSGLPTFVAPMGKGAVNETHRCYGGVYAGTGSNPGVREQVESSDLILSIGAIKSDFNTAGFSYRIGQLNTIDFHTTYVRVRYSEYPDTNMKGVLRKVIQRLGFIKADPVPHISNALPEHEKNSSEQRITHAWMWPMVGQWLKENDIVITETGTANFGICWNLLPSELQPISQVLWGSIGYSVGACQGAALAAKEQGNRRTVLWVGDGSLQLTLQEISTMIRNNLNPIIFVICGEGYTIERFIHGWDESYNDIQTWDIKGLPVAFGGKGRYKGYKVTTRDELTKLFASEEFSSTPCLQVSLCDLTHYLSDANFEQLG

SEQ ID NO: 53846 - protein, 485 aa, Bacillus halodurans C-125
MANLATGEKLKNFIGGQWVESDSGKTEAVPNPATGEILAHVPISNREDLDRAVSVAKEAFKTWGKTPVPRRARVLFKYQQLLVENWEELARLVTLENGKSYKEAYGEVQRGIECVEFAAGAPSLMMGKQLPDIATNIESGMYRYPIGVVGGITPFNFPMMVPCWMFPLAIACGNTFVLKPSERTPLLANRLAELFTEAGLPEGVLNIVHGAHDVVNGLLEHPDVKAISFVGSQPVAEYVYKTASQHGKRVQALAGAKNHSIVMPDADLDGAVNQIVNAAYGSAGERCMAAAVVVAVGEVAEPLMEKLQKAVNEITIGNGLDDDVFLGPVIRESHKQKTENYIELGEKEGATLVRDGRKDNVSKDGYFLGPTLFDNVTTEMTIWKEEIFAPVLSVVRVESLDEAIQLTNQSEFANGACLYTTNGSSVRKFREEIDAGMLGINLGVPAPMAFFPFSGWKNSFYGDLHANGTDGVEFYTRKKMITARW

SEQ ID NO: 53847 - protein, 494 aa, Synechocystis sp. PCC 6803
MGKPTGFLEYTREIPQELSPGDRLRNWDEFHVTMPDKQVETQGARCMDCGTPFCHTGSLISGMASGCPINNLIPEFNDLVYRGLWREALDRLHKTNNFPEFTGRVCPAPCEGSCVLGINNPPVTIKNIEYSIIEKGWQEGWVTPEPPAKRTGKKVAVVGSGPAGLAAAAQLNKAGHWVTVYEREDRPGGLLMYGIPNMKLDKEEVVLRRLNVLEAEGVTFVCNTEIGKDLPPETLLKDYDAVVLCTGATKPRDLAIAGRELEGIHFAMEFLTANTKAILDKTPGPNFISAKDKDVVIIGGGDTGTDCVGTSLRHGCRSLVQLEIMPKPPEERAANNPWPEWPKVYKMDYGQEEAAAVYGHDPRSYLTTATKIEGDDQGRVKAVHTVDVRWEKDGQGRFIPQQVAGTEQVRPAQLVLLAMGFVGPESQLLDAMKLDKDARGNIKAEYGQYETSIPGVFAAGDCRRGQSLVVWAFNEGRGAAKACDLYLMGETDLP

SEQ ID NO: 53848 - protein, 369 aa, Vigna radiata
MAVQAASLVSGYFSVAKEGKPGMSLRNTTMFGLSLEDALKADFSSLSFSCKREFQKKVCPLRVQSVATTPGVTKASPEGKKTLRKGSVIITGASSGLGLATAKALAETGKWHVIMACRDFLKAERAAKSSGISKENYTVMHLDLASLDSVRQFVDNFRQSGRPLDVLVCNAAVYLPTASEPTHTADGFELSVGTNHLGHFLLSRLLLEDLNKSDYPSKRLIIVGSITGNTNTLAGNVPPKANLGDLRGLAGGLNGLNTSAMIDGGSFDGAKAYKDSKVCNMLTMQEFHRRYHEETGITFASLYPGCIATTGLFREHIPLFRLLFPPFQKFITKGFVSEDESGKRLAQVVEITNKRLWRWLYTKKVGMSV

SEQ ID NO: 53849 - protein, 333 aa, Staphylococcus aureus subsp. aureus Mu50
MKNLRNRSFLTLLDFSRQEVEFLLTLSEDLKRAKYIGTEKPMLKNKNIALLFEKDSTRTRCAFEVAAHDQGANVTYLGPTGSQMGKKETTKDTARVLGGMYDGIEYRGFSQRTVETLAEYSGVPVWNGLTDEDHPTQVLADFLTAKEVLKKDYADINFTYVGDGRNNVANALMQGAAIMGMNFHLVCPKELNPTDELLNRCKNIAAENGGNILITDDIDQGVKGSDVIYTDVWVSMGEPDEVWKERLELLKPYQVNKEMMDKTGNPNVIFEHCLPSFHNADTKIGQQIFEKYGIREMEVTDEVFESKASVVFQEAENRMHTIKAVMVATLGEF

SEQ ID NO: 53850 - protein, 103 aa, Spiroplasma citri
MAVNEIKSIDEFEKTIGDEKLTCVDFYADWCGPCKMIAPIINELAKTRSDVNFIKVNVDVLQDLAQNYGILSIPTLITFQNGKELKRKTGFVTANEIEQDLLS

SEQ ID NO: 53851 - protein, 509 aa, Oryza sativa Japonica Group
MVQLFFQGTTDGGSVDTDAVKARRSLLGKVEPIIRSVIKSGGGYEARMWLCSTVSSIHLLDPYGQRDLFLNLLGMKNSKRDVAARLLRMIFDKKPKKAGSIIAKKCQMLEDFFQGNPKQIMQWFGHFAVTGELTHKKGARALSQFAFVNRDICWEELEWKGKHGQSPAVVATKPHYFRDLDVLRTVENFLEYVPDFWSSEELADSVKDGEILQIDTEYFVDQFVYLMYEENSRDAWQLVDEFLMDEQFSSLSQHLLIHLDEQRLLNFLRALGKLIKLNSQCKEMVFPCCWLEVLLSAHSDHISLDELVLLNCVISKGRQLWRLMNDEEQEEEQGQMQELLKSTNQLTDADHFALMKGFVDTELPDALKWIGIQSWLVFCELSKGCKSADSCEHLFTCNRIEFRKADDYPLVQNDGNSIALDSDDEDLIRGSHKRRKRDRKRKRRRYDSDEDDLDQLLELGTSNRRGIESHHGCWYLSTDGFSASWDIADIPDHLSSHYLKTWLKFACFR

SEQ ID NO: 53852 - protein, 292 aa, Zea mays
LRARSPFRCAHLGICASARLSPPARPPSFPCLAEGRSHCARVRATMSSAVEAISCPKVDVPAGPEPGEPAKEAAPPAEHCDTAPNGKCAPRCHGEEEEEEEDEEDEEKAPKAIDLGPMVSIKEQLEKDKDDESLRRWKEQLLGGVDLNSVGETLEPDVKIMSLSILSPGRPDIVLPLPVEPNGKGVWFTLKEGSPYRLKFTFSVSNNIVSGLRYTNTVWKTGLKVDRAKEMLGTFSPQLEPYTYVTPEDTTPSGMFARGSYSARTKFLDDDRKCYLEINYTFDIRREWPSTS

SEQ ID NO: 53853 - protein, 642 aa, Rhodobacter sphaeroides 2.4.1
MDRSRSASDSLTLGQHGQRGMESLLLQASIYLGAALLIVPLAVRAGLGSVLGYLAAGIVMGPVLGLAGAETEDLRHYAEFGVVLMLFLVGLELEPAALWAMRRSLVGLGGLQIVLTSLAAALGLFWLGFPWPEAAVLGMVAALSSTAIVLQTMTERRMLRTTGGRSAFAVLLAQDIAVVPMLALVPLIALRPGAGAHSAHDATEGPAMPIIGLLQSLPGWADTLVMLGVVGFIVLGGHFLTRPVFRYVHASRLPEMGSFIALFTVMGTAFLTMVVGLSPALGAFLAGVVLANSEFRHQLEADIRPYKGILLGLFFMAVGMGIDFRLLAADPWTLAGFTLALVGLKVLVLAALAQTFGLTGRDRWLLTLGLAQAGEFGFVLVAFAAQETILPALLAQKALIVISLSMLVTPVLFLVASWLTRLGEEAPALGADAIDEKGRVIIAGIGRFGQVVNRLVRMSGIETVVLDHDMAAVQIMRRFGVKGFFGDPTRPELLQAAGLAEATVLVVAVDDRENAIKIVRYARQVRPDLHIVSRARDRVHVYELYQAGADDIVRETFDSSIRAGRYVLENMGFSEYEAAQRSRTYYRVDRAAMRDLAELWVPGQPAHLNEAYVARARQLDDDLETAMLEEAGQIPLDPEAAE

SEQ ID NO: 53854 - protein, 179 aa, Brassica napus
ESGMHSVGFVDPDDMNVVSGSRKYSSVVGYSSSKLAQIMFSSVLFKKLPLETGVSVICLSPGVVLTNVARDLPRFLQFLYALIPYFIFSPQEGCRSTLFSATDPQIPEYWETLKNDEWPVCPFISQDCHPANPSEESHNTETAQRVWEKTSEMVGLPLDAVEKLIEGENVQCRYGAQEE

SEQ ID NO: 53855 - protein, 279 aa, Triticum aestivum
  misc_feature (78)..(78): Xaa can be any naturally occurring amino acid
MADRGGERGGDRGGERGGFGRGFGRGGRGDRGGRRGGRRGPRQEEEKWVPVTKLGRLVKEGRFTKMEEIYLHSLPVKXEHQIVEQLCPGLKDEVMKITPVQKQTRAGQRTRFKAFVVVGDSNGHVGLGVKCAKEVATAIRGAIILAKLSIVPVRRGYWGNKIGLPHTVPCKVTGKCGSVTVRMVPAPRGSGIVAARVPKKVLQFAGIDDVFTSSRGSTKTLGNFVKATFDCLMKTYGFLTPDFWRETTFTKGPYQEFTDILAKPTKALMLDAPVEKIEA

SEQ ID NO: 53856 - protein, 522 aa, Zea mays
NSGGKCDFDLAATFFCSVVYLVVGGDMQFALALDTNSGPHQIRSCEGDGIDRLEKLSIGGRKQEKALRNRCFGGRVAATTQCILTSDACPETLHSQTQSSRKNYADANRVSAIILGGGTGSQLFPLTSTRATPAVPVGGCYRLIDIPMSNCFNSGINKIFVMSQFNSTSLNRHIHRTYLEGGINFADGSVQVLAATQMPEEPAGWFQGTADSIRKFIWVLEDYYSHKSIDNIVILSGDQLYRMNYMELVQKHVEDDADITISCAPVDESRASKNGLVKIDHTGRVLQFFEKPKGADLNSMRVETNFLSYAIDDAQKYPYLASMGIYVFKKDALLDLLKSKYTQLHDFGSEILPRAVLDHSVQACIFTGYWEDVGTIKSFFDANLALTEQPSKFDFYDPKTPFFTAPRCLPPTQLDKCKMKYAFISDGCLLRECNIEHSVIGVCSRVSSGCELKDSVMMGADIYETEEEASKLLLAGKVPIGIGRNTKIRNCIIDMNARIGKNVVITNSKGIQEADHPEEGVI

SEQ ID NO: 53857 - protein, 217 aa, Bordetella pertussis Tohama I
MQRFTDFYAAMHGGSSVTPTGLGYIPMVIEQSGRGERAYDIYSRLLRERLIFLVGPVNDNTANLVVAQLLFLESENPDKDISFYINSPGGSVYAGMAIYDTMQFIKPDVSTLCTGLAASMGAFLLAAGKKGKRFTLPNSRIMIHQPSGGAQGQASDIQIQAREILDLRERLNRILAENTGQPVERIAVDTERDNFMSAEDAVSYGLVDKVLTSRAQT

SEQ ID NO: 53858 - protein, 125 aa, Arabidopsis thaliana
  misc_feature (14)..(14): Xaa can be any naturally occurring amino acid
  misc_feature (37)..(37): Xaa can be any naturally occurring amino acid
  misc_feature (58)..(58): Xaa can be any naturally occurring amino acid
  misc_feature (75)..(75): Xaa can be any naturally occurring amino acid
FFLTINLILFGLHXPQPPTCPRHIEACSNVFGLGRIXLNYQTVRPWFTLLDGPDPLIXAICLQSANPIKKYGISXSHPFGLFQSFLALSGPTIPPPCFSRIQRRPKFPNNQNNNGSKVMLLLKKC

SEQ ID NO: 53859 - protein, 468 aa, Methanosarcina acetivorans C2A
MSEHYESASLVKTLRPFHVWALGVGIVLVGEYMGWNFTVAKGGVLGSLLAMLVAGTMYVIISLCASELGAATKLAGGPYDWARLFIGPGAAASVGLAVYMEYIALEAADAIVVAFIAQSIFPELQVFPVTLLVIALLTFINYRGVVAALTLNFFLTMIAFISIVVFFFATAFGGVDIHPEYLFHGALPNGMIGLFAALQFGPWFYLGIEGAAMCAEECKHPSRAVPLGQQAGMITLLVGAAMTLYLCSVLIPTDQLGVSVYPLFEAAQNSGMFIFIALLGLGTFLTCVASANGCVCDSSRSWFALSRDNYVSSWFSAVHPRYNTPYRAVIFTMPVAIGFAFSGFLDQVITFSIVSGLLCYVLIPFALIRFRSLFPQNTSTIRPFVSPLQPYIAYFAIAIAITILSTLYWGYKYNLIFAFVFYGIAYFYFSHRHRSLNIENNWTEMGWPLPRGSENTGIRKEATGIGDE

SEQ ID NO: 53860 - protein, 414 aa, Debaryomyces hansenii CBS767
MLSRNIARASKTVANQKRFLSLHEFRSAALLKTYGVGVPDGSAATTPEKAYEVAKALGTNDLVVKAQALTGGRGKGHFDNGFQGGVKLISSPEEAKELAEKMLGHKLITKQTGEAGKEVTAVYIVERRDARTEAYLAILMDRSTQTPLIVASSQGGMDIEGVAAKDPDAIKSFPVPLEEGVSDKLAIDIASVLGYTQEAIPEAAKTVQNLYKVFMERDCTQVEINPLSETPDHKVLAMDAKLNFDDNAAFRQKEVFSWRDPSQEDPEEVTAAEYGLNFIKLDGNIANIVNGAGLAMATMDIIKLYGGAPANFLDCGGTATPETIEKAFELILSDKKVNGIFVNIFGGIVRCDYVAEGLIAATKNFNLDIPVVVRLQGTNMAKAKELIENSGLKLYAFEDLDPAAEKIVALAPKA

SEQ ID NO: 53861 - protein, 434 aa, Arabidopsis thaliana
MAREEQNIENRGSVHVVERESNLRSVVCGPVRWLKMLASKLHWSYVFAVVSNCGINQGFGYSLGHVATDYYMKDVQKVQPSQYQALSAITRISWIIFKPLFGILTDVLPIFGFHRRPYFILAGVIGVVSLLFISLQSNLHLYLALFWMTISSAAMAIADVTIDACTTYNSNKHPSLASDMQSLCSLSYSIGELLGFFMSGILVHLVGSKGVFGLLTFTFALVSVVGVLFSEPRVHGFSFKQNFTNAMKAMWRTIKCSDVWQPSLYMFITRALGLDIKEGLFYWFTDSKDGPLFAQETVGFILSIGSIGSILGVLLYNLRLKDHPFRKLFLWTQLLFALSGMFDLILVLRLNLKFGLPDYLFIVVDGIVSKMIIRLTWMVIFVLNTKLCPHGIEGTFFALLMSIDNAGLMTSSWLGGKMLHVLKEIRTRSSSRLR

SEQ ID NO: 53862 - protein, 491 aa, Zea mays
NNLFRTPLEAGGGAPWAERARVVGTQIRNRFRVAPVDHRSLWLRADGRVATEAVRRWSDRVRALLQRGRSADRNSTSTETSPEAVAKPSSSVLRFYRKRVGKEVNGIEDSVIFRSLQALAVPLIGNACYVFMHGLNSVQVYGVEKLHQALHGRPKGKALLTVSNHVAAMDDPFVIASLLPPSVMLEAQKLRWTLCATDRCFTNPVLSTFFRSVKVLPVSRGDGIYQKGMDMALSKLNSGGWVHIFPEGSRSRDGGKTIAPAKRGVGRLVMDADSLPVVIPFVHTGMQDIMPVGKRIPRAGKRVIVVVGDPINFDDLLIDNCGDTQDIPRGILYDKVTQRIGQRLQELKVEVDRLAAEQEPELQNHNVGDDGYRLWQQVDWEGFGIGSSMLPSEPSAAAQVPSREAEPEPHVEVEQSVSPAPSAATSYNVAVPHWFQRHADPSELMGFASRGLIKHGKFLEEGYREFQQSATTLHTFWVSRANNAAHRWSTA

SEQ ID NO: 53863 - protein, 464 aa, Ustilago maydis 521
MTMPNATGSTWRSAHSSPRRVSMATPIRALVHVANLPATTTERALREMFGSLGQMQSARVVASRSAGGLAYGFVEYVDVASAERAIRTMNGWVWFGTPIKVCWAKHSMHPDAVNEWVEVDRPVGMRSGVHSHLFVGDLSPDVDDALLQSFFSRFTSLADVRVMYDAATGKSRGFGFINFRSKQDADDCIATCQGQWLRGRQIRVNWANQKNQPSQAPATLTPTATATATATCSAYSDTPLSLSHAGSGVSTKTSATPSELSSTSSLINDASLQVALPRRHTTLGSQPQLSTITRNPANILRYNYDRVVSEAPSSQTSVYVGNISPLTSQQDLVRIFSPFAHGHHLEARIPPGRGYGFVTLNTHEQAASAICTLSIQGVFMHSRWLRFGWQKNRPSPLPIQHRSESAPEHMLYTLHNQPRQHTPNQSSQSLPSQQNILSRTQPQPHQQKPPPPSSSSSSNEFQPF

SEQ ID NO: 53864 - protein, 439 aa, Vibrio campbellii AND4
MLALAERLKNYKVEGLTTRPVASGKLVRVVGLTLEATGCRAPIGSLCLVETMSGHMEAEVVGFSGDNLFLMPSEQITGILPGARVTPLTSEVGLPVGMELLGRVIDGVGNPLDGLGPLYTEHRASFNAEPINPLARKPISEPLDVGLKAINGLLTVGKGQRIGLFAGSGVGKSVTLGMMTRGTTAQVVVVGLIGERGREVKEFIEEILGEDGRRRSVVVAAPADASPLMRLKGCQTALTVAEYFRDQGLDVLLLMDSLTRFAQAQREIALSVGEPPATKGYPPSVFAKLPALVERAGNGGGEQGSITAFFTVLTEGDDLQDPIADASRAILDGHIVLSREMADAGHYPAIDVEKSVSRVMPQITTEEHVLMSKAVRQVLSICRKNQDLVSIGAYKPGTDPAIDSAFTLKPKLDEYLQQRMKESVPYDMCVNMLKSILGG

SEQ ID NO: 53865 - protein, 339 aa, Brassica napus
  misc_feature (208)..(208): Xaa can be any naturally occurring amino acid
MADKKIRIGINGFGRIGRLVARVILQRNDVELVAVNDPFITTEYMTYMFKYDSVHGQWKHNELKLKDEKTLLFGEKPVTVFGIRNPEDIPWGEAGADFVVESTGVFTDKDKAAAHLKGGAKKVVISAPSKDAPMFVVGVNEHEYKSDLDIVSNASCTTNCLAPLAKVINDRFGIVEGLMTTVHSITATQKTVDGPSMKDWRGGRAASXFNIIPSSTGAAKAVGKVLPQLNGKLTGMSFRVPTVDVSVVDLTVRLEKAATYDDIKKAIKEESEGKLKGILGYTEDDVVSTDFVGDNRSSIFDAKAGIALSDNFVKLVSWYDNEWGYSTRVVDLIIHMSKA

SEQ ID NO: 53866 - protein, 231 aa, Cytophaga hutchinsonii ATCC 33406
MKTYKTVFFDLDHTLWDFNLNCAETLQELYTIYELAQFGFSVPDFQKTYRHINDSMWAGFHRNEVTKEELRTERFPRTFQMLGIHADNVPARIDTHFIELCPTKPHVHVNSFEILDYLKEKGYSLHIITNGFSETQHVKMKHSGLEKYFDSLIHADHTGYKKPEPQIFEYALQTTGSAAETSIMIGDDLYADVLGAKLMGIGNVFYNPEKKTHTEDIQFEITNLIELKHIL

SEQ ID NO: 53867 - protein, 507 aa, Salmonella enterica subsp. enterica serovar Paratyphi A str.
MVLVILDGYGYREEQQDNAILNAKTPVMDALWAKRPHTLIDASGLEVGLPDRQMGNSEVGHVNLGAGRIVYQDLTRLDVEIKERTFFANPVLTNAVDQAKNAGKAVHIMGLLSAGGVHSHEDHIMAMVELAAERGAEKIYLHAFLDGRDTPPRSAEASLKKFEDKFAALGKGRVASIVGRYYAMDRDNRWDRVEKAYDLMTLAQGEFQADTAVAGLQAAYARDENDEFVKATVIRAEGQADAAMEDGDTLIFMNFRADRAREITRAFVNADFDGFARKKVVNLNFVMLTEYAADIKTAVAYPPASLANTFGEWMAKNDKTQLRISETEKYAHVTFFFNGGVEEPFAGEERILINSPKVATYDLQPEMSSAELTEKLVAAIESGKYDTIICNYPNGDMVGHTGVMEAAIKAVEALDNCIEQVTKAVESVGGQLLITADHGNAEQMRDPATGQAHTAHTNLPVPLIYVGEKNVKAVEGGKLSDIAPTMLSLMGMEIPQEMTGKPLFIVE

SEQ ID NO: 53868 - protein, 131 aa, Triticum aestivum
  misc_feature (61)..(61): Xaa can be any naturally occurring amino acid
MAPAVMASSATTVAPFQGLKSTTGLPISRPSGSAGLSNVSNGGRIRCMQVWPIEGIKKFEXTLSYLPPLSKEALLKQVDYLIRSKWVPALSSAKVWASVFRGATTSPRVLTNGRITNVGNFPKVRGTGRQP

SEQ ID NO: 53869 - protein, 872 aa, Vitis vinifera
  misc_feature (241)..(241): Xaa can be any naturally occurring amino acid
  misc_feature (819)..(819): Xaa can be any naturally occurring amino acid
MAAVGMGHHGPTMPIFHGLWPARRFFAWSRFLFVIDVYISPPPVTVTDYPLQFPMTSSGVSSYRDRTSEFRSLSERMKKIGGMAVANHAEDDPATSRSLASASSRSEFNKKASRIGLGIHEACLKISRLAKLAKKSSMFNDPIMEIQELTALIKDDITALNIAVSDLQTLQNLEIADGNYSDDRVVHSNTNIKAHENRKQIFSTNVSRENPFQQHAKTVTEPPPWSSLSKTSGNLQPSVVXKWSSSWQPTEMCSDAMVTACIKPCQARRRLAVDNTPSNHMEVSMLQQVVPRQENYTQSRALALQNVESTISELSGIFTHLATMVAQQGELAIRLVKQCYLRDKLKKSWSPASTRQRVMRERKTRETRAQLSLKTLLWHGGSVYDAWFSCASNQVAQVLLTLPYSFSQLGMLSGVIFQIFYGILGSWTAYLISVLYIEYRSRKEKENVSFKNHVIQWFEVLDGLLGPYWKAMGLAFNCTFLLFGSVIQLIACASNIYYINDRLDKRTWTYIFGACCATTVFIPSFHNYRLWSFLGLGMTTYTAWYLTIAALVQGQVENVKHTGPTKLVLYFTGATNILYTFGGHAVTVEIMHAMWKPQKFKYIYLVATLYVFTLTIPSAVAVYWAFGDQLLDHSNAFSLLPQTGFRDAAVILMLIHQFITFGFACTPLYFVWEKVVGVHDTKSICLRALARLPVVIPIWFLAIIFPFFGPINSAVGALLVSFTVYIIPALAHMLTYRKASARKNAAEKPPFFLPSWSGMYMVGLKRMDAAVENMRLLGFSDELVRSTIKRLLEVYDGDAGWLFIEEGSYKLLIDTILDXQENGLLKWLSASVLPNTNEKYRHPHLGTIIFTNLGFETLGLKISLYRISQFDM

SEQ ID NO: 53870 - protein, 566 aa, Synechocystis sp. PCC 6803
MIKQIFPIFQWLPNYHPSWLKADVVAGLTLAAYAIPVALAYGSLAGLPSEVGLYCYMLGAVGYAFFGTSRQLALGPTSAISILVGVSLAPLANDDAGRYLILASSTAILVAIICLLAWLLKLSQIVNFISEPILTGFKAGAALQIASTQLPKLFGVPSGGSNFFSRIWDLFHHWQEIQPATLLVGGLALVLLVMGDRLWPSKPISLMVVILAIVVMGITNLLEQGVKVVGEIPQGLPSFGMPHWSFSDLDSLLPLALACFLLSYIEGISTARSFAIKHHYRINPEQELLAIGAANLAAGLGQGYPIAGGLSQSAVNEKAGAKTPLAIIITACIIAIVLLFFTGLFSNLPEAILGSVVLVAVKGLINIPELQHLKKIAPLEFKVSLIALFGVLCFGVLQGVLLAAIASILFLIHIISYPSSAVLGRIPGSDQFSDLERHPENLVISGVLIYRINGPILYFNINNIESDLFNHLAQQQEPVELVIFEMGTSPGIDTPAARWFKTLSQSLNQQGITLKLVNASGFVRDRLRAEGLEGEVGTFRRLDTVDSLISEFNCQRYSDLPHTEND

SEQ ID NO: 53871 - protein, 292 aa, Ostreococcus tauri
MSAPISTAVEAEDEDVDAALVEKFHKCANQFKLLLIDADAYFEPGVKAKMYGLYKRCQCSFDTDAVRPTNPLDVVGRAKYDAWKSVRNLSRREAMESYVETFREWGERYEELLAIEKAQKRDEKGFTDADKKAAEEFHDNDNELKVFGRAWSMGGAHSQPIAPTQEEESSSDDVEALIAACRAGDEDAAVKALQNGADLNERDSHGRTPLHWCADGGHTKLAMHLCLLKADVNAQDNYGQTPLHYSVSLEDAETANLLLDWGADPSMEDAESDTPESIGLWDLAGARTLEGE

SEQ ID NO: 53872 - protein, 884 aa, Oryza sativa
  misc_feature (280)..(280): Xaa can be any naturally occurring amino acid
FKLRSPTRRHFGLVYMLFMHREYRAGFISIDCGLPEKTSYVDDATKLKFTSDDAFTDAGTIHNVSSEFATPTTTTDRSLYNVRSFPAGARNCYTVPSVVPGSKYLVRAKFLYGNYDGLNKPPVFDLHLGVNFWQTVTVPSADWLGNAEVIAVVPDDFLQVCLVNTGAGTPFISGLDLRPLPSSLYAPANATQGLVLLDRRNFGASGSTVIRYPDDTYDRVWWPWSNPPAEWSDISTADKVQNTIAPVFDVPSVVMQTAITTRNSSIPIQFSWDTKPNHVXIFTLYVTELELLAGNAVRQFNVTINGVIWTKAPYKPVYLSTDAMYNGDRPYRGITRYNFSLNAAGSSTLPPILNAAEAFSVISTADLATDAQDVSAITAIKAKYQVNKNWTGDPCAPKTLAWDGLTCSYAISTPPRITGVNMSYAGLSGDISSYFANLKEIKNLDLSHNNLTGSIPNVISQLQFLAVLDLTGNQLNGSIPSSLLKRTSLLFDRYGNNPNLCSNSSSCQLPQKKSNSMLAVYVAVPVVVIGAVAVFLIFFIRKKKNKCVQSHSQNGSGGSLLELHNRQFTYKDLAVITNNFQRVLGKGGFGPVYDGFLKDGTHVAVKLRDESSSQGYSEFLTEAQILTRIHHKNLVSMIGYCKDGDNMALVYEYMSEGTLQEHIANSRRRFLPWRRRLQIALESAQGLEYLHKGCNPPLIHRDVKATNILLNAMLEAKIADFGLSKAFNRNNDTHVSTNTLAGTPGYVDPEYLMTMQPTTKSDVYSFGVVLLELVTGKPALLRDLDNTSIIQWVQQHLARGNIEDVVDARMHGDHDINSVWKVVDIALKCTMQESIHRPTMTGVVAMLQECIELENRHLKDYAANSENHNSSYNTYGVDQSTNVI

SEQ ID NO: 53873 - protein, 175 aa, Triticum aestivum
MAPTVMASSATSVAPFQGLKSTAGLPVSRRSNGASLGSVSNGGRIRCMQVWPIEGIKKVETLSYLPPLSTEALLKQVDYLIRSKWVPCLEFSKVGFIFREHNASPGYYDGRYWTMWNLPMFGCTDATQVINEVEEVKKEYPDAYVRIIGFDNMRQVQCVRFIAFKPPGCEESGKA

SEQ ID NO: 53874 - protein, 280 aa, Magnetospirillum magnetotacticum MS-1
MGTRVLPATKVLPKELLPVVDKPLIQYAVEEAAEAGITEIVLVTARGKEMLADHFDRNAELERSLEARGKTELLDIARGTCPKGVSITCVRQPAPLGLGHAVLCARPVIGDEPFAVLLPDDLILGKPGCLKQLVDVWSETRGHVIAVENVPADQVDRYGILDVIEEKGRLIRARGMVEKPKPAEAPSTLSVIGRYILDASVFDALERRERGAGGEIQLTDAIARTLGEVSLHGARFLGTRYDCGNKAGYVAAIIDAALAHPETASAVLAHLEALSGRRAA

SEQ ID NO: 53875 - protein, 214 aa, Vitis vinifera
MDLRDAVVIGIGIVVMLLLSDLQGVVGIRFVVDREDCFSHDVQYEGDTVHVSFVVIKADASWHYAEDGVDLVIKGPSGDQIHDFRDKTSEKFEFVAQKKGLHRFCFTNKSPYQETIDFDVHVGHFTYYDQHAKDEHFNPLLEQIAKLEEALYNIQFEQHWLEAQTDRQAIVNEGMSQRAVHKAMFESVALVGASVLQIYLLQRLFERKLGISRV

SEQ ID NO: 53876 - protein, 149 aa, Vitis vinifera
MPCLSGPIGPIPHSLSLLSSPLHLLSLSLSPLYSLRTQEKGIKTQTTATSLSLSISLSLSLHHVAFRSGSLILKEKGQPLPKFGDWDVNDPTSADGFTMIFNKARDEKKTGGKPDSPAKEDSAFKHGADLGKPQSKKWFCCMQSTYAES

SEQ ID NO: 53877 - protein, 421 aa, Schizosaccharomyces pombe
MQMISSVLKYLDKVYSKSADKVPVNENGIYIFREVVLLNSFEIGEKCVETILILVYLERKGNTINRPLINDCLDMLNSLPSENKKETLYDVLFAPKFLSYTRNFYEIESSTVIGVFGVVEYLKKAEKRFEEEKERSKNYLFTKIASPLLSVVEDELLSKHLDDLLENQSTGFFSMIDSSNFEGLQLVYESFSRVELGVKSLKKYLAKYVAHHGKLINETTSQALEGKMAVGRLSSNATMATLWVQKVLALWDRLNTIISTTMDADRSILNSLSDAFVTFVDGYTRAPEYISLFIDDNLKKDARKAIEGSIEATLQNSVTLFRFISEKDVFEKYYKTHLAKRYALIVFTVFNTFRLLNNRSISSDAELGMISRLKQEAGNVFTQKLEGMFNGKYSDFSKFFCVPLLMLRYESFTRIVTGVQT

SEQ ID NO: 53878 - protein, 1593 aa, Oryza sativa Indica Group
MAMLTAKLTSPPAATTWLPGGGRRSAPPRRATVIRAAAVSYADELVSTAKSVASPGRGILAIDESNATCGKRLASIGLDNTEVNRQAYRQLLLTTAGLGEYISGAILFEETLYQSTTDGKKFVDCLKDQNIMPGIKVDKGLVPLPGSNNESWCQGLDGLASRRTVVSIPCGPSALAVKEAAWGLARYAAIAQDNGLVSIVEPEIFLMVTMRSRELLKWQRKCGLSMVTPGAEHKQKATPEAIAKHTLTMLRRRVPPAVPGIMFLSGGQSEVEATLNLNAMNQEPNPWHVSFSYARALQNSVLKTWQGRPENVEAAQKALLVRAKANSLAQLGRYTGEGESDEAKKGIRHALRPDPSTPRRRLSPESELSALNPPQTPAVQIPPEPSSRPPAAAAAAPEAEGAEALHEISGPAAAAARLVMLLASCLRGRLRLHRRPRPLIMPSPLFLSRNPNPSPPRSATATGTTILSPPSTSASASMSTSGVYVPPMRRLRSVIASPTAASLRRRPRPAQAQPGGSTLDNIDEWKWKLHMLLRNEDEQEVISRERKDRRDFEQLSQLAERMGLYSRQYSRIVVFSKVPLPNYRSDLDDKRPQREVSIPSGLQREVDALLSDYLARKRTSSGSFPNAAFSRSSSTDSFATDESFLEQQDNQTSTSAVIERIQRRKSLQLRNQQESWQESHDGQSMMEFRRSLPAYKERQTLLEAIAQNQVVVVSGETGCGKTTQLPQYILESEIDAARGATCSIICTQPRRISAIAVSERVAAERGEKIGESVGYKVRLEGMKGRDTRLLFCTTGVLLRRLLVDRNLKGVTHVIVDEIHERGMNEDFLLIVLKDLLPRRPELRLVLMSATLNAELFSSYFGGAPMIHIPGFTYPVRSRFLEDILEITGHRLTPYNQIDDYGQEKSWKMQKQALRKRKSQIASVVEDTVQAADLRDYSARTRDSLSCWNPDSIGFNLIENVLCHICQKERAGAVLVFMTGWDDINALKEQLQANPLLGDPSKVLLLACHGSMASSEQKLIFDRPEPGVRKIVLATNLAETSITINDVVFVVDCGKAKETSYDALNNTPCLLPTWISKASARQRRGRAGRVQPGECYHLYPQCVYEAFADYQLPELLRTPLQSLCLQIKSLRLGSISEFLSRALQSPESLSVENAIEYLKVIGAFDRNEELTILGKHLSMLPVEPKLGKMLIFGAIFNCLDPILTIVSGLSVRDPFLTPFDKKDLAESAKLQFSCRDYSDHLALVRAYEGWREAERDRNGYDYCWKNFLSVQTLKAIDSLRRQFLFLLRDTGLVDENMTACNKWSRDENLVRAVICAGLYPGVSSVVNKEKSISLKTMEDGQVMLYSSSVNGKETKIPFPWLVFNEKVKVNSVFLRDSTAISDSILLLFGGNIKQGGLDGHLKMLGGYLEFFMSRDLASTYLSLKSELDNLIHCKLQNPRMDIQTSEELLSAIRLLVTEDPCNGRFVYGRQEQRSKKAKTMFSAAPMSHGGGGNGGDNAKNQLQTLLTRAGHDNPSYKTKQIKNSLFRSTVEFNGMQFVGQPCANKKLAEKDAAGEALNWLTGGAPSDSRDPQDMDHMSMLQKPPRRKRHHHRRG

SEQ ID NO: 53879 - protein, 396 aa, Methanococcoides burtonii DSM 6242
MSTTRDYYEILGVSKDASDTELKKAYRKLAMKFHPDKNKEADAEEKFKEISEAYAVLSDAEKKAQYDRFGHAGIDGRYSTEDIFRNADFGDFGDLGDIFGSIFGGGGGFGGFGGGGRRRQGPTRGSDLRYDLGVTLEQAAFGEKVHINVPRAENCETCGGTGAKEGTSPKTCATCRGSGQVTHARRTPLGNFMTTTTCDACHGKGQVIESPCPVCRGSGKQKKVRKMGVSIPKGADTGLRLKMSGEGEAGSPGAPSGDLYIVIHVKQHDEFERIGDDIVYGIPISFSQAALGAEIKVPTLHGKVKMKIKPGTQTHSILRLKGKGMPRLHGHGQGDQLVKVIVETPTDLTGKQKELLDEFDRLSTGNSKGSKGKGFFDKVKDTFESAISTISPGTVE

SEQ ID NO: 53880 - protein, 231 aa, Arabidopsis thaliana
MVGATVVSKWTPLCVASPPERNSASLNPHCSPARVNFRTALAAFRPQFRLFSRNSASRRRLRASSSAESGIFLPHLVASMEDVEETYIMVKPDGIQRGLVGEIISRFEKKGFKLIGLKMFQCPKELAEEHYKDLSAKSFFPNLIEYITSGPVVCMAWEGVGVVASARKLIGKTDPLQAEPGTIRGDLAVQTGRNIVHGSDSPENGKREIGLWFKEGELCKWDSALATWLRE

SEQ ID NO: 53881 - protein, 175 aa, Pseudomonas syringae pv. syringae B728a
MSYSKIPAGKDLPNDIYVAIEIPANHAPIKYEIDKDSDCLFVDRFMATPMFYPANYGFIPNTLADDGDPLDVLVVTPYPVTPGSVIRARPVGILHMTDDGGGDAKVIAVPHDKLSQLYVDVKEYTDLPPLLLEQIKHFFENYKDLEKGKWVKIEGWGNADAARAEITKSVAAYKG

SEQ ID NO: 53882 - protein, 285 aa, uncultured bacterium
MTIKKAIFPVGGLGTRFLPATKAMPKEMLPVVDKPLIQYAVEEAVAAGIEEFIFVTGRNKSAIEDHFDHSTELEHVLQAKGKTDALRTVQQMMREPGSVSYVRQQEPAGLGHAVWCARHQIGNEPVAVLLADDLILGKPALAEMVDAYQGGNMVAVMTVARAETGSYGIITPGEDSGNQIEVKGLVEKPAPGDAPSTLAVVGRYIIEPGVFSTLSEGKKGAGGEIQLTDALASRIGQAPFTGLKFSGQRFDCGSKLGFIKANMAFALQRDGLGAELKQWLAEQID

SEQ ID NO: 53883 - protein, 302 aa, Brassica napus
  misc_feature (52)..(52): Xaa can be any naturally occurring amino acid
MMLRAVIRRASTRGGSSASSGLAKSMKSSRVAASSQSFHSLSATETLVPRGXHARSYFHHRSCPGCSECSRTLLTSFQGTTLQKWVRPFSSDSGDVVEAVVPHMGESITDGTLANFLKQPGVRVEADEAIAQIETDKVTIDIASPASGVIQEFLVKEGDTVKPGNKVAIISKSADAVSHVAPSEKIPDKAAPKPSPAEEPKVESTKVAEKPKASSPPPPPTKQSAKEPQLPPKDRERRVPMTRLRKRVATRLKDSQNTFALLTTFNEIDMTNLMKLRSQYKDAFFEKHGVKLGLMSGFIKAH

SEQ ID NO: 53884 - protein, 435 aa, uncultured bacterium
MNIVVIGTGYVGLVSGACFSEFGFSVTCVDKDAAKITALKQGIIPIYEPGLDDLVKRNYSAGRLTFTTDLGPAVQAADAVFIAVGTPTRRGDGHADLSFVFAAAEEVAGHLTGYTVVVTKSTVPVGTGKQVEQVIRTANASADFDIASNPEFLREGSAIGDFMRPDRVVVGVQNDRAKDVMRQLYRPLYLIEKPVLFTDLETAELIKYAANAFLAVKISYINQMADLCEKVGANVHDVAKGMGLDNRIGSKFLHPGPGYGGSCFPKDTLALVKTAESYDSPVSIVSEVVAYNQARKNAMAARVQTAFSGDVKGRKIAVLGLAFKPETDDMRESPSIEIITALSEAGAQISAYDPAAMEEAKHLLPDTISFADSAQACLDGADGAVVVTEWNEFRALTPQLFAQLMAGNVLVDLRNIYAPDQMQEVGLTYLSIGRP

SEQ ID NO: 53885 - protein, 489 aa, Colwellia psychrerythraea 34H
MSNLDCQSASEIVIFGAMGDLSCRKLLPALYQLEVCGLINKDSRIVGAARQDHTLEEFKSVVVENLNKYVKETIDEAVLTRFINRLVYQALEFKDSSSFNKLNDALAGGNDTRVYYFSTPPAIYGDICKGLHHANLITDADRVVMEKPIGHSLESSIEINNQVSEYFKENQTYRIDHYLGKETVLNLLVLRFANSLFTNNWDRNSIDHVQITVAESVGIEGRWGFYDEAGQLRDMVQNHLLQILSLLAMEPPADLSAESVRAEKLKVVKALKAINRENIKDKAIRGQYSDGFLNGVSVPGYLNEEGANANSNTETFVAIKAEIDNWRWKGVPFYLRTGKRMPKKHSEIVVHFKQQPHNIFKDSYSDLPANKLTIRLQPDEGVELQMMNKIPGIASQMRIQENKLDLSFSDTYNDERVVDAYERLMLEVLNGNQSLFVSRDEVEAAWIWADSIIEAWKTTNEAPKPYAAGSWGPVSSISLIARDDRQWVE

SEQ ID NO: 53886 - protein, 506 aa, Pseudomonas syringae pv. syringae B728a
MRYAHPGTEGAIVNFKERYGNYIGGEFVAPVKGQYFTNTSPVTGKAIAEFPRSTAEDIDKALDAAHAAAAAWGSTSVQARSLVLLKIADRIEANLEVLAITETWDNGKAIRETLNADIPLAADHFRYFAGVLRAQEGSAAEIDGNTVAYHIHEPLGVVGQIIPWNFPLLMAAWKLAPALAAGNCIVLKPAEQTPLGISVLIELIGDLLPPGVLNIVQGYGREAGEALASSKRIAKIAFTGSTPVGSHIMKLAADNIIPSTVELGGKSPNIFFEDIMSAEPEFIDKAAEGLVLAFFNQGEVCTCPSRALVQESIYPQFMEAVLRKVEKIKRGDPLDTDTMVGAQASEQQFDKILSYLDIAKGEGAELLTGGKVEKLEGSLSTGYYIQPTLLKGNNKMRVFQEEIFGPVVSVTTFKDEAEAVAIANDTEFGLGAGLWTRDINRAYRVGRAIKAGRVWTNCYHLYPAHAAFGGYKKSGVGRETHKIALEHYQQTKNLLVSYDTNPLGFF

SEQ ID NO: 53887 - protein, 419 aa, Leptospira interrogans serovar Lai str. 56601
MSVEIKVPEMGESITEATIANWVKKEGESVKQDEILLELETDKATMEVPAPSSGVLQKIHKKAGETVKVKEIIGLIDSSATASSPSTSAPTNSAQTTQTSGNGTINETLPPAVRKLIEDNGLNPASITGSGKNGQITKEDVLKAIETKATSSVSNASVNVGTPAAVKATLTLPEIPKAVPAARRTDLPRENVVPMTRLRKVIAERLVSAQHNAAILTTFNEVDMSAVMELRNRYKDKFKEAHNVSLGFMSFFTKAAIHALKTIPAINAEIRGSDIVYKNYYDIGVAVGGPKGLVVPVVRDADLLSFAGVEQEIIRLANRVKDGKIELAEMEGGTFTISNGGIYGSMMSTPILNPPQSGILGLHNIVKRAVVVNDQIVIRPMMYLALSYDHRIVDGKEAVTFLVKVKEAIEDPSRLLLEL

SEQ ID NO: 53888 - protein, 394 aa, Bacteroides fragilis NCTC 9343
MAEKRDYYEVLEVTKESTVEEIKKAYRKKAIQYHPDKNPGDKEAEEKFKEAAEAYDVLSNPDKRARYDQFGHAGMSGAAGNGGPFGGFSGGMSMDDIFSMFGDIFGGHSGGGFGGGFGGFGGFGGGGSQQRKFRGSDLRVKVKLNLKEISTGVEKKFKLKKYVPCSHCHGTGAEGNSGSETCPTCKGSGSVIRNQQTILGTMQTRTTCPTCNGEGKIIKDKCKVCGGEGIEYGEEVVTVKIPAGVAEGMQLSMGGKGNAGKHNGIPGDLLILVEEEPHPELIRDENDLVYNLLLSFPTAAIGGAVEIPTIDGKVKVKIEAGTQPGKVLRLRGKGLPSVNGYGTGDLLVNVSVYVPETLSKEEKSTLEKLEESKNFKPSTSIKEKIFKKFRSLFD

SEQ ID NO: 53889 - protein, 467 aa, Leptospira interrogans serovar Lai str. 56601
MSAEFDVVVIGAGPGGYVCAIRCAQLGFKTAIIEKRKTLGGTCLNVGCIPSKALLDSSEEYHKTLHKLEVHGISVGKVDLDLNKLMNRKDQIVKEVTDGVDFLMNKNKIKRYEGFGKVLSAGKVEVAFNDGKKETLSAKHIVVATGSVPIDIPGLTVDGKNIITSDHAIDVRKLPKKMIIIGAGVIGLELGSVWGRLGTSVTVVEFLPGLISNVDRQMGSLLERSLTSQGMEFLFEHKVKGAATTKNGVKVQIEDSKGESKDLEADVVLVAVGRRPFLEGVGLEEAGVAFTQRKRIQVDAHFKTSVPGIYAIGDAIDGPMLAHKAEEEGVALAELLAGQSGHVNYNAVPYVIYTWPEMAWVGKGEEELKAAGIEYKVGKSLFRPNARSKAMNEAEGQVKILADKKTDKLLGAFVFGPRASDMVAELAVAMEFGASAEDIARSFHAHPTLSEVIKEAAMAVDKWAIHA

SEQ ID NO: 53890 - protein, 485 aa, Cunninghamella elegans
MVEAVADIGLIGLAVMGQNLILNMNDHGFVVCAYNRTTSKVDDFLANEAKGTNVVGAHSVEELCAKLKRPRKVMLLVKAGSAVDAFIDQLLPHLEEGDIIIDGGNSHFPDSIRRTKELEAKGILFVGSGVSGGEEGARYGPSLMPGGNSKAWEHIQPIFQAIAAKAPDGASCCEWVGETGAGHYVKMVHNGIEYGDMQLITEVYQILHEGLGLSHDEMADIFEEWNKGDLDSFLIEITRDILRFKDTDGQPLVTKIRDTAGQKGTGKWTAIDSLDRGIPVTLIGEAVYSRCLSSLKDERVRASKILQGPSSSKFTGDKKTFIAQLGQALYAAKIVSYAQGYMLMRQAAKDYEWKLNNAGIALMWRGGCIIRSVFLGKIRDAYTKNPELENLLFDDFFKDATAKAQDAWRNVTAQAVLMGIPTPALSTALNFYDGLRHEILPANLLQAQRDYFGAHTYELLHTPGKWVHTNWTGRGGNVSASTYDA

SEQ ID NO: 53891 - protein, 386 aa, Synechocystis sp. PCC 6714
TPDRHQFPGLANKTYFNFGGQGILPTVALEAITAMYGYLQENGPFSIAANQHIQQLIAQLRQALAETFNVDPNTITITDNVTTGCDIVLWGLDWHQGDEILLTDCEHPGIIAIVQAIAARFGITYRFFPVAATLNQGDAAAVLANHLGPKTRLVILSHLLWNTGQVLPLAEIMAVCRRHQGNYPVRVLVDGAQSAGSLPLDFSRLEVDYYAFTGHAWFAGPAGVGGLYIHGDCLGEINPTYVGWRSITYGAKGEPTGWAEGGKRFEVATSAYPQYAGLLAALQLHQRQGTAEERYQAICQRSEFLWRGLNQLPHVHCLATSAPQAGLVSFTVDSPLGHRAIVQKLEEQRIYLRTIADPDCIRACCHYITDEEEINHLLARLADFGP

SEQ ID NO: 53892 - protein, 337 aa, Coccidioides immitis RS
MVVKVGINGFGRIGRIVFRNAVEHPEVEIVAVNDPFIETHYAAYMLKYDSTHGRFKGDVKFSDNGLDVDGKHVRFYQERDPANIPWAETGADYVIESTGVFTTTEKASAHLKGGAKKVIISAPSADAPMFVMGVNNETYKSDIKVLSNASCTTNCLAPLAKVVNDNFGLVEGLMTTVHSYTATQKTVDGPSSKDWRGGRAAAQNIIPSSTGAAKAVGKVIPSLNGKLTGMSMRVPTSNVSVVDLTCRTDKSVTYDQIKEAMKKASANELKGIMSYSEDALVSSDLNGDTHSCIFDATAGIALNDHFIKLVAWYDNEWGYSRRVIDLIAYIAGVDAGK

SEQ ID NO: 53893 - protein, 216 aa, Candida albicans SC5314
MQQETNNTQYVSNNKHSEESSRKISRSVVKLVPPLNFSLVENGIYRSGFPMPINYPFLKQLRLKTIIYLGDLGNQTSKKGKKKDKHGTAEIMNNYLDWIKNDTEIRFYNLLFESSQEPFNKPDDIQQATQSLTFALQLILNKENYPILIHSNKGKHRTGVLIGIMRKVLQGWCLSGIFEEYEKFAMGKSEYDLELIELWQPELYIDDANKPDFVRI

SEQ ID NO: 53894 - protein, 299 aa, Campylobacter coli RM2228
MSKIAIIGAGKWGSALYSALSINNTCFMTSRTQRDLPYFVSLEQALNCEYLVFALSSQGIYSWLKQNFVNKGQKILIASKGIDTSTCKFLDEIFSEFIDRDKLCVLSGPSFAAEVMQNLPCALVVSGIKEELCKKFASFFPDFIKVYTDDDVRGAEICGAYKNVLAIASGISDGLGLGNNARASLISRGLIEMHRFGKFFGAKEETFLGLGGAGDLFLTATSVLSRNYRVGLALAKEKKLDDILQELGEVAEGVKTAYAIAKISKDKAIYTPIVNEIVQILQGKNVKQAVQNLLKTKDN

SEQ ID NO: 53895 - protein, 388 aa, Salmonella enterica subsp. arizonae serovar 62:z4,z23:--
MNLHEYQAKQLFARYGLPAPVGYACTTPREAEEAASKIGAGPWVVKCQVHAGGRGKAGGVKVVNSKEDIRAFAENWLGKRLVTYQTDANGQPVNQILVEAATDIGKELYLGAVVDRSSRRVVFMASTEGGVEIEKVAEETPHLIHKVALDPLTGPMPYQGRELAFKLGLEGKLVQQFTKIFMGLATIFLERDLALIEINPLVITKQGDLICLDGKLGADGNALFRQPDLREMRDQSQEDPREAQAAQWELNYVALDGNIGCMVNGAGLAMGTMDIVKLHGGEPANFLDVGGGATKERVTEAFKIILSDDNVKAVLVNIFGGIVRCDLIADGIIGAVEEVGVNVPVVVRLEGNNAELGAKKLADSGLNIIAAKSLTDAAQQVVAAVEGK

SEQ ID NO: 53896 - protein, 157 aa, Triticum aestivum
  misc_feature (81)..(81): Xaa can be any naturally occurring amino acid
  misc_feature (89)..(89): Xaa can be any naturally occurring amino acid
  misc_feature (118)..(118): Xaa can be any naturally occurring amino acid
  misc_feature (120)..(120): Xaa can be any naturally occurring amino acid
  misc_feature (126)..(126): Xaa can be any naturally occurring amino acid
GFQEGLYMGAGGGANAVNPGYTKGDGLGAEIVGTFVLVYTVFSATDAKRSARDSHVPILAPLPIGFAVFLVHLATIPITGXTGINPARXSLGAAIVYNRSHAWNDHWVFLGWPFIGAXLXAIYNVXIIRASPSKTVTDYTTLFITNTMQIRSSLLTI

SEQ ID NO: 53897 - protein, 357 aa, Glycine max
MLCLRLPLLRPKSTFPPSDFCYNYYQYKHIVGMARFSLDEISDTGAFVRSASTFRNWISRDPNSLFPPESGRYHLYVSYACPWASRCLAYLNIKGLDKAISFSAVKPIFERTRESDEYKGWIFPESETEVPGAEPDRFNGAKTIRELYEIASENYAGKYTVPVLWDKKLKTIVNNESSEIIRMFNTEFNNIAENPTLDLYPTDLKAQIDDTNEWIYDSINNGVYKCGFAKKQEPYNEAARQLYGALDKCEDILSKQRYICGNTLTEADIRLFVTLIRFDEVYAVHFKCNKKLLREYPNLFNYTKDIFQIPGISSTVNMEHIKLHYYGSHPSINPFGIVPVGPNIDYSAPHDRERFSA

SEQ ID NO: 53898 - protein, 406 aa, Salmonella enterica subsp. arizonae serovar 62:z4,z23:--
MSSVDILVPDLPESVADATVATWHKKPGDAVVRDEVLVEIETDKVVLEVPASADGILDAVLEEEGTTVTSRQILGRLREGNSAGKETSAKSEEKASTPAQRQQASLEEQNNDALSPAIRRLLAEHNLEASAIKGTGVGGRITREDVEKHLAKAPAKDESKAPETAPAAQPALGARGEKRVPMTRLRKRVAERLLEAKNSTAMLTTFNEVNMKPIMDLRKQYGEVFEKRHGIRLGFMSFYVKAVVEALKRYPEVNASIDGDDVVYHNYFDVSMAVSTPRGLVTPVLRDVDTLGMADIEKKIKELAVKGRDGKLTVEDLTGGNFTITNGGVFGSLMSTPIINPPQSAILGMHAIKDRPMAIDGKVEILPMMYLALSYDHRLIDGRESVGFLVTIKELLEDPTRLLLDV

SEQ ID NO: 53899 - protein, 224 aa, Staphylococcus aureus subsp. aureus Mu50
MRVKDNLQQISTQINDKSEKNNFSTKPNVIAVTKYVTIERAKEAYEAGIRHFGENRLEGFFQKKEALPSDAVIHFIGSLQSRKVKDVINDVDYFHALDRLSLAKEINKRAEHKIKCFLQVNVSGEASKHGIALEDVDQFIDDLKKYDKIEIVGLMTMAPLTDDEAYIRSLFKQLRLKKEEIQRLNLEYAPCDELSMGMSNDYLIAVEEGATFVRIGTKLVGEEE

SEQ ID NO: 53900 - protein, 277 aa, Triticum aestivum
QLLSVVSGGAAAAGNAVADSAPPPVEPAMAFYPPPPLAFRYANALGGVATGGTVSFQQPAPGVGAITSPTAAPQAVGDNKESASKRKRGGPGGLNKVCAISPELHTVVGETAMLRTQIVKQLWAYIRQNNLQDPDDKRKIICNDELRIVFGTDSTDMFKMNKLLAKHITPLDPKDQPSEAKKIKAATPAPQQMPTINQNQPYVVVSDALAKFLGVEGTVPHDDALKYLWDYIKANQLEDPASASILCDSSLQELFGCESIPASGLSDLLAHHFIQRT

SEQ ID NO: 53901 - protein, 409 aa, Staphylococcus aureus subsp. aureus COL
MSLRDEALEMHKRNQGKLEVKPNVKVTNKEELSLAYSPGVAEPCKDIYEDKRKVYDYTIKGNTVAVITDGTAVLGLGNIGPEASIPVMEGKAVLFKSFAGINGVPIALNTTDTEEIIKTVKLLEPNYGGINLEDISAPRCFEIEERLKKETNIPVFHDDQHGTAIVTLAGLVNALRVVNKDIAKIKVVLNGAGAAGIAIVKLLYAYGVRNMVMCDSRGAIFEGRSYGMNPTKDVVAKWTNKDKIEGSLEEVVKDADVFIGVSVANALSQDMVKSMADNPIIFAMANPNPEIIPDDAKAAGARVVGTGRSDYPNQINNVLAFPGIFRGALEVEATHINEEMKKAAVEAIADLIDSSELNEDYCIPGPFDKRVAPSVARNVAKAAMESGVARIEVDPQDVYDKTMKLTDLQ

SEQ ID NO: 53902 - protein, 420 aa, Sulfitobacter sp. EE-36
MSLQQHRLSNGFRIVTEHMPGLASASIGVWVSAGARHETATQNGIAHFLEHMAFKGTAKRTSLQIAEAIEDVGGYINAYTSREVTAYYVRVLENDVSLGLDVIADILRNPVLDNGEIEVERGVILQEIGQALDTPDDVIFDWLQEKAYPNQPIGRTILGPSERVSNFSREDLSGFISQHYGPDQMILAAAGAVDHDEIVRLAEQLFGDMPPKPLFDVDAAKFSGGEVRQLKPLEQAHFALGFEAPGYRADDIYVAQIYASALGGGMSSRLFQEVRENRGLCYTIFAQAGAYADTGMMTIYAGTSGEQLPELAGITIDEMKRAASDMSPAEVARARAQMKAGLLMGLESPSNRAERLARLIQIWDRVPPLEETIAQIDAVTTGDVRDFAQNIAASAPAALALYGPVDGAPTLEELQERRAA

SEQ ID NO: 53903 - protein, 143 aa, Bacteroides fragilis
MKFGIVVSEWNANITGALLDGAVKTLKKHGAKEENILVKTVPGSFELTFGANQMMENSDIDAIIIIGCVIKGDTPHFDYVCMGVTQGVAQLNATGDIPVIYGLITTNTMEQAEDRAGGKLGNKGDECAITAIKMIDFVWSLNK

SEQ ID NO: 53904 - protein, 123 aa, Zea mays
  misc_feature (53)..(53): Xaa can be any naturally occurring amino acid
MMLRAAGRRLLGVGGGDPAPAVAAAVAASRSRGYHERVVDHYNNPRNVGSLDXKDDADVGTGIVGAPACGDVMKLQIRVDEGSGRIVDARFKTFGCGSAIASSSVGWFHSSRYLGCRVDQDLE

SEQ ID NO: 53905 - protein, 534 aa, Porphyra purpurea
MMKKKVHPIVLAILDGWGHSNSHQGNAIKIAKTPTIDSLLETYPNTLLVASGEEVGLPKGQMGNSEVGHTTIGGGRVVEQELVKIGNSIENKSFFNNVQLNCACDHAISTQTSLHLIGLCSNGGVHSHLDHLLALIHVAESKKVPNLYIHLITDGRDTNSNSAKSFIKLIADHIEKKSFVIISTISGRYYAMDRDFRWSRTKAAYTVLTSDNSDITNQPLNYNDLIDHYYNKGISDEFIPPSRINTGSIKDGDAIIFFNFRPDRMRQLVQALVQKPFNCFLTKSLSHLHVLTFTNYDSSLNTALAFPPNTLNNFLGETISKYGLKQFRVAETEKYAHVTYFFNGGAEEPFSGEDRELVSSPSVTTYDLSPDMSAELVTQKSISAINKGIYSCIVINYANADMLGHTGKLKETIRSIETVDNCIALLFDAVSQSNGTLIITADHGNAECMLTNEGTSCTSHTTNLVPFILIEGEQATISGHGGQVEFRKNGSLADVAPTILDILNLKKPPEMTGKSLIINSKYETRNLDKTFIEL

SEQ ID NO: 53906 - protein, 214 aa, Triticum aestivum
  misc_feature (8)..(10): Xaa can be any naturally occurring amino acid
  misc_feature (14)..(14): Xaa can be any naturally occurring amino acid
  misc_feature (21)..(21): Xaa can be any naturally occurring amino acid
  misc_feature (24)..(24): Xaa can be any naturally occurring amino acid
  misc_feature (36)..(37): Xaa can be any naturally occurring amino acid
  misc_feature (39)..(39): Xaa can be any naturally occurring amino acid
  misc_feature (42)..(42): Xaa can be any naturally occurring amino acid
  misc_feature (52)..(53): Xaa can be any naturally occurring amino acid
  misc_feature (66)..(66): Xaa can be any naturally occurring amino acid
  misc_feature (68)..(68): Xaa can be any naturally occurring amino acid
  misc_feature (77)..(77): Xaa can be any naturally occurring amino acid
  misc_feature (82)..(83): Xaa can be any naturally occurring amino acid
  misc_feature (91)..(91): Xaa can be any naturally occurring amino acid
  misc_feature (122)..(122): Xaa can be any naturally occurring amino acid
  misc_feature (135)..(136): Xaa can be any naturally occurring amino acid
  misc_feature (140)..(140): Xaa can be any naturally occurring amino acid
  misc_feature (157)..(158): Xaa can be any naturally occurring amino acid
  misc_feature (163)..(163): Xaa can be any naturally occurring amino acid
  misc_feature (167)..(167): Xaa can be any naturally occurring amino acid
MAPTVMAXXXTSVXPFQGLKXTAXLPVSRRSNGASXXSXSNXGRIRCMQVWXXEGIKKFETLSYLXPXNTEALLKQXDYLIXXKWVPCLEXSKVGFIFREHNASPGYYYGRYWTMWKLPMFXCTDATQVINEVEXXKKEXPDAYVRIIGFDNMRQVXXVSLIXFKPXGCEERGLKQNSPGQHIKVFAGFFDFWGCFLSHLFLVPKKNIGKGPFG

SEQ ID NO: 53907 - protein, 618 aa, Helicobacter pylori 26695
MILQNKTFDLNPNDIAGLELVCQTLRNRILEVVSANGGHLSSSLGAVELIVGMHALFDCQKNPFIFDTSHQAYAHKLLTGRFESFSTLRQFKGLSGFTKPSESAYDYFIAGHSSTSVSIGVGVAKAFCLKQALGMPIALLGDGSISAGIFYEALNELGDRKYPMIMILNDNEMSISTPIGALSKALSQLMKGPFYQSFRSKVKKILSTLPESVNYLASRFEESFKLITPGVFFEELGINYIGPINGHDLSAIIETLKLAKELKEPVLIHAQTLKGKGYKIAEGRYEKWHGVGPFDLDTGLSKKSKSAILSPTEAYSNTLLELAKKDEKIVGVTAAMPSGTGLDKLIDAYPLRFFDVAIAEQHALTSSSAMAKEGFKPFVSIYSTFLQRAYDSIVHDACISSLPIKLAIDRAGIVGEDGETHQGLLDVSYLRSIPNMVIFAPRDNETLKNAVRFANEHDSSPCAFRYPRGSFALKEGVFEPSGFVLGQSELLKKEGEILLIGYGNGVGRAHLVQLALKEKNIECALLDLRFLKPLDPNLSAIVAPYQKLYVFSDNYKLGGVASAILEFLSEQNILKPVKSFEIIDEFIMHGNTALVEKSLGLDTESLTDAILKDLGQER

SEQ ID NO: 53908 - protein, 517 aa, Psychrobacter arcticus 273-4
MLSHWVRAILQATVYDVAIQTPLEAAPKLTQRFANDIRFKREDLQPVKSFKLRGAYNRISQLNDEQKARGVICASAGNHAQGVAYSARKLALNNIIVMPTTTPDIKVDAVRALGGNVDLYGDSFDEANRYAIDRAEREGLTFIPPYDDELVIAGQGTIGLELTQQWRNMDYVFVAVGGGGLISGVAAFLGEVAPHVKVIAVEADQSASLKAALEANERVKLEQVGLFVDGVAVAQIGELPFDIVRMQKSDKSGPVVEPQVVTCTNDEVCAAIKDIFEENRSIVEPAGALPVAGMKKYLEAHDLQGKNCVAIICGANMNFDRLRYIAERTEIGEKKEAVFGVTIPEQTGAFLSFCRSLHGRNITEFNYRADSKKSPDSMEPAAIFVGIALKEGDKERQTIRTQLAADGYTAHDLTDDDVAKSHIRYLIGGHAHVENEQLLQVTFPERPGALLTFLEKLGNDFNITLFHYRNHGAAEGRVLVGLQASESNSRQLQDALLDIGYDCTMLNDNIGYQLFLK

SEQ ID NO: 53909 - protein, 450 aa, Lysobacter enzymogenes
MSSLPRTVLQPAPAPVQIDPLIAALARVPSVVRVGKVAEAYGTMIRATGLKAMIGELCELRSPRDRSFRLAAEVVGVSRQYTLLTPLGALDGVAHDTEVIATGRQASVRCGEGLLGRILDANGDAIDGRGGFGPTVQMPIYAASPNPLARQLIDRPFATGVRALDTVITAGVGQRLGIFAVAGGGKSTLLGMLARGGDADVNVIALVGERGREVNEFIHDNLGEEGLKKSIIVVATSDRPALERSRAAWVATAIAEYFRDRGKRVMLLVDSVTRFARALRDVGLAIGEPPARRGFPPSVFSQMPRLFERAGNNDKGSITAFYTVLMEGEDGDDPVAEEVRSILDGHIVLSRKLAAAYHYPAIDVLVSLSRTMPRVADEAHQRAAGQLRKYLAKHQDIELLLQLGEYKRGSDADADIAIEKIEPIRKLLKQSSNDLADYKQSIDALRRLFG

SEQ ID NO: 53910 - protein, 529 aa, Ostreococcus tauri
MERDQTADDESESSESVDDEGLRRQVLEVDGEPDYASGPPMDGFEYLRRVAYEARQSPDIMRAENLDASVFSTQSAGVYAAKVDEETELAPPDWAKPNREWTRRTVGDFSDLRIHVSRMLASTSTRNCSGASGTSAYPRCGDRRAWEKLCAEIVEPPIGAVLAMDAVTCAHLLRHVSHALCRYDYDGDNADFEEIIRLLRWFHALCARVDLPLDPDTEAGIRSAMKGVARGRLSVVSGEDALVAHFNLAIAIGGGYFKQWRDEGSRVMMSILEAVACGSVDDVDSALKTGECIDVLNELGEAALMIATRARDVTMVRHLLERGANCRLRNANGDTSLHVACFTGQLKVVEALLSHGALLEGLGEQSNRPIHLACAGGFEDVVACLLLRGCVVNAQNANGALPSTLCAKFERVRAIVSDIERLGEVSRDALRREVAARGATVAIERRNIAREEDERRVREAQEQDAQRAETTRARDAELRRIVAEKDAALAEIAALREKEEERLKVEEAKKAKRAKLAAKKAKVGVGKRT

SEQ ID NO: 53911 - protein, 403 aa, Bordetella pertussis Tohama I
MSNRPIYLDYSATTPVDPSVVEKMIPWLYESFGNPASRSHAFGWEAEDAVEKAREEVAKLVNADPREIVWTSGATESDNLAIKGAANFYAERGKHIITVKTEHKAVLDTCRELERQGFEVTYLDVQDDGLLSLDAFKAALRPDTILVSVMMVNNEIGVIQDIAALGEICREKGIIFHVDAAQATGKVEIDLQKLKVDLMSFSAHKTYGPKGIGALYVRRKPRVRIEAQMHGGGHERGFRSGTLATHQIVGMGEAFRLAREEMGTENERVRMLRDRLLAGLTQIEEVYVNGSMEHRVPHNLNISFNYVEGESLIMAIKELAVSSGSACTSASLEPSYVLRALGRNDELAHSSIRFTLGRFTTEQEIDFTIELIKSRVGKLRDMSPLWEMAQEGIDLNSVQWAAH

SEQ ID NO: 53912 - protein, 136 aa, Bordetella pertussis Tohama I
MAYSSKVLDHYENPRNVGSFDKGDDSVGTGMVGAPACGDVMKLQIKVNEAGVIEDARFKTYGCGSAIASSSLVTEWVKGKTLDEAMNIRNTQIAEELALPPVKIHCSILAEDAIKAAVQDYKTKHGAETPEAVAAN

SEQ ID NO: 53913 - protein, 344 aa, Helicobacter pylori 26695
MALLFTGACGYIGSHTARAFLEKTKENIIIVDDLSTGFLEHLKALEHYYPNRVVFIQANLNETHKLDAFLNKQQLKDPIEAILHFGAKISVEESTHLPLEYYTNNTLNTLELVKLCLKHAIKRFIFSSTAVVYGESSSSLNEESPLNPINPYGASKMMSERILLDTSKIADFKCVILRYFNVAGACMHNDYTTPYTLGQRTLNATHLIKIACECAVGKRKKMGIFGTNYPTRDGTCIRDYIHVDDLANAHLASYQTLLEKNKSEIYNVGYNQGHSVKEVIEKVKEISNNDFLVEILDKRQGDPASLIANNAKILQNTSFKPLYNNLDTIIKSALDWEEHLLRFQ

SEQ ID NO: 53914 - protein, 219 aa, Psychrobacter arcticus 273-4
MSDQQAQKQAAAKAALRYIEDDMILGVGTGSTVNCLIELLPTLKLAGAVASSQVTEDRLRALGIEIVDLNFAGQLDVYIDGADEVNAHLQLIKGGGGALTREKIVAAASNKFVCMVDESKSVEILGRAFPVPIEVLPQARSYVARQLARMGGEPVYREDFVTDYGNVILDTYDLDVSNPLALEQQLNNIVGVVCNGIFAANQADVLLKASSNGVEILNR

SEQ ID NO: 53915 - protein, 448 aa, Vibrio sp. Ex25
MSNTLSHELLSERLSEALASLDSIPVARVTGRLIKVNGLMLQAVGCRFKLEQRCLVETAEGDMIEAQVVGFEHTIAYLMPIRRLGGLFAGAKVIPLDGDSTVQLSAQWLGRVLNGLGEPLDDGAPLKGGDRVSLEPKPINPLKRRPVDTPLNVGVRAINGLLTVGKGQRIGLMAGSGVGKSVLMGMITKNTEADVIVVGLIGERGREVREFIERNLTPEARKKAIIIAAPADESPLMRLRATLLCHRVSEYFRDQGKDVLLLMDSLTRYAMAQREIALSLGEPPASRGYPPSVFSVLPQLLERAGNSENQHGSLTAIYTVLAEGDDQQDPVVDSARAILDGHVVLSRQLAEQGHYPAIDINASISRCMSTCTQEAHSTIANNFRQMYSNYLQVKELLPLGGYQPGQDPELDQSVAMYPNLRAYLQQAANESVDYPTSLTELAQLFQSA

SEQ ID NO: 53916 - protein, 307 aa, Psychrobacter arcticus 273-4
MSLRHFLTLSDFTKQELENLIKRASELRKMQHAGEIYQPFVGRTLGMIFEKSSTRTRISFETGMGQFGGNAIFLSPNDTQLGRGEPLEDSARVISSMVDIIMIRTFGHEKVETFAKYSSVPIINALTDEFHPCQLLADMQTYYEHRGSIENKIVTWVGDGNNMCASFMQAAHQFGFELRVAAPYGFEPDSALMERFSHCVSLVENVQDAAKDSNLIVTDVWASMGQESEQNTRARRFAPYQVTPSLLDKADPEVVFMHCLPAHRGEEISHDMLDDPRSVVWDEAENRLHAQKALMEFLLKDKIKLPA

SEQ ID NO: 53917 - protein, 701 aa, Dunaliella salina
MLLQKGNIGKGIAQPVQRRGVPSALRHAPLANKVATPAVAPQGLLRPILSERGSPALLKRQRALDVVLRAAETEQEAENAGTVVPGDGWESFPPPPYEPSEQVLDLWQQADAVCFDVDRTVTTDASVGLLAKFMGIEDEAQSLTEQANRGEINLTKAFEDRLAKLNFTPTDIDRFLEEHPAHTRLVPGVENLIAALKARGVEVFLISGGFREMALPIASHLKIPAKNVFCNTMSWQLDDHGEPVRLQGLDMTRAAESHFKSRAIERIRRKYPYNNIIMVGDGFSDLEAMQGSPDGADAFICFGGVMQRPAVASQADWFVRSYDELMAKLKRYKVTMVGSGAWACTAVRMVAQSTAEAAQLPGSVFEKEVTMWVHEEKHSGRNLIEYINENHENPIYLPGIDLGENVKATSDLIEAVRGADALIFCAPHQFMHGICKQLAAARVVGRGVKAISLTKGMRVRAEGPQLISQMVSRILGIDCSVLMGANIAGDIAKEELSEAVIAYANRESGSLWQQLFQRPYFAINLLADVPGAEMCGTLKNIVAVGAGIGDGLGVGPNSKASILRQGLSEMRKFCKFISPSVRDDTFFESCGVADLIASSYGGRNRRVAEAWAQKRIAGDDQVTFEKLEKEMLNGQKLQGVLTSDEVQEILHARGWELEFPLFTTINRIIHGEVPPTMILRYRVACSMPSMPPARRVVNDYY

SEQ ID NO: 53918 - protein, 336 aa, Burkholderia pseudomallei K96243
MSFNLHNRNLLSLIHHNARELRYLLDLARDLKRAKYSGTEQPRLLRKNIALIFEKTSTRTRCAFEVAAYDQGANVTYIDPASSQIGHKESMRDTARVLGRMYDAIEYRGFSQEIVEELAHHAGVPVFNGLTDEYHPTQMLADVMTMREHSDKPLHDIRYAYLGDARNNMGNSLLLIGAKLGMDVRIGAPKSLWPAADFIAQCEAFAAESGARLTLTEDPYEAVKGVDFIHTDVWVSMGEPVEAWDERINALLPYQVNRKLIESTGNPRTRFMHCLPSFHNCETKVGKQIAERYPHLKDGIEVTDEVFESPRCIAFEQAENRMHTIKAVLVSTLGGI

SEQ ID NO: 53919 - protein, 500 aa, Arabidopsis thaliana
MLYFILLPLLFLVISYKFLYSKTQRFNLPPGPPSRPFVGHLHLMKPPIHRLLQRYSNQYGPIFSLRFGSRRVVVITSPSLAQESFTGQNDIVLSSRPLQLTAKYVAYNHTTVGTAPYGDHWRNLRRICSQEILSSHRLINFQHIRKDEILRMLTRLSRYTQTSNESNDFTHIELEPLLSDLTFNNIVRMVTGKRYYGDDVNNKEEAELFKKLVYDIAMYSGANHSADYLPILKLFGNKFEKEVKAIGKSMDDILQRLLDECRRDKEGSTMVNHLFSVQQQQREYYTDVIIKGLMMSMMLAGTETSAVTLEWAMANLLRNPEVLEKARSEIDEKIGKDRLIDESDIAVLPYLQNVVSETFRLFPVAPFLIPRSPTDDMKIGGYDVPRDTIVMVNAWAIHRDPEIWEEPEKFNPDRYNDGCGSDYYVYKLMPFGNGRRTCPGAGLGQRIVTLALGSLIQCFEWENVKGEEMDMSESTGLGMRKMDPLRAMCRPRPIMSKLLL

SEQ ID NO: 53920 - protein, 363 aa, Leptospira interrogans serovar Lai str. 56601
MMKAFLVLDNGTIFEGESFGYETESVGEIVFNTSMAGYQEILTDPSYCNQIITLTYPMIGNYGIHPDNMESSKIQASGLIVKEYVDLPSNFKSEKTLSQFLKEYKIPAIQGIDTRKLTRFIRTNGSPNGGIFVASEYSPSFLEKVKSFPGIINADLAKVVTTSSKYIFGTHTGKKFKLAVYDYGVKTNILRLLDANGFAVTVYPAKTPSEEIMKEGTDAFFLSNGPGDPAPLDYAIASTQKIMEKRYPLFGICLGHQIIGLSLGKKTEKMKFGHRGGNQPVKNLETGQVEITSQNHGFAVIDDQKQDEPISFLNLNDHTVEGILKSGYPLLTVQYHPESAPGPNDSRYLFQKFYDLVEKTKKG

SEQ ID NO: 53921 - protein, 391 aa, Sulfitobacter sp. EE-36
MIPSVLPTYSRAPLSFVKGEGSWLIEQDGRRFLDLGAGIAVNALGHAHPALVAALTEQAGQLWHTSNLYEIPQQQELADRLVALSFADTVFFTNSGTEACELAVKMARKYFYDKGQPDRTEIITFSGSFHGRSSAGIAAAGSEKMTKGFGPLLPGFKHIEFGDMEALGAAITDTTAAIMIEPVQGEGGIRPVPDADLKQMRALCETHGLLLIFDEVQCGVGRTGKMFAHEWAGVTPDIMMVAKGIGGGFPLGAVLATENAASGMTAGTHGSTYGGNPLGCAVGNAVVNIIGTDAFLDDVNRKAGLMRQKLEGLVASHPDVFESVRGSGLMLGLKCKATNSDVVSAGYRHEVITVPAADNVIRLLPPLNITDEDIAEAVSRLDQAASSLAAS

SEQ ID NO: 53922 - protein, 301 aa, Sulfitobacter sp. EE-36
MKHFLDIHQTDPADLRSIIDNAATMKSSRLGRPRGAPDDEQPLKDHMVALIFEKPSTRTRVSFDVGVRQMGGQTMVLSGADMQLGHGETIADTARVLSRYVDLIMIRTFEEATLLEMAEYASVPVINGLTNRTHPCQIMADIMTFEEHSGPIKGKKVVWSGDGNNVFASFAHAAKAFDFELVFTGPQTLDPEAALNGLYTTVRDPNKAVEGADLVVTDTWVSMHDPQSARERRHNQLRGYQVNDALMAKAKPDALFMHCLPAHRDDEVTSSVMDGPSSVIFDEAENRLHAQKSVMRWCLGK

SEQ ID NO: 53923 - protein, 270 aa, Triticum aestivum
  misc_feature (39)..(39): Xaa can be any naturally occurring amino acid
  misc_feature (49)..(49): Xaa can be any naturally occurring amino acid
  misc_feature (213)..(213): Xaa can be any naturally occurring amino acid
  misc_feature (234)..(234): Xaa can be any naturally occurring amino acid
NGLCFLSVRVIIRQGNQRRLNHLFLIVTMTSGGYGNLFXNTDTTKLLAXVFVFPGMAIIALFVSKSADYLVEKQEVLFFKALHMNMKCGEAKMLRQIETNKTKYKFYTAALLLVTAIVVGTVFLWKVEKLSLVDSFYCVCATITTLGYGDKSFSSQLGRTFAVFWIITSTIILALFFMYLAEIYTERRQKMLAKWVLTRRVTTMDLEAADLDXNRESWVLAEFVVYKLKELGEXSSQEDISSFLEEFDKLDIDQSGTLSTYDLTQAQSGQ

SEQ ID NO: 53924 - protein, 392 aa, Carboxydothermus hydrogenoformans Z-2901
MNLEEKINPVLRQIPPSGIRKFFDLVANTKGVISLGVGEPDFVTPWYIREEGIYSLEKGYTMYTSNQGLLELREEISRYLLRLTGVAYDPVQEVLVTVGVSEGVDLALRALVSPGDEVLIPEPSYVSYGPTTMLAGGKPVYIRTRPENGFKLTPELLEEAITPKSKILLLCYPNNPTGAVMTADDLAKLLPVIAEHDLLVISDEIYAELTYEGKHVSVASFPGMKERTVILNGFSKAFAMTGWRLGYAAGPKEIIAAMTKIHQYTMLCAPITAQKAAIEALKNQNDAVKKMVEEYNYRRRILVEAFSEMGLWLFEPKGAFYAFPDISATGLSSEEFAERLLFEEKVAVVPGSAFGPSGEGFIRISYATARKDLIEALKRIKRFVRKKSLKKQ

SEQ ID NO: 53925 - protein, 397 aa, Alkaliphilus metalliredigens QYMF
MNIHEYQGKEIMKQYGISVPRSRITFTVEEAVQAAIDLGCEVIAVKAQIHAGGRGKAGGVKITRSLEETKSAAEAILDKILITKQTGPEGKVVNQVLIEEGLKIEKECYLSCAVDSTTSTVVLIGSPEGGMDIEEVAEKTPHKIFKESIDPAIGLQQYQARRLAFNMGINEACLQEAAQCIMNIYRLFMEKDCSMVEINPLITTEEHKVVALDCKVCFDDNSLCRHPEILKYRDLTEEDPREVQASKYDLSYISLSGNIGCMVNGAGLAMATMDMIDHFGGAPANFLDVGGGATAEKVKEAFKILISDKKVAGIFVNIFGGIMKCDVIATGILQAVNALDLDVPLVVRLEGTNVELGKEILKSSWLDVITVNSMAEGAEKIVALVNGKGVVRDERLN

SEQ ID NO: 53926 - protein, 278 aa, Vibrio alginolyticus
MMEIRQMEHKKIAFIGAGNMVRAIVSGLVANGYPAQNITATAPSEARRLPLEQDFGIRTTSDNIQAATEADVVVLSVKPQMMADVCKPLQAIDFTNKLVISIAAGINCSRLDDMLATKLNLVRVMPNTPSQLGLGMSGLFAPIHVTEHDKAFAAELMEAVGKVCWVEQESGINNVIAAAGSAPAYFFLFMEAMQAEAIAQGFDKESARLLVQQAALGAASMVVSNPETELSTLRENVTSKGGTTAEALRTFNEHQLSDIVAKAMQAAVARAEEMEKLF

SEQ ID NO: 53927 - protein, 347 aa, Rubrobacter xylanophilus DSM 9941
MKAARLYEYDPELEGQEFLKVEEVPEPEIEAPDDVIVRVGGAGVCRTDLHIIEGLWDEALVVEPPYTLGHENAGWVEEAGSSVSRFAPGDAVVIQPALSDGTCLSCLRGRNNLCESLVWIGIQQNGGFAEYVRVKERNLVKLPENVEPRDAAPYADAGLTAYHATKKAARVLDAGDVAVVIGIGGLGHIGVQVLKALSPARVVALDRSEGALRLAEEVGADHVVNSAGDAVDRVLELTGGRGAQAVVDFVGEADVPARALAMTRTGGYYFVVGYGGEIRVPTMEMIATEKSIVGNIGGTTSELHELIALAGEGKVRMNVRHYPLEEANRALLDLHEGRIHGRGVLVP

SEQ ID NO: 53928 - protein, 246 aa, Zea mays
  misc_feature (203)..(203): Xaa can be any naturally occurring amino acid
  misc_feature (215)..(215): Xaa can be any naturally occurring amino acid
  misc_feature (223)..(223): Xaa can be any naturally occurring amino acid
MGRQFFVGGNFKMNGSIKSITDIVENLNKGKLDPNTEVVIAPPALYLLLTREHLRKGLEVAAQNIFDKPNGAFTGEISAEQLKDSGITWTLVGHSERRQILQENDDFIANKTKTATDNGLGVILCCGESLEQREAGETVSVVTKQLKAVADKVKDWSKIVVAYEPIWAIGTGKVATTEQAQEVHAALREWLKKEVSPEASEKXRILYGGRVSEKXCNELAKRXNIDGFLVGGASLKPAFVDIITLT

SEQ ID NO: 53929 - protein, 475 aa, Sulfitobacter sp. EE-36
MAADLKTADIGVYGLGTMGSALSLNLAEQGFRVAVSNREADWIAPFLEEAGPLAGQLSGHATLEDFVDSIAQPRSILFMIPSGAPMDAMIDAVMPLLDEGDTIIDGGNADFHDTRRRAAAFDGTGRHFVGMGVSGGEEGARHGPSMMVGGTDHSWTQLRPMLSAIAAKFQGAPCVDHLGPDGAGHFVKTVHNGIEYADMQMIAEVYGLLRDAGGQTAPQIGALFESWQKGPLSSYLIEVSAAALQTVDAESGAPMVDLILDKAGQKGTGRWTLIEALKLGQSVSTIEAAVGARGWSSEKALRVAAAPLLPDAVTGGTLPTEDEMKSALLAARILGHAQGFRVLSAASDEFGWQLDMARIAEIWRAGCIIRSALLDDLADAFHAGLPEGALILAPAIRDMLGDHLAGLRKTVAAGVSLGVPMPALSASLAWYDSIRTARGSANLIQAQRDFFGAHGFERGDIAGAHHGTWNAIRRD

SEQ ID NO: 53930 - protein, 482 aa, Rubrobacter xylanophilus DSM 9941
MIESQIESRNYIGGEWVPADSGEVEEVRNPARPSEVLGTAPRSDRGEMERAVAAAQEALPGWRSALPAARGQILLRAADIIDSRSEELARLMALEAGKPLGESRAEVSRAAAIFRYYGSEGWRLYGVEAPSTRPGVRITSTREPLGVVGLITPWNFPLAIPSWKMAPALICGNTVVIKPAANAVLNAAELVRILEEAGLPGGVVNLVMGPGGSSGDALVRDERVRAISFTGSTAVGLSIQERAAGKKVQLEMGGKNPYVVMEDADLEDAAAKVAYGAFGYAGQKCTASSRAVVVEEVYEAFLEQVVEATRALKLGEPLDEEAVIGPVINESQYESILGAIEQAREDGRVVLDGGATGPREEGYYISPVIVADVDNGSKTAREEIFGPVLAVIKARDFDHAVEIANDTRYGLTAGIATRSLRYAEEFIERSQTGLVNVNLPTAGVEFQVPFGGSKQSGVGGREQGMAAIEFYTGWKTASVLAL

SEQ ID NO: 53931 - protein, 389 aa, Schizosaccharomyces pombe 972h-
MGGIGKKRVKKRTHLKADPIQEAAIPKSMVIRSGASEVGRSLSLLTRDLRHMMEPHTAIRLKERKANKIKDYLTMAGPLGVTHLLVLSRTDNNANLRIIRAPRGPSLHFRIHEYMLNKDVRRLQKNPKSPTTEFLTPPLLVMNHFNQNSSKDSPHEALLTTTFQNMFPPISVQHTNINSVKRVLLLNRRDDGYIDLRHFIISTKPVGISRPIRHLLKGEKKDSDIPDLHNVRDISDYVLHGDGISGAASDSEIEEDATVEIDRPVPTKTEENLLSASQLLKPKQQAIKLIEIGPRMTLELIKITEDAMGGKVLYHSHVHKSKEEIKQQDNFHEQSRALKEKRKKEQDENVRRKRENKKRRKDQKKEGITSSNKNDDSGNEGSSAYSDTE

SEQ ID NO: 53932 - protein, 457 aa, Carboxydothermus hydrogenoformans Z-2901
MELITLEQALTLTRQDIRDLYREYVNESLATLLSLLEFDKQFVKAKGTKVWDNEGNIYLDFLGGYGSLNFGHNPEEIWEAVKMVEELPNLLQASIGQLIGAAAYNLAKITPGNLKRVFFGNSGAEAVEGALKLARIYTGRPGIVYAHNSFHGKSFGALSVTGRQKYQTPFTPLLPECYPVTYGDLDELENILKSKPIAAFIVEPIQGEGGVVVPPQGYLKNALELCHKYGALLIVDEIQTGFGRTGKVFAVEYDEIVPDIMCVAKSLGGGVMPVGAYITTDTIWKKAYGSTDKATLHTSTFGGNTKAMAAVIKAIELLVKWDLAKKAKELGDYLLSQLSSLQTSYPLIKEVRGKGLLIGLEFNEPQGLLNKIPGLTNLAREYTGSFVAGLLMNKHRIITAYTLNNPNVIRLEPPLIVEKEELDRLIYALKDIFESHSSFLGVASANLKTVIGSLFKR

SEQ ID NO: 53933 - protein, 460 aa, Glycine max
MQKREQGKSGGSAGGGAAPPAKRGRPFGSGNNSSSAAASAADSAAPSTLLGPSLHVHNSFADQNNKRIVLALQSGLKNELTWALNTLTLLSFKEKDDMRKDATPLAKIPGLLDALLQVIDDWRDIALPKEFAKTTRIRTLGANSVVSGFGSEYQALGSTGTHHRPGVGSGSAGIESTQQNGVTKSRFSELWLDEDSLFNLDDEGRAEKQQCAVAASNIIRNFSFMPDNEVIMAQHRHCLETAFQCIEDHLVEDEELVTNALETIVNLAPLLDLRIFSSSKPSFIKITEKRAVQAIMGMLESAVKAWHCAAAELLGRLIINPDNEPFLLPFFPQIHKRLIDLISMPALDAQAAAIGALYNLAEVNMDCRLKIANERWAIDRLLKVIKMPHPVPEVCRKSAMILESLVSEPQNRSLLLAYENAFAEIVFTDGRYSDTFARILYELTSRPSNKVAAARGIWGM

SEQ ID NO: 53934 - protein, 331 aa, Zea mays
WWILPPPGAARANRPPPPRTTRPQPGLPPRSQNTAASCAAQRCHPPQSREDFAPLATPSQSPNTNHLPFPCKPFSQIRRHPHPQSAAPCPCTLPLLATDTAVLFPAVTTKHQHTTDENICEEATWQPAPKQGLSAWYEPFPPAPNVDPNERYSLDEIVYHSSLGGLLDVRPDTVVLARFSGAYWRDLFDSFPECSRHYHLLDHMALGYFPYAELAAAPTKCSMMVLNCGAYSVPNPSQASPVGFIQSTPSSPAPVPSTAASSLLPAAAPTRGDGVVLQLVQEIQDTLARGHGGVSDLLRNGAAVGAHLVLRQLDPLLTITEIIATDASPNS

SEQ ID NO: 53935 - protein, 485 aa, Magnetospirillum magnetotacticum MS-1
MIKHLINGKHVESASTIANLNPATNEVICQIAAGGEAEVARAVAAAKEAFPKWAGLAPAQRAKLLRKVGDLINQHVDEIAKLESLDTGQSYWRTKKMLVPRAADNFYFFADTCQHVDGETYPTNDHLNYTIYQPVGVVGLISPWNVPFMTATWKTAPCLAFGNTAVLKMSELSPLSADRLGQLILEAGIPAGVFNIVHGYGSAVGEALVKHPDVRGVSFTGSTATGNRIIQSGGLKKYSMELGGKSPNIVFDDCDFERAVDAAIVAVYGNNGESCTNGTRILVQDGIYDRFVAALAERTKKVVVGDPLDEATNVGPMITRDHWKKVTGYIELGIKEGARVVAGGLGEPEGLPAHLKNGNFVKPTVLADVDNSWRVAQEEIFGPVACVIRFKDEAEALKIANATTYGLASYVWTENGAKAIRMAEGIEAGLVFVNSQNVRDLRQPFGGIKGSGTGREGGHYSYEAFLEVKNVCVSKGNHHIPRWGV

SEQ ID NO: 53936 - protein, 560 aa, Turritis glabra
MASSTALICDTEAWKDLKGHVEDIKKTHLRDLMSDANRCQSMIMEFDGLLLDYSRQRATVETMDKLLNLAKAAQLTEKISRMFNGEHINSTENRSVLHVALRAPKDAVIKADGKNVVPEVWNVLDKIKEFSEKIRSGSWVGATGKPLKDVVAIGIGGSFLGPLFVHTALQTDPEALECAKGRQLRFLANIDPVDVARNINGLNPETTLVVVVSKTFTTAETMLNARTLREWITTALGASAVAKHMVAVSTNLALVEKFGIDPNNAFAFWDWVGGRYSVCSAVGVLPLSLQYGFSVVEKFLKGASSIDQHFQSTPFEKNIPVLLGLLSVWNVSFLGYPARAILPYSQALEKFAPHIQQGSMESNGKGVSIDGLPLPFETGEIDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLPELTAYNVGQLLAIYERRVAVQGFVWGINSFDQLGVELGKVLATQVRKQLHSSRTQGTALEGFNYSTTTLLKRFLETSSKPQM

SEQ ID NO: 53937 - protein, 390 aa, Wolbachia endosymbiont of Drosophila melanogaster
MSKIIEIRAPKTLGGESVTEGIVKIKKGIGEAVKVDDLIFEIETDKTALELTAEASGQITEFLIKEDDVISPDQLLAKLSMGEVKEEARKEDKSESAAKKDAPSARKIMEENAISAESVKGTGMGGRITKADVIGHMNKAEQPAIKQYELPKSVVNGEQREERVKMSKIRQVIAARLKASQNTAAILTTFNEIDMKNVMDLRAKYKDAFEKKYGIKLGFMSFFIKAAVQALKEIAEINAEISGDEIIYKHYYDVGVAVGTDKGLVVPVIRGADQMSFAEIELTLVALGKKAREGKLQVSEMEGATFTISNGGVYGSLLSTPIINPPQSGILGMHSIQNRPVAVGNAVEIRPMMYIALSYDHRIVDGKGAVTFLVKIKNYIEDPNRLVLEV

SEQ ID NO: 53938 - protein, 587 aa, Candida albicans SC5314
MARIKKRGTTGNAKNFITRTQAIKKLQISLADFRRLCIFKGIYPREPRNKKKANKGSTAPVTFYYSKDIQYLLHEPVLDKFRQHKTFAKKLQKALGRGEVSDAYKLDQHRPKYTLNHIIKERYPTFADALRDLDDPLNMLFLFANMPATDKVSAKVVSEAEKLCNQWLAYVAKERCLKKVFVSIKGVYYQATVKGQEIRWLIPYKFPTNIPTDVDFRIMLTFLEFYSTLVHFVLYKLYNEAGLIYPPIIEKSIGLSGYVLQDKDAPLKKKEEKNDEEGKNLSKKELNKAIKADQEQQENDEQDNNNGESVEDIELDEFTSTKEDSLLQPSKYASSTAELFSKFIFYIGREVPLDILEFCILSCGGKIISEIAIDDLKINDPEAYKKLNLSNITHQIIDRPKILQKVPGRTYVQPQWVFDSINKQELINVNEYAAGETLPPHLSPWGDAGGYDPNKEVEKEDGEAVEDTDEEEEEVEIEDGDEDQEDEEEEEDEDLKAQKELELEAAGVKFSEINEENKKSHSKKSKGTSNKEADEEKELKKIMMSNKQKKLFKKMQYGIEKKENREKQLTKKKKQLNKKKEQLKKLN

SEQ ID NO: 53939 - protein, 290 aa, Bordetella pertussis Tohama I
MSTRIRSLHIYPVKSCAGIDLAESIVDRAGLAHDRRWMVTTAAGQFMTQRQYPQMARIRTALEDGMLVLRAPGMEDLRIPADGSELAERTQPVGVWRDTVIARAEHPRSAEWLSRFLGLPCRLLKIDLRADRTANPEWVDTWLERHPEWAEDFAGDHFFGFADGFPLLVANQSSLDELNERLAARGQAPVPMNRFRANIVVEGDWPAFEEDQTACIVAGGVRMAFVKPCTRCPMSNVDQVTAEVYDELGLTLTTFRSLEIGVVFGQNAIVDRTAPAPLRVGDAVEIELDF

SEQ ID NO: 53940 - protein, 348 aa, Bordetella pertussis Tohama I
MSFQVTIEPSKHQFQAEAGQTVLDAALAAGIVLPYSCRTGACSTCKGKVVAGEVDAGPYPAQILSPEDLAQGYTLFCQAKPQSDLVVESTEVRLASDIQIRKLPSRVQTIERVAPDVAVLKLQLPASEQFRYYAGQYIEVILKDGKRRSYSMAGAPHTGSPLELHIRHMPGGLFTDHVFGAGDTQMKEREILRLEGPFGSFFLREDSDKPIVLLASGTGFAPVKAIVEHMIHNQIQRPVVLYWGGRRPRDLYHDALAQSWAGRLPGFRYVPVVSDALDEDGWSGRTGYVHEAVMQDLPDLSGYEVYACGTPLMVDAARREFSAQCGLPAEAFYADAFTSEADLAKATP

SEQ ID NO: 53941 - protein, 179 aa, Debaryomyces hansenii CBS767
MISRSFLRLANPARRAMPAVKRVNMMPSMALPTKRLYHEKVLDHYSNPRNVGTLNKLDVDVGTGLVGAPACGDVMRLQIQVDDETGVIKDVKFKTFGCGSAIASSSYLTELVKGKTIEEAVKIKNTAIAKELSLPPVKLHCSMLAEDAIKSAVKDYRSKRSVKQPTLGPEAAQAETIAT

SEQ ID NO: 53942 - protein, 185 aa, Methanosarcina acetivorans C2A
MEPTITIENIVASTRLAEDFDLQKLLDTGLKGAVYNKNKFPGLVYRIENPKAAFLIFASGKVVCTGTKNVENSRIALFNLANELNSIGYKGIYLKPEIHVQNVVASANLRTSLNLNAVLSAFGVENVEYEPEVFPGLVYKLADPRVVVLVFRTGKLVITGGKCPEDCEEGLRIIKTQLDNLGLLY

SEQ ID NO: 53943 - protein, 366 aa, Staphylococcus aureus subsp. aureus Mu50
MQSKRYLVLEDGSFYEGYRLGSDNLTVGEIVFNTAMTGYQETISDPSYTGQIITFTYPLIGNYGINRDDFESLVPTLNGIVVKEASAHPSNFRQQKTLHDVLELHQIPGIAGVDTRSITRKIRQHGVLKAGFTDRKEDIDQLVKHLQQVELPKNEVEIVSTKTPYVSTGKDLSVVLVDFGKKQNIVRELNVRGCNVTVVPYTTTAEEILAMAPDGVMLSNGPGNPEVVECAIPMIQGILGKIPFFGICLGHQLFALSQGASSFKMKFGHRGANHPVKNLETGKVDITSQNHGYAIDIDSLKSTDLEVTHLALNDGTVEGLKHKTLPAFSVQYHPEANPGPSDSNYLFDDFVAMMTNFKEKERHINA

SEQ ID NO: 53944 - protein, 210 aa, Schizosaccharomyces pombe 972h-
MGLTSWLFGGGKSPQEQLRAHQRSLGRAERELDRERTKLDQRERALIQEIKGSAKAGNTGAARIQARDLMRLRNSRKKMMNAKTQLQAISLRLQTMRTSEQMMQSMRGATRLLTGMNKSMNIPAMARITQQFERENEIMEQRQEMIDENMDDALEEDDEEEADELVNKVLDEIGVDLSQGLPDAATQIGTVPELKTEDNLQARLDELAKR

SEQ ID NO: 53945 - protein, 766 aa, Solanum lycopersicum
MERLRLMFLLILMVVLFHVFVDARQNQKKTYIIHMDKFNMPADFDDHTQWYDSSLKSVSKSANMLYTYNSVIHGYSTQLTADEAKALAQQPGILLVHEEVIYELHTTRSPTFLGLEGRESRSFFPQTEARSEVIIGVLDTGVWPESKSFDDTGLGQVPASWKGKCQTGKNFDASSCNRKLIGARFFSQGYEAAFGAIDETIESKSPRDDEGHGTHTATTAAGSVVTGASLLGYATGTARGMASHARVAAYKVCWTGGCFSSDILAGMDQAVIDGVNVLSLSLGGTISDYHRDIVAIGAFSAASQGIFVSCSAGNGGPSSGTLSNVAPWITTVGAGTMDREFPAYIGIGNGKKLNGVSLYSGKALPSSVMPLVYAGNVSQSSNGNLCTSGSLIPEKVAGKIVVCDRGMNARAQKGLVVKDAGGIGMILANTDTYGDELVADAHLIPTAAVGQTAGNLIKQYIASNSNPTATIAFGGTKLGVQPSPVVAAFSSRGPNPITPDVLKPDLIAPGVNILAGWTGKVGPTGLQEDTRNVGFNIISGTSMSCPHVSGLAALLKAAHPEWSPAAIRSALMTTSYSTYKNGKTIEDVATGMSSTPFDYGAGHVNPTAAVSPGLVYDLTVDDYINFLCALDYSPSMIKVIAKRDISCDENKEYRVADLNYPSFSIPMETAWGEHADSSTPTVTRYTRTLTNVGNPATYKASVSSETQDVKILVEPQTLTFSRKNEKKTYTVTFTATSKPSGTTSFARLEWSDGQHVVASPIAFSWT

SEQ ID NO: 53946 - protein, 185 aa, Solanum demissum
MKAVSIEAGERSKAKRVHGVNRGISVFDLVLRIVALVGTLASAVAMGTAGQALSFSTQIVNFEAQYDDIDAFKFFVVSNSITCVYLALSIPISIFHIIRSRAGKSRVLLIVLDAIMLVFLTSGASAAAAIVYLAHNGNTSTNWFSICQQYTDFCQRSAGSLIGSFGAMALMVLLIILSSIALSRR

SEQ ID NO: 53947 - protein, 238 aa, Glycine max
  misc_feature (210)..(210): Xaa can be any naturally occurring amino acid
  misc_feature (212)..(212): Xaa can be any naturally occurring amino acid
MAPPIETPTKVSSYQHSPNPRLNERILSSISRKHVAAHPWHDLEIGPEAPKIFNCVVEIGKGSKVKYELDKRTGLIMVDRILYSSVVYPHNYGFIPRTICEDGDPMDVLVIMQEPVLPGCFLRAKAIGLMPMIDQGEKDDKIIAVCADDPEYRHYNDIKDLPPHRLAEIRRFFEDYKKNENTEVAVNDFLPASAAYEAIKHSMTLYGGNXLXENLRREKLGEFWFWGKTYRLSKGCLL

SEQ ID NO: 53948 - protein, 560 aa, Crucihimalaya himalaica
MASSTALICDTEAWKDLKGHVEDIKKTHLRDLMSDANRCQSMMVEFDGLLLDYSRQCATVETTDKLLNLAKAAQLSEKISRMFNGEHINSTENRSVLHVAPRAPKDAVIKADGKNVVPEVWNVLDKIKEFSEKIRSGSWVGATGKPLKDVVAIGIGGSFLGPLFVHTALQTDPEALECARGRQLRFLANIDPVDVARNINGLNPETTLVVVVSKTFTTAETMLNARTLREWITTALGASAVAKHMVAVSTNLALVEKFGIDPNNAFAFWDWVGGRYSVCSAVGVLPLSLQYGFSVVEKFLKGASSIDQHFQSTPFEKNIPVLLGLLSVWNVSFLGYPARAILPYSQALEKFAPHIQQVSMESNGKGVSIDGLPLPYETGEIDFGEPGTNGQHSFYQLIHQGRVIPCDFIGVVKSQQPVYLKGEVVSNHDELMSNFFAQPDALAYGKTPEQLQKENVSENLIPHKTFSGNRPSLSLLLPELTAYNVGQLLAIYEHRVAVQGFVWVINSFDQWGVELGKVLAAQVRKQLHSSRTQGKALEGFNYSTTTLLKRYLETSSEPQM

SEQ ID NO: 53949 - protein, 56 aa, Populus trichocarpa
MRKFDPWPVFFRREWNRNWPFLAGFAITGTLITKFSLSLTEEDAKNSPFVQRHKRH

SEQ ID NO: 53950 - protein, 272 aa, Thermoplasma acidophilum DSM 1728
MTEKCVIKIGGSVLKDGSSLPRVMDIISHFRSPILVVSAFGGITDALYRFYEYDESRMDKLRDLLLMHLGILWKYNIEAHPEISIQDSSILDQDAYVSYGEKMSAFTLARFLTGNGIPAAPIYTDEAGLIVEEISKERTVDLEGSRAFFENIARVETSGKVPVVTGFFGIDRYGKTRILGRNSSDYSAVAVAAILGIREVILIKDVPGIYMNLEDRTSIVNRIDYETALRIVDRGSKVVHRAALRLAMKMGMNLLITSPENLESGTVIGDLF

SEQ ID NO: 53951 - protein, 560 aa, Arabidopsis halleri subsp. gemmifera
MASSTALISDTEAWKDLKGHVEDIKKTHLRDLMTDANRCQSMMMEFDGLLLDYSRQRATVETVDKLLNLAKAAQLTEKISRMFNGEHINSTENRSVLHVALRAPKDAVIKADGKNVVPEVWNVLDKIKEFSEKIRSGSWVGTTGKPLKDVIAIGIGGSFLGPLFVHTALQTDPEALESAKGRQLRFLANIDPVDVARNINGLNPETTLVVVVSKTFTTAETMLNARTLREWITAALGASAVAKHMVAVSTNLALVEKFGIDPNNAFAFWDWVGGRYSVCSAVGVLPLSLQYGFSVVEKFLKGASSIDQHFQSTPIEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLPELTAYNVGQLLAIYEHRVAVQGFVWGINSFDQWGVELGKVLATHVRKQLHSSRTQGTTLEGFNYSTTTLLKRYLETSSEPQM

SEQ ID NO: 53952 - protein, 229 aa, Nicotiana benthamiana
YAVPFEEDDRDPSIWFLDHNYHESMFSMFRRINAKEHVVGWYSTGPKLRENDLNIHGLFNDYVPTPVLVIIDVQPKELGIPTKAYYAVEEVKENATQKSQKVFAHVPSEIAAHEVEVIGVEHLLRDVKDTTISTLATEVTGKLAALKGLDARLQEIRSCLDLVIDGKLPLNHEILYHLQDVFNLLPNLNVAELVKAFSVKTNDMMLVIYLSSLIRSVIALHNLINNKML

SEQ ID NO: 53953 - protein, 445 aa, Gossypium hirsutum
MAATIVSVKARQIFDSRGNPTVEVDVETSNGIKARAAVPSGASTGIYEALELRDGDFDYLGKGVSKAVANVNTIIGPALIGKDPTEQTAIDNFMVQQLDGTQNEWGWCKQKLGANAILAVSLAVCKAGAEVKKLPLYKHIANLAGNSKLVLPVPAFNVINGGSHAGNKLAMQEFMILPVGASSFKEAMKMGVEVYHHLKSVIKKKYGQDATNVGDEGGFAPNIQENKEGLELLNTAIAKAGYTGKVVIGMDVAASEFYGTDKTYDLNFKEENNDGKQKISGDALKDLYKSFVAEYPIVSIEDPFDQDDWEHYSKLTNEIGEKVQIVGDDLLVTNPKRVAKAIAEKTCNALLLKVNQIGSVTESIEAVKMSKQAGWGVMASHRSGETEDTFIADLSVGLATGQIKTGAPCRSERLAKYNQLLRIEEELGAEAVYAGASFRAPVAPY

SEQ ID NO: 53954 - protein, 145 aa, Zea mays
NHGERDNATGLALCCKRFWVYSTDVEVEVILGWRILSWSDNFFFNHNLFLIFWPVALYASVMYDVVFSLLYMAVALPFAAPAMLVTWTTVLVLLAFAGCLCRSLVAEGRRTTRDISGLALHVLLRKGNVVAVLLLGRHDDYAGRH

SEQ ID NO: 53955 - protein, 435 aa, Desulfovibrio vulgaris str. 'Miyazaki F'
MGLNHRTASVEVRERFALTDCTVLEQGVVPTGDDISEVVILSTCNRVEIMAVGNGPGVPARVLDCWAAARGQKRSDLEPFVYVHKGIDAVRHLFSVASSLDSMVVGEPQILGQLKDAYRKAVGRNATRVVLNRLLHKAFSVAKRVRTETGVASSAVSISYAAVELAKRIFGEMSQYKAMLIGAGEMAELAATHLLNSGIREIMVANRTFERGLQLARQFKGEAVLFQDLSVRLAEADIIISSTGAHEPIIRARDIKDVLKRRKNRPMFFIDIAVPRDIDPDVNNLDNVYLYDIDDLKEVVEENMAQRRDEAAKARSIVEEEAGNFAKWLKSLDLQPTIVDLLRRSERIAQDELARTLKRLGPVDDATREALQAMLCAIVKKVNHEPITFLKRRFDEEEAGTRYIDITRRMFNLDCDDVPDDAHSDRKHTQQRDDA

SEQ ID NO: 53956 - protein, 468 aa, Cryptococcus neoformans var. neoformans JEC21
MAPITVKKICCIGAGYVGGPTCAVIALKCPQIQVTIVDLNQQRIDAWNSDNLPIYEPGLDEVVKATRGKNLFFSTDVDKGIEDADLIFVSVNTPTKKSGVGAGYAADLKFLQLATRRIAEVATSSKIVVEKSTVPCRTAESMRTILEANCRPGCHFDILSNPEFLAEGTAISDLFNPDRVLIGSLQTEQGIDACQALSGVYANWVPKERILTVGLWSSELSKLAANAMLAQRISSVNALSAICEATGANIDEVSYAVGKDTRMGSKFLKASVGFGGSCFQKDILNLVYLSESLHLPEVAKYWRAVVEMNEYQKSRFARKVVDTLFNTITGKKIAILGWAFKKDTGDTRESPSIGIANHFLSEKARIAVYDPQVTESQIWLDMTDYGEIPAEPIQPHLTICKSVEEACANAEAIVICTEWDEFKTLDWKKIYDNCPRPAFVFDGRLILNRQELTNIGFKVVTIGTGDRI

SEQ ID NO: 53957 - protein, 207 aa, Psychrobacter arcticus 273-4
MILMIDNYDSFTYNIVQYFGELQQDITVCRNDEITIEQIKVLAPDAIVIGPGPCTPDSAGISLELIDTFKGIIPILGICLGHQAIGQAFGGKIVKASEVMHGRLSAIYHNGQGVFIDLPNPAQFTRYHSLIIDKSSLPEGFEVTAWTQHIDGSMEEIMGIRHRDFAIEGVQFHPESILSEAGYQLLNNFLQAHHLAVIDSDSLPQVG

SEQ ID NO: 53958 - protein, 392 aa, Wolbachia endosymbiont of Drosophila melanogaster
MDHVVNAYNRLDTPIVRGEGAYLFDKDGKKYLDFAAGISTTSLGHCHPYITDKLKEQSSSLWHCSNIFTIPEQERLAEHLTTLTFADKVFFCSSGLEATEAAIKFIRRYFYSKGQAKRNRIITIEGGFHGRSIAAISAGGNEKSREGFAPLLSGFDKVPRNNIKALEEKINNEIAAVFLEPIQSEGGVYPLDVEYLQKVREITKAQGIILCFDEVQCGYGRIGSLFHYQNVGIEPDMLTCAKAMGNGFPVAACLVKDYIAEAITPGTHGSTYGGNPLAMTVGNAVLDIMLKEGFFDHVKRISKYLKEKLLLLAKEFPEMILEVRGEGLLMGIELATLVADKIISRSLDKGLIITRVLNNKVVRVTPPLIIEDEHVNAACNMLYDLFLKIKGI

SEQ ID NO: 53959 - protein, 469 aa, Psychrobacter arcticus 273-4
MSNKLLDLIKSSNAKWVDFRFTDTRGKEHHMSFPAHSVDEESMEDGKMFDGSSIAGWKGIEASDMILRPDPETAFIDPFFDAVTVVVTCDIIEPSTLQGYDRDPRSIARRAEEYLKSTGIGDTAFFGPEPEFFVFDEVKWSVGMSGVSHEIVAEEAAWSTNKDYEWGNMGHRPRVKGGYVPVPPVDSSQDMRTVMCDRIEDMIGEGCIEVHHHEVAPCQLEIGVAFNTLVRKADEVQKLKYAVHNVAHQFGKTATFMPKPIVGDNGSGMHVHISISKDGVNTFSGDEYAGLSETALYFVGGIIKHARALNAITNPSTNSYKRLVPHYEAPIKLAYSASNRSASIRIPHVSSPKAVRVEARFPDPAANPYLAFAALLMAGLDGIQNKMHPGEAADKNLYDLPPEEEALIPTVAENLEVALQALKDDHEFLLKGDVFTKEMLEAYIALKQEEVQRVNITVHPVEFDLYYSC

SEQ ID NO: 53960 - protein, 536 aa, Hyphomonas neptunium ATCC 15444
MTETTFADFGLAENILKAVTESGYTIPTPIQREAIPHILMGGDVTGVAQTGTGKTAAFVLPMIQRLSTGRARARMPRCLILCPTRELAAQVAENFEKYGKYLKLTMALLIGGVSFKEQETLLQRGVDVLIATPGRLMDQFDRGKLLMMGVETLIIDEADRMLDMGFIPDIEKICAKLPANRQTLLFSATFPTDIQRLAKTFQKDPKKIEVTRPAQTAETISQFVVKLPTNDGKARRTALRRVIEATNVKNGIVFCNRKVEVDIVAASLTKHGHDAAPIHGDLPQSVRSETLQRFRDGKLKLLVASDVAARGLDIPDVGHVFNFGPPPKDEDYVHRIGRTGRAGRTGESYTVVTPADDKSWGFVVKMIKKDVPEFMPEGLLEELETLPPEEKRDRKTGGRGGDRDRGGRSARGRTERTEQSDRSERAPRRRREKEDGDVAVADAPVETVATETVEAAEPAAVQEKPKRERAPRGEKRRERTEETPQPRAEKRERSGGDRERERPQRDYKRKDDDLILEPAPDRVVGFGNDVPNFLKR

SEQ ID NO: 53961 - protein, 874 aa, Candida albicans SC5314
MTMTTHFLYDRIRGCFLSSLVVGHVTFFVWFPGQPTRFSFDQLQTVTDAFKLDSSNLRKQLSDFLERENKLTLLASKDPLLSRNLTANANTEAKTKQSKIADESFAQLLQGLSGPPLTVAFASDGGNAEAVAKKVNRQALGRGLKSVVLQMDDLSVEDLPTETNVVFITSTSGQGEFPTNGKQFWDGVKNTTDLDLSGIRFSVFGLGDSQYWPRKEDKHYYNKPAKDLFAKLKLYGGVELADIGLGDDQDADGFSTGFNEWIPKIWAALGVDNVEGVEEPKPITNEDMKIGSDYLRGTIVEGLNDQSTGAISAVDQQLTKFHGIYMQDDRDIRDERKAQGLEPAYTFMVRVRLPGGIATPDQYLKMDELADERGNGTLKLTTRATFQLHGVVKHDLKPAIRGMNSALMDTLAACGDVNRNVMVSALPHNAKVHGQVSQIGALISEFLLPKTTAYHEIWLQGDDAGDKPGYREAWENRKEGPTKKKTLVAGNVLADVEPQYGVTYLPRKFKIVITVPPYNDVDVYAHDVGLIAIVEDNEVVGFNVLAGGGMGSTHNNKKTYPRTGSMLGYVSKDQVHIACEKIMLVQRDFGDRTNRKHARLKYTIDDLGVDVFKAKVEELLGYKFDEPRPFKIESNIDYFGWCKDELGYNHFTAFIENGRIENTPELPQKTGLRKIAEFLKSGNRSGEFRLTGNQHILISNVSDQDLDEVKKLLAQYKLDNTDFSALRKSSAACVAFPTCGLAMAESERYLPVLITKLEEALEEYGLRHDSIVMRMTGCPNGCARPWVAEVALVGKAYGAYNLMLGGGHHGQRLNKIYRYSIKEDEILDILKPLFKRWSLERNENEPFGDWCIRAGIIAETTEGKYFHDDIPEDA

SEQ ID NO: 53962 - protein, 703 aa, Vibrio campbellii AND4
MSEQKAFSLKIDEQNIAWLAIDVPNEKMNTLQAAFADEMKEIFAQLQDTSGVKGMIIHSLKPDNFVAGADVRMLEACTTATEAQALAKQGQDLFQQLSDLPYPVVAAIHGPCLGGGLELALACDYRVCTDSDKTRLGLPEVQLGLLPGSGGTQRLPRLIGLLPSLDLILTGKQLRAKKAKKLGVVDACVPETVLLDVAKMHVEKGKNKGNKKQSTKEKLVSGSGLGRKFVFEQAAKKTNKKTRGNYPATVAILEVIQHGLEKGFAQGQELEAKRFGELVMSSESKALRSIFFATTEMKKENGAEADPVAINKVGVLGGGLMGAGISHVSVAKAKVPVRIKDVSNDGVLNALNYNYKLFEKQRKKRIISKADLQSKMLQLSGGTDFTSFKHIDVVIEAVFEDLNLKQTMVAEIEANAKPNTIFATNTSSLPIHRIAEKADRPENIVGLHYFSPVEKMPLVEVIPHETTSEETISTVVALAKKQGKTPIVVKDKAGFYVNRILAPYMNEAAHILLANEPIEQLDNALLDFGFPVGPITLLDEVGVDIGAKIIPILVNELGERFKGPEVFDTLLNDGRKGRKSGKGFYTYKGKKKEVDKSIYKLLNLTPESKLRDTDIALRCVLPMLNEAVRCLDDGIIRSPRDGDIGAIFGIGFPPFLGGPFRYMDQFGLIELVEKMNEFASKYGDRYAPCDGLLTRAGEGRNFY

SEQ ID NO: 53963 - protein, 134 aa, Nocardioides sp. JS614
MRTWRFREPSAAITSLARRQADVRPWGDWLVLDEGPGFKVKRLHVHPHARLSLQQHHFRAEAWIVVAGIATCQVGTRSWLASPGETAHVPRCSAHRLANQHDEELLVIEVQWGAETREDDIVRLADDYGRAGVA

SEQ ID NO: 53964 - protein, 519 aa, Oryza sativa Japonica Group
MAMGLLAWMVAAAAAAVLASWAFSAVVHLVWRPRAISRRLRAQGVGGPGYRFFSGNLGEIKRFRGDGAGVVLNVSSHDFLPIVQPHFRKWIPLYGRTFLYWFGAQPNICLADVSMVWQVLSDRTGIYPKNLTNPHFVRLLGKGLVLTDGDEWKRHRKVVHPAFNMDKLKMMTMTMSDCSRSMMSEWESELAAKGGLVEIELSRRFEELTADVISHTAFGSSYKEGKQVFLAQRELQFLAFSTFLTVQIPGFSYLPTMKNFKTWSLDKKVRGMLMDIIKTRHANKDVAGYGNDLLGLMLEACAPEHGESCPQLSMDEIIDECKTFFFAGHDTTSHLLTWTMFLLSTHPDWQEKLREEIAMECGDKVPTGDMLNKLKMVNMFLLETLRLYSPVSLIRRKVDTDIELGGIKMPEGALLTIPIATIHRDKEVWGEDADEFRPERFENGVTRAAKHPNALLSFSSGPRSCIGQNFAMIEAKAVIAMILQRFSFTLSPKYVHAPTDVITLRPKYGLPMILKSLKL

SEQ ID NO: 53965 - protein, 381 aa, Zea mays
FGSRKLDAQQKAHVSLPMDTFKSYVLKEPIGVVALITPWNYPLLMATWKVAPALAAGCAAILKPSELASVTCLELAEICKEVGLPPGVLNILTGLGPEAGAPLAAHPDVDKIAFTGSSATGSKIMTAAAQLIKPVSLELGGKSPIIVFEDVDLDKAAEWTIFGCFWTNGQICSATSRLIVHESIATEFLNRIVKWVKNIKISDPLEEGCRLGPIVSEGQYEKILKFISNAKSEGATILTGGSRPEHLKKGFFVEPTVITDVTTSMQIWREEVFGPVLCVKTFSTEEEAIDLANDTVYGLGSAVISNDLERCERITKAFKAGIVWINCSQPCFTQAPWGGIKRSGFGRELGEWGLDNYLSVKQVTQYISDEPWGWYQSPSRL

SEQ ID NO: 53966 - protein, 368 aa, Leptospira interrogans serovar Lai str. 56601
MIYSKMSDLDQQLKIFRDQIDSLDREIVKSIQTRAEFASKIGEIKRERNEPVFRPDREKEVYEKIKSFSPGPLPDKVLLAIYREIMSGSISVEKGLEIGYLGPAGSFSNQAVRSRFGASINALEFNSIPDVFRAVETDKIDYGVVPVENSSEGLVNSTLDQFLVSDLLIYSEHYLRINISLLGLEHDLSKIKTLYGIKIANSQCKNWIAANLPHVEIVETSSTAKAAQIVAEKKDACAAVASSIAAEIYGLSLIRESIEDLPDNTTRFLIIGKNQCPPTGNDKTSIVFSCPDKPGALYRVLKPFFDYQLNLSKIESRPTRRNSWEYNFFIDFHGHQKDPSIQNVLAGLKENTIFLRVLGSYPMSPQNL

SEQ ID NO: 53967 - protein, 838 aa, Xanthomonas campestris pv. campestris str. ATCC 33913
MSSPSIAPVTPDLVRLRATARDKDDAIAQAAQLLVAAGCVAPGYDASMRRREGLANTFLGHGLAIPHGVGEDRHLVRRDGIAVLQLPEGVEWNPGQTTRLVVGIAAQSDTHITLLRRLTRLIQDPAQLEALFTTDDPAVIVAALTGDRAPDTSAAPATDLAERFEWTIAYPSGLHARPATRWAETARGFSARAQVRAGDQAADAKSLVGLLQLGLRAGDSITVSAKGSDAPALLKRLRAVMDSLTAQEKADAERAAQRRAAPVIGWTPPQAQPAIVGIGASPGVAIGIVHRLRAAQTEVADQPIGLGDGGVLLHDALTRTRQQLAAIQDDTQRRLGASDAAIFKAQAELLNDTDLITRTCQLMVEGHGVAWSWHQAVEQIASGLAALGNPVLAGRAADLRDVGRRVLAQLDPAAAGAGLTDLPEQPCILLAGDLSPSDTANLDTDCVLGLATAQGGPTSHTAILSRTLGLPALVAAGGQLLDIEDGVTAIIDGSSGRLYINPSELDLDAARTHIAEQQAIREREAAQRALPAETTDGHHIDIGANVNLPEQVAMALTQGAEGVGLMRTEFLFLERGSTPTEDEQYQTYLAMARALDGRPLIVRALDIGGDKQVAHLELPHEENPFLGVRGARLLLRRPDLLEPQLRALYRAAKDGARLSIMFPMITSVPELISLREICARIRAELDAPELPIGIMIEVPAAAAQADVLARHADFFSIGTNDLTQYVLAIDRQNPELAAEADSLHPAVLRMIRSTIDGARKHDRWVGVCGGLAGDPFGASLLAGLGVQELSMTPNDIPAVKARLRGRALSALQQLAEQALQCETAEQVRALEAQREGQA

SEQ ID NO: 53968 - protein, 483 aa, Escherichia coli
MSQCLYPVIIAGGTGSRLWPLSRVLYPKQFLNLVGDSTMLQTTITRLDGIECENPIVICNEDHRFIVAEQLRQIGKLTKNIILEPKGRNTAPAIALAAFIAQKNNPNDDPLLLVLAADHSINNEKAFRESIIKAMPYATSGKLVTFGIIPDTANTGYGYIKRSSSADPNKEFPAYNVAEFVEKPDVKTAQEYISSGNYYWNSGMFLFRASKYLDELRKFRPDIYHSCECATATANIDMDFVRINEAEFINCPEESIDYAVMEKTKDAVVLPIDIGWNDVGSWSSLWDISQKDCHGNVCHGDVLNHDGENSFIYSESSLVATVGVSNLVIVQTKDAVLVADRDKVQNVKNIVDDLKKRKRAEYYMHRAVFRPWGKFDAIDQGDRYRVKKIIVKPGEGLDLRMHHHRAEHWIVVSGTAKVSLGSEVKLLVSNESIYIPQGAKYSLENPGVIPLHLIEVSSGDYLESDDIVRFTDRYNSKQFLKRD

SEQ ID NO: 53969 - protein, 656 aa, Solanum tuberosum
TTHTSDFLKLNPSSGLWPASSLGQDVIVGVLDGGIWPESASFQDDGMPEIPKRWKGIYRPGTQFNTSMCNRKLIGVNYFNKGILADDPTVNISMNSARDTSGHGSHCASIAAGNFAKGASHFGYAPGTAKGVAPRARIAVYKFSFSEGTFTSDLIAAMDQAVADGVDMISISYGYRFIPLYEDAISIASFGAMMKGVLVSASAGNRGPGIGSLNNGSPWILCVAAGHTDRRFAGTLTLGNGLKIRGWSLFPARAFVRDSPVIYNKTLADCKSEELLSQVPDPERTIVICDYNADEDGFGFPSQIFNINRARLKAGIFISEDPAVFTSSSFSYPGVVINRKEGKQIINYVKSSAAPTATITFQETYMDGERPAPVLAQFSARGPSRSYLGIAKPDIMAPGVLILAAFPPNIFSESIQNIELSSDYELKSGTSMAAPHAAGIAAMLKGAYPEWSPSAIRSAMMTTANHLDSSQKPIREDDNMIATPLDMGAGHIDPNRALDPGLVYDATPQDYINLICSMNFTEEQFKTFARSSANYDNCSNPSADLNYPSFIALYPFSLEGNFTWLEQKFRRTLTNVGKGGASYKVKIETPKNSTVSVSPRTLVFKEKNDKQSYNLTIRYIGDSDQSRNFGSITWIEQNGNHTVRSPIVTSPIIEVW

SEQ ID NO: 53970 - protein, 439 aa, Salmonella enterica subsp. arizonae serovar 62:z4,z23:--
MSKPKANKMGVVQLTILTMVNMMGSGIIMLPTKLSEVGTISIISWLVTAVGSMALAWAFAKCGMFSRKSGGMGGYAEYAFGKSGNFMANYTYGVSLLIANVAIAISAVGYGTELFGAALTPLQIGLATIAVLWVCTIANFGGARITGQISSVTVWGVIIPVVGLCIIGWFWFSPSMYVASWNPHHVPFFSAVGSSIAMTLWAFLGLESACANADVVENPEKNVPIAVLGGTLGAAVIYIVSTNVIAGIVPNMDLANSTAPFGLAFAQMFTPAVGKVIMALMVMSCCGSLLGWQFTIAQVFKSSADEGYFPKVFSRVTKVDAPVQGMLIIVIIQTGLSLMTISPSLNSQFNVLVNLAVVTNIIPYILSMAALVIIQKMANVPSSKAKVANFVAFVGAMYSFYALYSSGEEAMLYGSIVTFLGWTLYGLVSPRFELKNKHG

SEQ ID NO: 53971 - protein, 386 aa, Alkaliphilus metalliredigens QYMF
MPSLSKTILNLEESGIREIMNLALGMEDVIRLEIGEPQFDTPEHIIEATSQAARDGFTKYTANLGLLSLRETISNHVNNRFNLETSWENVAVSVGGVGAVSSLIRVLADAGDELLIPSIAWPNYKMAIDCIDATPVFYKLDPNNDFLPSIENLESLVTPKTKVLVINSPSNPLGVVIPQKLIKELVEFAKKHDLFLISDEVYEEIIFEGDHISTLPYDTDGRVIGVFSFSKTYAMTGYRLGYAIGNKEIIKEVGKFQEVNVMNACGIAQKAAEAALKGSQDCIREMVAVYKDNMEAATRLMDEYEIPYQQPTGAFYLWVNIGCKDATVFAKDFLVQHKVAIAPGNTFGPEGSPYIRISLASKKEDILEGIHRLAVMLGKSKLAVNA

SEQ ID NO: 53972 - protein, 586 aa, Vitis vinifera
MSQSLHFVVSSSRSPNLTLPNHSYLKLSPPPSNLRFPVTFARRPISASSSDLDSNSPSKVLVSDNGKGGVLPATSPEYVPPPSDSSSIDVDAVTETDLKENGFRSTRRTKLVCTIGPATCGFEQLEALAVGGMNVARINMCHGTREWHRRVIERVRRLNEEKGFAVAIMMDTEGSEIHMGELGGAPSAKAEDGEIWTFSVRAFDSPRPERTINVNYDGFAEDVKVGDELLVDGGMVRFDVIEKIGPDVKCRCTDPGLLLPRANLTFWRDGSLVRERNAMLPTISSKDWLDIDFGIAEGVDFIAISFVKSAEVIKHLKSYIAARSRDSDIAVIAKIESIDSLKNLEEIIQASDGAMVARGDLGAQIPLEQVPSAQQRIVQQCRHLNKPVIVASQLLESMIEYPTPTRAEVADVSEAVRQRADALMLSGESAMGLFPEKALAVLRSVSVRIEKWWREEKRHEAMELPDTASSFSDSISEQICNSAAKMANNLAVDALFVYTKTGHMASLLSRCRPDCPIFAFTSTISVRRRLNLQWGLIPFRLSFSDDMESNLNRTFSLLKARGMIKSGDLVIAVSDMLQSIQVMNVP

SEQ ID NO: 53973 - protein, 148 aa, Populus trichocarpa
MQNPRMAPSSEIQNAKPRKKKAGASRASTIQLQGNDVREVKQVRVPLSLRPGQKAFKKSSKKEGSPLFQQPERSNSDSLPDSSAPVDEYRHLRHRYLLLEEDSFSVGGALSKVEDEVKTLEDEKFALLDQLVVLEGLIDPSKVQPNGF

SEQ ID NO: 53974 - protein, 533 aa, Solanum demissum
MAGQRNNYGKRMQSESDYSRSDGSKRRTPTDEKESNSIGPEDTVFRYLCPTGKIGSIIGVGGDIAKQLRTETNSKIRISETIPGCEERVVTIYSGSEETNVSEDTGDLISPAQDALFRVHDRVLAEDLRMDEDLEDHQQITVRMLVPSDQIGCVIGKGGQVIQNLRSETGAQIRVLSSEHLPPCALNSDELLQITGEGAVVKKALYQVAARLHDNPSRSQHQLLSSPSIFRSGAGFVNPHAGTQVMGVTSLMGPYASYKSDGRSKSSSVKEFAVRLVCPTENVGAVIGKGGGIIKQLRQESGASIKVDSAAAEGDDCIIFVSAKEAFEDQSPTIDATMRLQPRSSEKTEKESGDAILTTRLLVPSSRVGCLIGKGGSIINEMRNSTRASIRVLSKENLPKVASEDDEMVQITGDANVATNALLQVLMRLRANTFEMEGSFPAFSPGLSYVPMSASMPDGSRYGNRDNRSRRHGYSSYSGGHDYNDLSPSDSYGGSQVGGGGNYAPYGVYSSGRPSSAGVSSHNPSAYGKSYGY

SEQ ID NO: 53975 - protein, 449 aa, Alkaliphilus metalliredigens QYMF
MNDIIKGLEVIQKDDELISLGTRIAFYPLAIKEAKGAILMDYDGNEIIDFLSAACVSNVGHSHPRVVNAIIEQTKKFIHYNPAYAVHEQMGNLAEELIRITPGDFPKRVAFSLSGGDANDNAIKVARSYTKRTKVISYFRAYHGTTYGALSLSAVSLPMRRDLGPFVPDVYHIPYPDCYRCNRKSPDSGCNMDCMEKLKELFNTVVPAEEVAAIFLEPFQGDSGVIEPPAEYIEELVKVCKDNGILLVVDEVQSGFGRTGKWFASEHYNLEPDIIVLGKSIASGMPLAALVARKEILEGWGAPAGSYSTAGNPICCAAALATIDIIEEEGLVKKAEELGNYTIKRFEEMKEKHPLIGDIRGKGLMIGVDLVKDRGTKERAKDETAKVSYRCWEKGLFITFFSGNVLRIAPPLTISKKELDKALDIIEEALCDVEAGRVPDEILESVKGW

SEQ ID NO: 53976 - protein, 598 aa, Prochlorococcus marinus subsp. marinus str. CCMP1375
MTTENIQSEDIKDPELFPCIANGQDRSKFEQFKADSNYLKEPLASELKNESNHFSNDAVQLLKFHGSYQQDNRENRKKGLDKDWQMMLRLRSPGGYIPAELFVALDDLSNRFGNKTLRATTRQAFQMHGIRKENLKEVISTIVKSMGSTLAACGDINRNVMAPAAPYNKGGYPAARKLANEIADLLIPLTAEGTYLELWADGDLTYKICPSKKVQDTRKQQFSKGLFSGDSQEPLYGSTYLPRKFKCAVTVPGDNSVDLLTHDIGLVAFTKNNGELKGCNVYVGGGMGRIHNTETTFARIADPLGYIDAKDVLSLVQSILTLQRDFGNRKLRKNARMKYLLHNKGLKWFKNKLISKYFFKGLQEIHPEPTTRLKDYLGWNKQSKGLYFVGIPLISGRLSGDIKEIIRCVVEKYQLEIRLTPNQDLLLCNIGNYQVSSIKKELAGINIPAPSSMNDISRHAIACPALPLCGLAITEAERFLPELINRIDIQLKKLKIQKSILLRMTGCPNGCARPYMAELALVGSGVNQYQLWLGGSPNLQRLAKPYLQKMHIDKLEATLEPLFINWKQNSLETSFGDYISSLSDQLIMDLLSDSSTAP

SEQ ID NO: 53977 - protein, 138 aa, Glycine max
  misc_feature (46)..(46): Xaa can be any naturally occurring amino acid
  misc_feature (73)..(73): Xaa can be any naturally occurring amino acid
  misc_feature (80)..(80): Xaa can be any naturally occurring amino acid
  misc_feature (85)..(85): Xaa can be any naturally occurring amino acid
  misc_feature (109)..(109): Xaa can be any naturally occurring amino acid
  misc_feature (128)..(128): Xaa can be any naturally occurring amino acid
INHTNTNIITPFTNLKSITNFPTKKTNNNITSITSNNKRIQYIPIXPPINKKKFKTLSYLPDLDNTQLAEKIXYLLRKEXNSLLXFHLNHNFIYHNHNRSPKYYNERYXTIYKLPIFGYTNTSQVLKXLEQAKTTYPN

SEQ ID NO: 53978 - protein, 247 aa, Prochlorococcus marinus subsp. marinus str. CCMP1375
MSSAFTSSNRPIQIIPSVLPADWANMGQCVKDLEEAGVDRIQFDVMDGNFVPNLTFGPEMISACRKYCNVPFETQLMVSQYNCETMLEAYVEASKGPNGEPGVVIAHVEANVHLHRILGKIRQLGGSPSVALNPHTPMEMVKDVLDMVDHVLVMTVNPGFGGQAYIPTMLNKIKSLREVIVENNYDIDIEVDGGIKADWTISQCCAAGANCFIAGSGMFAYPSLKEGCDALRSVAKDAQNGKLLEKS

SEQ ID NO: 53979 - protein, 542 aa, Cytophaga hutchinsonii ATCC 33406
MDIEFNKNEDTLKMLCYALRERLKKVAQGGGEKRLQAEKEKGKFTARERISALFDAGSRVIEIGALAAEDMYTDVGGCPSAGVVVKMGYVEGRICIVVANDATVKAGAWFPMTAKKNLRAQEIAMENRIPIIYLVDSAGVFLPMQNEVFADKEHFGRIFRNNAWMSSEGILQIAAVMGSCVAGGAYLPIMSDEAFIVEGTGSIFLAGSYLVKAAIGETVDNETLGGATAQTEISGVIDHKCKDDAECLTRIRAVLAHTGHTEKAGFDRTAPAKPALNEEEIYGLMPLDRSKPYDMMDIINRLVDDSAFEPYKELYGQTIICGYARIDGWAVGIVANQRKIVKTKKNEMQMGGVIYSDSADKAARFIMNCNQRKVPLVFIQDVTGFMVGSRSEQGGIIKDGAKMVNAMANSVVPKFTVIVGNSYGAGNYAMCGKAYDPRLIIAWPGAQIGVMSGASAAKTLLQIKVSSLKAKGKEITPAEEAELLKEITDKYNEELSPYYAAARLWIDAVIDPLETRSYLSMGIEAANNNPKMKRFNVGVIQT

SEQ ID NO: 53980 - protein, 169 aa, Cytophaga hutchinsonii ATCC 33406
MKNKLTSIFLTAGLLMSLTACSQQKAQPIKKTDTIQATSNMPLMPIKDQSNYNPLTPEEKYVIINKGTERPFTGKYYNFKEPGTYICKQCNAPLYRSSDKFDSHCGWPSFDDEIPGAVTRVPDADGRRVEIICTNCKAHLGHVFEGERMTDKNVRHCVNSISIEFVPVK

SEQ ID NO: 53981 - protein, 375 aa, Methanosarcina acetivorans C2A
MTQYKVPVLPGDGIGPEIIAEGKKVIDAAGERFGFDVEWIEYPHGADHYLKTGELISEETLKELSGYPAIYLGSIGDPRIAPGVLEKGILLTARFYFDQYINLRPIKLLEGVWTPIKDKTAKDIDFVVVRENTEDFYIGVGGRAKKGESKDLLEVKRTLYSAKFGLDIETDSEEIGYQIGLISKEGTKRVIEYAFDLAENRKKHVSSVDKANVLSDIYGFWREEFNAVAAAHPDITTDFNFVDAITMWFVKNPEWFDVVVTPNMFGDIITDLGAMIQGGLGLAPGGNINPKGTSMFEPIHGSAPKYKGQNKVNPIATIWAGAMLIEQLGEKEAADTIVNAIQKNILEGKVKTYDMGGKNTTSDVGDDIARIVKGE

SEQ ID NO: 53982 - protein, 274 aa, Magnaporthe grisea 70-15
MALSPILRNHGTAALAELVGTFLFLFFAFSAAGVANAVPPEFSDGIAVPNIAALLYISFAFGISLMVNVFAFYRISGGQFNPAKFVKVSTALCLVGAIPPLRAGFCIVGQIVGGIIAAAAVDGLYPTFLNVETTLGSGVSPAQGVFIEMFLTTQLILVILLLAVEKHRLTYLAPLGIGFALFVTHLAGVYFTGASLNPARSLGPAVINRSFPSYHWIYWIGPMLGALLASGFYTLLDFCKWKQVNPGQDWDGIGEKEAQRDDFDGARDPLTRVA

SEQ ID NO: 53983 - protein, 350 aa, Mycobacterium smegmatis str. MC2 155
MPVFADVDTGVDDAMALAYLLASSDADLVGIASTAGNIGVHQVCINNLGLLELCGAPDIPVSRGAEQPLAAPLRTAEDTHGPEGLGYARLPATDRTLTTHDAAEAWIRAAHAHPGELIGLATGPLTNLALAMRAEPALPRLMRRLVIMGGAFDYKGNTTPVAEWNISVDPESAAEVFGGWDAAWGGRGDDAAPAHVPIVLGLNLTENVAMTPALLNRLATAAGSPSTAMSVRDERGTRSTAANPLIRVLEDAMRFYFEFHFDTGDGYLAHLHDPLAAAVALDPELVRCRQTTVDVELTGTLTRGMTVADWRGHWGRRPNALIGMEVDPTVFFDRFISRVGAFAQRLTSHS

SEQ ID NO: 53984 - protein, 515 aa, Oryza sativa Japonica Group
MGDMVLLATRPGVVCHRHRLPVISCAANTKPSRLNLPPGPSTLPLIGSIHHFVPSSESVHGAMRRLAREHGPVMQLWFGEVPTVVASSPEAAQEVLRSKDMAFADRHMTSATAAFSFGGRDVALAPYGERWRHLRRLLTQELLTAARVRSFRRVREEEVARLVRDVSAAAASGGTAVNLTEMAAKLINDIVLRCSVGSRSKYSDEYLAALHAMVVQSFSLSVADLFPSSKLASMVAMAPRRALANRKKMERIIEQIIQERKDQMETDTGDQAAAAERKSCSLDVLLRLQKEGGGPMPITNDVIIVLLMDMFAAGTDTSSTTLIWTMAELIRSPRVMAKAQAEVRQAFEGKNTITEDDLAQLSYLKMVIKESLRLHCPVPLLAPRKCRETCTIMGYDVPKGTSVFVNVWAICRDSKYWEDAEEFKPERFENNNIEYKGSNFEFLPFGSGHRICPGINLGLANMEFALANLLYHFDWKLPNGMLHNDLDMREAPGLIAAKHTSLNVCPVTHIAPSCS

SEQ ID NO: 53985 - protein, 510 aa, Burkholderia vietnamiensis G4
MNAPAVAAVAADTPPSSAATDAALRVAVQPVILAGGSGTRLWPMSREHYPKQLIGLLGDHSLLQSTALRLDGLAASHPVNDDVLIVCGEDHRFTTAEQLRVTGKRASIMLEPLGRDTAPALTLAALRIVADGSDAVMTVMPADHAVADRARFHAAVAAGVHCAAQGKIATMGIVPARAETGYGYIRVGAPLGDAATGGLDVRRLDRFVEKPHLELARQYVESGEYWWNSGIFIVRASVWLDAIRRLEPEIHAACEQAVANGKQDGDFFRVDRDAFAASPSNSIDYAVMEPLASQPQLCESVVVPLDAGWSDVGSWDAIWQILPKDDAGNVGRGHVLFENADSTFAHAESRLVACVGTQNLVVVETPDAVLVADKSRVQDVKKIVGRIKAERGAEATDHRKVHRPWGHYDSVDMGERFQVKRIVVKPGARLSLQMHHHRAEHWIVVRGTARITRGDETFLLSENESTYIPLGVSHRLENPGKMPLELIEVQSGAYLGEDDIVRFDDTYGRQ

SEQ ID NO: 53986 - protein, 271 aa, Nicotiana tabacum
MACSASSTALLSSNPKAASISPKSSFQAPISQCLSVPSSFNGLRNCKPFVSRVARSLSTRVAQSQRRRFVVRASSELPLVGNQAPDFEAEAVFDQEFIKVKLSEYIGKKYVILFFYPLDFTFVCPTEITAFSDRYGEFEKLNTEILGVSVDSVFSHLAWVQTDRKSGGLGDLNYPLISDVTKSISKSYNVLIPDQGIALRGLFIIDKEGVIQHSTINNLGIGRSVDETLRTLQALQYVQDNPDEVCPAGWKPGEKSMKPDPKGSKEYFASI

SEQ ID NO: 53987 - protein, 265 aa, Legionella pneumophila str. Lens
MLKQIVLTGLVIIGIVITLMYLFQRHLIYFPNRHTPKLEDYNASDMKVVSLRTKDNLHLKSWYKPASEHRPTILYLHGNAGHIGYRMPLVREFIDAGLGVFLLEYRGYGGNPGKPGEKGLYEDGETAIEFLIQHGVPSKRVILYGESIGTGVATHLATKYLVCAVILQSPFTSLTRLAQYHYPLNFLKPWDQYNSLARMKKINAPILVLHGKLDQIVPYQEGLNVFNEANEPKKMISFDDKEHNDLWSADNFSREIIQFALNQCS

SEQ ID NO: 53988 - protein, 437 aa, Prochlorococcus marinus subsp. marinus str. CCMP1375
MNIAVVGLSHRTAPVEVREKLSISDEHIEKSFCSLNATEQVLEVSILSTCNRLEIYALVKNQELGVSAIKEFLIDHSGLSKEDLFPHLFTFNQAEAVNHLMRVSGGLDSLVLGEGQILSQVKKMVRLGQDYKSIGPILNRLLTQAVSTGKKVRSDTNLGTGAVSISSAAVELAQLKLGQSLGKDQLMTLQSEKVAVIGAGRMSRLLIQHLQSKGCSKLTLLNRTLNRAESLAKDFPDLDVKCGLLDDLDKCIEFSTLIFTSTASNTPIINSELLSGFKRNNNLLRLIDIGVPRNIASDVSGLPGFEAYDVDDLQEVVARNQDARQQIAIEAQNLIDEEARVFLEWWASLEAVPTINRLRSNLESIRKEELQKALSRMGPDFSARERKVVEALSKGIINKILHTPVTNLRAPQPSSQRKESLKIVESLFELGVSENDQ

SEQ ID NO: 53989 - protein, 431 aa, Prochlorococcus marinus subsp. marinus str. CCMP1375
MKRVLAIILGGGKGSRLYPLTKMRAKPAVPLAGKYRLIDIPISNCINSNITKMYVLTQFNSASLNRHLAQTYNLSSPFAQGFVEVLAAQQTPESPSWFEGTADAVRKYQWLFQEWDVDEYLILSGDQLYRMDYSLFVEHHRETGADLTVAALPVDGAQAEGFGLMRTDNDGNIREFKEKPSGEALKAMAVDTSRFGLSPDSAKERPYLASMGIYVFSRSTLFDLLNKYPSYKDFGKEVIPEALSRGDALKSYVFDAYWEDIGTIGAFYESNLALTQQPTPPFSFYDEKFPIYTRARYLPPSKLVDAQITDSIVGEGSILKSCSIHHCVLGVRSRIESDVVLEDSLVMGSDFYESAEERIALRKGGGIPLGVGQGTTVKRAILDKNTRIGENVTIINKDRIEEADRADQGFYIRNGIVVVVKNASILDGTII

SEQ ID NO: 53990 - protein, 472 aa, Prochlorococcus marinus subsp. marinus str. CCMP1375
MSKAHFGLVGLGVMGENLVLNAERNGFSSVVYNRTYSKTEAFLNGKGLGKKISGASDLQDFVNKLERPRRILMMVKAGAATDAVIEQISPYLQEDDLLIDGGNALFSDTERRVLELESKSFGYIGMGVSGGAKGALEGPSMMPGGTKASYKAIENLLNKMAAQVDDGPCVTYIGPRGSGHFVKTVHNGIEYGIEQILSEGYDLMKRVCKMNCDEISDVFGIWNKTEELSSYLVEITEICLRTKDPTDGADLVEKIMDKAGQKGTGLWTVVSALQLGASVPTIYASLNGRVMSSMKSERVKAEKVFGKLSIERTDLGSPSNGMSPIMDAVVLSTIASYAQGMEILRLASEEYKYDLHMPSIAQIWKGGCIIRSTLLQRIQDAFNNEPQLTNLLMDPWFAEQIKNRLPGLTKTVAVAAQTGVPVPCFSSTLDYINSYRTARLPQNLVQAMRDCFGSHTYERIDKEGSFHTEWIN

SEQ ID NO: 53991 - protein, 261 aa, Aspergillus niger
ASTQGISEDLYNRLVEMATISQAAYADLCNIPSTIIKGEKIYNAQTDINGWILRDDTSKEIITVFRGTGSDTNLQLDTNYTLTPFDTLPQCNDCEVHGGYYIGWISVQDQVESLVKQQASQYPDYALTVTGHSLGASMAALTAAQLSATYDNVRLYTFGEPRSGNQAFASYMNDAFQVSSPETTQYFRVTHSNDGIPNLPPAEQGYAHGGVEYWSVDPYSAQNTFVCTGDEVQCCEAQGGQGVNDAHTTYFGMTSGACTWV

SEQ ID NO: 53992 - protein, 184 aa, Glycine max
MKLRLRSLESKETLKIEVPDSCSLLQLKDTVSRTISSSSSSLHLSLNRKDEIHAPSPEEPLHSLGVAAGDLIFYSLNPIAFTLETLLHKPETASRDGPSIQDSPETLASDSPSVPDAEKPPTLDAAELEPMEMIDGSDEMVVVGTNSEPFFVRRVLKEALGNNVTDFKLLVFAGHGVVLESGFV

SEQ ID NO: 53993 - protein, 548 aa, Zea mays
  misc_feature (284)..(284): Xaa can be any naturally occurring amino acid
  misc_feature (296)..(296): Xaa can be any naturally occurring amino acid
MGLGAAVALALGDPPADYASIAAVGLFVALMCVCIVVGHLLEENRWMNESITALFIGLGTGAVILFASSGKHSRVLVFSEDLFFIYLLPPIIFNAGFQVKKKQFFRNFITITLFGAVGTLISFTVISLGALGLISRLNIGALELGDYLALGAIFSATDSVCTLQVLSQDETPFLYSLVFGEGVVNDATSVVLFNAIQNFDPGNISSAKLLNFIGSFLYLFGSSTILGVASGLLSAYTIKKLYFGRHSTDREVSIMMLMAYLSYMLAELLDLSGILTVFFCGIVXMSHYTWHNVTEXSSRVTTKHAFATLSFISETFLFLYVGMDALDIEKWKIVGQTYSPVKSIALSSTILALVLVSRAAFVFPLSFVSNLTKKTPNGKISFRQQVIVWWAGLMRGAVSIALAYNKFTRSGHTQQPSNAIMITSTISVVLFSTIVFGLLTKPLIRLLIPSRHLSREPSALSEPSSPKSFFEQLAANSPGHPDLENGISLRRPASLRFLLVSPARSVHHYWRKFDDSFMRPVFGGRGFVPFVPGSPTESSLPLLPGNEN

SEQ ID NO: 53994 - protein, 224 aa, Oryza sativa Japonica Group
MSFIFGKRKTPAELLRENKRMLDKSIREIERERQGLQAQEKKLIAEIKKVAKQGQMGAVKIMAKDLIRTRHQITKFYALKSQLQGVSLRIQTLKSTQAMGEAMKGVTKAMRQMNRQMNLPALQKIMREFEIQNEKMEIVSSTMNDAIDDALEGDEEEEETEELVNQVLDEIGIDVNSELVGAPSTAVAAPVGAGKVAAQVEAAGGGDGGIDDDLQARLDNLRKM

SEQ ID NO: 53995 - protein, 122 aa, Cytophaga hutchinsonii ATCC 33406
MSSAIISLEGLKFHAYHGVHAQERLVGCIFMVDIHLTMALPTGGFQDQLKNTIDYEQVYTTIAAVMREPKHLIETLAELILQQIFGTQPLVTAGHVLISKMHPPVGGECLKSKIELKLERPY

SEQ ID NO: 53996 - protein, 47 aa, Zea mays
IFNPIPEPSRLEGYLVTNQISSYCNHINGVAGQNFDRLYLMKALHED

SEQ ID NO: 53997 - protein, 489 aa, Mycobacterium bovis AF2122/97
MSAASQRVDAFGEEAGYHKGLKPRQLQMIGIGGAIGTGLFLGASGRLAKAGPGLFLVYGVCGVFVFLILRALGELVLHRPSSGSFVSYAREFFGEKAAYAVGWMYFLHWAMTSIVDTTAIATYLQRWTIFTVVPQWILALIALTVVLSMNLISVEWFGELEFWAALIKVLALMAFLVVGTVFLAGRYPVDGHSTGLSLWNNHGGLFPTSWLPLLIVTSGVVFAYSAVELVGTAAGETAEPEKIMPRAINSVVARIAIFYVGSVALLALLLPYTAYKAGESPFVTFFSKIGFHGAGDLMNIVVLTAALSSLNAGLYSTGRVMHSIAMSGSAPRFTARMSKSGVPYGGIVLTAVITLFGVALNAFKPGEAFEIVLNMSALGIIAGWATIVLCQLRLHKLANAGIMQRPRFRMPFSPYSGYLTLLFLLVVLVTMASDKPIGTWTVATLIIVIPALTAGWYLVRKRVMAVARERLGHTGPFPAVANPPVRSRD

SEQ ID NO: 53998 - protein, 336 aa, marine gamma proteobacterium HTCC2080
MNAICSTVLDAIGDTPMVSLAAFGKDTLPHLYAKLECTNPGGSMKDRAAKGMIEWAEREHNLTSGARIVVCTSGNMGVGMAMVCAVKGYQLMCLVDAKINPATENCLRVLGAEVIKVYQRDETGGYHLTRLSKLDSVLAEYPDAIYLDQYDSPAAVMSHSTSTGPEIYNAFQGQVRAIVMVAGTGGSSMGIARFFKEHSPQTDIWLVDEAGSLALPGNGGASPRHLNGMGTSIAPANYGPADFHTFIDHVVYVNAEDSIRAAIELARCEGILVGGSGGAAVQVMRDVAAAHYGADDNLVALLPDHGSRYTETQFDPDWLAARGINVPEIFNVEDES

SEQ ID NO: 53999 - protein, 280 aa, Cytophaga hutchinsonii ATCC 33406
MKIAIQGGRASFHDITARYYFGENIDIEECESFRQLCFKLSAGEVDYAVMAVDNSIAASILPNYALIEEFGFKIIGEVYLQIKQYIMCVPDTKEEHIRWVMSHYMALNQCEEYLLNRPMMERREYHDTADSAKYIKEHHSTDIAAIASKYACELYGLKLLEPESIETYKNNFTRFFILSTDKKFKDETANKATISFRLSNEVGALSKVLKIIVDNEVNLTKIQSLPVFGKAAEYRFHVDCEWSDYAKFKKSIAINSIVEDLKILGEYKKGEFVNDYSRSK

SEQ ID NO: 54000 - protein, 335 aa, Bacillus megaterium
MAVKIGINGFGRIGRNVFRAALKNDNVEVVAINDLTDANMLAHLLKYDSVHGKLDAEVVVDGSNLVVNGKTIEISAERDPAQLSWGKQGVEIVVESTGFFTKRADAAKHLEAGAKKVIISAPASDEDITIVMGVNEDKYDAANHNVISNASCTTNCLAPFAKVLNDKFGLKRGMMTTVHSYTNDQQILDLPHKDYRRARAAAENIIPTSTGAAKAVSLVLPELKGKLNGGAMRVPTPNVSLVDLVAELDKEVTVEDVNNALKEAAEGDLKGILGYSEEPLVSGDYNGNINSSTIDALSTMVMEGNMVKVISWYDNESGYSNRVVDLAQYIAAKGL

SEQ ID NO: 54001 - protein, 294 aa, Acinetobacter sp. ADP1
MYLLIKKLSSMHRYAKSKDTKAKLAPKQKISYEKKADPAITEYSVKSLNWLRKAEFLMSAPKLSLCVEDTGYEIAFAGRSNAGKSSAINSLTNQKQLARASKKPGRTQMINFFSLGNPDQRLVDLPGYGYAAVPEDMKRIWQKELENYLIHRQSLQGLVLLMDIRHPLQHFDTMMLEWAHSRKLFVHILLTKADKLNRGPANQVLLDVKQTLKKMKLSFSIQLFSSLNKQGLEELASVMAGRLNYTLDKTLDFDLDAIPEATEDDLNDELMDQDETSEFNTENIDDHLDQEPKI

SEQ ID NO: 54002 - protein, 391 aa, Cytophaga hutchinsonii ATCC 33406
MIIPAANRLNVVKEYYFVRKLEEIAKLNKEGKNVISFGIGSPDLAPSEATVDALVATSRLSNAHGYQPYRGIPELRDSIASFYKNTYGVELDSNTEVLPLMGSKEGILHVSMAFLNPGDEVLVPDPGYPTYTSLTTLIGGVVRKYALSEKNNWHPDLEELKKQDLSKVKLMWLNYPHMPTGAEADRAQIEKIIAFAKEYKILLCFDNPYSLVLNQNKPFSILSIPGATEVAVEFNSLSKSHNMAGWRIGMMVGSPIYLNPALTVKSNIDSGMYLGLQKAAIEAFKNTEAWHAERNKIYADRREKIFGILDKLGFEYSRKQVGLFVWCKPKDAAAIGDIPAYVDRLLNEAYVFFTPGAIFGEKGEGYLRASLCVPIEKITEAEARIDAWLKK

SEQ ID NO: 54003 - protein, 78 aa, Triticum aestivum
  misc_feature (12)..(12): Xaa can be any naturally occurring amino acid
  misc_feature (18)..(18): Xaa can be any naturally occurring amino acid
  misc_feature (26)..(26): Xaa can be any naturally occurring amino acid
  misc_feature (28)..(29): Xaa can be any naturally occurring amino acid
  misc_feature (32)..(32): Xaa can be any naturally occurring amino acid
  misc_feature (34)..(34): Xaa can be any naturally occurring amino acid
  misc_feature (49)..(50): Xaa can be any naturally occurring amino acid
  misc_feature (56)..(56): Xaa can be any naturally occurring amino acid
  misc_feature (67)..(67): Xaa can be any naturally occurring amino acid
  misc_feature (70)..(70): Xaa can be any naturally occurring amino acid
  misc_feature (72)..(73): Xaa can be any naturally occurring amino acid
PPRSPCFPGFGXPNGEPXRKSLPGCXVXXDLXVXNLVIVKKGENDLPGXXDPEKPXMRGPQRASKMXKFXNXXKDDDV

SEQ ID NO: 54004 - protein, 947 aa, Eleocharis vivipara
MERVCLHAIHGACKPDMDGNIRFGRKKRHLYKRLSSCRVRAMKLDQSGFEASRKQSSYALKAIATPMAVTTKKRVFTFGKNKTEGNKGMKELLGGKGANLAEMSSIGLSVPPGFTVSTEACQQYQESGHKMPPGLWDEIIDGLKWVQQDMGARLGDPEKPLLVSVRSGAAVSMPGMMDTVLNLGLNDEVVSGLAKKSGERFAYDSYRRFIDMFGDVVMGISHEHFGDKLEEMKATKGVKNDTDLSANDLKELVVQYKEVYAKAKGEPFPTDPMKQLSLAVLAVFDSWDSPRAKKYRSINKITGLKGTAVNVQCMVFGNMGNTSGTGVLFTRNPSTGEKKLYGEFLVNAQGEDVVAGIRTPQELETMKDYFPQAYQELVDNCKILESHYKDMMDIEFTVQENRLWMLQCRTGKRTGKAAVKIAVDLVSEGLVDTRTAIKMVDPGHLDQLLHPQFENPKAYKDKVIASGLPASPGAAVGQVVFTAEDAEMWHAQGKAVILVRTETSPEDVGGMHAAAGILTARGGMTSHAAVVARGWGKCCVSGCSDIRVNDAEKVLLVGDKKLQEGEWISLNGSTGEVIMGKQPLSPPALSGDLGTFMAWVDEVRQIGVMANADTPEDALAARNNGAQGIGLCRTEHMFFASDERIKAVRQMIMSGTVEQRQKALDRLLPYQRSDFEGIFRAMDGLPVTIRLLDPPLHEFLPEGNIEDIVREMASETGSAEEEVFSRVEKLSEVNPMLGFRGCRLGISYPELTEMQARAIFEAAITMSNQGVKVLPEIMVPLVGTPQELGHQVSLIRQVADKVFSATGTSVSYKVGTMIEIPRAALVADEIAEHAEFFSFGTNDLTQMTFGYSRDDVGKFLPIYIAHGILQNDPFEVLDQKGVGELVKLATERGRKTRPDLKVGICGEHGGEPSSVAFFAKSGLNYVSCSPFRVPIARLAGAQVVVQK

SEQ ID NO: 54005 - protein, 593 aa, Xanthomonas campestris pv. campestris str. ATCC 33913
MITSPRRLFPSGLLLLAFVVAPAAWSAQPDAAAATPPPAGTATHPPGAAVASGHALATDAGLQILREGGNAFDAAIAVSSTLAVVEPISSGLGGGGFFLLHDAKTGKDVMLDAREYAPESATSAQFLDKNGGLDRDRSVNGPWSAGIPGLPAALVELAAKHGRLPLTQSLAPAIRIATEGFPVYARMAKGYASRREVMERYPGTREVYLRGGKPIAEGDIFKQPELAHTLTLLGEKGFDGFYKGETAKKLLAGVKQAGGRWTAAELAGYQVKERTPIQFDYRGWKVTTAPPPSSGGIALAAMLQILEGWDLNTLDDAHRTHLVVEAMRRAYRDRTFFLGDPDFVDVPQRVLTSKDYAQGLRATINPDKATPSNLLSGNPTPLEDDETTHFSIIDGEGNRVGATQTVNLLYGSGLIPKGTGVLLNDEMDDFALKPGTPNAFGVMGYAANAPKPGKRMLSSMTPTFMESADKVAVLGTPGGSRIITMVLLGILGYDAGLDAQQVSALPRYHHQWLPDVIEAESNAFSPQTAKALEAMGHALKLPGDTAEGGRGSSHVWGNFQTVEWDKRRNVLSGGSDPRNPVGKAAVQLATPAR

SEQ ID NO: 54006 - protein, 884 aa, Eleocharis vivipara
MAPSAPVVGAQRVFTFKNKTEGNKGMKELLGGKGANLAEMSSIGLSVPPGFTVSTEACQQYQETGHKMPSGLWDEIIEGLNWVQQDMGARLGDPEKPLLVSLRSGAAVSMPGMMDTVLNLGLNDEVVAGLAKKSGERFAYDSYRRFIDMFSDVVMGIPHEHFGEKLEEMKATKGVKNDTDLSADDLKELVVQYKEVYAKAKGEPFPTDPMKQLSLAVLAVFDSWDSPRAQKYRSINRITGLKGTAVNVQCMVFGNMGNTSGTGVLFTRNPSTGEKKLYGEFLINAQGEDVVAGIRTPEELDTMKDCFPQAYQELVENCKILESHYKDMMDIEFTVQENRLWMLQCRTGKRTGKAAVKIAVDLVSEGIIDTSTAIKMVDPGHLDQLLHPQFENPKAYKDKVIASGLPASPGAAVGQVVFTAEDAETWHAQGKAVILVRTETSPEDVGGMHAAAGILTARGGMTSHAAVVARGWGKCCVSGCSDIRVNDAEKVLLVGDKKIQEGEWISLNGSSGEVILGKQPLAPPALSGDLGTFMAWVDEVRQIGVLANADTPEDALAARNNGAQGIGLCRTEHMFFASDERIKAVRQMIMSGTVEQRQKALDLLLPYQRSDFEGIFRAMDGLPVTIRLLDPPLHEFLPEGNIEDIVREMASETGSAEEEVFSRVEKLSEVNPMLGFRGCRLGISYPELTEMQARAIFEAAITMSNQGVKVFPEIMVPLVGTPQELGHQVSLIRQVADKVFSAAGTSVAYKVGTMIEIPRAALVADEIAEYAEFFSFGTNDLTQMTFGYSRDDVGKFLPIYIAQGILQNDPFEVLDQKGVGELVKLATERGRKTRPDLKVGICGEHGGEPSSVAFFAKSGLNYVSCSPFRVPIARLAGAQVVVQK

SEQ ID NO: 54007 - protein, 471 aa, Burkholderia vietnamiensis G4
MNLTIIGSGYVGLVTGACLADIGHDVFCLDVDQAKIDILNAGGVPIHEPGLKEVIARNRSAGRLRFSTDIEAAVAHGDVQFIAVGTPPDEDGSADLQYVLAAARNIGRYMKGFKVIVDKSTVPVGTAERVRAAVADELAKRGEDGQMFSVVSNPEFLKEGAAVDDFTRPDRIVIGCDDDVPGERARELMKKLYAPFNRNHERTLYMDVRSAEFTKYAANAMLATRISFMNELANLADRFGADIEAVRRGIGSDPRIGYHFLYAGCGYGGSCFPKDVEALIRTADEHGQSLQILKAVSSVNATQKRVLAEKIVARFGEDLSGRTFALWGLAFKPNTDDMREAPSRELIAELLSRGARIAAYDPVAQQEARRVLALDLADHPSWLERLTFVDDEAQAARDADALVIVTEWKAFKSPDFVTLGRLWKSPVIFDGRNLYEPETMSEQGIEYHPIGRPGSRQAVAARAPAAARASA

SEQ ID NO: 54008 - protein, 798 aa, Pisum sativum
MAPPSITKTATQQDVISTVDIGNSPLLSISLDQSRNFLVNGHPFLTQVPPNITTTTTSTPSPFLDFKSNKDTIANNNNTLQQQGCFVGFNTTEAKSHHVVPLGKLKGIKFTSIFRFKVWWTTHWVGTNGHELQHETQILILDKNISLGRPYVLLLPILENSFRTSLQPGLNDYVDMSVESGSTHVTGSTFKACLYLHLSNDPYRLVKEAVKVIQTKLGTFKTLEEKTPPSIIEKFGWCTWDAFYLKVHPKGVWEGVKALTDGGCPPGFVIIDDGWQSISHDDDDPVTERDGMNRTSAGEQMPCRLIKYEENYKFREYENGDNGGKKGLVGFVRDLKEEFRSVESVYVWHALCGYWGGVRPKVCGMPEAKVVVPKLSPGVKMTMEDLAVDKIVENGVGLVPPNLAQEMFDGIHSHLESAGIDGVKVDVIHLLELLSEEYGGRVELAKAYYKALTSSVNKHFKGNGVIASMEHCNDFFLLGTEAISLGRVGDDFWCCDPSGDPNGTYWLQGCHMVHCAYNSLWMGNFIHPDWDMFQSTHPCAEFHAASRAISGGPVYVSDCVGNHNFKLLKSFVLPDGSILRCQHYALPTRDCLFEDPLHNGKTMLKIWNLNKYAGVLGLFNCQGGGWCPETRRNKSASEFSHAVTCYASPEDIEWCNGKTPMDIKGVDVFAVYFFKEKKLSLMKCSDRLEVSLEPFSFELMTVSPLKVFSKRLIQFAPIGLVNMLNSGGAVQSLEFDDSASLVKIGVRGCGELSVFASEKPVCCKIDGVSVEFDYEDKMVRVQILWPGSSTLSLVEFLF

SEQ ID NO: 54009 - protein, 124 aa, Brassica napus
MGKASVILYITVGILVLFLVSYSPKKKSHHHNGGHNSQHHRLKLRSSFNFKPTRHDPIPFDPLVADMERRREDKEWERQYIEHSHPELAHDPAPGHESQPEWEEFMDAEDYLNDEEKFNVTDRL

SEQ ID NO: 54010 - protein, 196 aa, Mycobacterium smegmatis str. MC2 155
MPAADEGRDRVLTVPNVLSFVRLLLVPVFLYLLLVAHAQGWAVAVLMFSGFSDWADGKIARLVANQSSRLGELLDPLVDRIYMVTVPVALALYGAVPWWLVLTLLGRDAVLAATLPVLRSRGLAALPVTYIGKAATFALMSGFPLVLLGQWDALWSRVVLACGWAFLIWGLLLYLWSAVLYLMQVVLVVRRMDPVR

SEQ ID NO: 54011 - protein, 320 aa, Candida albicans
MSGPVNSVSKQMNVDTDIITLTRFILQEQQTVAPTATGELSLLLNALQFAFKFIAHNIRRAELVNLIGVSGSANSTGDVQKKLDVIGDEIFINAMRSSNNVKVLVSEEQEDLIVFPGGGTYAVCTDPIDGSSNIDAGVSVGTIFGVYKLQEGSTGGISDVLRPGKEMVAAGYTMYGASAHLALTTGHGVNLFTLDTQLGEFILTHPNLKLPDTKNIYSLNEGYSNKFPEYVQDYLKDIKKEGYSLRYIGSMVADVHRTLLYGGIFAYPTLKLRVLYECFPMALLMEQAGGSAVTIKGERILDILPKGIHDKEFYCVGIQG

SEQ ID NO: 54012 - protein, 409 aa, Carboxydothermus hydrogenoformans Z-2901
MIHVTTLPNKITVLVEEIPYIRSAAIGLWFKVGSRHERRDESGISHFIEHMMFKGTVNRTAKEIAESLDQVGGQLNAFTTKEYTCYYARVLDEHTLLALEILHDMVFNSKFAEEDIEKEKNVVIEEIRMYEDAPDELIHDLLTEVMWNNHPLGRPILGEIQDIESLTREKVVNYYKRYYTPDNLIIAVAGRVNYQQLLDKIMELFGSIQGEQKGDKITIPEFNLHSFSRRKDSEQVHLCLGTKGYAINDDRIYGLNILSTILGGGISSRLFQELRERHGLVYSVYSYTTAYQDAGLFGIYAGLGPNKVNEALELIQKQLKELKTGDISAEEVERARQQIKGNLLLSLESVTTRMSRLAKSFLYHGKIISPEEIVEKVFNVSLEDIKAMAEEISDLNNFTKVSIGPWEGF

SEQ ID NO: 54013 - protein, 208 aa, Alkaliphilus metalliredigens QYMF
MLNLYIVRHGETEWNTQRRMQGWQDSNLTERGIEDARALHDHLIKVEFDSIYASPSSRAFKTAELIKGERKLKIIKDDNIREIGLGNWEGKTTEEIEQMDPKAYQHFWKAPHLYNRESVETFTCVQKRALKTINKLIEEESAGNILIVTHAVTVKTIMGHFQKQSLEKLWEPPFIQNTSVSLIRIENNLPSIVLYGDTSHLQEAYETY

SEQ ID NO: 54014 - protein, 477 aa, Candida albicans SC5314
MSALFAVSRSAIALRSIAPRSSTATTSSFLALARLYSSGKFPPHTVINMPALSPTMTQGNIQSWAKKVGDELTPGEAIAEIETDKASMDFEFQEEGYLAKILLDAGAKDVPVGQPIAVYVEDAGEVAAFENFTAADAGEAPKPAPAAEEEAPKKEEPKASTSTSAPASTPSPSSKKAPTDRIIASPFAKTIALEKGISLKGIKGSGPNGRIVAKDLEGVEPQAAAAAAPAAAAATAGAAPSATASYEDIPITSMRKTIASRLLQSTQQSPSYIIQSQISVSKLLKLRASLNATAEERYKLSINDLLIKAIAKTCVRIPEVNAAWLGEQGVIRQYKNVDVSVAVATPTGLITPIVTNAESKGLAEISNQVKDLGKRAKVGKLLPEEFQGGTICISNLGMNHAVTAFTSIINPPQSAILAIGTTEKKAVPSEVNEQGFVFDDVITITGTFDHRVIDGALGGEWMKELKRIVENPLEMLI

SEQ ID NO: 54015 - protein, 764 aa, Chenopodium rubrum
MGVVLLPDLGTEILIPVCAVIGIVFSLIQWYVVSQVKLSPDSGRSNNNKNGFSENLIEEEEGINDQSVVAKCAEIQNAISEGSTSFLYTMYQYVGIFMIAFAVLIFVFLGSVEGFSTKSQECTYDKSKTCKPALATAIFSTVSFLLGAVTSLASGFLGMKIATYANARTTLEARKGVGKAFIVAFRSGAVMGFLLAANGLLVLYITILLFKLYYGDDWEGLFEAITGYGLGGSSMALFGRVGGGIYTKAADVGADLVGKIERNIPEDDPRNPAVIADNVGDNVGDIAGMGSDLFGSYAESSCAALVVASISSFGINHELTAILYPLLISSVGIVICLITTLFATDFFEIKAVKEIEPALKKQLVISTALMTVAVAVISWVALPSSFTIFDFGSQREVKNWQLFLCVAVGLWAGLIIGFVTEYYTSNAYSPVQDVADSCRTGAATNVIFGLALGYKSVIIPIFAIAVSIFVSFSFAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLLVGAMLPYWFSAMTMKSVGSAALKMVEEVRRQFNEIPGLMEGTAKPDYANCVKISTDASIKEMIPPGALVMLTPLIVGTLFGVETLSGVLAGSLVSGVQIAISASNTGGAWDNAKKYIEAGASEHARQLGPKGSDAHKAAVIGDTIGDPLKDTSGPSLNILIKLMAVESLVFAPFFATHGGLLFKIF

SEQ ID NO: 54016 - protein, 355 aa, Bacillus cereus ATCC 10987
MVTKEQVVEALEGIVDPFLHKTLKETGAIKEVTVKPEKEHVSVKIAILKTGTAEQMQLQSGIVKLVKELGAATVGLRFAEFTEEELAQFAPEQEEEQTESLLSPNSKTTFLAVASGKGGVGKSTVSVNLAIALARLGKKVGIIDADIYGFSVPDMMGIEKRPVVRGDKIIPVERLGVKVISMGFFVEDNAPVIWRGPMLGKMLNHFFTEVEWGDLDYLVLDLPPGTGDVALDLHSMLPACKEIIVTTPHPTAAFVAARAGAMALRTEHSILGVVENMAYFESKTTGEKEYVFGRGGGDKLATELQTEVLGRIPLQQPDWNKEDFAPSVYEDTHTTGLIYRTIAETVIDKTTVAQK

SEQ ID NO: 54017 - protein, 149 aa, Oryza sativa Japonica Group
VEQSYIMIKPDGVQRGLVGEIISRFEKKGFVLKGLKLFQCPKDLAQEHYKDLKEKPFFPGLIEYITSGPVVCMAWEGNGVVASARKLIGATNPLQAEPGTIRGDLAVQTGRNVVHGSDSPDNGKREIALWFKEGELCEWESVLTPWLVE

SEQ ID NO: 54018 - protein, 89 aa, Glycine max
MAMRRFYNEIKGKRVSEVPEHVKPMLSLNYIKKAIQRGFDNYHAKYIETSSPDPIFHVCYGGMIFSYLVALPHERRHLQHAQEHAQQHH

SEQ ID NO: 54019 - protein, 169 aa, Zea mays
  misc_feature (131)..(131): Xaa can be any naturally occurring amino acid
MMSRERKKAAAALQEKLKILRSTTHSHALSNTSIIMDASAYIKQPQQKVVRLNQEIACAQDALRHKSSSYPTVSVETLGVQGFLVNVFSDKSCPGLLVSVLEAFDELGLSVLQATASCAADSFRLEAVGGXNVVDNVDEHVVKQAVLQAVRSCSESGCGGEHDDEESLG

SEQ ID NO: 54020 - protein, 203 aa, Zea mays
GFTAHLPFEAEMKNQDLNTRRSLATPRGVGVMCDFYAVRAENATLWDANGKEYIDFAGGIAVLNTGHLHPKVKAAVSAQLDNFTHTAYQIVPYEGYVSLAERINRLAPIDGLKKSAFFTTGVEAVENAIKIARSATGRSGVIAFSGSFHGRTMLGMALTGKVAPYKLSFGPMPGDIYHVPFPNGTQSITVADSLKALDLLFKI

SEQ ID NO: 54021 - protein, 327 aa, Nocardioides sp. JS614
MQTHLRGRDVIDFQEWTRDEIETVLDVAFALKRDRALGQPHPYLRDKVLAMLFFFASTRTRASFEAGMAQLGGHAQFIESRSTQIAHGDTATEIGEILGRYNDGIAIRNVDWGVGNGYIRAVAVAAASRVPVLNMQCDHFHPHQALADLMTIIERFGDPRGRTATISWACAKTYSKPLSVPQSLIMLLPRFGMNVRLVHPPEFALMPEYVEQARENARLGRASFELMDDFDAGIRGTDVVYAKSWGAVMTTSDVEEEKRLVDSYADWIADERRLDTASDDAIYMHPLPGERGTEVTDGVIDGPHSAVFDQAENRLHGQKAVLALTMG

SEQ ID NO: 54022 - protein, 686 aa, Carboxydothermus hydrogenoformans Z-2901
MENGMTLAYYGLGAGILAILFALYLFSSVLKEDMGNEKMREISQAIFEGAMAYLNRQYKTLIPFALVVFVLLVVGFGYKEGDFGYGLKVGVSFLVGAIASALAGYAGMTSTTKANARTTQAARKSLNAALNVAFRAGGVMGMSVAGLGLLGVSALYIIFKDVHVIDSFAFGASAIAFFARVGGGIYTKAADVGADLVGKVEAGIPEDDPRNPAVIADNVGDNVGDTAGMGADLFESYGATTMAAMLLGLTFAKNHGFSEVLGATFPLLLGAAGIVAAIISTFFVRTSEDGNPQMALNIGLWSTNFITAIFTYIIAQYVFGSEWAPKIFIAVVSGLVVNVAIGSLTEYYTSNLKPPAQKIAEASTTGPATNIISGIAVGMRSTYLPIIVIVAAIMVGYWAAGFYGIALAAMGMLATAAMVVAVDSFGPVADNAGGIAEMAELGPEIRNKTDKLDAVGNTTAAVAKGFAIGSAALTALALFSAYTDLAKTNPNLQKYLVNGKFDLNITDPWVLVGLFLGGTVAFLVAALTMESVGKAAFDMIEEVRRQFREIPGLMEGKARPDYARCVSISTAAAIRQMIAPGLLAVGAPLAIGFILGFKALTGYLAGVTATGVLLAIYMANAGGAWDNAKKYIEAGNLGGKGSDTHKAAVVGDTVGDPFKDTSGPAMNPLMKVAGTFALIIVPLLLF

SEQ ID NO: 54023 - protein, 311 aa, Salmonella enterica subsp. arizonae serovar 62:z4,z23:--
MALPIILDCDPGHDDAIAIVLALASPELDVKAITSSAGNQTPDKTLRNVLRMLTLLKRSDIPVAGGAVKPLMRELIIADNVHGESGLDGPALPEPSFAPQNCTAVELMAKTLRESPQPVTLVATGPQTNVALLLNSHPELHAKIARIVIMGGAMGLGNWTPAAEFNIYVDPEAAEIVFQSGIPVLMAGLDVTHKAQIHTADIERFRAIGNPISTIVAELLDFFLEYHKDEKWGFTGAPLHDPCTIAWLLKAELFTTVERWVGVETQGKYTQGMTVVDYYFLTGNKPNATVMVDVDREGFVDLLAERLKFYG

SEQ ID NO: 54024 - protein, 238 aa, Bradyrhizobium japonicum USDA 110
MFRTELKTWTKGASSPVSEADIAVNDLLEARLRSATPDYGWLSEESADDSTRLSRRLVWVVDPIDGTRNYLGGHDEWCVSVALVEDAAPLLAAVFAPASGEFFFAARGQGTLLNDKPVRATPGSTLDFSRMAGPKPMVERLNTAGGDIKLHPRIGSLALRLCRVAHGALDAAFAGGNSHDWDLAAADLIVQEADGRMSDLSGDPILYNRREVAHGVLVAAGRDRHASIVAHFRNRPLP

SEQ ID NO: 54025 - protein, 442 aa, Arabidopsis thaliana
  misc_feature (422)..(422): Xaa can be any naturally occurring amino acid
MSSSSRNLSQENPIPRPNLAKTRTSLRDVGNRRAPLGDITNQKNGSRNPSPSSTLVNCSNKIGQSKKAPKPALSRNWNLGILDSGLPPKPNAKSNIIVPYEDTELLQSDDSLLCSSPALSLDASPTQSDPSISTHDSLTNHVVDYMVESTTDDGNDDDDDEIVNIDSDLMDPQLCASFACDIYEHLRVSEVNKRPALDYMERTQSSINASMRSILIDWLVEVAEEYRLSPETLYLAVNYVDRYLTGNAINKQNLQLLGVTCMMIAAKYEEVCVPQVEDFCYITDNTYLRNELLEMESSVLNYLKFELTTPTAKCFLRRFLRAAQGRKEVPSLLSECLACYLTELSLLDYAMLRYAPSLVAASAVFLAQYTLHPSRKPWNATLEHYTSYRAKHMEACVKNLLQLCNEKLSSDVVAIRKKYSQXNTSLQQRSFVPRHYRKSFSS

SEQ ID NO: 54026 - protein, 263 aa, Spiroplasma citri
MPFRLEKIAFGTLFLKKEEAIINALQNGYKIIDTAKVYQNEEIVGRAIKKYLNSNNQRREDIIIETKIWCDDVEAGNTTNAVLESLKRLNVTYLDIVLIHRPNLNFYKTIKAYVELLQCKAKGLINVVGVSNFDKDMIEILFEETGAYPNLNQIEFNPFNQRWDRVQYCQNKNILVQSYSPIANTLENQTLATEAKKYNCTVAQLILAWIQYFSIQPIVKAELLRHIQENKQSEKIRLTKKTIQILQSLNMYDNIYPETFDRF

SEQ ID NO: 54027 - protein, 125 aa, Triticum aestivum
KEQEIVGKVPVFGICMGHQLIGQALGGKTFKMKFGHHGGNHPVRDNRTGRVDISAQNHNYAVDPESLPEGVQVTHINLNDQSCAGLVFPKMKLMSLQYHPESSPGPHDSDLAFGEFVELMKNNRL

SEQ ID NO: 54028 - protein, 182 aa, Cryptococcus neoformans var. neoformans JEC21
MGGQLSKALGKLFGNKEMRILMLGLDAAGKTTILYKLKLNQSVTTIPTVGFNVETVTYRNVRFNVWDVGGQDKIRPLWRHYYTGTQGLIFVIDSGDRDRIDEARLELERILADREMRECLLMVFANKQDLPGAMSPAEVTEKLGLHRMKDRSWYVHPSCATTGEGLFEGLQWLSSNVKNLKV

SEQ ID NO: 54029 - protein, 220 aa, Brassica napus
MVVSLRRRTQATNPRSDLPRSLAADDSDSELDTVCEECSSGKQPAKLLLCDKCDKGFHLFCLRPILVSVPKGSWFCPSCSQHQIPKSFPLVQTKLIDFFRIKRGPDSTSPDSSIGKKRKRTSLVMSKKKRKLLPYIPTVDPQRRLEQMASLATALRASNTEFRNELTYVSGKAPRSDNKAVLEKGGMQVLSKQDAETLALCKNMMDRGECPPLMVVFDPY

SEQ ID NO: 54030 - protein, 703 aa, Clostridium thermocellum ATCC 27405
MVGQILGNRYELIEKIGGGGMADVYKARCKLLNRFVAIKILKPEFINDEEFLKRFTIEAQAAASLSHPNIVSIYDVGQENDIHYIVMEYVNGQTLKEYLDENGALYWKDAVNIAIQICQAIEHAHKNHVVHRDIKPHNILLTKDGMLKVTDFGIARAVSSSTITMAGNAIGSVHYFSPEQARGGFTDEKSDLYSLGIVLYELLTGRVPFDGESPVAVAIKHIQDEPEEPINIKEDIPTGVNSIVMRAIQKDQALRYQSASELLNDLYKVLKQPDAQFAKARTTEDSPTVRIPSIKKKELVLEMDTSGKAGDDAVKKKKKDNKTTVWAVVTSILVIFVLGALMVKGLGPVVYSMFNKPEDFIVEDYTNQNFYEVKGKLSQYNIEAIEIRKHDDQIPKDRIISQDKAVGERIKPGEFAKIEFVVSDGPLLVKIPDLRRMEYRQAVIELRQLGLEANVIDEYSDVVSKGVVIRTEPDINAEVKPGTVVNVYKSLGPEIKYSLVPNLIGKTKSEALNLLVGAKLTMGKIYPEDMTYARDKIVRQEPAAGTEVEEGTPVNIYLEDYNPDQKYVTRLIELDNPDNYGENIKFLVNITRSDTKRVETLYSEVRKKSDFPITISIPVPNGGSTLVRVYLDNKNYMEFTEEFNKRSNETNTGNTANNNGNSNNNGSGSGTDNINDTNNTDNANNDNERTEESGETNHAEAAG

SEQ ID NO: 54031 - protein, 109 aa, Brassica napus
MASSMLSSAAVVTSPAQATMVAPFTGLKSSSAFPVTRKANNDITSIVSNGGRVSCMKVWPPVGKKKFERRLISVLKEMVRLQSEFLKPMRPRPKLLKKRLQYQQQEEEE

SEQ ID NO: 54032 - protein, 197 aa, Leptospira interrogans serovar Copenhageni str. Fiocruz L1-130
MPETEKIAEVFEELTGSKISKNFLDHRKIFLWGPVTDESSKDLVGKLLYLEMKDPGKKITFYINSPGGVVTSGMTVFDTIKMISSPVHTVCMGMAASMGSVLLAAGTKGERSIWPNGKVMIHQPSIGGQIVAPATDLKIHAEEILKTKTKLNQILADACGHPISKLEEDTDRDYYMDAEEAIKYGIVDKLATKIDFN

SEQ ID NO: 54033 - protein, 220 aa, Clostridium thermocellum ATCC 27405
MLIKIAPSILSADFSKLGEEVLRIEKAGADLVHIDVMDGHFVPNITIGPPVVKSLKKVSKLPFDVHLMIENPDMYIESFADAGADIISVHAEACRHLHRTIQKIKQLGIKAAVALNPATPLCAVEWVMEDVDMILLMTVNPGFGGQKYINGVTRKIEELERIVESRGLNIDIEVDGGIDTETVQYVTKAGANVIVSGSTIFAAEDTAKIIQELRMNSYRK

SEQ ID NO: 54034 - protein, 276 aa, Acinetobacter sp. ADP1
MEPMVVMAARAAQLVGQELLKAHQNRHKLDLQVEEKGIEGPVTRVDRYLEQLTMDTLRKSYKNHSFLGEEFGFQEGKGHDADWCWVIDPLDGTQNFVHGFPHFCISIAVQHKGVTQHGVIYDPVRDEMFSASRGRGAVMNQRRIRVNVRDHLENAFLAVGHPYRAQRNGEIVSYAEQHFASLLAVTKAGAHIRRAGSAALDLAYVAAGRFDGFFEIGLKPWDIAAGELIVKEAGGIVVDSRGGNESYENGQVLACSMKMLKPLMQTVVPAWGEMAK

SEQ ID NO: 54035 - protein, 401 aa, Bifidobacterium longum NCC2705
MAQWQTLSDRINTVAPSATLAVDSKAKAMKAAGLDVVGFGAGEPNFPTPANVVKAAADACLDPKNYKYTPTPGLPELREAIAAKMLRDSGYEVNADQVVVTNGGKQAVYESFQILLNDGDEVIIPAPYWTSYPEAVKLAGGVPVEVFAGADVNFEPSLEALEAARTEHTKAIIVNSPNNPTGAVWKPETVEAIGRWAVEHHIWVISDEIYEHLNYDDAHTTYIGAAVPECRGQLLVLNGVAKTYAMPGWRVGWMVAPLEVAKAAAKLQGHMTSNVANISQRAALAAVAGPLDEVHEMRKAFDARRRAIVTALNDIEGVNCPTPTGAFYVFADITALLGKPLGPKGTVSDTSADFAAALLDEAHVAAVPGEAFGAPGYLRFSYALADEDLAEGMRRFKEWAN

SEQ ID NO: 54036 - protein, 732 aa, Debaryomyces hansenii CBS767
MRSPNNIIEDSNISRIASSNSRALPSFSQMLARSKNNTNNYLNDNNDSNNSSVNQEFEFQMDNDSSSDYRELRNSIIQRRQSSTSNHRNEIQKLNYKNSLLLNLPTEILLQIFHHLDRKELYSLLTVCHEFADLIIEILWFRPNMQNDDSFKKIKTIMEIPKGGTHWDYRSFIKRLNLSFMTKLVDDDLLKLFVGCPKLERLTLVNCTKLTYSPVTSVLKNCEKLQSIDLTGVTGIHDDIILALANNCPRLQGLYAPGCGKVSEDAILKLLKSCPMLKRVKFNGSANITDRSIEAMHENCKSLVEIDLHNCSNVTDKYLKLIFLNLSQLREFRISNAAGVTDRLFELLPSEYYLEKLRIVDITGCNAITDRLIEKLVMCAPRLRNVVLSKCMQITDASLRALSQLGRSLHYIHLGHCGLITDFGVASLVRSCHRIQYIDLACCSQLTDWTLVELANLPKLRRIGLVKCSLISDSGILELVRRRGEQDCLERVHLSYCTNLTIGPIYLLLKNCPKLTHLSLTGISAFLRREITQYCRDPPPDFNEQQKNSFCVFSGNGVSQLRNHLNQIMEDRSYLIDHGDMHALFHERRRRFMNGGNDMDDEEMNLWVRQRGLGVLQGGDLGNPEVAEINREIFRELNEGNMGPEEMREHFQRLIRNHHQQRLLQRQMLEQDLQFQPDQQNQDPQNAPQIIQPAVFPNGDQLIQFVNGEGEDDDDVEMQPVDLFPRDRNPPA

SEQ ID NO: 54037 - protein, 640 aa, Acinetobacter sp. ADP1
MPHMLYTEIPTHRPVTPLLDEIDHPQQLRQLEQSQLTQVADELRQFILYAAGQSGGHFGANLGVIELTVALHYCFNTPHDRLIWDVGHQAYPHKVLTGRREQLMTIRAQHGLAAFPAREESVFDTFGVGHSSTAISAGLGMSLARRYQQNPCEVVCIVGDGAMTAGMAFEAMNDAVAHDADLMVVLNDNDMSISCSTGGFARHLAAIWEKGQLVNIDEHGEAYVQPHPKWTYNSRLHQSATDAADNLFKAIGFDYFGPFDGHDVEHLVHVFNALKKRQGPRLIHIYTKKGKGFEPAEADPITYHAITKITPVSIAPVKKSPPKYSDVFGQWLCDEAAQDDRLLAITPAMCEGSGMVKFAKQYPERFFDVAIAEQHAVTLAAGMACEGLKPVVAIYSTFLQRGYDQLIHDVALQNLDVTFGIDRAGLVGEDGPTHAGAYDYAYMRTIPNLVIMAPKDENECRQMLHTAYDFNGPAAVRYPRGAGLGVEIQQELTKLEIGKAEMVLQCHPEHDEHITILAFGSRVSVAMEAAQQLAQLHDIGITVVNMRFVKPLDEQIIRDLAERTQLFVTIEEHAVMAGAGSAVNEYLAKAQIMKPTLNLGLPDTFMAQATHTQMLKNCGLDAEGIQASIEKVWLRIVQAV

SEQ ID NO: 54038 - protein, 200 aa, Acinetobacter sp. ADP1
MAIEFVATSKLPTKFGDFNISVFQDPVTGEEHVALSKGLEIAPTGPVLVRIHSECLTGDAFASLKCDCGPQLQATQKLINDVGQGVILYLRQEGRGIGLTNKIRAYALQDQGHDTVDANLLLNLPADARRYDMCSIMLDHLQVKQVKLITNNPLKLKALTDLGINVIDRVPLTVGKNPFNEQYLKTKKERMAHLYQKDDF

SEQ ID NO: 54039 - protein, 366 aa, Leptospira interrogans serovar Lai str. 56601
MLEYVLANRIQGLDTSAIRKAFELAGTLKNPINLSIGQPHFPCPSNIIEAGSKALKEGKTAYTLTGGIPELKSALSEKYKNENEISYAKPERILVTSGISSAFLLLFNALLNEGDECLVITPHFLMYPAYIKIYGGKMNSIHESFEPEELKEFANKKLKIIIYSSPSNPTGKILSKKQLEALAELAEKTGAYLISDEIYEKFDYDKKFISVGSFYEKAITLSGFSKTYSMTGLRLASILAPESITKTLTTLQQYTLVCAPSITQWMGIEALKTDMSPYIADYKEKRDFVFESLKDHYEITKSEGAFYFFIKIKEKDEDFILKAVKEKELILVPGYIFTSSKNYIRISFASEWENLKRGISALVDLA

SEQ ID NO: 54040 - protein, 399 aa, Oryza sativa Indica Group
MAAAAESKAGKSPEELLCAAAESGDAEAITGLLAEGADPTHFDASGLTPLMHAATGGHAAVVQLLLDAGAPWNALSPTGISAGDLASDSATFDLLLDHALRSELVLGTVARRQAGPADSPAESYLESRVSFSEERVMDADSKAVMMEWERPLMEAHARAVCSGGKVLNVGFGMGLVDTAIQRYEPEEHTIVEAHPEVYARMLKLGWGEKKNVKVVFGRWQDVLPQLGSYDELSVSCFEGIAKQDFYLLDSSQISAASDKYDAILNKIIALDNSVLLIHYYPKMFVHVYFITKQHGIFFDTYGEYYEDMREFHQHLPKLLKPGGIYSYFNGLCGDNAFFHVVYCQLVALELANLGYSTQFIPLPVKDCLSEEIWNGVKQKYWQLDTYHLPVCQAESEPEQ

SEQ ID NO: 54041 - protein, 186 aa, Leptospira interrogans serovar Copenhageni str. Fiocruz L1-130
MTTIFLLISWYFEVSFQSIQGIRMNQNSEFDIVTLIELAKRNKYERAVAGFHTLDRIERLELPKKIKARKLAVQAMFALASEEVQYQYFTKEERIQLDREANLTNESYSKFNGLFEAPQAPIAEEDTEEDFIPEEAPRPILDGEDDEDEDSLDEDDDDDEDEDEDDDNEDEDDFDEDEEDSEKEED

SEQ ID NO: 54042 - protein, 397 aa, Clostridium thermocellum ATCC 27405
MISESVVNSLKKASWIRAMFEEGEKLRKIHGADNVYDFTLGNPDHEPPSSVKETLKKIVTEDKPGIHRYMNNAGYEDVRQKVADYLNRTSGLSSISSQHIIMTCGAAGALNVVLKTLLNPGEEVIILAPYFAEYIFYVGNHGGKVVIVPPEKDSFKPDLKILENSITEKTKAIIINSPNNPSGYIYSEETLKEIFEVLEKKEKEYNSSIYAISDEPYYKLVYDNVKLPFLFRLYKKSFIVNSFSKSLALAGERIGYIAVNPEIPELELILESLIFCNRTLGYVNAPALFQKAIADSLDADIDVESYKQRRDLIYDTLTRLGFSCIKPQGTFYIFPKSPIEDDIQFIKHAVKYNILLVPGTGFGLPGHFRLSYCVSMDIIKKSLPAFEALAKDFNLIK

SEQ ID NO: 54043 - protein, 233 aa, Brassica napus
  misc_feature (147)..(147): Xaa can be any naturally occurring amino acid
  misc_feature (162)..(162): Xaa can be any naturally occurring amino acid
MDAFRRQASKLRDQVAKQQLAVIKQFSGTGYESSDVMVIDELEMQRHHQLEKLYRSTRSAKEFQREVIKAAETFTTIGLRHIEAGTKLAEDCCKYGTENSQNIDENILAKAAAIYGDARKHVEKEQEDFNKLLSSQVLDPLRAMVAXSPLEDARHLAQRYSXRMRQEAETHAAEVSKRQVRVKEAPIPENVAKLQLAEAKMQELKANMAVLGKEATAALAAVESQQHRLTFQR

SEQ ID NO: 54044 - protein, 992 aa, Vitis vinifera
  misc_feature (8)..(8): Xaa can be any naturally occurring amino acid
  misc_feature (26)..(26): Xaa can be any naturally occurring amino acid
  misc_feature (73)..(73): Xaa can be any naturally occurring amino acid
  misc_feature (453)..(453): Xaa can be any naturally occurring amino acid
MALYSPSXWLHLLLLLLPLMYLIKRXIELKGQKKPLPPGPTKLPIIVSSAEAAREFLKTHDIDCCSRPPLVGXGKFSYNHRDIGFAPYGDYWREVRKICVLEVFSTKRVQSFQFIREEEVTLLIDSIAQSSSSGSPIDLTERLMSLTANIICRIAFGKSFQASEFGDGRFQEVVHEAMALLGGFTAADFFPYVGRIVDRLTGLHGRLERSFLEMDGFYQRVIEDHLNPGRVKEEHEDIIDVLLKIERERSESGAVQFTKDSAKAILMDLFLAGVDTGAITLTWAMTELARNPRIMKKAQVEVRNSIGNKGKVTEGDVDQLHYLKMVVKETLRLHPPAPLLVPRETMSHFEINGYHIYPKTQVHVNVWAIGRDPNLWKNPEEFLPERFMDNSVDFRGQHFELLPFGAGRRICPGMYMAIATVELALANLLYRFNWNLPNGMREADINMEEAAGXTVRRLLKVHGLSTDEQDKSLCTSGISGVHGLFIVDKNPTNHQWHPIPRICGFPWFSYSSHCCFFWKKILELKEQKGPPGPPKLPIIGNLHQLGALIHQSLWQLSKKHGPVMLLHLGFVPTLVVSSAEAAKKVLKDHDISCCSRPPLISIGRLSYNYLDISFAPYGPYWREIRKICVLQLFSTNRVQSFQVIREAEVALLIDSLAQSSSSASPVDLTDKIMSLTANMICRIAFGRSFEGSEFGKGRFQEVVHEATAMMSSFFAADFFPYVGRIVDRLTGIHERLEKSFHELDCFYQQVIEEHLNPGRMKEEHEDIIDVLLNIEKEQDESSAFKLTKDHVKAILMAYFFEQDLFLAGVDTGAITVVWAMTELARKPGVRKKEKFRESDIEQFHYLKMVVKETLRLHPPVPLLLPKETMSTIEISGYQIYPKTQVYVNVWAIGRDPNLWNNPEEFFPERFIDNSVDFKGQHFEFLPFGAGRRVCPAMNMAIAMVELTLANLLYHFNWKLPHGMKEGDINMEEAPGLSVHKKIALSLVPIKYP

SEQ ID NO: 54045 - protein, 435 aa, Arabidopsis thaliana
MKPSSPISLTSSSIARKARFSPYLFTLLAFILFVSVLYGEDFMCIFGQLEPNFVLPPSRTPEKNKKSEKLAFAIGKTEESCDVFSGKWVRDEVSRPLYEEWECPYIQPQLTCQEHGRPDKDYQFWRWQPNHCDLPSFNASLMLETLRGKRMMYVGDSLNRGMFVSMICLLHRLIPEDQKSIKTNGSLTVFTAKEYNATIEFYWAPFLLESNSDDAIVHRISDRVVRKGSINKHGRHWKGVDIIIFNTYLWWMTGLKMNILEVSDIGGIYRQGSFDDKEKNIVEVSTEDAYRMGMKSMLRWVKNNMDRKKTRVFFTSMSPTHAKGIDWGGEPGQNCYNQTTLIEDPSYWGSDCRKSIMKVIGEVFGRSKTPITLLNITQMSNYRKDAHTSIYKKQWSPLTAEQLENPTSYADCVHWCLPGLQDTWNELLFAKLFYT

SEQ ID NO: 54046 - protein, 245 aa, Cyanothece sp. PCC 8801
MFGSIPLRHNHASSRGRPLEASTTALSDTSFESLTLWGNLKRDFQIIFRRDPAARNWLEVLCCYPGFHALALHRFSHWLWSHQVPFFPRFLSHLGRFFTGIEIHPGATIGQGVFIDHGMGVVIGETAIIGDNCLIYQNVTLGGTGKETGKRHPTLGNNVVVGAGAKVLGNLNIGDHVRIGAGSIVLRDVPSDCTVVGVPGRIISGSGRGCPLEHGKLPDIEAQVMRSLLDRIEQLEQKIQNLPSP

SEQ ID NO: 54047 - protein, 366 aa, Bacteroides fragilis NCTC 9343
MNIERKILLNPGPATTTDTVKLAQVVPDICPREKEFAGMMKQLRDDLVRVAHGDLSKHTAVLFCGSGTINIDICLNSLLPADKKVLVVNNGAYSTRAVEVCEYYGLPHIDLKFSVYELPDLSVIEKTLSDNPDIALVYTTHHETGTGILNPIREIGKIAHSHGAVFVVDTTSSLGMIPFDIGKDNVDFCMASAQKGLQAMTGLSFIIGDESLIRASRDYPKRSYYCNLYLQYDYFEKTGEMHFTPPVQTVYAARQALDEYFAVGEEAKFARHKRVFEAIHKGLQELGLQYAIKREWQSGLVVSVLYPDDPLWDFDKVHDYCYERGFTIYPGKISTTNTFRLCALGEIDVEDIERFFEVMREAVLKY

SEQ ID NO: 54048 - protein, 232 aa, Actinobacillus pleuropneumoniae serovar 1 str. 4074
MPSIAFLLAKAFQLPPDLPIGVILVGSCPGGTSSNVMTYLARGNTALSVACTTVSTLLAPVLTPAIFYLFASEWLEIDAGAMFVSVLKMVLLPIFVGVVIRSIFKQKIEQFSQTMPLISVVAIILIVTAVVSVSKDRIIESGLLIFFVVVLHNGLGYLIGYTVGRVLKLPIADSKAISIEVGMQNSGLGAALAALHFKANPVVAVPSAVFSFWHNISGPVLAMIFASIKNEK

SEQ ID NO: 54049 - protein, 401 aa, Actinobacillus pleuropneumoniae serovar 1 str. 4074
MTDFQFSKVEDAIEAIRQGKIILVTDDEDRENEGDFICAAEFATPENINFMATYGKGLICTPISTEIAKKLNFHPMVAVNQDNHETAFTVSVDHIDTGTGISAFERSITAMKIVDDNAKATDFRRPGHMFPLIAKEGGVLVRNGHTEATVDLARLAGLKHAGLCCEIMADDGTMMTMPDLQKFAVEHNMPFITIQQLQEYRRKHDSLVKQISVVKMPTKYGEFMAHSFVEVISGKEHVALVKGDLTDGEQVLARIHSECLTGDAFGSQRCDCGQQFAAAMTQIEQEGRGVILYLRQEGRGIGLINKLRAYELQDKGMDTVEANVALGFKEDEREYYIGAQMFQQLGVKSIRLLTNNPAKIEGLKEQGLNIVAREPIIVEPNKNDIDYLKVKQIKMGHMFNF

SEQ ID NO: 54050 - protein, 716 aa, Nocardia farcinica IFM 10152
MSETNMIGWEKDSDGIVVLTMDDPNQGANTMNELYKKSMTATVDRLEAEKDDITGVVLTSAKKTFFAGGDLKNMMKVGPDDAQALMAELTEIKSALRRLEQLGKPVVAAINGAALGGGLEIALATHHRIAADVPGSQIGLPEVTLGLLPAGGGIIRTVRMLGLQNALMQVLLQGQRNKPAKAKEIGLVDELVGSIEELVPAAKAWIKANPDAGVQPWDKKGFKIPGGTPASPGFAANLPAFPANLRKQLKGANMPAPRAIMAAAVEGSQVDIDNASLIESRYFVHLLTGPVAKNMIQAFFFDLQAINNGGSRPKDVPKREIKKVGVLGAGMMGAGIAYVSAKAGYEVVLKDVSLEAAERGKGYSEKIEAKALSRGKTTEEKSKALLDRIKPTADAADFAGVDFVIEAVFENTELKHKVFQEIEDIVTPDALLGSNTSTLPITGLATGVKRQEDFIGIHFFSPVDKMPLVEIIKGEKTSDEALARVYDYTLAIKKTPIVVNDSRGFFTSRVIGTFVNEAIAMLGEGIEPATIEQAGSQAGYPAPPLQLSDELNMKLMLKIAKETEEAIKAGDTKLGTERHPAIDVIEWMVGEGRPGRLEKAGFYEYDENGKRLGLWQGLREHFKTTAGFDVPLQDLIDRMLFAEAIETQKCFDEGVLETTADANIGSIFGIGFPAWTGGVHQFIVGYPGGQEAFVARADELAEKYGQRFQVPASLRK

SEQ ID NO: 54051 - protein, 267 aa, Shewanella sp. MR-7
MHPMLTIAVRAARAAGQTIMRAYTELDRVEVSAKGVNDFVTSVDKEAEAAITYQIRKSYPDHTIVGEEKGENRGENKDYVWIVDPLDGTNNFVRGIPHFAVSIALQHKGKTEVAVVYDPVREELFTAIRGKGAKLNDFRIRVTNVTELAPTIIGTGFPFKARQHTESYMAIFGEVFGQCSDLRRAGSAALDLAYVAAGRLDGFFEIGLKPWDIAAGDLICREAGGTVTDFTGSHNYLISGNIVAGSPKVTTELVKTMRPLLNEGLKR

SEQ ID NO: 54052 - protein, 273 aa, Shewanella sp. MR-7
MGVIARLKEDIESIYHRDPAARSAFEILVNYPGMHAIWLHRISHKLWKRDWRLMARCLSTFSRWLTGVEIHPGATIGDRFFIDHGMGVVIGETAEIGDDCTLYHGVTLGGTTWQAGKRHPTLGNNVVVGAGAKILGPITMHDGARVGSNSVVVKDVPKDTTVVGIPGRVVATPSPQSKEKSERRSAMAKKYGFDAYAVSPDNPDPVANAIGQMLDHMHLMDSKVQELCQAIQRLGGDVCTERLPELNVGEFNDAEKAAADKRQSALDEFDPSI

SEQ ID NO: 54053 - protein, 247 aa, Spinacia oleracea
MAIAFGRFDDSFSWASIKAYIAEFISTLLFVFAGVGSCIAFAKLTEDAALSPSGLVAVAVCHAFALFVAVSVGANISGGHVNPAVTFGLALGGQITILTGILYWIAQCAGSVAACLLLKASTGGLATPIHSVAAGVGSIEAVVMEIIITFALVYTVYATAVDPKKGSIGTIAPIAIGFIVGANILAAGPFSGGSMNPARSFGPAVASLDFSDHWVYWVGPLVGGGLAGLIYGNVFMQDDHAPLSNEY

SEQ ID NO: 54054 - protein, 349 aa, Neurospora crassa
MAGLFGSAAASASNTLGDLKQDVELGQPPEDSISDLAFNPNPADQKDFLAVASWDKKTRIYEILSNGQGQGQAMIEHDAPDGTKVISAGADKAAKVLDLATGQSMQVAAHDMPIKCVRYFEANGTPMAVTGGWDKQIKYWDFRSANPAATVQAQERVYTMDVRDNLLVVGTADRYINVINLKDPGKFYKTMQSPLKWQTRVVSCFNDSQGFAIGSIEGRCAIQYVEDKDSASNFSFKCHRDPAQGNTTAVHAVNDISFHPQHGTFSTAGSDGTFHFWDKDAKHRLKGYPNVGGSITSTTFNKTGSIFAYAISYDWSKGYQGNSPTYPTKVMLHPVQQDECKPRPSVKKR

SEQ ID NO: 54055 - protein, 297 aa, Schizosaccharomyces pombe
SGQNNVVGVHYKVGRRIGEGSFGVIFEGTNLLNNQQVAIKFEPRRSDAPQLRDEYRTYKLLAGCTGIPNVYYFGQEGLHNVLVIDLLGPSLEDLLDLCGRKFSVKTVAMAAKQMLARVQSIHEKSLVYRDIKPDNFLIGRPNSKNANMIYVVDFGMVKFYRDPVTKQHIPYREKKNLSGTARYMSINTHLGREQSRRDDLEALGHVFMYFLRGSLPWQGLKAATNKQKYERIGEKKQSTPLRELCAGFPEEFYKYMHYARNLAFDATPDYDYLQGLFSKVLERLNTTEDENFDWNLL

SEQ ID NO: 54056 - protein, 349 aa, Aspergillus nidulans FGSC A4
MSTLVIDAGLVPSGSGSNALAGCDCTGKCCYQICDHLSRIESLLSIANLGLPTADDNFSKSAPHPSNPNRIPKHSHCMTSQSEGQPVIMPASPSRTTTLLANLASVTSRIQSASSKLPLPKEPRLVAVSKLKPASDILALHNPPTAHSHFGENYLQELQEKARLLPPTIKWHFIGGLQSNKCVSLARDTRALWAVESVDSEKKATLLDKGWGERKAEMGGEEKLRVFVQVNTSGEENKSGVDPGEEVVRLCRFIMDKCPRLRLQGLMTIGAIARSKATTAETENEDFICLKQARERVNEALGLEGDARLELSMGMSEDFEGAIALGSDEVRVGTTIFGDRPPKDRARIL

SEQ ID NO: 54057 - protein, 275 aa, Bifidobacterium longum NCC2705
MAIQSTIMLNNGTVIPQVGLGVFQTPDGDTTVNAVQTALENGYRHIDTAMIYHNEASVGEGIRRAGVPRSDFFLTTKLWNDDIRARRGKDAFQESLDRLGVDYVDLYLIHWPADGWQQAWDDLQEIYASGRAKAIGVSNFQKHHIDELLTHSDVVPAVDQVESSPQFTNQELIGQLRAKGIHTEAWSPLGGTGGNLLSNPVLAGIGAKYGRSAAQVVIRWHIQRGIVVLPKSTHAERIKQNFEVFDFNLSVDDMTAISAINTGKRNGADPDNFNF

SEQ ID NO: 54058 - protein, 507 aa, Candida albicans SC5314
MLILLPIAVIAASIYYIAEYWKRESIKRKYDCQPVKQAPLVTWYDIFGIKALVDNSNLTKSGYFYQDIQRKLDNLDTTTMKTTALGKNQIITIEPENFRTMCSSADLNNWTIGTRPIALKPLLGNGIFSSEGESWKHSRIMLRPIFAKEHIKQITAMESYIQSLIKVIKLQQQGEGEFDLQHLFHCFTIDYATDFLFGESCDCLKSILGETSISTMSEEEKSKFAPNFDVMQYHMTKRLVFGYFSFLVNPPEFKNAVKHLHEFVFHFVDRAINFTDEELNDPSKNYVFLYQLAKQTKDRKVILDELLSVLLAGRNTTASLLSFMFFELAQNKPVWNKLKKEITEHFPDVESITFETIHNCEYLRWCIHESLRINPPVPINTRTANRDTVLPKGGGKGNNYPIFVRKGEQVIFPLFSSNRQERFFGPEPEKYIPERWANLPRNGGVAFGPFGTGPRLCLGQQLALVEASYVTIRLLQTFSQLDSNHTECRRSVGATMRLMDGCQVTLK

SEQ ID NO: 54059 - protein, 378 aa, Oryza sativa Japonica Group
YAEVVSLIKDESGERIIGARIRDTLSGKEFDAFAKVVVNAAGPFCDSVRKMANNDVVPMISPSSGVHIVLPDYYSPDGMGLIVPKTKDGRVVFMLPWLGRTVAGTTDSSTAITMLPEPHEDEIQFILDAICDYLNVQVRRSDVLSAWSGIRPLAMDPSAKNTESISRDHVVFEDYPGLITITGGKWTTYRSMAEDAVNAAIRSGNLKPANGCVTDHLHILGGYGWDPASFTVLAQNYKRMKRTYGGKIIPGAMDSAVSKHLSHAYGTLATQVASIAQNEGLGKRLAHGYPFLEAEVAYCARHEYCESAVDFIARRCRLAFLDTDAAGRALPRIIEILALERKWDKARQKLELQKGKDFLETFKSSKNAQFRDGKHNGQ

SEQ ID NO: 54060 - protein, 310 aa, Burkholderia thailandensis E264
METIAVIGSNMVDLVTYVARMPADGETLEAPNFELGCGGKGANQAVAASKLGARVAMVSKVGDDLFAENTLRNLERFGIDIEHVRRVPGVSSGVAPIFVSPDSRNRILIVKGANRHLKPADIDAAAAKIAASRLVVLQLEIDIDTVYYAIDFAAARGIPVLLNPAPGAADLDFSRLAKLEFLVPNETELALVSGMPTDTPDAIEHAARSLVERGVKHVIVTLGDKGSLLVSRAGVVRVPPVAVDARDTTGAGDAYIGCFARHYVATLDIPAAMRLASAYAAHSVTGFGTQKSYADAATFERFLQTPRSGA

SEQ ID NO: 54061 - protein, 444 aa, Burkholderia thailandensis E264
MAAEAAQAGVRCPHVRLNGAPGRRAAYAVRATATCRDTRARTSRSPAPGRNPIDARLPSDESGRFAGARRISRDSSAPGGLLRIRLARAIRPLLRTRCRCRTTEIESMFAWNFLGKRCFAVSAVHSIVEPSPATPDRITDSTAAFARDMRTSYRAMIPSAGAPDAVKQVLAISVGARHPDRDIPVRVYKPEGSRDEERLPTVLFVHGGGFVSGDLDTHDVLARAIANRAQALVLSIDYRLAPEFPFPAGLDDIYAVLQWAAGHLDTLGGDATRIAISGDSAGATLSAATAMLARDRGGPPLIAQWLMYPSVSNDMDTPSWDELGDTHFPTREVMRNVRHSYVPMETSPHAPLLAPIHGNHADLPPALIQVGQLDPLRDENISYASILNKAGVEASVTVYEGQSHGFIQFFKDKSNHPRGETALDDGVRFLRERFASGATQPPRR

SEQ ID NO: 54062 - protein, 450 aa, Nocardioides sp. JS614
MAETYDLVVVGAGMAGVAAANKCASSGWRVAIVDALPYGGTCALRGCDPKKILRRGAEIIDGARLMRGKGIDGQGLRIDWADLMRHKRGFTDPVPDNLERDLAGHGVETLHGNARFLGGNTVEIAGASVESRHFLVATGARPRALAFPGHEHLIDSTDFLDLERLPARILFVGGGFISFEFAHIATRAGSATTVVDRGPRPLRGFDPDLVDLLLGRSRQAGIAVRPATTVTAIAKDKAGYQVTLETPEGSETIECDLVVHGAGREADLAGLDLEAAGVEWSPRGVRVAGHLQSTTNPAVYAAGDSADTPGMPLTPVAVFEGRVAASNMVNGTTRAPDYAGVPTAVFTIPELARVGLLEREARERGLDVDVRFNDTSGWYSNYRTGETTAAAKILVDRATDRVVGAHLLGPEYAELINVLGLAIKLGLTTRQLKSTTAAYPTVGSDLGSML

SEQ ID NO: 54063 - protein, 295 aa, Thermosynechococcus elongatus BP-1
MLSDSDRVRVLSEALPYLQAFAGRTFVVKYGGAAMKEEQLKDSVIRDIVFLSYVGIRPVVVHGGGPEINTWLAKLNIEPQFKNGLRVTDAATMDVVEMVLVGRVNKEIVTLINQAGGQAVGLCGKDGNLIRARAKGEESIGFVGEVQGVDTRVITALVEKGYIPVISSVAADDTGQAYNINADTVAGEIAAALGAEKLILLTDTAGILRDYRDPSTLIYRLDIAEARQLIKDGVVSGGMIPKVTCCVRSLAQGVKAAHIIDGRVPHALLLEIFTDSGIGSMLVGSNAAYDSAFSG

SEQ ID NO: 54064 - protein, 308 aa, Haemophilus ducreyi 35000HP
MNKPNLQITNNMTYSLTTDLNAIQQRINHFLSNQLPQSPTEQPPLNQAMAYAVLLGGKRIRPFLMYTTGKMLGVPLTTLDHSAAAIEAIHAYSLVHDDLPAMDNDQLRRGKPTCHIAFDEATAILAGNALQALAFELIANAPHLTDWQKVQQIRTLSTAAGAKGMCLGQNLDLLAENKSLNLTELEQIHRHKTGALIVASVLMAVNLSDHAQNNAIKQPLERYAQAIGLAFQVQDDILDVIGQTDKIGKTVGADQQLHKSTYPKLLGLTQAKQKAQDLHQTALNALAELPFKSTALKELADFIIHREN

SEQ ID NO: 54065 - protein, 1249 aa, Candida albicans SC5314
MHLFKRIALTLWLIISSTLAVVITEDRVDRGTISVNLGEVTVNSGASWSIINNAVTAFAGKINVQSGGGLYISSTSPLLALQVTLTSLLDSITNDGVISLDSRASLTASNYNLIGLSFTNNGEMYLAASGVLPSTMDLTAASWTNNGLIVAYQNQRSSGVLNLGTPLGAITNNGQICLYNQVYQQQTRIEGSGCITANKNSAIYISNAVLPVATTQNFYLQDSKSSMIVQAVSSTQTFNVYGFGNGNKIGITLPAVGIPPNPAYSYDVDTGILTVRAGLLSQKFNIGLGYYSLFFSVVTDNGAGLPSTILGSISYSGPVPSRNLPASCKIACKPVPTAPGTNPTEYTTTITTTNSAGNPLTETGVVDISTDSNGSWFTTTSIFPTTSQSSSSETVASSSQPDSSSTEPSAFPSSTGDSSAEPSITSDYSSSELSVVPSSASESASESSAEPSSASESASESGSESVASETSASESASEQSSTSESVSSEFASSDSSSEPSSASESSVESSSASEFVVPSSATETSVSESASESSAEPSSASESVASESAVSETSASESAAPSSASETSVSESAASSSASESFASESSVESSAVPSSASEFSTSESVASETPASETPASETPASESASEQSSTSESSAEISSASESSAEPSSAKSAISESASEFSAAPSSASQSSASQSSTNESSSQQSSAESSSTGTSSVSASAATSEYTATWTTTNSDGSVSTESGIISQSGSSFTTITTFVPDATSEYTTTWTTTNSDGSVSTESGIVSQSGSSFTTITTFAPDATSEYTTTWTTTNSDGSVSTESGVVSQSGTSLTTITTFAPDVTSEYTTTWTTTNSDGSVSTESGIVSQSGSSFTTITTFEPPVVCKRDDVNCGSSIGLSTPYYGNSSQPLSSTKMTDTSATQTVDSSLSSITDATTTQSVNSLETPVPTSGSGNGSNNGSDNGSNNGSNNGSNNGSGSGNGSNNGSNNGSGSGNGFNNGSDNGSNNGSGNASNNGSASGSGSDNGSDNGSDNGSDNGSNNGSNTDNGSNSGSDSGNGIDNGSGNGSSDGSDNGTTNGSGSGGESNNGSGNGSDNGSSPDNGSNNGSNNGSNNGSGDGIGTGSNSDTDNGSGNGSNNGSGSVNGSANGSGNGSNNGSNSGSNSDNGSNNSSGNGSSSDLGSVSGTGNGSNEGSSNESGANNGSNNGAGALPAATLSVVPSPSADSGSTSSASAMVIPNTNGSGKLLNGKVLTLSVLSSMVVVFL

SEQ ID NO: 54066 - protein, 325 aa, Acetabularia acetabulum
MLSTVILCLLVVSAFTKQKSHDDEFNYKLGGDDWPGLCATGDLQSPIDVHFMNQLSGSQIQGCEIVEELKGDTDMYAYPERLVLNRDGQPQATFQFGSTDEVLITNVGDAIVWMFDDDFSLLNLPIQGGKLDGVLHPITKGQGRTSNFMGGQIEYVQARFVNFHVHSPGEHMYNGYLAPLEGHFVMNIDQADLDTCPEAGCLAVVSVHFQHSLDDTPNQFIQDTLELIGGEWPVQIGASMEANGSLNFDQLLPQNPHYMLYSGSLTTPPCTEGVLWHVIQESVPVSIAQVAALQNAIGYSHDGIVRNNRRIQPINNRDIIYHDCI

SEQ ID NO: 54067 - protein, 502 aa, Zea mays
MGALLPWLAWLLVSLVGVYLLGHLVQARRRRGLPPGPHPLPIIGSLHLLGNQPHRSLARLAKTHGPLVSLRLGSVTTVVASSPAAAREILQRHDAAFSNRSVPDAPGAHARNSTVWLPNAPRWRALRKIMGTQLFAPHRLDALQHLRRDKARELVDHVRRLARRGEPVNVGRVAFTTSLNLVSRTIFSRDLASLEDDGASRKFQEVVTDIMEAVGSPNVSDFFPALAVADLQGCRRRLARLFARLHRIFDEEIDARLRGRDAGEPKKNDFLDLLLDAAEDDDNTAGLDRDTLRSLFTDLFSAGSDTSSSSVEWAMVELLRSPGSMAKACDELATVIGPRKDIEESDIGRLPYLQAVVKETFRLHPAAPLLLPRRAQADVKMMGYVIPEGSRVFVNVWAMGRDEETWPEPEKFMPERFLGKKKTQAVDLRGGDFDLIPFGGGRRICPGMPLAIRMVHLLLASLLNQFAWRLPAELERNGVDMAENFGITLTKAVPLCAIATEI

SEQ ID NO: 54068 - protein, 315 aa, Acetabularia acetabulum
MLSALVLCQLVVLSISQKDFNYKLGGDDWPGLCATGNLQSPIDVRFSEPLSSLKAQTCEISSKLKISNPGRLVLNRAGLPQATFQFGSSDKVTVANVGGAIVWLFDDDFSLLNLPIEGGKLDGILQSNNKGLDRISIFMREQIEVVQARFINFHVHSVSEHMFNGFLAPLEGHFVMQIDQADLQSCPEAGCLAVVGVHFQHSIDDTPNQFIQDTLQLIGGKWPDTNGQSIPASGSLNFDQLVPHNPSYMLYSGSLTTPPCTEGVLWHVIQQPMTVSIAQVAELQNAIGFERDGLVRNNRRIQPINNRDMIYHDCI

SEQ ID NO: 54069 - protein, 315 aa, Acetabularia acetabulum
MLSALVLCQLVVLSISQKDFNYKLGGDDWPGLCATGNLQSPIDVRFSEPLSSLKAQTCEISSKLEKSNPGRLVLNRAGLPQATFQFGSSDKVTVANVGGAIVWLFDDDFSLLNLPIEGGKLDGILQSNNKGLDRISIFMREQIEVVQARFINFHVHSVSEHMFNGFLAPLEGHFVMQIDQADLQSCPEAGCLAVVGVHFQHSIDDTPNQFIQDTLQLIGGKWPDTNGQSIPASGSLNFDQLVPHNPSYMLYSGSLTTPPCTEGVLWHVIQQPMTVSIAQVAELQNAIGFERDGLVRNNRRIQPINNRDMIYHDCI

SEQ ID NO: 54070 - protein, 342 aa, Alkaliphilus metalliredigens QYMF
MEKMKAVHINDDATIQVVEIDRPTPKKGEALLKIKYCGICGSDIQTYTGNQPFATYPRIPGHEFSAEIIEIEENDMGLQKGMIVTANPYFNCGKCYSCLRGKVNCCENNETMGVQRDGSFAEYIVMPIERIVDGKGLDAKTLSLIEPFSISYHAVNRVNIQKGDKVLVIGAGAIGIFAALAAKLRGAEVYISDIFDERLEAALKMGADGTINVKNENLQERVKDITNGNGMDVCIEAVGMPETFLDCIENVCFGGKIGLIGNGKRETTFNHSILLKKELDVYGSRNSLNDFIPLVDLVSKDKIDILQIVSDILPLENVKEAFDLLKNNDGSKMKVLVEFDKV

SEQ ID NO: 54071 - protein, 160 aa, Haemophilus ducreyi 35000HP
MIRIGHGFDVHAFGEKRPLIIGGVTIPYHTGFIAHSDGDVALHALTDALLGAAALGDIGKLFPDTDQQYKNIDSRKLLIEAYRQVQTKGYQISNIDITIIAQAPKMRPHIDNMRQLIANDLNCDIDQINIKATTTEKLGFTGRGEGIACEAVALLSKKTV

SEQ ID NO: 54072 - protein, 174 aa, Zea mays
  misc_feature (146)..(146): Xaa can be any naturally occurring amino acid
LDTSGIVWSVGGHRPAGSGAVACPASGVSGFITSTGGGGEPPPRDATLGRHLARRLVQVGVSDVFAVPGDFNLTLLDHLIAEPGLRVVGCCNELNAGYAADGYARARGVSACVVTFTVGGLSVLNAIAGAYSENLPVLCVVGGPNXSNDYGTNRVLHHTIGLPDFSQELRCFQP

SEQ ID NO: 54073 - protein, 442 aa, Legionella pneumophila str. Lens
MIHRNKVLNSILLILFTSQIAFAKSNPASQAYVDGKVSELKNELTNKINSIPSGPQGPRGDKGKAGPKGDRGETGPQGLPGPKGDRGEAGPQGLPGPKGDRGEAGPQGLPGPKGDKGEAGPQGLAGPKGDRGEAGPQGLPGPKGDKGEAGPQGLPGPKGDRGEAGPQGLPGPKGDKGEAGPQGLPGPKGDRGEAGPQGLPGPKGDKGEAGPQGLPGPKGDKGEAGPQGLPGPKGDKGEAGPQGLAGPKGDRGEAGPQGLPGPKGETGAVGPQGMPGPKGEAGDDGQGVPAGGETGQVLAKSNDLDFNTMWVDPANSGIRRQLGDKALGGTVIYVNALGTHGLVVANSDQVNSNTWWDAQDSITNPAHFDTEGKLYSDWRLPTRFELNLIYMMRNELGNFLAGNYWSSIEKSSANSWVFNSKTGEIKNIAKNKTAAVRAVRAF

SEQ ID NO: 54074 - protein, 435 aa, Wolbachia endosymbiont of Drosophila melanogaster
MYITIIGIGYVGLVSCAMLSEQGHNVDCIDINTKKIELLKLGKIPIYEPGLADYLENNIKLQRIRFFDSYSQINPNTEVVFVTVDTPSDSLGNANLQNVYNAVSEVSERVNQDCLIVIKSTVPPGTAENIYNYLSNKGYNFDLGVNPEFLKQGSAVSDFLYPDRIIIGVKTKLARAKLEVIYRSFIDKNIPLIVTDTVTAEMIKYASNAFLATKVAFINEMAGLCELLGADIDLLANSMGMDHRIGKEFLKAGPGFGGSCFPKDLSALIRLAEDHNVKLQILNSVKESNYNHITNIAKKVEYVLNGVQNKKIAIWGLTFKSGTDDVRNSPAIDIAQLLVNNKAKITAYDPMGMDNARQVLKDIEYADNAIGAARDAEALLLLTEWKEFKNQDFASLKSIMAAPNVFDFRNLLDSELLLRYGYHVYSLGKKSIYKV

SEQ ID NO: 54075 - protein, 236 aa, Oryza sativa Japonica Group
MASTSSCLASPATAAAAPRLRVRVTPRAGRVVACSAGGGGGPEAAGLFAGERKAVGGLACGVLAAWAVASSSSPVIAASQRLPPLSTEPNRCERAFVGNTIGQANGVYDKPLDLRFCDYTNEKTNLKGKSLAAALMSDSKFDGADMSEVVMSKAYAVGASFKGTDFTNAVIDRVNFEKADLQGAIFRNTVLSGSTFDDAKMQDVVFEDTIIGYIDLQKLCTNTSISADSRLELGCR

SEQ ID NO: 54076 - protein, 428 aa, Chlamydophila pneumoniae J138 [sequence omitted]

SEQ ID NO: 54077 - protein, 371 aa, marine gamma proteobacterium HTCC2080
MTNSLTYRDPEGLISDLRHGQMVLLLLEDSSGGVTGIVTIAAELCEASHITFMARQARGLICLGLTRERCDYLHLPLMVEGQGDAAPFTLSIEAAEGIETGISAKDRAHTVRVAVAPQTSAADLVQPGHIFPVAAEEGGLLTRADRAEATTDLARLAGLFPAAVFTEVLDETGNMARGDALERFAVLHELPVGRVSELIDHRLTTERTIERIRQGAIRTSHGEFELTVYREIHHGSIHLALSRGNLQTDATTLVRVHVTSALRDLVGTTLEGQATWRFDTSLSEIAASERGVLVLISRPETAEELLASVDRLLGLPIADNVSSQAGYASVGLGAQILNDLGVGKIELLGAPLKYNALAGFGLEVVNFVAPT

SEQ ID NO: 54078 - protein, 160 aa, marine gamma proteobacterium HTCC2080
MSSQGIRTTEGTLGPNQGRYVLVVARWNSFVVEHLLEGALDTLRRHGISDEQMHIVRVPGAFEIPIACQKLAQRDDCDAIIALGAVIRGGTPHFEYVAGECTKGLAQVQMETGKPIAFGVLTVDSIEQAVERSGTKAGNKGAEAAMSALEMVSLSIALGA

SEQ ID NO: 54079 - protein, 280 aa, marine gamma proteobacterium HTCC2080
MSDVNQPEAPLHCDDPRLAAALQYVLENSGKKLRARLVMASYHMLCEGADDAAASAATAIEWLHTYSLVHDDLPAMDDDALRRGKPTVHTVYDEATAILIGDGLQAAAFSLISEDERLASGTRLKLITLIANAVGFNGMVGGQALDMAAQGKASTFEQLRLIHEQKTGALFRAAVLSGAVCANATEQDIQRLDQFASTIGLAFQVADDILDVTENSATLGKTAGKDIAVEKSTYVSCLGLEEAQNEAERLLDEAMTCLNPYGDRAQPLVDLAIAMVRRKH

SEQ ID NO: 54080 - protein, 104 aa, Leptospira interrogans serovar Copenhageni str. Fiocruz L1-130
MALAEVNDTNFKSETSGGLVLIDCWAEWCGPCRMVAPVLEELSGELDGLVKIKKLNVDDNQDTAQSLGISSIPTLLLYKDGQLVDKVIGALPKAQIKNFIERHK

SEQ ID NO: 54081 - protein, 385 aa, Zea mays
MARVRDRTKHFKGVAMLSHGYIEKMGTTRKRRSLWLRGIVVNGKSTSELLSGSVSLRSAEVVGTPVGRIVKCEEFLKAAGPVMAVKEIEPALKKQLIISTTLMTVGIAVISWLALLAKFTIFNFGTQKDVSNWGLFFCVAIGPWAGLIIGFVTEYYTSNAYKFKAYKTGAVTNVILGLALGYKSVIIPIFAIAVIIYVSFSIAAMYDIAVAALVTMLVVLLRTDAVDAAGNTTAAIGKGFAIGSAALVSLALFGAFVSRAGVKVVDVLSPKVFIGLIVGAMLPYWFSAMTVKSVGSAALKMVEEVRRQFNTIPGLMEGTAKPDYATYWKISTDASIKEMIPPGALVMLTPLIVGTLFGVETLYGVLAGALVSGVQPSFSLNRKEL

SEQ ID NO: 54082 - protein, 493 aa, Blastopirellula marina DSM 3645
MATISRSNSSTSPEVRHTQCFIDGQWVPAMSGKTFATLNPATEEVIAEVAEGDAADIDVAVRAARNAFDSGPWRKMDARDRGALIYRLAELIEQEKEELAALESLDNGKPIRDALAADLPLVVDCLKYYAGWADKIQGATIPIRGDYFCYTRREPVGVVGQIIPWNFPMLMAAWKWGPALAAGCTIVMKPAEQTPLTCLRMAQLAQEAGIPDGVINVVPGFGPTAGGSLVKHPGVDKIAFTGEHITAQTIMKNAADTMKRVTFELGGKSPNVIFADADLDAAIAGAHFGLYFNQGQCCTAGSRVFVEDSIYDEFCERMVAMNQDRKLGDPLDPDTEQGPQVDQRQMDKILGYVELGKKQGARLLSGGQRHGDKGFYVQPTLFADVTDDMKIATDEIFGPVMSVLRFKGQDDIIQRANDTFYGLAAAVWTNDVKKAHRFAADVRAGTVWVNCYDVFDTAAPFGGFKMSGLGRELGAAGLDAYLENKTVTVNLAD

SEQ ID NO: 54083 - protein, 639 aa, marine gamma proteobacterium HTCC2080
MGYHPDMTTSFPTVKPITPLLEQINSDLGVLRSLGEDDLQTLANEVRQYMLFSVSQTGGHFGAGLGVVELSIALHHVLNTPEDRIVWDVGHQTYPHKILTGRMERLATIRQAEGLSGFPKRTESGFDTFGVGHSSTSISAAMGMAIAANQQGLDRKVVAVIGDGAITGGMAFEALAHAGHVRPNMLVILNDNQMSIGHNTGGLANYFAKIWASPTYIALREGSKRILEHVRTAWDFAKKTEEQMKSLVAPGMLFEELGFNYVGPLDGHDLPQLVQTLEAMIELKGPQLLHIRTVKGKGFSPAESDPVGYHAINKIEANPDSSTKKPSPPKYQDVFGRWLCDTAATDNRLIGITPAMCEGSGMVQFSQEYPSRYHDVAIAEQHAVTLAAGMACDGLKPVVAIYSTFLQRAYDQLIHDVALQNLDVTFAIDRGGLVGQDGATHHGVYDLSYLRCIPNMIIACPSNENECRQLLHTAYQHDGPAAVRYPRGAGTGALIEEEMTALPIGQAVTLRTGHNVAILNFGVLLDEAEAAARVLKATLIDMRWAKPLDETLLLQVARSHDRLITVEENALAGGAGSAVAEFLSGANIEVEIRHIAIPDAFIHHGSQAENRRAAGLTSDDIVTAGTLTATSKEALTKIV

SEQ ID NO: 54084 - protein, 458 aa, Nocardioides sp. JS614
MVATATPGHDVSALHPELRPMYEKVVSRNPGEREFHQAVFEVMQSVGPIAEERSDYAQWSILQRICEPERQIIFRVPWVADDGKVEINRGFRVEFNSALGPFKGGLRFHPSVNLSIIKFLGFEQVFKNALTGMPIGGGKGGADFDPKGRSDGEVMRFCQSFMTELYRHVGEYTDVPAGDIGVGGREIGYLFGQYKRITNRYESGVITGKGLTWGGSQVRTEATGYGTVFFVEQMLQARGEHLEGKRVVVSGAGNVAIYAVEKAQALGAVVVAVSDSGGYVVDEAGIDLELLKEIKEVERGRLTEYVERRSGATHVTDGCIWDVPCDIALPCATQNELDESAAKTLAANGVTLVAEGANMPSTPAAVQLFQAAGVLFAPGKASNAGGVATSALEMQQNASRDSWHFDETEARLQEIMSEIHDTCLATSDHYGAPGNYVVGANLAGYVRVADAMVALGVI

SEQ ID NO: 54085 - protein, 144 aa, Zea mays
  misc_feature (108)..(108): Xaa can be any naturally occurring amino acid
  misc_feature (117)..(117): Xaa can be any naturally occurring amino acid
  misc_feature (133)..(133): Xaa can be any naturally occurring amino acid
RSSRRAGILPSPSFLLSLFLSIPRRETRAPDWRRPPVREARQIFDSRGNPTVEADVCCSHGTFAKAAVPSGGSTGAYAPLKLRDGGSDYLGQGVSKAVNNVNSIIAPXLVGKDPTRXTLCFDIFMAQELDGTXNEWGVVQRKSL

SEQ ID NO: 54086 - protein, 246 aa, Oryza sativa Indica Group
MEKPEWSMDDFEIGKYIGEGKFGKVYLAREKQSGYVVALKVTFKAKLDKYRFHAHLRREIEIQHGLDHPNVLRLFAWFHDAERVVLVLEYAARGELYKLLRTVRRFSERTAATYVASLAGALAYCHKKQVIHRDIKPENLLLDIEGRLKIADFGWAVRSNAKRHTLCGTIDYLAPEMIEKKAHDHAVDNWTLGILCYEFLYGSPPFEAAEQDDTLRRIVKVDLSFPSTPYVSADAKDLICKVTPCH

SEQ ID NO: 54087 - protein, 408 aa, Zea mays
MGQKRALLVGINYLGTDGELKGCLNDVARMRRCLVGRFGFDEADIRVLADADPSTPPPTGANIRLELERLVAGARPGDALFFHYSGHGLQLPAETGEDDDTGYDECIVPCDLNLIKDQDFTDLVAKVPDGCRFTMVSDSCHSGGLIDKTKEQIGNSTKQNRTQQRREREMKPPPPAPGSALRVSLARIVRGVLESLGCIHCSRCRVQQQGNSNSSSISNRSLPLSTFIQMLRDKTGRHDVGVGSIRTTLFHHFGDEASPKVKRFMKAMLLGKLRHDGKEAEEQSRVPREAEVEETLAQDAHSVEEVYAGPAAAAAAARVPPRNGVLISGCQTDETSADATTADGMSYGALSNVIQTILAGDGKKRGVALAVTNRELVVRARELLSRQGYTQQPGLYCSDEHATLPFIC

SEQ ID NO: 54088 - protein, 360 aa, Triticum aestivum
MSDGKDTLDLSALGAAVPNAAELSAEDKANLVESIKNTLQGLAARHTDVLESLEPKVRKRVEALREIQSQHDEFEAKFFEERAALEAKYQKMYEPLYSKRHDVVNGVVEAEGEAAEDQKEEVGVPDFWLNAMKNHEILAEEIQERDEEALKYLKDIKWYRITEPKGFKLEFHFNTNPFFKNEVLTKTYHMIDEDEPILEKAIGTEIEWCPGKSLTQKVLKKKPKKGSKNTKPITKIENCESFFNFFSPPQVPDDDEEIDEDTAEQWQNQMEQDYDIGSTIRDKIIPHAVSWFTGEAAQDEDFDGIMDDDEDDDEDDEEDEDEDEDDEEDEDDDDGDKKKGGRVPAGEGQAGERPAECKQQ

SEQ ID NO: 54089 - protein, 426 aa, Blastopirellula marina DSM 3645
MESNVRSYCRSFPTIFTRAKDHLLFDEQGRSFIDFFAGAGSLNYGHNNDVIKSALLEYLSADGVTHALDMSTAAKRDLLQAMQDVLLAPRGLDYKVMFPGPTGTNAVESALKLARKVTGRANVIAFTNGFHGMTLGSLAMTGNSGKRAGAGVALSDASHMPFCDYFDADTDTISLIESYLSDNSSGIEPPAAFIVETVQAEGGVNVASKKWLQRLAALAKKVGALLIMDDIQVGCGRTGPFFSFEFAGIKPDIVCLSKSFSGYGLPLAVVLMKPELDAFQPGEHNGTFRGHNPAFVTATAALRNYWQDDQLSLAVNSKAKKIKATLLDLAEAYGADVRGRGLIQGIQFHEEDVSAKISRAAFGRGLIIETAGPNDEVVKTLPPLTIAEDALDNGLKILVDSVREVMGSPRTKKPAQSMASADEVSG

SEQ ID NO: 54090 - protein, 239 aa, Magnaporthe grisea 70-15
MCFGSRNVHDEAGAARSRELDKAIRADEKRLQKEVKLLLLGAGESGKSTVLKQMKLIYAQGFSKNEKIEWKPVVFQNIVQSFRLIHDAMQELDIEFENKENERNITLIMEEQELGAHDALPIEFLDPIKALWVDAGVKKAIAKGNEFALHDNLDYYVPTDQDLLRSRLRTTGITETVFDLGQLTYRMFDVGGQRSERKKWIHCFENVNCLLFLVAISGYDQCLVEDKDGVSLNTASTTL

SEQ ID NO: 54091 - protein, 403 aa, Haemophilus ducreyi 35000HP
MSIEILTPVLPESVADATVATWHKNIGETVKRDEVLVEIETDKVVLEVPAPNDGLLTEIIQPTGSSVVPKQLLGKLSTIQAGDMAQITAKQPPQRQTTEPRTDTHNDIDSQGPSIRRLLAEHNIEAHAIQGSGVDGRITREDIQQFLATQSSQQVASTDLTDSLNTIAYEDRSEKRVPMTRLRKRIAERLLEAKNSTAMLTTFNEVNMQPIMQLRKQYGEKFEKQHGVRLGFMSFYIKAVVEALKRYPEINASIDGEDVIYHNYFDISIAVSTPRGLVTPVIRDCDKLSMAEIEKAIKLFADKGRDGKLTVEELTGGNFTITNGGVFGSLMSTPIINPPQSAILGMHAIKDRPIAMNGEVVIRPMMYLALSYDHRLIDGKESVGFLVSIRDLLEDPTRLLLEI

SEQ ID NO: 54092 - protein, 178 aa, Triticum aestivum
  misc_feature (107)..(107): Xaa can be any naturally occurring amino acid
  misc_feature (138)..(138): Xaa can be any naturally occurring amino acid
  misc_feature (149)..(149): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGXYYDGRYWTMWKLPKFGVATDATQVINKVEEXKKEYPDAFVRXIIGYHNMRQVQCVSFIAFKPPGCEESGKA

SEQ ID NO: 54093 - protein, 401 aa, Arabidopsis thaliana
MEGQTHDAQNNVPEHDNPLMNVKNPSSNLFSKKDAQCLSVLCNGKWLQIVRSSPKVSCEASTCPSHILTKVGENYVAESEKMHKKVISFSSKTFSQGTLQFTMRANGTPHFVFKLENQKDVYVASLSSNVQDQNSYMIHLQRGESSASSSHLVGRINVSTLFSEKVLEREFVLFSSNGENLKIPRTRKNRGLSKKVVHAVKNERRTARLSRTSFIPDLGSWDEQFQAQNYDCLLKNKLPTNLETLAVVVKQETIEDEIGGWGLKFLKRSPMFQRSNDASETETSTSSISMNVVIPSGIHGGPEDGPSSLIERWKSQGNCDCGGWDLCCSLTLLKGQPRKDQYFELFIEGSKHETTGLKIVNVSGGLYLVQFEAKLTSLQSFAIALAFIHSEKLRPLHLYVF

SEQ ID NO: 54094 - protein, 585 aa, Shewanella sp. MR-7
MKFPSLVSLMPGLAQMLQYEKQWLRDDVRAGLSVAAVALPVAIAYAQLTGVNAAVGLYSCVLPMLVYALFGTSRQLIVGPDAATCAVIAAVVTPLAAGDSMKHWQLVMTMTAMTGFWCLIASRFRLGVLADFLSKPILMGLLNGVAITIIVGQFSKIFGFTFDERYLIERLTGAPSYLTKTHWPTLLMGGGTLATYALVKRYRPLWPASMCAMAMAAFLVWAFNLTSFDINVVGEVSAGLPSFQAPAFDLGIARELVVPALNLAMVSFVSMMLTARSFAAKNGYDIDADKEFRALGIANIASALSQGFAVSGADSRTAVNDANGGKSQLVSIIAAVLIALVALFFTAPLKYIPSSALGVVLVIASISLIDLKALWNLRVRDRSAFLLACTTLFSVLFIGVIPGITLAVLLGLFQFLATVMRPTDQVLGLDQKGVIRSVDDSGKAKSVPGVFIYRFNSPLTYFNATYFKRRLLEKFIRESEPVDCIIIDAVPCFTHLDLSVMAMLADLHQLLKKRGIRLVLAGRKRQMLGWFEQAGMQSGEGGILIRPDLYLALKMNQSYKQALAEGQAPVIKKAPEDDVLLHSHL

SEQ ID NO: 54095 - protein, 240 aa, Oryza sativa Japonica Group
MAHGGGEEEEERVLSHGDVVLFRCDLTILRGPHFLNDRIIAFYLAHLAADHDADDDLLLLPPSIPYLLSNLPDPASVAAVADPLRLASRRLVLLPVNDNPDVSHAEGGSHWTLLVLDNSNAVSGPRFVHHDSLPPTNLPFGRRFAAVLRPLLPASAIPLIEGPTPRQTNGYDCGVFVLAVARAICNWWPTRARHSNSDSDWLEAVKREVNADSVKAMRTQLLQLIHTLIQNNTTTNQHSC

SEQ ID NO: 54096 - protein, 164 aa, Zea mays
  misc_feature (103)..(104): Xaa can be any naturally occurring amino acid
MASPSSSPSRKALSKIACSRLQKELAEWQVNPPAGFKHRVTDDLQRWVIDVAGAAGTLYTGETYKLQVDFPEHYPMEAPQVIFLHPAPMHPHIYSNGHICLDXXILYDSWSPAMTVSSICISILSMLSSSPEKQRPADNDRYVKNCRNGRSPKETRWWFHDDTV

SEQ ID NO: 54097 - protein, 166 aa, Actinobacillus pleuropneumoniae serovar 1 str. 4074
MSNIEKQAGELQEKLIAVNRVSKTVKGGRIMSFTALTVVGDGNGRVGFGYGKAREVPAAIQKAMEKARRNMINVALNEGTLQHPVKGSHTGSRVFMQPASEGTGIIAGGAMRAVLEVAGVRNVLSKAYGSTNPINVVRATIDALANMKSPEMVAAKRGKTVEEILG

SEQ ID NO: 54098 - protein, 516 aa, Phanerochaete chrysosporium
MSLHQVYDAVVAHGDMGTLLVYMAYSVPLVMFLYSLFSPASLRHIPTEGGPSFPLLSYKAARAYLRDATGILQRGYDKHKGKPFKVAMPDRWVVVLTGKKLVDELQRLPDDAVSFIKGASDLSGTEHMFGRQVIDDPFHVPIIRTHLTKNLAPMFSDVFDEVSIAFQELIPACDGEWVPVHAIKVARSVVARTSNRIFAGLPICRHPEYLNLVINFTVDVAKGRYALLLFPPALKGIAAKILTNIDGRINEGLKYLGPLIEQRMALAEKFGDDSSEKPDDMLQWIIDEVRARNQSVFEVVRTVLLVNFAAIHTSSSSFTHALYHLAANPEFIASLREEIETIVSEEGWSKAAIGKMWKLDSFMRESQRYNGINSVSVKRKALKPLTLSDGTFIPKGTVLVTPTVATHFDDDNYKNPTVFDPFRYYREKERDMSAVKHQFVTTSPDYVSFGHGKHACPGRFFAANELKAMMAYVVVNYDVKFEKEGVRPENIYAAMGISPDPNARVLFRKRESIVSV

SEQ ID NO: 54099 - protein, 302 aa, marine gamma proteobacterium HTCC2080
MPAGDSPLPADLIPNLLTLLARTSAALVGYYHDAESVTVDRKADRSPVTTADRSAHAALAQGLATLTPDVPFLSEESSTEEIRERRDWRICWMVDPLDGTREFLGRTGEFTINVALIVDHVPILGFIAQPLEHQCYLGIPGSGLWRCTGDDFELLTELNPGLTSGKNVRMSASQRHSPQRVAALIELLSGSGLPVERVNAGSALKFFALVDGRADIYPRSSPCYEWDVAAGDALVRAAGGQVLTAEGLPMAYNHRDTLLVHYFVAAAPSGLLWVPLLEGAHKLFKESRDAHASNVVEGLGNG

SEQ ID NO: 54100 - protein, 485 aa, Leuconostoc mesenteroides
VSEIKTLVTFFGGTGDLAKRKLYPSVFNLYKKGYLQKHFAIVGTARQALNDDEFKQLVRDSIKDFTDDQAQAEAFIEHFSYRAHDVTDAASYAVLKEAIEEAADKFDIDGNRIFYMSVAPRFFGTIAKYLKSEGLLADTGYNRLMIEKPFGTSYDTAAELQNDLENAFDDNQLFRIDHYLGKEMVQNIAALRFGNPIFDAAWNKDYIKNVQVTLSEVLGVEERAGYYDTAGALLDMIQNNTMQIVGWLAMEKPESFTDKDIRAAKNAAFNALKIYDEAEVNKYFVRAQYGAGDSADFKPYLEELDVPADSKNNTFIAGELQFDLPRWEGVPFYVRSGKRLAAKQTRVDIVFKAGTFNFGSEQEAQEAVLSIIIDPKGAIELKLNAKSVEDAFNTRTIDLGWTVSDEDKKNTPEPYERMIHDTMNGDGSNFADWNGVSIAWKFVDAISAVYTADKAPLETYKSGSMGPEASDKLLAANGDAWVFKG

SEQ ID NO: 54101 - protein, 575 aa, Lactobacillus casei subsp. casei ATCC 393
MAEHLKGIAASDGIATAKAYLLVQPDLSFQKKTVDDPSKEIDRLKQSLDQSNDELKVIRAKAAESLGEEEAQVFDAHMMILADPDFTGQVETKIKDEKVNAEQALKEVSEFFIKTFEGMTDNPYMQERAADVRDVTKRIMAHLLGRNLPNPALIDEEVVVVAHDLTPSDTAQLNKKYVKAFVTDIGGRTAHSAIMARSLEIPAVVGTDDITKKANNGDLISVDGLTGEVVVDPTDDEVAKFKQDAEAFAKQKAEWALLKTAKSITADGKHFDVAANIGTPKDLDGVLANGAEGIGLYRTEFLYMDSAELPTEDDQFEAYKKVVETMSPKPVVVRTMDIGGDKHLPYLPLPEEQNPFLGYRAIRISLDRQDIFRTQLRALLRASAFGNLRIMFPMIATIAEFKQARQIFTEEKDKLVKDGVKVSDDIQLGIMIEIPAAAVLADQFAKYVDFFSIGTNDLIQYSMAADRGNEHVSYLYQPYNPSILRLIKHVIDSAHKEGKWAGMCGEAAGDPIMVPLLLGMGLDEYSMSATSVLKVRSLMKKLSTADMAKMDEIALNQNITNDENADLVKKTTGQK

SEQ ID NO: 54102 - protein, 513 aa, Thiobacillus denitrificans ATCC 25259
MKALPVLLIILDGFGCRDERANNAIAQANKPNWDRLWKHHPHTLIHASESEVGLPKGQMGNSEVGHLNIGAGRVVYQEFTRIDRAIESGYFYTNPALLNAVHLARDNGKTLHVLGLLSDGGVHSHELHFHALLDLAAREGLSKVCLHVFLDGRDTPPKSAELYLRRLTDKIAQAGVGHVASMIGRYFAMDRDRRWQRVKSAYDLLTQGAAEFSAGSAQAGLEAAYARGETDEFVKATAIVPADGRPVTMEDGDSVIFLNFRSDRARQLSRPFIEPDFSEFERERTPRLATYCTLTGYSDDFDVSVAFPPERIKNGLGEYVANLGLRQLRIAETEKYPHVTFFFNGGEEVSFPGEDRILVSSPDVATYDLKPEMSAFEVTEKLLAAIGSKQYDLIVCNYANPDMVGHTGNLEAAIKAIETVDTCLGRVVEAQLARGGEVLITADHGNAELMLDAETGQAHTAHTMNLVPVIFVGRRHASLAETGALEDVSPTLLRMMGLPQPPEMSGESLLAFE

SEQ ID NO: 54103 - protein, 297 aa, Acinetobacter sp. ADP1
MIEPKLKIETAQTNPMSIEKNIPDLILHDGHSIPALGFGTYTLKGQQGVDTMLRALGHGYRMLDSAFNYENEGAVGAAVRQSGLLRDEIFITSKLPGRHHAYDKAMETIEESLYRMQFDYLDLYLIHWPNPQQGLYIEAWQALIDAQKKGYIRSIGVSNFLPKHIETLRRETGVIPVINQVELHPYFNQAEQRAYDESQQIITMAWSPLGRAKAILDDAVLKQIAQETSRTVVQVVLRWQVQMGVIPIPKAASDQNQMANQAIFDFSLSDDQVQRINALTCADGRIRNQDPAVYEEF

SEQ ID NO: 54104 - protein, 233 aa, Zea mays
  misc_feature (204)..(204): Xaa can be any naturally occurring amino acid
  misc_feature (206)..(206): Xaa can be any naturally occurring amino acid
  misc_feature (225)..(225): Xaa can be any naturally occurring amino acid
MSGSASRNLFQAGRSFVLSASQRSSSVLAAEGHTAALTNFGRKILPSACSYHRQGSHAASGWGAIAAAVYMLQDQEAHAAEMERTFIPIKPDGVQRGLISEIVNRFERKGYKLVAIKLIVPSKGFAEKHYHDLKERPFFNGLCDFLSSGPVLAMVWEGEGVIKYGRKLIGATDPQKSEPGTIRGDLGVVVGRNIIHGSDGPGEXAXDEIALWFEPKELFSYTSNXENWVLGVN

SEQ ID NO: 54105 - protein, 470 aa, Lactobacillus casei subsp. casei ATCC 393
MYQSKTHNHRFTGHLASAKTRLRLVALISTMGGLLFGYDTGVINGALPFISSELKLAPGSQGWVTSSLTLGAAFGAILVGRLSDRYGRRRLITMLAGLFFLATVASSLSPSAGWLIGARLILGLAVGGVSVLVPSFLAEIAPTSHRGRLVTQNELMVVTGQLLAFVLNAFLGTTFGNVPGIWRWMIVLAVIPAIILGIGTYFVPESPRWLMMKGRPAAARSSLEVLRSAAEVPAEIDHLKQNLAEDAKHKQASVRALKTKWIRRLVLIGIGLGVIQQIAGINVMMYYGTSILQMTGFGRDSALIANIANGVTAVAATIVTLQLLKHVPRRPMLIVGLIGSTVAITGVTFASRLPAGSPFRAFATIGMMMLFLAFFQGAISPMTWLLMSEIFPEQVRGIGMGAATFCLWLANFGVGVLFPIGLAQIGMFWTFVCFIGTNLISLLFVLIFVPETAGRSLETLHREEKARLNH

SEQ ID NO: 54106 - protein, 523 aa, marine gamma proteobacterium HTCC2080
MADFLQPLIIFVALLCGLTSRALGLPALIGYLAAGFVLHEIGIAAGSWLGQLSDLGITLLLFTIGLKLDIKALLKLNVWGTTLIHMAVSQGFLLLLLIGLARAFPVLNLSLAGAALIAFALTFSSTVFVIQTLQERGELQSSHAVLAIGILIVQDLVAVGFLAVTTGEVPSVYALGLFLIIPARPVILKLLSVSGYGELLTLLGLALAIGAAGLSELVGLKGDLGALLIGAMLAGAQKTKALAANLTQLKDLFLVGFFLSIGLGGWPPTILIGVAIILGLASVAKPLLYFFLMTRLHTTPRTAVLASAALSNHSEFGLIVISVAAGLGWIAPVWSSTLSIALAISFLLAAPMSKASHGFYRKHRDQLLGHRSVQLLHTYERTDNINTVILGMGRVGTGAYEALAPRLGEALLGVEASIGKATHHQQEQRRVICADASDPDFWVRINLKEVKVVMLALTNHPENILVAELIRSMGYSGDIASVVRHEEHSAQLNSLGISAFNLYAQAGAGFAAHASTARDPGDQ

SEQ ID NO: 54107 - protein, 136 aa, Triticum aestivum
  misc_feature (86)..(86): Xaa can be any naturally occurring amino acid
  misc_feature (102)..(102): Xaa can be any naturally occurring amino acid
  misc_feature (118)..(118): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLDPSKWXCPCLESSKVGLSSVRXRIPGYYDGRYWHVEVXMFGAPTHQVINRWRQEDT

SEQ ID NO: 54108 - protein, 106 aa, Oryza sativa
RKPKKLPGEVISEEYSLEYGTDKIETHVGAVEPNGRAVVVDDLIATGGTLSAAVKLIERAGAEVVECACVIELPELKGRDKLGNKPVFVLVKADYEACWKQLRYRS

SEQ ID NO: 54109 - protein, 153 aa, Burkholderia thailandensis E264
MSLTVAQILKSKPDSGRTIHMVEKSDSVYNAIKLMAEKSIGALLVMDGANIAGIVTERDYARKVVLLDRSSKATRVEEIMTSKVRYVEPTQTSDECMALMTEHRMRHLPVLDDGKLIGLVSIGDLVKSVIADQQFTIDQLEHYIHGIPAAAHS

SEQ ID NO: 54110 - protein, 329 aa, Thermosynechococcus elongatus BP-1
MSQPTVLCAGEVLFDCLEIPPDPPQCFLGGAPANVACGLVKLGVSAAFLGAVGEDPLGERACAELAALGVNIEAVERVAGLPTRQVRVQLVEGDRQFVGFAPAGTSVFADMQFCGQQVSPLLLTGARFFVTGTLGLASEPTATTIAHLVHQLRQKGTLILIDANWRPIFWSDPRVAPERICPFLAQAHFLKLAKEEAELFFSDSDPQVVYRALWGRAPDHGVVITDGDQAIRYFWHENQGELQPPSMSVVDTTGAGDGFVAGWIAQLLQGTPETYRDPAWQVACLEFATVVGALVTTKRGAIAGQPTLAEVRQWLRDHPQRKIQTHSTG

SEQ ID NO: 54111 - protein, 265 aa, Bacillus cereus G9241
MGNILIDAFLETRAVKPSCLTIINRTPAKAYHIKEKHPSVHIAKTIDEVIERSHLIFICVKPIDIYPILQKYAEHFSDEKCLVSITSPISPSQLETLVPCHVARIIPSITNRALSGASLFTFGSNCSEEWQQKLFGLFKNISTPLVIEEDITRVSSDIASCGPAFFSYLLQCFINAAVDKTNITHEEATTLVSEMVVGMGKLLEKGIFTLPTLQEKVCVKGGVTGEGIRVLEEHVGDMFHKLIERTHEKFDEDLKCVDQQFNKHT

SEQ ID NO: 54112 - protein, 564 aa, Yarrowia lipolytica CLIB122
MIKADNALLLEEPLLRVPYEMLRKNLKTVHKHMTQESTMVEQTLSKLQQSTQHVAAEYGEKQQEEARESLDQLISRVRGLKRKIATLKDEQNETLTTTKARVEHLNVIFDNEKETDPEKQKETEKKWLRTRLERLLTDYFLRQGFSETAKSFAQNRGITSLVDVTILDQCISVETSLRQRHSTAECLAWCSENRSFLRKTRSSLEFEVRLQHYVELVKSGRVEDALKYCQRFLSKNADIHLREIQQAAGLLAFPPGTEGSPYKDLYACERWNQLSRKFVQTFADVHGLSDGSSLLYTLSTGLSVLKTHSCRNFGAPAELPITADKDEDMDPSLTSSARPYARRSENLPSVFGSGFSIRMYGSDEIRGLDTLPVIPPRALANLSSMRRDIAMQNNLDLEESIEDDNEESEERTSGDGERDSDGAVPVEELEELPDAPPELLSAEYLARRIEEATKENTDIIPKTTLDMFNHFYPGCCTSHQLSRADACPVCSVELNSLAENLPYAHHIRSHLDADPVVLPNSRIFGRAKLMEYSHKMMKAAPNTVVDPTSFECFKIDELITAYPS

SEQ ID NO: 54113 - protein, 170 aa, Actinobacillus pleuropneumoniae serovar 1 str. 4074
MKKSLLALVLGATLTLAACDQANQAKDAAAAKMEDAKAATQDAAKAMADKATEMKDAAATKMEDAKAMTQDAAKAMADKATEMKDAAATKMEDAKAATQDAAKAMADKATEMKDAAATKMEDAKAMTQDAAKAMADKATEMKDAAATKMEAGAEAVKEKAAEVKQAVETK

SEQ ID NO: 54114 - protein, 567 aa, Cryptococcus neoformans var. grubii
MDPPHASSIPSSSSSMPTPGSASTSANKPKKFKLDPMSMLLPHERPGYRGSPAACRSMPPIHNQFQLQPQPGSPAYFAMLQSQQVQQDSATQRIGIPTRTAASMGEQGGKRGESSGSQIPTQAPVGSQHPAQGVPLSPPASMSSTPQSGSWEDSASQWSSMEGVVDGKPASGQRSQPSRHYAPRMTQGNMRLEDWEIVETLGTGTFGRVLLVRQRPSYRPTPYHPIFPHLYRSRHPLSPSPSTTQKSDDHLPHFAMKVLRKSEIVRLKQVEHINSERIILERVRHPFIVELHATYQDQINVYMLLFYIPGGELFSHLRRAGRFSADVTRFYLASIVLAIEYLHSRNIIYRDLKPENLLLDRHGYLRIADFGFAKVVQDRTFTLCGTPEYLAPEIVLSQGHGKAVDWWALGILGFEMLAGYPPFFDDHPLGIYEKILRGDIAFPSHIDPFAKDLIRGLLTADRSKRLGNLRGGAKDVMGHPWFAGVDWRSLERKEIGAPIVPRVASMGDSQNFQRYPPPRPQDLPGVFGQTYNTSSDPCGELFTDFSFPRGESERGSASGSAEVLGRQ

SEQ ID NO: 54115 - protein, 305 aa, Pyrobaculum aerophilum str. IM2
MKHLLTLMEFAPHEVEYLLRVSREFKTRFLAGEIYTPLFPGRVLILYFEKHSTRTRLSLTSAAAQLGIQAVYTTPNELQIARGETVADTMRVISRYAAAVAARVYKHETLEEMARHSAIPVINALSDKHHPLQALADALTLWERAGRLHNVKIAFVGDVSNNVATSLAIIGAKLGWEVRLVGPKQLWNQRLVDELAEDAAKTGARIYFTDSINEVAGVDGVYTDVWVSMGFEKEAEERRRLLKPYQVNQRVMEIAGKKAVFLHCLPAHRGEEVTDDVIDGPQSAVWDQAENRMHTAKAVLAYLLK

SEQ ID NO: 54116 - protein, 294 aa, Burkholderia vietnamiensis G4
MTFEQWMRSVLDRVEDALGHYLPADNVVPTQLHEAMRYAVLGGGKRVRPLLCHAAGELTGATEAARNAAAAALEMIHVYSLVHDDMPCMDDDALRRGKPTVHVQYDEPTALLVGDALQSQAFVALTDADALSPVQQAALVRELALASGSIGMAGGQAIDLASVGLKLTREQLETMHRMKTGALLRAAVRMGALAGETPSADAMAALDVYAGAVGLAFQVVDDILDVTTDSATLGKTAGKDAANDKPTYVSILGLDASRELAAQLRAEAHDALKPFGARAQRLAELADLVVNRVS

SEQ ID NO: 54117 - protein, 646 aa, Burkholderia vietnamiensis G4
MRARLISYNGTTMYDLLKTIDDPADLRRLDRRQLQPLADELRAFVLDSVSKTGGHLSSNLGTVELTIALHYVFNTPNDRIVWDVGHQTYPHKILTGRRDQMHTLRQYDGISGFPRRSESEYDTFGTAHSSTSISAALGMAIGSQLNGDDRFSIAVIGDGAMTAGMAFEAMNNAGVSEDAKLLVILNDNDMSISPPVGALNRHLARLMSGRFYAAARAGVERVLSVAPPVLELARKLEEHAKGMVVPATLFEEFGFNYIGPIDGHDLDSLIPTLQNIRELRGPQFLHVVTKKGQGYKLAEADPVLYHGPGKFNPAEGIKPSATPAKKTYTQVFGEWLCDEAERDSRVVGITPAMREGSGMVEFEKRFKDRYYDVGIAEQHAVTFAGGLATEGLKPVVAIYSTFLQRAYDQLIHDVALQNLPVVFAIDRAGLVGADGATHAGAYDLAFMRCIPNMTIMAASDENECRQMLHTALQQPNPTAVRYPRGSGTGVATVKEFTALPIGKGEVRRRSSQPEGKRVAILAFGTMVAPSLAAADELDATVANMRFVKPIDAALVRELAETHDYLVTVEEGCLMGGAGSACVEALMESGVIRPVLQLGLPDQFIDHGDPAKLLSQCGLDSAGIAKSIRERFLSPVADLAGEAKRVA

SEQ ID NO: 54118 - protein, 386 aa, Deinococcus radiodurans R1
MKLHEYQGKEVLRDFGVNVQDGKVATTPEEVQAIYKEYGQPVVVKAQVHVGGRGKAGGVKYSANEDKALENAKNILGMDIKGLTVNKVLVTKAVDIDAGTEYYVGMIVDRNVQSYTLMASAEGGMEIEEVAATNPEKIIRHRVDPVTGLRPYEAREVAIKAGFRGNLNKIADMMVKMSKAALERDAVLVEINPLFVDADGTPIALDTKFEIDDNAMYRHKDLAHYRELSAEHPLEVEASDYGFAYVKLDDGNVGVLGNGAGIVMTTLDVVNRAGAKPANFLDIGGGAKADVVYNAVKLVSKDPDVKAIFINIFGGITRADEVAKGVIRALDEGILTKPVRMRIAGTAEDEAKALLNEKNSDLIKMYPTMFEAANEAAKEANALGGK

SEQ ID NO: 54119 - protein, 567 aa, Shewanella sp. MR-7
MSITGIIVSSGIAFGQALHLTHAEHHLDYRPIPLSRLPQQQTKFVKALQALQQQLNHSQTKLDPQSENYQLIEADLLLLEDEELIAQVKEAIRTLQLSASVAVERVFAHQANELESLDDPYLANRAQDVRCLGQRLVSAINGRLDQGLAQLTEPTILLAQDLTPAEFALLPKEQISGIVLKTGGLTSHTAILARAAGIPAILNCQFDAEFIPNGTPLVLDALSGELFVNPAPEQQARLTVTLHHEQARRAALQTYRDVPAKTQDGHLVGLMANVGNLNDITHVGDVGADGIGLFRTEFMLMHTSTLPDEKAQYNLYCEALHALGGKTFTIRTLDIGADKELPCLCQEVEDNPALGLRGVRYTLAHPELFKTQLRAILRAANHGPIRLMFPMVNQVEELDQLFNLIAECQDALEEEEKGFGELSYGIVVETPAAVMNLASMLPRLDFVSIGTNDLTQYAMAADRANPQLTRDYPSLSPAILRLIKMTIDQAKAAGVKVSLCGELASSPLMVPLLIGMGLDELSVNLSSLLEVKAAVCQGQLAKFSALAHTAMQQNRISELQQCITNYK

SEQ ID NO: 54120 - protein, 339 aa, Coccidioides immitis RS
MAAPFLGQLMSDSVADYIGGTPLVRLNRVPAALGIKAQVYAKLEYFNAGGSVKDRIAKHMIEQAERDGVIKPGDTLIEASSGNTGIAIALMAAIKGYKCIITLSEKMSLEKEQILHALGARVVRTPAGVPIDSPDSIISVAKRLRNEIPRSFILDQYTNPANPAAHEFGTAEEIWHQTQGKVDAVISGAGTGGTVTGIAKGMKKHNPDVFLVGVDPVGSILAIPERLNETKGEYKVEGIGYDFLPDVLDQTAPDLWVKTTDKDSFKLARRLVREEGLLCGGSAGATVAALVQFMEQRPEFNKEEKLIVLILADGLRNYLTKFADDNWMKQNGYAVDAGA

SEQ ID NO: 54121 - protein, 290 aa, Pyrobaculum aerophilum str. IM2
MEIKMAEAGDVALRKYGTAMPQEALRLADAADVIFKGPIGESAYDVTSLIRMRYTLYANIRPVKNLPGVPAVREIDCVFVRENVEDVYVGAEYKVGDVAIALKVITEKGTRRVARMARKYAEMRRRRVTIVHKANVLRVVDGFFRDIALEELKGLEVDQMYVDAAAMELVRNPKRFDVVLTMNQYGDILTDLAAQVAGGIGLAPSGNIGDAKAMFEPVHGAAFDIAGKGVANPIATILSAAMMFEWMGRGDVAEKIRGAVEKSIEAGVKTPDIGGDKSTIEVGKFIASIL

SEQ ID NO: 54122 - protein, 323 aa, Alteromonadales bacterium TW-7
MGLLVNGQWQDKWYDTDSSDGKFEREAAQLRNWITSDGSAGETGEGGFKAEAGRYHLYVSLACPWAHRTLIFRTLKKLDELISVSIVSPDMLANGWEFDQNNHSTGDALFASDYLHQVYTKNNSNYSGRVTVPVLWDKKQNKIVSNESADIIRMFNSAFNEITGNKDDYYPESLRSEIDELNALIYPNINNGVYRAGFATTTHAYEQAFDDVFTALDKVEKILSKKRYLAGDKITEADWRLFTTLIRFDCVYVGHFKCNLRTIESYPSLSGYLRDLYQVEGVANTVDFYHIKRHYYFSHTMINPTQIVPKGPEINYLQAHGRA

SEQ ID NO: 54123 - protein, 421 aa, Nocardia farcinica IFM 10152
MALVVQKYGGSSVASAERIRRVAERIVETKKQGHDVVVVCSAMGDTTDELLDLAEQVAPAPPAREMDMLLTAGERISNALVAMAIHSLGAQARSFTGSQAGVITTGAHGNAKIIDVTPSRLREALDEGTIVLVAGFQGVSQDSKDVTTLGRGGSDTTAVALAAALEADVCEIYTDVDGVFTADPRIVSDAQRLEQVSYEEMLEMAACGSKVLMLRCVEYARRYNVPVHVRSSYTDKPGTYVYGSMEDIPLEKAILTGVAHDRSEAKVTVVGLPDEPGYAAKVFRAVADAEINIDMVLQNISKVETGKTDITFTLPKTEGARAVEMLTKRQGEIGFSQVLYDDHIGKVSLVGAGMKSHPGVTATFCEALADAGINIDLISTSEIRISVLVKDTELDDAVQVLHRAFDLGGDEVAVVHAGTGR

SEQ ID NO: 54124 - protein, 103 aa, Zea mays
NSMLTGSTSALRFGIVLGLALLTLGISSLRSHREGDRRPRLLVKGQAAIFFVIFFREFSVVLQNGWFPKIFIVLLSGVVAAFYFYRIATGNPKDLSSKNDSAN

SEQ ID NO: 54125 - protein, 361 aa, Kluyveromyces lactis NRRL Y-1140
MSKKFASEDGSFKRQVSSFRETISSTHPIYKPEKGRYWLYVSLACPWAHRTLITRVLKGLTSVIGISVVHWHMDEKGWRFLPYNESNKTDGKESYKPSAGLKCEKDLCVSADVDNHSIKYGIDGTIDHNYHFQRISELYFKSEPEYAARFTVPVLWDLKTQTIVNNESSEIIRIFNSGVFNEVADSHPDIDLVPKELESQIDEINSWVYDSINNGVYKTGFAEKQDIYEKEVLNVFKHLDKVEGILKKRYETLKSTHSSEEEIVKKLYLLGDQLTEADLRLYPTIVRFDPVYVQHFKTNLNTIRSGYPYIHLWLRNLYWNYEAFQETTNFNHIKWHYTRSHTKINPLSITPLGPSPNILPL

SEQ ID NO: 54126 - protein, 385 aa, Lentisphaera araneosa HTCC2155
MLIKVSCPACAEVFAADSAECGHSVNCPSCSSEFQIPLQGELEVGNIIDDHIIKEFIGKGSMGFVFLAEHLLMNRQVALKTISPDQLHTEGTVDLFIKEVQNSAALQHPNIVTTYNAGCKNNIFFITMQYVDGHDLSDVVNENKTLDEKGALTLVKEIAQALSYAWNDHNMIHRDIKPENIRCNSKGRYLVMDFGLAMQGGVDDSGYINGTPDFMSPEQATMKEVDFHTDMYSLGLVMIYALSGKRIYQGTPQEVLQMQVSSPIPSLEELAPNKSFSSKIHTIIGKMTAKNPDDRYESWEKLMLLLDKALGSEGSAKAASKPAPEKKKNAIKANKATVQHTAAANKTIRRQNSGLGFAIYTFFCFMVLMCYLYYIGRIPDFLNLL

SEQ ID NO: 54127 - protein, 368 aa, Desulfitobacterium hafniense Y51
MKIKVSRIFLSVTMLIFLSIVGTGCSEAAVPAESSKRFPDNPNLGVSYEGKELQEIWMAGGCFWDVDAYLSRIYGVADVTVGYANGNSENPTYEDVCYRNSGHAETAYVRYDPERVDLETILEYFFKIIDPTSLNRQGNDVGTQYRTGIYYQNEADREIILKVITEEQSKYEKPMVTEVIPLAHFYEAEEYHQDYLVKNPDGYSHIDFSPLEEQKLVNIDPGPYNKPSDDLLRKTLTDLQYAVTQKDATERAFANDYWDHHEQGLYVDVVTGEPLFTSRDKFDSGTGWPSFTRPIASEVIIEKEDSTLGMKRIEVRSRAGDSHLGHLFNDGPPEDGGLRYCINSAALRFIPLSELQAEGYGQYLSRIE

SEQ ID NO: 54128 - protein, 116 aa, Oryza sativa
TIAGIDDVYTSSKGSTKTLGNFAKATFAAITATYSFLTPDLWPEHRLLNHPFAHFSEFLSAPKVEKYHREERDREQRGDRPEGGRGGFRGRRGGFRGGRGGFRGGDRQEAPQTSDE

SEQ ID NO: 54129 - protein, 464 aa, Lentisphaera araneosa HTCC2155
MSLDQVRIAIIGALPEELEKLKPQLGSAKSINHGPFQYEECSYKNINCLLALSGIGKVQAAMLVQHIADIWKPDYFIFTGVAGALNEEYDTGDVVIGTEFIQHDLELNALGFERGEIPYTKEKVFHACDFLCNMAESFHTENHKTFKGRILTGDQFITHEHVKPYFTEELAGDAVEMEGAALAFVASRHKIPFLVIRTISDRADGNAACDFNTLLPLVAENSCYMVKHILDSIVENSEVPQRYDNVLNDIAESAKKHQRDMTDIQLLTVTKNHPADKIFALYKHGQNEFAENRVQELLTKAESLPQDIHWHLIGPLQSNKVRQAVKVAKTIHSVDNTSLAKRIDRIAEEEGKQIDIFIQLNLTGEIQKSGISTLSLEKLLISCSELKNINLIGLMTMGPLSASKEENLKVFKELKEQSVEHSKYFENDVKLSMGMSGDFDEAIECGSHILRIGSAIMGTRTYET

SEQ ID NO: 54130 - protein, 418 aa, Brassica napus
  misc_feature (20)..(21): Xaa can be any naturally occurring amino acid
  misc_feature (102)..(102): Xaa can be any naturally occurring amino acid
LAVHGLGLVNPKKVFNFYNXXHSYLASCGIDGVKVDVQNIIETLGAGLGGRVSLTRSYHQALEASIARNFKDNGCISCMCHNTDGLYSAKQTAIVRASDDYXPRDPASHTIHIASVAYNTLFLGEFMQPDWDMFHSLHPTAEYHAAARAVGGCAIYVSDKPGNHNFDLLRKLVLPDGSVLRARLPGRPTRDCLFADPARDGTSLLKIWNMNKFTGIVGVFNCQGAGWCKDTKKNRIHDTSPGTLTGLVRAEDADLISEVAGPDWSGDSIVYAYKSGELVRLPKGASIPLTLKVLEYELFHISPLKEITASISFAPIGLLDMFNSSGAIQSMEINTVTDDKPEVSSSSVVSENRSPTALISLGVRGCGRFGAYSSQRPLRCAVDGTETVFNYDAEVGLVTLNLPVTREEMFRWRVEILV

SEQ ID NO: 54131 - protein, 576 aa, Zea mays
MGGGGAIVHGFRRWFHRRSGSTSNQSSIAGDGEGEADGGSPDLEIVDDPDLLGLRAIRVPKRKMPLPVESHRKDSVEMEFFTEYGEASQYQIQEVIGKGSYGVVAAAVDTRTGERVAIKKINDVFEHVSDATRILREIKLLRLLRHPDIVEIKHIMLPPSRREFQDIYVVFELMESDLHQVIKANDDLTPEHHQFFLYQLLRALKYIHAANVFHRDLKPKNILANSDCKLKICDFGLARASFNDAPSAIFWTDYVATRWYRAPELCGSFFSKYTPAIDIWSIGCIFAELLTGRPLFPGKNVVHQLDIITDLLGTPSSETLSRIRNEKARRYLSCMRKKYPVPFTHKFRNADPLALRLLERLLAFDPKDRPTAEEALADPYFASLANVEREPSRHPISKLEFEFERRKLAKDDVRELIYREILEYHPQMLEEHMQGGEQISFLYPSGVDRFKRQFAHLEEHYSKGERGSPLQRKHASLPRERVVVSKDGDTDQHINDQERSADSVARTTVSPPRSEDDDMSDVKSTSLSSRSYLKSASISASKCVVATKKHPEDDGIAEEMEGAVNGLSEKVSRMHS

SEQ ID NO: 54132 - protein, 415 aa, Nocardia farcinica IFM 10152
MTSADPGNALHRRLGLTDSVVIGLGSMVGAGIFAALAPAAAAAGSWLLLALGVAALLAYCNAMSSARLAARYPVSGGTYVYGRERLGPFWGYLAGWGFVVGKTASCAAMALTVGHYAWPEHARWVAVATVVAITAVNYTGVQKSALATRIIVGAVLTVLVVVVVVAFSGSHSAAAPMPGRIGPGDVLQAAGLLFFAFAGYARIATLGEEVREPHRTIPRAIRLALGLALAVYALVAVAALLTLGSQGLATAVDPLARVVAAAGAGWLTPLVRAGAVLAAAGSLLALILGVSRTTLAMARDGHLPSPLATVHPRFGVPHRAELAVGAVVAVVAATADLRSAIGFSSFTVLVYYLVANLSAGTLGAGEGRPARWIPVVGAAGCVIVGFALPIGSVLAGLAVLALGAGWYAVRSARLA

SEQ ID NO: 54133 - protein, 435 aa, Arabidopsis thaliana
MSKPEETSDPNPTGPDPSRSSSDEVTVTVADRAPSDLNHVSEELSDQLRNVGLDDSAKELSVPISVPQGNVETDSRALFGSDQKEEEEGSEKRMMMVYPVKPDSEDCSFYMRTGSCKYGSSCKFNHPVRRKLQIGRERVRERDEDVENPKLMECKYYFRTGGCKYGESCRFSHMKEHNSPASVPELNFLGLPIRPGEKECPFYMRNGSCKFGSDCKFNHPDPTAIGGVDSPLYRGNNGGSFSPKAPSQASSTSWSSTRHMNGTGTAPFIPSMFPHSRGVTPQASDWNGYQASSAYPPERSPLAPSSYQVNNSLAETSSFSQYQHQMSVEEFPERPDQPECTYYLKTGDCKFKYKCKYHHPKNRLPKQAAFSFNDKGLPLRPDQSMCTHYSRYGICKFGPACRFDHSIPPTFSPSSSQTVEARQVGANGNEDDSWH

SEQ ID NO: 54134 - protein, 1081 aa, Triticum aestivum
  misc_feature (724)..(724): Xaa can be any naturally occurring amino acid
MDGDADALKSGRHGAGDVCQICADGLGTTVDGEVFTACDVCRFPVCRPCYEHERKEGTQACLQCKTKYKRHRGSPPIRGEEGDDTDADDGSDFNYPASGTEDQKQKIADRMRSWRMNTGGSGNVGHPKYDSGEIGLSKYDSGEIPRGYVPSVTNSQMSGEIPGASPDHHMMSPTGNISRRAPFPYVNHSPNPSREFSGSIGNVAWKERVDGWKMKQDKGAIPMTNGTSIAPSEGRAATDIDASTEYNMEDALLNDETRQPLSRKVPIASSKINPYRMVIVLRLVVLSIFLHYRLTNPVRNAYPLWLLSVICEIWFALSWILDQFPKWFPINRETYLDRLALRYDREGEPSQLAAVDIFVSTVDPLKEPPIVTANTVLSILAVDYPVDKVSCYVSDDGASMLTFDALAETSEFARKWVPFVKKYDIEPRAPEFYFCQKIDYLKDKVQPSFVKDRRAMKREYEEFKIRINALVSKALKVPEEGWIMQDGTPWPGNNTRDHPGMIQVFLGHSGGLDTEGNELPRLVYVSREKRPGFQHHKKAGAMNALVRVSAVLTNGQYMLNLDCDHYINNSKAVREAMCFLMDPNLGPQVCYVQFPQRFDGIDRNDRYANRNTVFFDINLRGLDGIQGPVYVGTGCVFNRTAIYGYEPPIKAKKPGFLASLCGGKKKTSKSKKRSSDKKKSNKHVDSSVPVFNLEDIEEGVEGAGFDDEKSVLMSQMSLEKRFGXQSAAFVASTLMEYGGVPQSSTPESLLKEAIHVISCGYEDKSEWGTEIGWIYGSVTEDILTGFKMHARGWRSVYCMPKRPAFKGSAPINLSDRLNQVLRWALGSVEILFSRHCPLWYGYGGRLKFLERFAYINTTIYPLTSLPLLVYCILPAICLLTGKFIMPEISNLASIWFIALFLSIFATGILEMRWSGVGIDEWWRNEQFWVIGGISAHLFAVFQGLLKVLAGIDTNFTVTSKANDEEGDFAELYMFKWTTLLIPPTTILIINMVGVVAGTSYAINSGYQSWGPLFGKLFFAFWVIVHLYPFLKGLMGRQNRTPTIVIVWAVLLASIFSLLWVRVDPFTTRLAGPNIQTCGINC

SEQ ID NO: 54135 - protein, 444 aa, Burkholderia thailandensis E264
MQDIDEFLKKHRITEIEAIIPDMAGIARGKIIPRSKFETGESMRLPQAVMIQTVTGDYPEDGSLTGVTDPDMVCLPDASTIRLIPWAIDPTAQVIHDCVHFDGTPVEISPRRVLRRVLELYKAKGWKPVIAPELEFYLVDMNKDPDLPLAPPIGRTGRPETGRQSYSIEAVNEFDPLFEDIYEYCEVQDLEVDTLIHEVGAAQMEINFLHGDPLNLADRVFLFKRTVREAALRHHMYATFMAKPMENEPGSAMHVHQSIVDEETGRNLFTSNDGGPTDMFYAYIAGLQKYTPALMPIFAPYINSYRRLSRFMAAPINVQWGYDNRTVGFRIPHSSSASRRVENRIPGVDCNPYLAIAATLAAGYVGMTQRLVPTEPLVSDGYSLPYQLPRNLEEGLTLMAACEPIAQILGEKFVTAYLALKETEYEAFFRVISSWERKHLLLHV

SEQ ID NO: 54136 - protein, 282 aa, Oryza sativa Japonica Group
MSKEVSEEPEHVRPKDYTDPPPAPLFDVGELRLWSFYRALIAEFIATLLFLYITVATVIGYKVQSSADQCGGVGTLGIAWAFGGMIFILVYCTAGISGGHINPAVTFGLLLARKVSVIRAVMYIVAQCLGGIVGVGIVKGIMKHQYNANGGGANMVASGYSTGTALGAEIIGTFVLVYTVFSATDPKRNARDSHVPVLAPLPIGFAVFMVHLATIPITGTGINPARSIGAAVIYNQKKAWDDHWIFWAGPFIGALAAAAYHQYILRAAAIKALGSFRSNPSN

SEQ ID NO: 54137 - protein, 328 aa, Thiobacillus denitrificans ATCC 25259
MKLTVLGAGAWGTALAASWASQHAVTLWGRNARDVDTMRASRVNTHYLPGCPLPSSLALSADFDRALEAAELIVIAVPSSGLRATLAALARRPALPPILWVCKGFEPGTRRLPHQLVAELLPAGAETGVLSGPSFAQEVAHGYPTALTLASADIALAQRLAEALSGNRLRLYAHDDVVGVEIGGALKNVMAIAAGICDGLNFGHNARAALITRGLAEMTRLGVDSGGRFETFMGLSGLGDLILTTTGDLSRNRQVGLRVAKGQPLDRILDELGHVAEGVTTAREVAALAAERGVEMPIARMVCRILFEGLPASEAVDSLLNREIRSEF

SEQ ID NO: 54138 - protein, 453 aa, uncultured bacterium
MSFVAWVAVLGAVLLTLALTSSYLRWMPVTTSAVCLVLGVAIGPTGLGLLRLDIKGAAFWMEHLTEVAVLFSLFVCGLKLRLPLKDRQWRVAFGLAGPVMVLTIVGVCLLLHFCFGLDWGPSLLIGAILAPTDPVLASLVQVNDAKDYDPVRFGLTGEAGLNDGIAFPFVILALLFLQQSGDSTAWLDEWALKRLLWAVPAGLLTGYWMGRSIGRLTLTMRIKNADSTFSPNDYLALALIALAYVAAESIHGYGFLSVFAAGLGLRQAEVNTSGDSHTPAEHLVQPIVGHQNVEPHAAVHGNVEHLEDTQVAAGIMMGDMLSFGSLVERSMEVFLVTLLGVVLTAHWDWRALVVSLVLFGAIRPLSVGLVPWGRLLDGPQRMLIGWFGIRGIGSFYYLFYALNHDLLPEVATVCADLTLSVVALSILVHGISTQPMLARYEQHNRRATSSPRR

SEQ ID NO: 54139 - protein, 629 aa, Thermosynechococcus elongatus BP-1
MEAAMESSAELTALFVITVVLGIGAQVAAHWLRLPSIVLLLLVGILSGPSGLGWVHPEVLGEGIEVLVPLCVALILFEGGLSLDLSRADQDITGSLWKLVTLGGLVTFVAGAMAAHWIGEFPWQLAFLYASLVVVTGPTVVGPLLRQVGVEHKLAVILEGEGVLIDPIGAILAVVVLNVVLNQDLGMGAIALGIGQRLAVGALMGGIGGWFLSHFLRRAWFLADDLRNLLVLAVLWGLFWLSDQLVSESGLMMAVVLGLVLRWGEVPGERLLRRFKGQLSTLSISVLFVLLAADLSIAGLLELGWSGVLTVLCLMFIIRPLGVVLCTWGSDLSWQQKAFLSWIAPRGIVAASVASLFAITLTNAGMSGGDAIKGQVFLTILMTVFGQGLTARWVATQLQVRAQGASGVMIAGCTPLGRLLARLLRDRGEEVVMIDTDPEAVEQARREHLPVYLSSALDLNILQEAGITQLGTYLAVTSNTEVNAVLAQRVLEEFHPPRVLAALELEDCPLGLSPAFALQLSIKKWNQYINTEAVRLGELVIEEERSQLQRQHLEALIRSGKVLPLLVERPEGLRVVRAHEEWQVGDRLIYLLHSPKPHTLPAALISGWQMNTQVESVLVPSEAPSPKGT

SEQ ID NO: 54140 - protein, 398 aa, Prochlorococcus marinus str. MIT 9313
MATSRRLGRLGRGVFDRNDRRKQAYRLANAGPQSLPLLDLSLGSTDLSPPAVALEAIEVALRAPESSSYCLHASTRPFREAVAAWSQRRFGVSVDPDREVLLLVGSQEGTAHLPLAVLDPGDSALILDPAYPSHRGGLILADARIERLLLRPEQEWRPDFKALSNSQWDQLRMMVFGFPHNPTAQVGEQSWLAEAMDRGIRHQVVVAHDNPYVDLALDGEAPALLRCPGWRECGIEFFSFSKAWCLGGFRLAFAIGAEHLITALRELKGVVDFNQSLALQRGAIAALTDAQDWPQEILGVYRERRDRTLAALHALGWHAPCPSMALYLWLPIPAWAKQQNYNDETLAADLLDQTGVALTPGSGFGSGGDGWLRLALVHPVEDLEAAVARMWPWWHAHI

SEQ ID NO: 54141 - protein, 462 aa, Thermosynechococcus elongatus BP-1
MVKLTPTPAYSLTLRLETSLDPTELGTVLQIIGGQQGQVGSIRLLEKTANRILRELVVVAASQEHGQAIVNAVKSDGQATVLEVSDRTFRLHEGGKITIKSKHPLQEYDDLAMAYTPGVGRVSQAIADDPDLVHKLTIKSHTVAIVSDGSAVLGLGNIGPEAALPVMEGKAMLFQEFAGLDAFPICLATQEVDEIVATVKRIAPVFGGINLEDISAPRCFDIEARLQAELDIPVFHDDQHGTAIVTLAALKNALQFVGKSLETVRIVINGAGAAGIAVARLLRKAGAKDLILCNRRGILSLQTDLTPAQKEFAVTQTGTLADALGDADVFIGLSAPGVLTVEMVQRMAKEAIVFAMANPVPEIQPELIYNHVAVVATGRSDYPNQINNVLAFPGVFKGTLACRAPRMTEEMFLAAAEAIAGLVSPSERHSAYIVPSVFDPRVAPAVAKAVEDCARSLGLARA

SEQ ID NO: 54142 - protein, 415 aa, Pyrobaculum aerophilum str. IM2
MQSESGFLAYVLAQLKRSVELGGFPEDFYAMISRPKRILHVYIPVKMDSGRIEVFEGYRVQHNDALGPFKGGIRFHPEVTLADDVALAILMTLKNSLAGLPYGGAKGAVRVDPKRLSQRELEELSRGYARAIAPLIGDLVDIPAPDVGTNSQIMAWMVDEYSKIAGRNAPAVFTSKPPELWGNPVREYATGFGVAVVAREMAKRLWDGIEGKTAAIHGAGNTGAWAAYWLEKMGVKIVAVSSTKGTVYNKAGIPAAEILRYYKREIPFEKIPGEFIKDPEASLNVEADLLVPAAIENVIRSDNAGQVKARLVVEGANGPTTPEAERVLYQRGVVVVPDILANAGGVIMSYLEWVENLQWLSWDEEETRKRLEAIMVNNVARVYQRWQKEKWTMRDAAIVTALERIYKAMKLRGWI

SEQ ID NO: 54143 - protein, 188 aa, Zea mays
  misc_feature (33)..(33): Xaa can be any naturally occurring amino acid
  misc_feature (46)..(46): Xaa can be any naturally occurring amino acid
  misc_feature (65)..(65): Xaa can be any naturally occurring amino acid
  misc_feature (86)..(86): Xaa can be any naturally occurring amino acid
  misc_feature (161)..(161): Xaa can be any naturally occurring amino acid
  misc_feature (167)..(167): Xaa can be any naturally occurring amino acid
TSSPPTTGRRHTKGETKDDDKVCALYDSTISPXAGDDVVGQQSSAXIFKIMRGCDNQALPMKQAXGLSSGRARLLLHRGTPCFRGXACANGERTQEFVSGFIVRQDLSVIDLVIDENGQNGVRGLTDTEKPNMRVPDRASEIDMLFNLGKDDDVRNYVNTXRRTFLXQKGSKVSPAPHIQRLETPMTL

SEQ ID NO: 54144 - protein, 557 aa, Zea mays
  misc_feature (210)..(212): Xaa can be any naturally occurring amino acid
MAIPVRSAAAPRRLVPSIPPASSGHVRGLACFGTRTGPRGARGLSMVVADSTSRRAKQADGGDGVLGAPVLGGLGMEGLGDQLSVVMKFGGSSVSSAARMAEVAGLILTFPEERPVVVLSAMGKTTNNLLLAGEKAVGCGVIHVSEIEEWNMVKSLHIKTVDELGLPRSVIQDMLDELEQLLKGIAMMKELTPRTSDYLVSFGECMSTRXXXAYLNKIRVKARQYDAFDIGFITTDEFGNADILEATYPAVAKRLHGDWIQDPAIPVVTGFLGKGWKSGAVTTLGRGGSDLTATTIGKALGLREIQVWKDVDGVLTCDPNIYPHAKTVPYLTFEEATELAYFGAQVLHPQSMRPAREGDIPVRVKNSYNPKAPGTLITRQRDMDKVVLTSIVLKSNVTMLDIVSTRMLGQYGFLARVFAIFEDLCISVDCVATSEVSVSVSLDPSKIWSRELIQQASELDHVVEELEKIAIVRLLQQRAIISLIGNVEQSSLILEKTGRVLRKSGVNVQMISQGASKVNMSLIVHDSDAKALVEALHQAFFEDDVLSQVEAENLLVG

SEQ ID NO: 54145 - protein, 567 aa, Zea mays
MATRPALVFVCCCLLLAYAAAARVLDEGEPFGRLKNAARRLRDGEPFGGRKDPADPDHSPGSHRTPPCPPSIGTSPTTPTTPGGGGSYYPPSPDIGTSPTTPTAPGGSGGYDAPPSPSSDTSPTTPGGGYYGPPSPSSDTSPATPPGGGGGGGYSAPPSPSSDTSPSTPGSGGGCSVPPSPSSDTSPSTPGGGGGYYGPPSPSSDTSPTTPGGGGTGGCGAPPSPSSGSSPSTPGGGGGYYGPPSPSSDTSPTPPPGGGGGGYSAPPSPSSDTSPSTPGGSDGRCSTPPPSSSGISPSTPGGGGTGGCSAPPSPSSDTSPSTPGGGGGYYGPPSPSSDTSPTTPSAPSGGYYGPPSPSSDTSPTTPGGGGYYGPPSPSSDTSPTTPGGSGGGYYGPPSPSSETSPTTPGGDGGYTPTPQVPLPPISTSPPFSPLTPTPTTPTPYDPNTPPFTGPCTYWMMHPGVIWGLFGFWCPLVRLFGPSAAVPFGHDLTVPEALANTREDGVGALYREGTASLLNSMVNNRFPFTTQEVKDAFGAALNSGDDGAAAAQARLFKKANEGHVIRQN

SEQ ID NO: 54146 - protein, 302 aa, Streptococcus sobrinus
LDSQKEICVLGGSKIGLVELPWALMNPGDLLLLPDPGYPDYLSGVALGRVDYETFPLLAENDFLPDLAAIPEEIARRAKFIYINYPNNPTGRVATSDFYQDLVAWAKKYQVGVVSDFAYVPWATRAMKILAFCLHRGPRRSVLNSIPSPRPLTWPAGRLAFAAGNADMIEALNLIQDHLFVSIFPAIQDAGVAALLDPQAKEAIVQLNQIYDQRREAFVQASAKIGWQAFPSKGSFYAWMPVPRGYTSQSFADLLLEKAHVAVAPGVGFGQAGDGYVRIGLLVEPERLAEAVERIGALNLFG

SEQ ID NO: 54147 - protein, 408 aa, Clostridium acetobutylicum ATCC 824
MNNKYIKDFPTLDQEFNGHKFVYLDNAATTQKPLSVINAVNDYYRKSNANPHRGAYALSVKATDLYEGARDVVKDFINANKSKEIVFVRNATEALNLVAYSYGLNFINAGDEIVISIAEHHSNLVPWQQVAKAKGAVLKYLYLNEDGIIPHEEFESKITSKTKIVSVTHVSNVLGTINPVNDIIKKAHSVGAIAILDAAQSIPHMEVDVKALDADFVVFSGHKMLAPMGIGVLYGKEALLEKMPPFMFGGDMIEYVWEQKTTFAEVPHKFEGGTQNVGGAVGLTAAIEYLNKVGLDKVYAIEKELTAYALERLSELPYVKVYGTKDASKKAGVISFNVDDVHPHDVATILDSYGVAIRTGHHCANPLMRYMDVNATCRASFYFYNTREDVDALVEGLKNTRKWLGYGS

SEQ ID NO: 54148 - protein, 112 aa, Zea mays
QLSRPGWGPLLPAPLTWFPMESPTLWLPPVVLLRWPPAAFSGPLDTLPAALYAFHYVHRTLVHPVRLARLRRAPAPVPLLIDACALGFNILNAYLHARSFALHSSRQASTFR

SEQ ID NO: 54149 - protein, 146 aa, Picea sitchensis
MAATAVFSTTTSVSAFLLNRSLGSAAASRPSSLSVVGLPALDKRCTVCYAQKQEEIVRAKENSQNCMVSLGGAAPLMAVAAALTVSTKEAFALVDERLSTEGTGLGLGLSNPLLGWILVGVFTLIWILYFTTYSNVKEDEDSGLSL

SEQ ID NO: 54150 - protein, 205 aa, Pseudoalteromonas tunicata D2
MFNSVTDPLNALVPMVVEQTAKGERSYDIYSRLLKERVIFLTGQVEDHMANLIVAQLLFLESENPEKDIFIYINSPGGSVTAGMAIYDTMNFIKPNVSTVCMGQAASMGAFLLSGGTKGKRFCLPNSRVMIHQPLGGFQGQASDFEIHAREILSIKDKLNRLLAEHTGQPIEVISRDTDRDNFMSGAQAVEYGIVDAVLTQRDLK

SEQ ID NO: 54151 - protein, 574 aa, Thiobacillus denitrificans ATCC 25259
MSFSMHGIGVSGGIAIGYAHLASSARVEVPQYMLDHKYIKDELARFDEAILATRAELETLRSHIPANAPAELSAFLDMHLMFLGDSMIAEQPKRLIRETQCNAEWALAQQMEALVARFDEIDDPYLRSRQEDVVQVVQRVLKALMGHPSHLPLDVDFDSERILVAHELSPADMVIFKNVHFAAFVTDLGGTTSHTAILARSMGMPSVMALHNARGLIRDHDLLIVDGREGVVIVNPDESVLAEYRLRQNQWRIDTDKLKRLKTSKSATLDGTPVELMANIELLSDIDAVKAAGAHGIGLFRSEFLFLNRSDLPTEEEQYESYKAVAEALDGKPVTIRTLDLGADKQAPWGHTVADNPALGLRAIRLCLAEPGLFHTQLRAILRASAHGRVRMLIPMLANFVELRQTLQRIDEAKDSLRRDGLAFDEGIPVGGMVEVPAAALAASFFADQLDFLSIGTNDLIQYTLAIDRADDSVAHLYDPLHPAVLGLIQQTIRAGAKAGKPVAVCGEMAGDPLLTRLLLGLGLRTFSMHPASLLQVKQQILRSHLAELPALTQRLLKNTDPDRTLTLLGRLNG

SEQ ID NO: 54152 - protein, 132 aa, Triticum aestivum
MATYYPSGASALLLPVPRTRAAFPQRFPGPASGRSSPCAAVRPQRRGRGAVGVVRACFNPFGDERILREALKEPVAFMGGVFAGLLRLDLNEDPLKEWVTRTVEASGIAEENSAEESNEGAQNDGPQQIEIE

SEQ ID NO: 54153 - protein, 273 aa, Panax ginseng
PYYVAPEVLLKHYGPEADVWTAGVILYILLGGVPPFWAETQQGIFDAVLKGHIDFESDPWPLISDSAKDLIRKMLCSRPSDRLTAHEVLCHPWICENGVAPDRALDPAVLSRLKQFSAMNKLKKMALRVIAESLSEEEIAGLKEMFKAMDTDNSGAITFDELKAGLRKYGSTLKDTEIRDLMDAADVDNSGTIDYGEFVAATIHLNKLEREEHLMAAFQYFDKDGSGYITVDELQQACAEHNMTDVFLEDIIREVDQDNDGRIDYGEFVAMMK

SEQ ID NO: 54154 - protein, 271 aa, Thiobacillus denitrificans ATCC 25259
MHKVSFIGGGNVAAAIIGGLVASGTAPTDIEVVEINADARDKLATRFGVVTHTDLSQARLHALVVLAVKPQTLPEVAAALAQRLSGQLVVSIAAGVRVADLARWLGGHARIVRAMPNTPALVQAGITGLFAPDAVSQESRSQAESVLRAVGGVVWVDDEPQLDAVTAVSGSGPAYVFYFIESLEAAAEAQGLAPGVARQLALQTFFGATKLALESGEEPALLRQRVTSKGGTTERGLAALDAAGVKQAVGQAVDAASRRGAELGDELGRLA

SEQ ID NO: 54155 - protein, 246 aa, Thiobacillus denitrificans ATCC 25259
MNNGPFPSELEPAAGPGADSATARLQGVRGRIAAAAARAGRDPASVELLAVSKAFGAAAVRALAGAGQRAFGENYLQEALVKQAALADLALDWHFIGPIQSNKTRPIAENFGWVHSVDRLKIAQRLSAQRPLGLPPLNVCIEVNVSGEASKGGASPDALPELVEAVARLPGLRLRGMMTIPAPTHDFDAQRAAFRRLRELFDGLRERHALDTMSMGMSADLEAAILEGATIVRVGTALFGERKYPR

SEQ ID NO: 54156 - protein, 387 aa, Zea mays
  misc_feature (135)..(135): Xaa can be any naturally occurring amino acid
HFPIYRRKLCILKGVFPRQPKKKVEGNHKTYYHTKDIAFLAHDPLIEKFREIKVHRRKVKKAVAKKNRDLADRLLNRPPTYKLDRLVLERYPTFVDALRDLDDCLTMVHLFAALPAVDGERVEVKRIHNCRRFIXSYMSHPKLSHECLTFISVKGIYYQAEVQGQKITWLTPHALQQVLTDDVDFNVMLSFLEFYETLLGFVNFKIYHSINVNYPPILDPRLEALAVELYALCRYMSAGSRRMIGNSQTDEVMEDKDEKSKAEEVIEEEKVVKNKASSKADESEFRLAQLQHQLPTNEPGALMNLVEESTADDADDDDTKDCKGLFKNLKFYLSREVPRESLLFIIPAFGGTVSWEGEGAPFKEIDEDITHQVDSICNNLLHQSLTI

SEQ ID NO: 54157 - protein, 511 aa, Bradyrhizobium sp. BTAi1
MIATSHPQAALAGIEVLRAGGTAADAAVAACALLGVIEPQSTGIGGDCFALVQPKGEGRITAYNGSGRAPMAATVDWYLERKIHSVPLTSAHAVSVPGAIDAWDRILRDHGRLGLDRLLQPAIRAAEDGYVVAPRVAFDWNNQFEKLRNGTNTARYFLPHGKVAAVGDVIRQPELAQTLRIIAKEGPKGFYTGAVAEDMVQTLRGIGGLHTLEDFANHQTEVTAPIGTSYKDYDVWQCPPNGPGITMLVMLNILSRFDLTRIAPLSVERFHLEAEAARIAYMMREQHIGDPAHMTTEVASILAKEFADEYISQISLDKLLDLPNVAPPMNPETVYITVVDRDRNVCSFINSIAHSFGSAIVSNETGVLLQNRAGGFRIQPDHPNCIGPGKRPLHTIIPALATKAGRAQMSFGVMGGQYQPVGQTHVLTNILDYGCDVQEAIDMARGLHYEGVYQLEDGVPADVVEGLQKIGHKTSKVVSPLGGGQAIWIDWDKGTLTGGSDPRKDGCALGY

SEQ ID NO: 54158 - protein, 176 aa, Prochlorococcus marinus str. MIT 9313
MIPGLQPISLQELKALAAPRHWSIEGHLDEMASLTPLRGSISAEHQGSILEVKGKFQTIVTLCCDRCLSEFNQTLACNTEELIWLKGNGPKPNELNGSSHSEDMDALMECLDPLGSFDPERWVFEQLSLQMPLVKRCGADCPGPAQQQPSAQTTAVKPEGTDLDPRWAALQKLTSP

SEQ ID NO: 54159 - protein, 126 aa, Triticum aestivum
  misc_feature (24)..(24): Xaa can be any naturally occurring amino acid
  misc_feature (36)..(36): Xaa can be any naturally occurring amino acid
  misc_feature (38)..(38): Xaa can be any naturally occurring amino acid
  misc_feature (46)..(46): Xaa can be any naturally occurring amino acid
  misc_feature (50)..(50): Xaa can be any naturally occurring amino acid
  misc_feature (59)..(59): Xaa can be any naturally occurring amino acid
  misc_feature (68)..(68): Xaa can be any naturally occurring amino acid
  misc_feature (85)..(85): Xaa can be any naturally occurring amino acid
  misc_feature (91)..(91): Xaa can be any naturally occurring amino acid
  misc_feature (94)..(94): Xaa can be any naturally occurring amino acid
  misc_feature (96)..(96): Xaa can be any naturally occurring amino acid
  misc_feature (101)..(102): Xaa can be any naturally occurring amino acid
MGPTVMASSATSVAPFQGLKSTAXGLPVSRRSNGAXLXSVSNGGRXRCMXVWPIEGIKXFETLSYLPXFSTEALLKQVYYLIRSXWVPCLXFSXVXFIFRXXNASPVYYGRYWTMWKPMCDLHNEV

SEQ ID NO: 54160 - protein, 197 aa, Thermosynechococcus elongatus BP-1
MSECLRVGQPAPDFEAVAVYDQEFKTIKLSDYRGKYVVLFFYPLDFTFVCPTEIVAFSDRYDEFAKLNTEILGVSVDSQFSHLAWTQTDRKAGGVGDLKYPLVSDLKKDISTAYNVLTEEGVALRGLFIIDKEGIIQHATINNLAFGRSVDETLRVLQAIQYVQTHPDEVCPAGWHPGDKTMNPDPVKSKVYFEAVG

SEQ ID NO: 54161 - protein, 451 aa, Haemophilus ducreyi 35000HP
MSHFSVAKFGGTSVADFNAMNACANIVVKDNHTRVVVLSASAGITNYLVELANGCAPLRRVEILQNVRSVQYNIIQQLQQPEAISAEIDRLLQHISVLAESASVTTSATLTDELIAHGELMSSKIFTQLLIEREIPAIWVDVRDVIATNSHHGKATPDDKKTQQQADAIVKPLLEANKIIITQGFIARDQQGNTTTLGRGGSDYSAALLAEVLSAKDVLIWTDVPGIYTTDPRIVPNAQRIATIAFNEAAEMATFGAKVLHPATLLPAVRSNIPVYVGSSKAPEQGGTWVTRDPTCRPIFRAIALRRNQTLVTLSSLAMLHAQEFLASVFSILAKYQVSVDIITTSEVSITLTLDKTDSTASTAQILSDALVHELSQFCHIKIENDLSLLAIIGNDLHLQQGIAKELFQTIEPFNIRLINYGASTNNIYMLVKNSDADHILLALHYDLFES

SEQ ID NO: 54162 - protein, 284 aa, Jacobaea maritima
PKSQITPYRVVIIVRLVILGLFFHYRITNPVESSYGLWLTSVICEIWFAISWVLDQFPKWYPINRITFTDELSARFEKEGEPSQLAAVDFFVSTVDPLKEPPLITANTVLSILAVDYPADKVSCYVSDDGAAMLSFESLVETAEFARKWVPFCKKFSIEPRAPEFYFSQKIDYLKDKVQPSFVKERRAMKRDYEEYKVRVNALVAKAQKTPEEGWTMQDGTPWPGNNTRDHPGMIQVFLGNSGAHDIEGNELPRLVYVSREKRPGYQHHKKAGAENALVRVSAV

SEQ ID NO: 54163 - protein, 406 aa, Coccidioides immitis RS
MAARSFPTSGFEQLDPTDPIEEELLPGYKPEQFYPANIGEVFNGRYQALCKIGYGTTSTVWLARDLQTSEGPSAYVSLKIYTNGYVRGDELAVLQHINTVSAETTHPGHQDIRKLLASFEIKGPHGVHMCLVQQALGMSLHGLLQFIPTRSLSLELLKPFLRQCLFGLDFLHTTAGIIHTDLQPKNLLFPVDSPLIFSDLEEDEIKNPSARKVLSDRVIYQTKELPRPRRGFPLICDFGEARFMNKDGHPHTDDIMPDLLRPPEVVMRMAWDEKVDIWSIAPLTWHLVSPRPLFDRRNPETGEPDDRFMIAHLGALLGPPPPEFRRRSAVCQSFWDENGKWTDAVPMPELTLEDLSTGIIGENKAGYLQFLRRILRWLPEERPTVRELIVDPWLMEGLGGKKAAGG

SEQ ID NO: 54164 - protein, 284 aa, Echinacea angustifolia
PKSQITPYRVVIIIRLVILGLFFHYRITNPVESSYGLWLTSVICEIWFAISWVLDQFPKWYPINRVTFTDELSARFEKEGEPSQLAAVDFFVSTVDPLKEPPLITANTVLSILAVDYPVDKVSCYVSDDGAAMLPFESLVETAEFARRWVPFCKKFSIEPRAPEFYFSQKIDYLKDKVQPSFVKERRAMKRDYEEYKVRVNALVAKALKTPEEGWTMQDGTPWPGNNTRDHPGMIQVFLGSSGAVDIEGNELPRLVYVSREKRPGYQHHKKAGAENALVRVSAV

SEQ ID NO: 54165 - protein, 149 aa, Lentisphaera araneosa HTCC2155
MIRVDFLVIGKTKEKWIQTGIDKYLKRLKPYANLTLKELPDQAVDKRKDSKILQAVSSRDLLILLDEKGLEFASVEGAKWLEKKAHHCSGKLIFVVGSAYGFTEEEYSRANHTLSLSKMTFTHEMVRVFFLEQLYRMLSIQKGTPYHHV

SEQ ID NO: 54166 - protein, 294 aa, Kluyveromyces lactis NRRL Y-1140
MLKTRVVPLALRSFARAKSSSTSALAYKQLHRNKARPPLPTIETPSWSTNSAISSILYENPVISKEPKKQHVLNCLVQNEPGVLSLVSGTLAARGFNIDSLVVCNTEVKDLSRMTIVLQGQDGVIEQARRQIEDLVPVFVVLDYSHSTIIERELLMTRISLLGAEYFEDLIHHHEQDENTDTVERIRQQQFHPSNLPLSQVLRLKHEHLNDISNLTGNFGGKIVDIAEQSCIVELCAKPSRISAFLKLVEPFGILEVARSGMMALPRTHLSVGDEDDAQSKMNDIVDISQLPPG

SEQ ID NO: 54167 - protein, 284 aa, Echinacea angustifolia
PKSQITPYRVVIIIRLVILGLFFHYRITNPVESSYGLWLTSVICEIWFAISWVLDQFPKRYPINRVTLTDELSARFEKEGEPSQLAAVDFFVSTVDPLKEPPLITANTVLSILAVDYPVDKVSCYVSDDGAAMLSFESLVETAEFARRWVPFCKKFSIEPRAPEFYFSQKIDYLKDKVQPSFVKERRAMKRDYEEYKVRVYALVAKALKTPEEGWTMQDGTPWPGNNTRDHPGMIQVFLGSSGAVDIEGNELPRLVYVSREKRPGYQHHKKAGAENALVRVSAV

SEQ ID NO: 54168 - protein, 338 aa, Aeromonas hydrophila
MRVLVTGGSGYIGSHTCVQLLQSGHDVVILDNLCNSKRSVLPVIERLSGKQPTFVEGDIRNEALMTEILHDHAIETVIHFAGLKAVGESVAKPLEYYDNNVNGTLRLISAMRAANVKNFIFSSSATVYGDQPKIPYVESFPTGTPQSPYGKSKLMVEQILTDLQKAQPEWSIALLRYFNPVGAHPSGDMGEDPQGIPNNLIPYIAQVAVGRRDSLAIFGNDYPPEDATAVRDYIHVMDLADGHVAAMQQLADKPGVHIYNLGAGIGSSVLDVVNAFSKACGKPVKYHFAPRRDGDLPAYWADATKADKELNWRVTRTLDEMAQDTWHWQSRHPQGYPD

SEQ ID NO: 54169 - protein, 684 aa, Treponema pallidum subsp. pallidum
MLRAMRTIPPITGIIASAGCAIGPVFCFDTLLPTRSRPGGSRLRPPSQEIARLRNALSYARASLQNLLDSVRAKASGDEPAPEYAVLSGQAEMLADAAFIATVEETLRSCSCDAETALRKAITHVTDALSATSDEYLRARAADIRDAFSGVFDALAHDTTPTAGSSLPTQGIGNSTPHSPWELTLAPFPQDPSWLPLTYNLRTHCACTRQISLVWTEGGSVTSHVAIMARAWSLPLLVSAQGCKDVAQYVLRVRQTARATDEALRALLDAESSGGKTDALGTLTVNPDVRALRTRMPHPFLTVKHTSTAEQSPPAACVLNAPLRTYSSDGIRFEVGANIVMPQEACAAAALGAAGIGLFRSEFLLFGSDRFPDEETQCSAYTRALQAMRGLPVVLRTFDLGADKLVPDPARMCALSDAAEPCAHTASERNPLLGLRGIRYCLAHPELLKVQLRAMLRAGACATCAEGTLRILIPMVSRVEEIHAVADLISEVADECARAHVSTPDRVALGIMIETPASALMAADFAPHVDFFSIGTNDLTQYVFAADRENEQVSSYADYFHPALLRLIQHVIHAHRHLRQRPGISFGEQGIGRVVMCGAMAEDETALFLLAGLGLRALSVPSSRIETLHTFLSRISVSDAEHCARAAVQLSDAQSVRTLIEEHLRTAGITLEKDEEEPSPPRSP

SEQ ID NO: 54170 - protein, 392 aa, Pseudoalteromonas tunicata D2
MANDVLDTLRKDINEIDAELLVLLAKRRRISHSVVEYKISNNKPIRDEQRELILLEKLIAYGKSLGLDSYYVNNVFQTIIEDSVLHQQAMLQQSLNPDALNETNRVAYLGGQGSYSQLACHKYFSRRAGKLVELGCDSFSKITHMVETGQADYGLLPIENTCSGSINEVYDLLQHAQVSIVGELTQSVEHCLIAQPGVELNEITKVFGHPQPFAQCSQFIQTLGEMQLAYCDSTSSAIQEALKTKNSAAIASAQAGKNAGLEVIKSAVANQPDNHSRFIVVARKAMQVSKQIPTKTTLIMATAQIAGALADALMIFKQQKINLVKLESRPVPGNPWEEVFYVDLEANLAQNNVKRALEELKEVTEYVRILGCYPSESMKAVQVINNDSLVEE

SEQ ID NO: 54171 - protein, 266 aa, Pseudoalteromonas tunicata D2
MIELSPADLNILLVEPSATQRKVIARELSQEGITNIDFADTIFNALEQIQVSAPDLVISALHLADGSALELLENIKNHSTLAALPFMLVSSETRKPQLEEFKQSGVIAILPKPFTREHLGRAINATLDVLSPQELELDFYDVHDIRVLVVDDSRLARNHIKRVLNNLGVQHCVEAEDGQAAIEILSTQMFDLIVTDYNMPQINGKELTEYIRNSSEHSHLPVLMVTSEANDTHLSNIAQSGVNAMCDKPFEPQTVRKLLYQLLDQN

SEQ ID NO: 54172 - protein, 277 aa, Bacillus cereus ATCC 10987
MSLTSLKDYTTLHNGVKMPWFGLGVFKVEDGSEVIESVKAAIKNGYRSIDTAAIYQNEEGVGQAIRESGVSREELFITSKVWNSDQGYETTLQAFETTLEKLGLEYLDLYLVHWPVKGKYTESWKALEKLYKDGRVRAIGVSNFHIHHLQDVFEIAEIKPMVNQVEYHPRLAQEELHAFCKEHNIQLEAWSPLMQGQLLDNPTLQEIATKYNKSTAQIILRWDLQNEVVTIPKSIKEHRIIENANIFDFELSADDMKAIQALNEDRRVGPDPDNFNF

SEQ ID NO: 54173 - protein, 267 aa, Bacillus cereus ATCC 10987
MLTKHRILFIGAGRMAEAIFSGLLKTSKEYIEEIIVSNRSNVEKLEQLQARYNVSTTTDWKQHVTSVDTIVLAMPPSAHEGLLAELSPLLSHQLVVTVAAGIGPSYLEERLPKGTPVAWIMPNTAAEIGKSISLYTMGQSVTEIHQETLQLLLRGIGTSQLCTEEEVHQLTAVTGSAPAFLYYFAESLIEATKSYGVDEATAKHLVIQMISGSASMLEQTQDPANLREQVTTPGGSTAEGLKALYEYNFSEAIQKAVEATNKKARGK

SEQ ID NO: 54174 - protein, 490 aa, Glycine max
SISERTKMTADIGLIGLAVMGENLVLNIESRGFTVAVFNRTTSVVDKFLEARAKGKKIIGTHSLEELVSKLKRPRKIMLMIRAGSPVDQQINALLPFLEAGDIVIDGGNSHYPDSNRRTKFLKEKGISFIGTGVSGGEEGALTGPSIMPGGDPAAWEHVKPIFQAISAKVEDGTPCCDWVGEDGAGHFVKMVHNGIEYGDMQLIAEAYHLLSGVLGLSNDELAKVFAEWNKGDLDSYLIEITSHILGKKDEETGKHVVDLILDAAGQKGTGKWTATSALDFGIPVTLIGEAVFARCLSSLKDERVQASKVIPGPKANFTGDREVFIAQVRDALFAAKVVSYAQGFLLMRSAAQEFKWNLNYGGIALMWRGGCIIRSTFLGKIKEAYNNNPSLPNLLLDPYFQAKIESVQSAWRTVVSTAFLNGIPIPALSSALAYFDGFRTERLPANLIQAQRDYFGAHTYERVDKPRGEYFHTNWTGHGGTTSSRTYNV

SEQ ID NO: 54175 - protein, 396 aa, Pseudoalteromonas tunicata D2
MFSILKPLPTDPILGLMAAYRQDTNPNKIDLGVGVFKDESGHTPVLKSVKKAEAFRLENETSKSYIGLAGDLGFCNKMEIQLLGEHKALLANRVRTAQTPGGTGALRVAAEFIVRCNPNATVWVTTPTWANHISLFEAAGLTVKEYPYYDYENKGLLFDEMITALKQVPKGDVVLLHACCHNPSGMDLNIEQWKIVAELAVEVGFTPLVDIAYQGFGTGLDDDAAGLRLLAEYVDELIICSSCSKNFGLYRERIGACSIVSSDAKVADVANSVLLSVVRSIYSMPPAHGAAIVDTILGSTELTALWHQELAEMRDRINGLRTLIVDSLNAQGIDQDFSFIKHQFGMFSFLGINKEQIDRLQKEYGIYMVGSSRVNVAGVSHANIDYFSKAVASVLK

SEQ ID NO: 54176 - protein, 177 aa, Zea mays
GVKLGLMSCFVKAAVSALQNQPIVNAVIDGDDIIYRDYVDVSVAVGTSKGLVVPVIRDADTMNFADIEKGINNLAKKATEGALSIDDMAGGTFTISNGGVYGSLISTPIINPPQSAILGMHSIVQRPVVVNGDILARPMMYLALTYDHRLIDGREAVFFLRRIKDVVEDPRRLLLDI

SEQ ID NO: 54177 - protein, 478 aa, Rhodospirillum rubrum ATCC 11170
MKRNRCAKILATLGPATSSESTLETLVRAGADMVRLNFSHGAHEEHRRRYDVVRAVENKLGRPIGILMDLQGPKLRVGDFVGGKVKLETGATFRLDMEKDLGTIQRVRLPHPEIFAAIGEGTDLLLDDGKLRLRVETFGADYAITRVITGGVLSDHKGLNVPNAVLPISALTEKDRRDLQFGLDLGVDWVGLSFVQRPEDVAEARKLIGGRAAIISKIEKPAALDHLTHIIELSDALMVARGDLGVEVPPERVPILQKRILAACHLAGKPVVVATQMLESMINAPTPTRAEASDVATAIYDGADAVMLSAETAVGQYPVEAVAMMDKIIQQVETDEHYQYLRNARRESPEGTAADAISAAASQVAETIKAAAIVTYTSSGSTTLRAARQRPGVPILCLTTNPRIARRMAMVWGVHSVLDKDISNFQEMVELAVKAAYREGFANIGERIVMTAGVPFGTPGTTNVLRIAWVEGDDSWAE

SEQ ID NO: 54178 - protein, 295 aa, Zea mays
  misc_feature (28)..(28): Xaa can be any naturally occurring amino acid
RPNPAPPELRDAGRDILDPAPGEPDFDXPEHIKQAAYAAIAAGATKYTPTPGVKALRVAVQRKLAEENHLDYSLPNIVIANGAKQIIFNAFAATLDDGDQVLVPTPYWPSFPDSVRFNGGEPVFIECGLEQGCKLLPAQLEQHINQRTRWLILNGPGNPSGAVYSEVELQALAEVLRRHPQVLVLLDELYEHIRFDGRPAQSLLNVAPDLQDRCLLVGGVSKTYAMTGWRIGFGAGPQTLTNAMAVVQSQSTSGASSVGQAAALAAFTGGLGFLAEQVAAYQLRRDLLMMALGTG

SEQ ID NO: 54179 - protein, 547 aa, unidentified eubacterium SCB49
MDINFNKNEDHNKLLVSDLKQRFNKVKLGGGEKRIEKHHAKGKMTARERIDYLLDDKKKSIEIGAFAGDGMYEEHGGCPSGGVVVKIGYVQGKQVIVVANDATVKAGAWFPITGKKNLRAQEISIENKLPIIYLVDSAGVYLPMQDEIFPDKEHFGRIFRNNAVMSSMGITQISAIMGSCVAGGAYLPIMSDEALIVDKTGSIFLAGSYLVKAAIGESIDNENLGGATVQCEVSGVTDYKSKDDKDALDTIKNIVSKIGDYDKAGYNRIKAAKPKDNPQDIYGILPKSRAEQYDMREIITRLVDDSDFEEYKKGYGQTILTGYARIDGWAVGIVANQRKLVKTTKAKTKPSEMQFGGVIYSDSADKATRFIANCNQKKIPLVFLQDVTGFMVGSKSEHGGIIKDGAKMVNAVSNSVVPKFTIVVGNSYGAGNYAMCGKAYDPTLIAAWPSAELAVMSGNSAAKVLLQIETASLKKQGKEITPEVEKELFDRIKARYDKQISPYYAASRIWTDGVIDPLDTRTWISLGIEAANHAPIEKPFNMGVLQV

SEQ ID NO: 54180 - protein, 395 aa, Mycobacterium avium 104
MMTSTLPDARPAVAALNPLEDYLAACKQACDREIVRLYGSGERGSNGLYQLILDYPLRGGKALRPALSIATCLGLGGHLEAILPTAATLELYHNAFLIHDDIEDESWWRRGKPTLHIDHGVPVAVNVGDAMLSLSLQPLLDNVERVGLGPALRILRAVATMTRKTVDGQALELDWVHSNTWRLDDADYLEMVELKTSWYSFITPLQAGAVAAGSTPDRMAPLESLGRHLGAAFQITDDLLNLRADPQEYGKEIGGDLWEGKRTLMLLHTLRHAEPGDQQRAVQILSRRRPSPDAEFDLTELLDRLTAGGQLSVSGRTEIEARLRRHHHSEVKSLNDIRWLYELMHRVGSLNHARDVAVRQARQAAAVLAGLDWFPRSRHRDMLAALVDYVHGRAR

SEQ ID NO: 54181 - protein, 426 aa, Actinobacillus pleuropneumoniae serovar 1 str. 4074
MNLYNIKHPEEQVNFAQGVRQGLGKDQGLFFPEVLPKFDDIDALLDLPLVERSQKILAALIGNELPQETVNAMVKNAFTFPAPLAKVNDYIYALELFHGPTLAFKDFGGRFMAQALASVRGDGKITILTATSGDTGAAVAHAFYGLENINVVILYPKGKISPLQEKLFCTLGGNIRTVAIESDFDACQVLVKQAFDDAELRQAIGLNSANSINISRLLAQVCYYFEAVAQLPKAKRSDVVVSVPSGNFGNLTAGLIAKTLGLPIKRFIASTNANDTVPRYLKSGKWEPNATVATLSNAMDVSRPNNWPRVEELFKRNGWALSDLGSAALNDAETEAALKAQYAEGYLCEPHGAIAYQALKDQLQAGETGIFLCTAHPAKFKESVERILNIELPLPEALDKHNKMELLSDTMPADFAKLREYLLAGN

SEQ ID NO: 54182 - protein, 145 aa, Zea mays
  misc_feature (5)..(6): Xaa can be any naturally occurring amino acid
  misc_feature (11)..(11): Xaa can be any naturally occurring amino acid
  misc_feature (17)..(18): Xaa can be any naturally occurring amino acid
  misc_feature (20)..(20): Xaa can be any naturally occurring amino acid
  misc_feature (22)..(22): Xaa can be any naturally occurring amino acid
  misc_feature (28)..(29): Xaa can be any naturally occurring amino acid
  misc_feature (31)..(31): Xaa can be any naturally occurring amino acid
  misc_feature (36)..(36): Xaa can be any naturally occurring amino acid
  misc_feature (43)..(43): Xaa can be any naturally occurring amino acid
  misc_feature (54)..(56): Xaa can be any naturally occurring amino acid
  misc_feature (59)..(61): Xaa can be any naturally occurring amino acid
  misc_feature (65)..(66): Xaa can be any naturally occurring amino acid
  misc_feature (69)..(69): Xaa can be any naturally occurring amino acid
  misc_feature (74)..(74): Xaa can be any naturally occurring amino acid
  misc_feature (81)..(81): Xaa can be any naturally occurring amino acid
  misc_feature (90)..(90): Xaa can be any naturally occurring amino acid
  misc_feature (94)..(94): Xaa can be any naturally occurring amino acid
  misc_feature (96)..(96): Xaa can be any naturally occurring amino acid
  misc_feature (104)..(104): Xaa can be any naturally occurring amino acid
  misc_feature (110)..(110): Xaa can be any naturally occurring amino acid
  misc_feature (117)..(118): Xaa can be any naturally occurring amino acid
  misc_feature (120)..(120): Xaa can be any naturally occurring amino acid
  misc_feature (123)..(123): Xaa can be any naturally occurring amino acid
  misc_feature (128)..(128): Xaa can be any naturally occurring amino acid
  misc_feature (139)..(139): Xaa can be any naturally occurring amino acid
RRRKXXRGGNXSQDQTXXNXEXEKKGEXXRXGPTDXEKPRKRXPKRAAGGESRXXXNKXXXERKXXNTXRRTGXTKNGKKXSKAPKSQRXETPXTXQRKRARSXDKKKRXTKKKPEXXEXQKXRAQRXKEQRDRRSESXAKRRPK

SEQ ID NO: 54183 - protein, 278 aa, Lactuca sativa
  misc_feature (9)..(10): Xaa can be any naturally occurring amino acid
PKSQITPYXXVIIIRLVILGLFFHYRITNPVESSYGLWLTSVICEIWFAISWVLDQFPKWYPINRVTFTDELSARFEKEGEPSQLAAVDFFVSTVDPLKEPPLITANTVLSILAVDYPVDKVSCYVSDDGAAMLSFESLVETAEFARRWVPFCKKFSIEPRAPEFYFSQKIDYLKDKVQPSFVKERRAMKRDYEEYKVRVNALVAKALKTPEEGWTMQDGTPWPGNNTRDHPGMIQVFLGSSGAVDIEGNELPRLVYVSREKRPGYQHHKKAGAENAL

SEQ ID NO: 54184 - protein, 284 aa, Lactuca sativa
PKSQITPYRVVIIIRLVILGLFFHYRITNPVESSYGLWLTSVICEIWFAISWVLDQFPKWYPINRVTFTDELSARFEKEGEPSQLAAVDFFVSTVDPLKEPLLITANTVLSILAVDYPVDKVSCYVSDDGAAMLSFESLVETAEFARRWVPFCKRFSIEPRAPEFYFSQKIDYLKDKVQPSFVKERRAMKRDYEEYKVRVNALVAKALKTPEEGWTMQDGTPWPGNNTRDHPGMIQVFLGSSGAVDIEGNELPRLVYVSREKRPGYQHHKKAGAENALVRVSAV

SEQ ID NO: 54185 - protein, 477 aa, Zea mays
MVVSILTHPFMAAAACVAVALALLATTSSAQLDPHFYDKACPAALPTIKRLVEEAVAAEPRMGASLLRLHFHDCFVNGCDGSILLDDTPFFTGETMAAPNANSVRGFDVIDRIKGAVNAACRGNVVSCADVVAIAARDSVVALGGPSYDVPLGRRDARTASQAAANSSIPAPTFGIDRLASNFASHGLSLQDLVALSGAHTLGFSRCTNFRDRLYNETATLDGSLAASLRAACPRAAGTGDDSLAPLDPTPARFDAAYFASLLRNRGVLHSDQQLFAGGPGVADALVRLYAADTDAFRRDFADAMVRMGSLSPLTGSNGEIRYNCRKFVRFARRRRHTPETPKPHTNHGRRRRASIGTVGRCCRSRREPRDARVVRELLRSMGLGEGEYEPRVVHQFLDLAYRYVGDVLGDAQVYADHAGKAQIDADDVRLAIQAKVNFSFSQPPPREKDSAAYATPTAVPFDRVRLTGSQAPPEAP

SEQ ID NO: 54186 - protein, 284 aa, Lactuca sativa
PKSQITPYRVVIIIRLVILGLFFHYRITNPVESSYGLWLTSVICEIWFAISWVLDQFPKWYPINRVTFTDELSARFEKEGEPSQLAAVDFFVSTVDPLKEPPLVTANTVLSILAVDYPVDKVSCYVSDDGAAMLSFESLVETAEFARRWVPFCKKFSIEPRAPEFYFSQKIDYLEDKVQPSFVKERRAMKRDYEEYKVRVNALVAKALKTPEEGWTMQDGTPWPGNNTRDHPGMIQVFLGSSGAVDIEGNELPRLVYVSREKRPGYQHHKKAGAENALVRVSAV

SEQ ID NO: 54187 - protein, 284 aa, Lactuca sativa
PKSQITPYRVVIIIRLVILGLFFHYRITNPVGSSYGLWLTSVICEIWFAISWVLDQFPKWYPINRVTFTDELSARFEKEGEPSQLAAVDFFVSTVDPLKEPPLITANTVLSILAVDYPVDKVSCYVSDDGAAMLSFESLVETAEFARRWVPFCKKFSIEPRAPEFYFSQKIDYLKDKVQPSFAKERRAMKRDYEEYKVRVNALVAKALKTPEEGWTMQDGTPWPGNNTRDHPGMIQVFLGSSGAVDIEGNELPRLVYVSREKRPGYQHHKKAGAENALVRVSAV

SEQ ID NO: 54188 - protein, 213 aa, Zea mays
MEWLSWRTVCCLSVLCTVLFLRPVEGIRFVIDREECFSHNVEYEGDTVHVSFVVIKADTPWHYSEEGVDLVVKDPNGAQVRDSRDKTSDKFEFIVQKRGVHRFCFTNKSPYHETIDFDVHVGHFSYFEQHAKDEHFAPLFEQIAKLDEALYNIQFEQHWLEAQTDRQAILNENMSRRAVHKALFESAALIVASVIQVYLLRRLFERKLGTSRV

SEQ ID NO: 54189 - protein, 251 aa, Pseudomonas fluorescens PfO-1
MRRPMVAGNWKMHGTRASVAELINGLRHLALPSGVDVAVFPPCLYINQVIDGLKGKSISVGAQNSAVESMQGALTGEIAPSQLVDAGCSLVLVGHSERRQIMGERDGMLNRKFAAAQACGLIPVLCVGETLEQREAGKTLEVVGRQLGSIIEELGVGAFANAVIAYEPVWAIGTGLTATPQQAQDVHKAIREQLAAENSEVARGVRLLYGGSVKAANAVELFGMPDIDGGLIGGASLNADEFGAICRAAGN

SEQ ID NO: 54190 - protein, 284 aa, Euryops virgineus
PKSQITPYRVVIIIRLVILGLFFHYRITNPVESSYGLWLTSVICEIWFAISWVLDQFPKWYPINRVTFTDELSARFEKEGEPSQLAAVDFFVSTVDPLKEPPLITANTVLSILAVDYPVDKVSCYVSDDGAAMLSFESLVETAEFARRWVPFCKKFSIEPRAPEFYFSQKIDYLKDKVQPSLVKERRAMKRDYEEYKVRVNALVAKALKTPEEGWTMQDGTPWPGNNTRDHPGMIQVFLGSSGAVDIEGNELPRLVYVSREKRPGYQHHKKAGAENALVRVSAV

SEQ ID NO: 54191 - protein, 437 aa, Clostridium acetobutylicum ATCC 824
MKQESLAQKIKNKTAVVGVIGLGYVGLPLAVQSAVKGYKVVGFDVQSKKVDMINNGQNYINDIPNDTLKEVVKKDKLKATFNFEFIKSTDIVLICVPTPLDKYQQPDISYVRNSTEVVGKYLNKGMLVVLESTTYPGTTEELILPTLQKESGLKCGRDFYLAFSPERVDPGNVKYKTENIPKVVGGVQKESTKIAAAFYENILEVKVHEVSSPKIAEMEKILENTYRNINIGLINEMAIICNKMNIDIWEVIEAAKTKPYGFQAFYPGPGLGGHCIPLDPYYLTWKAREYNYHTRLIETSGEINNCMSMYVVERATKILNRFNKPLKDSKILILGIAYKKDIDDYRESPAIRIIENFELEGAKVSFYDPHISVYKYKNKEHYGIDISKSKLMDFDLVIITTDHSKYDYKFIQQNSNFIFDVRNATKNLKDRSNIELL

SEQ ID NO: 54192 - protein, 372 aa, Zea mays
MVHRTSIADVHVMCMDLSPKKPNKASASDGGAYYDWSPADLPMLGVASIGAAKLCLTAGGLALPSYSDSAKIAYVLQGKGIFGVVLPEATKEKVISVKEGDALALPFGVVTWWHNNADAAISDLVVLFLGDTSTGHKPGQFTNFQLTGSTGIFTGFSTEFVARAWDLTQDDAAKLVSTQPGSGIVRVKDGHKMPEARDEDRQGLVLNCLEAPLDVDIKNGGRVVVLNTQNLPLVKEVGLGADLVRIDAHSMCSPGFSCDSAYQVTYIVRGSGRVQVVGIDGTRVLETRAEGGCLFIVPRFFVVSKIADETGMEWFSIITTPNPIFSHLAGRTSVWKAISPAVLQSSFNTTPEMEKLFRSKRLDSEIFFAPSN

SEQ ID NO: 54193 - protein, 410 aa, Aspergillus nidulans FGSC A4
MASARSPRWQQIQDLIMIAGTSATAYFLVRHLLSRLDFDPDRQKKEEQQRKSAAILRKLDGNLDENSSGESGGKTRKGDLVLNQYEQAIAMDVVAPEDIPVSFKDIGGLEDIIEELKESVIYPLTMPHLFSSTSSLLTAPSGVLLYGPPGCGKTMLAKALAHESGASFINLHISTLTEKWYGDSNKLVNAVFSLARKLQPSIVFIDEIDAVLGTRRSGEHEASGMVKAEFMTHWDGLTSANSLGEPQRVVVLGATNRMQDIDEAILRRMPKKFPVELPPAAQRLGILSLVLKDTKIDRQNFDLHYLVKAMAGMSGSDIKEACRDAAMVPVREFIRQKTAQGLKITSVDPSEVRGLRTEDFFASAGGAQRFIPVATQNIPPETSSEKEWSTEDEAASENGTQQSRTTQAEA

SEQ ID NO: 54194 - protein, 189 aa, Thiobacillus denitrificans ATCC 25259
MTDKVYDSALAPHHGVMPTLATGAWVHPRASVIGEVSLGRDASIWPGAVIRGDVNAIAIGEATNIQDNSVLHVSHKTRDNPAGGPLVIGAGVTVGHSVILHACTIEDECLIGMGSIILDRAVVQKHVLLGAGSLVPEGKVLESGHLYLGRPAKMVRPLTDEEIAYFSYSAQHYVALARSYQDASSPESP

SEQ ID NO: 54195 - protein, 260 aa, Brassica napus
MAERVHPADSPPQSGQFSGNFSSGEFPRKPAPPPATYVIQVPKDQIYRVPPPENAHRLQLLSRKKPNRSRCRCCFCYFLAAIFTLAVLAAISFAVLYAVFRPEAPKYSVEGFSVSGINLTSPSPISPRFNVTVRSRNGNGKLGIYYEKGSSVDVFYGDVALCNGALPVFYQPANNVTLVKTALTVGGIQLNSGARKEMRNELSKKTVPFKLKIKAPVKIKVGSVKTWTITVKVNCDVTVDKLTAPSRIVSRKCSHDVDLW

SEQ ID NO: 54196 - protein, 120 aa, Picea sitchensis
MAEGNVFACHSTEAWRSKLQEAIDTKRLVVVDFTATWCGPCRVIGPVFVELSKKFPEIFFLKVDVDQLRDVAQEWDVEAMPTFIFIKDGKAVDKVVGAKKDDLERKVAALATEAALAAQA

SEQ ID NO: 54197 - protein, 201 aa, Pseudoalteromonas tunicata D2
MGVLVGRQAPDFTAAAVLGNGEIVDSYNLHETIKGKKAVIFFYPLDFTFVCPSELIAFDKRFEEFQKRGVEVIGVSIDSQFSHNAWRNTPVNQGGIGPVKYALVADVKHEICQAYDVEHPEAGVAFRGSFLIDEAGNVRHQVVNDLPLGRNIDEMLRMVDALAFHSEHGEVCPAGWTEGKKGMDASPEGVAAYLSQNEGDL

SEQ ID NO: 54198 - protein, 129 aa, Arachis hypogaea
RPLRPGFLAKVFSIFEDLGIYVDVVATTEVSISLTLDPSKLWSRELIQEELDYVVEELEKIAVVNLLQNRSIISLIGNVQKSSLILEKAFRVLRTLGVNVQMISKGASKVNISLIVNDSEAEQCVRALH

SEQ ID NO: 54199 - protein, 235 aa, Picea sitchensis
MAAEACGQEGQVKLLGSSQSPAVLRVRIALALKGIDYEFIEEDLQNKSPLLLQSNPVHKKIPVLLHNGNSVCESMIIVQYIDDAWDTKAPNLMPKDPYARAIARFWAAFVDDKIVPSIRRVFTGQGEEQQKAVEESVANLFSLEEALRTSSKAYFGGDEIGLVDIALGSMSTWIKVLQKLTDIVLIDPEKMPLLSTWMERFLEADGMKEVMPDPAKLLEFASAMRARFTQTPAAN

SEQ ID NO: 54200 - protein, 476 aa, Solanum lycopersicum
MGDSTNFAAKHPVSINITESKLFDDDGRIKRSGSVWTASAHIITAVIGSGVLSLAWAVAQLGWIAGPIVMLLFSFVTYYTSSLLSDCYRSGDPLFGKRNYTYMDVVQANLSGLQVKICGWIQYVNLFGVAIGYTIASSISLMAVKRSDCFHKHGHKAPCLQPNTPYMIIFGVIEIIFSQIPDFDQIWWLSIVAAVMSFTYSTIGLGLGIAHVAETGKIGGSLTGVSIGTVTEMQKVWRTFQALGAIAFAYSYSLILIEIQDTIKSPPSEAKTMKNATIISVSVTTVFYMLCGCFGYAAFGDHAPDNLLTGFGFYDPYWLLDIANIAIFVHLVGAYQVYCQPLFAFIEKTAAEWYPNSKIITKNISVPIPGFKSYNIYLFRLVWRTIFVIISTIISMLLPFFSDIVGILGAFGFWPLTVYYPVEIYIVQKKIPKWSRKWFGLQILSVTCLIVSIAAAVGSFAGVVSDLKVYKPFKFT

SEQ ID NO: 54201 - protein, 538 aa, Oryza sativa
MNPGRPAPASFRDRTNEFRAAVESAARYASSSAAAAPSSSSGGGVGGPLDVSRGAASAHSEFNRRASKIGLGIHQTSQKLARLAKLAKRTSVFDDPTVEIQELTAVIKKDITALNSAVVDLQVLCNSQNESGNLSKDTTNHSTTVVDNLKNRLMSATKEFKEVLTMRTENLKVHENRRQMFSSSAANNASNPFVRQRPLVTRDGGLIMVGGGRRGAAAEEVKLSTGNVFAALETLKKKKKGGDKAKGGSSSSSGRKREQQGAQPSSQQQQQQQKEVFWAPAPLTTKSWADVEDDDDDDYFATTAPPRPVWGTGHGDDGAKEEDEEDDDDAVHAALQEEVESEDEDLDDEVDDGAVDEPEHEVDDTSAEPAGKKAAVPVAPPKDTERQLSKKELKKKELAELDAVLAELGISGGSSNAAQDENNAEKKGSNQTGDGDAPAPSESKSSKKKKNKKAKEAKESQEPADGTEETASAEPDEDTTSVDVKERLKKMASMKKKKSGKESDTAAKIAAAEAAARSARLAAAKKKEKNHYNQQPVR

SEQ ID NO: 54202 - protein, 178 aa, Pichia guilliermondii
MSIEEIPEEIPQGADVTILSKNEKKARELIKKLHLKPVPGITRVTFKQKGNLIYAIEQPDVFKSAAGTYVVFGEAKVDDMNKRIAEAQAQQEQQEALTKAAADAETADKSPESITNDLQNASLEDKTVEEDEGEVDETGLDSKDIEIIVEQTQVSRAKAVKALRAHKGDMVNAIMELS

SEQ ID NO: 54203 - protein, 514 aa, Bradyrhizobium sp. BTAi1
MERIYDLAIVGGGVNGCGIARDAAGRGNSVFLCEMNDLASGTSSWSTKLVHGGLRYLEYYEFRLVREALIEREILWQIAPHIIRPLRFVLPHHSGLRPAWLLRLGLFLYDHLGGRKLLPPTRSVNLRSDEVGRPLIAGRYSTGFEYSDCFVDDARLVVLTARDAADRGAVIRTRTRATAIRQDGSNWLVTTENTQTGERETIKARALVNAAGPWVEQVLSTGAGVNAKAKVRLVQGSHIVVRKLYDHDRAYIFQNADGRIIFAIPYQQDFTLIGTTDRDYQGDPAKVKATDEEIAYLCAALGEYIAKPVTPADVVWSYSGVRPLYDDGASEAKAATRDYVFELDTPGGLPLLSIYGGKITTYRRLSEEALERLAPYLKGAKADEGWTGKAALPGGDMQVQAVATLVADLGKTYPFLSDAHAKRIAHAYGTRAQTMLAGATSLADLGQDFGGTLTEREVRYLMTNEWALTAEDIVWRRSKLGLRMSAAEIAALDAWITAHRERAAVTAREAGGRA

SEQ ID NO: 54204 - protein, 96 aa, Brassica napus
  misc_feature (55)..(55): Xaa can be any naturally occurring amino acid
SPTLPLTLCTLSFNFDSLFPPRTIIFSTKATSNILSYINIDNFDKNITKICFVPXTTTNICKYYPFLPILLCFFVFFFIGSSLFHIIRTATSVVIA

SEQ ID NO: 54205 - protein, 471 aa, Solanum lycopersicum
MADKPHQVFEVYGESKCFDDDGRIKRTGSVWTASAHIITAVIGSGVLSLAWATAQLGWVAGPTVLLLFSFVTYYTSALLSDCYRTGDPVTGKRNYTYMDAVRANLGGFQVKICGVIQYANLFGVAIGYTIASSISMVAVNRSNCFHKQGHHAACNVSSTPYMIMFGVMEIIFSQIPDFDQISWLSIVAAVMSFTYSTIGLGLGVAQVAETGKIEGSLTGISIGTEVTEMQKIWRSFQALGAIAFAYSYSLILIEIQDTLKSPPAEAKTMKRATLISVAVTTVFYMLCGCFGYAAFGDQSPGNLLTGFGFYNPYWLLDIANIAMVVHLVGAYQVYCQPLFAFVEKTAAEWYPDSKIITKEIDVPIPGFKPFKLNLFRLVWRAIFVIITTVISMLMPFFNDVVGILGAFGFWPLTVYFPVEMYIVQKRITKWSARWICLQILSGACLVISIAAAAGSFAGVVSDLKVYRPFQS

SEQ ID NO: 54206 - protein, 567 aa, Prochlorococcus marinus str. MIT 9313
MSHPSESSAAPCVTTVDEFAKLADYSLMDSLNTDPDSTVDGDDHLARQVFSGHFVPVTPTPLKNPEYVTHSSTFFNELGLNNELAFNENFCKLFSGDLSATREPMRQVGWATGYALSIYGREYTQQCPFGTGNGYGDGRAISVFEGIINGKRWEMQLKGGGPTPYCRGADGRAVLRSSVREFLAQEYMQALGVPTSRSLTLYVSKSETITRPWYSQHSQSTDPDILVENPVAISTRVAPSFLRVGQLELFARRARSNTHPRALEELRMIVSHLIEREYKSDINQTLSFTVQLVKLARLFRDRLTLLVANWLRIGYCQGNFNSDNCAAGGFTLDYGPFGFCEIFDPKFQPWTGGGKHFSYFNQPIAAEANYHMFWKALRPLLEEDAKALKEFDQVRDGFEQAMDKQIQKMWAAKLGLKEYNSNLFEELLQLIINSKVDYTIFFRELSHIPNNLSALKKSFYIQTSQQIDEQWKSWLQSWRDLVLNKGSSTETSKTMKLTNPKYTWREWLIAPAYQQAEEGNYSLVKELQEVLSHPYDEQSKEIEDKYYRLKPKVFFNAGGISHYSCSS

SEQ ID NO: 54207 - protein, 330 aa, Bacillus cereus G9241
MNSILICGGAGYIGSHAVKKLVDEGLSVVVVDNLQTGHEDAITEGAKFYNGDLRDKAFLRDVFTQENIEAVMHFAADSLVGVSMEKPLQYYNNNVYGALCLLEVMDEFKVDKFIFSSTAATYGEVDVDLITEETMTNPTNTYGETKLAIEKMLHWYSQASNLRYKIFRYFNVAGATPNGIIGEDHRPETHLIPLVLQVALGQREKIMMFGDDYNTPDGTCIRDYIHVEDLVAAHFLGLKDLQNGGESDFYNLGNGNGFSVKEIVDAVREVTNHEIPAEVAPRRAGDPARLVASSQKAKEKLGWDPQYVNVKTIIEHAWNWHQKKPNGYEK

SEQ ID NO: 54208 - protein, 255 aa, Herminiimonas arsenicoxydans
MNPQISSWHDKRVWVIGASTGIGAATAQKLLAQGARVALSARRPELLAMVADGHPNALIAVLDIVDHASVSAAHTLIMQQWQGIDLVLIIAGGYHEMRADSFDLSAAYRLIDLNIRGTYNCLDLVLPTLLAQGNGGIGIVASVAGYSGLPKALIYGPTKAALINLCESLYIDLHPRGIGAYLINPGFVETPLTAGNDFPMPAMISANEAAQELLHGLERGQFHIHFPRRFTNILRILRLLPYRLYFWLIHKGTGL

SEQ ID NO: 54209 - protein, 336 aa, Actinobacillus pleuropneumoniae serovar 1 str. 4074
MSEMYSAPVTVLGAGSYGTALAIALARNGHKTYLWGHQPEKMAVLATERMNNAFLPDIAFPDALEIESDLVQAIAKAKDILIVVPSHVFADVLKQIKPLLSAHHRIMWATKGLERNTGRLLQTVAQEILGNQYPLAVLSGPTFAKELAQGLPTAIALSSTDSQFADEMQQRIHCAKAFRVYLNNDMIGVQLGGAIKNVIAIGAGISDGMGFGANARTALITRGLAEISRLGASLGANANTFMGMAGLGDLVLTCTDNQSRNRRFGLMLGQGKSAEEAMAEIGQVVEGFYNTKEAYLLAQTQGVEMPIVEQIYQMLFCGKNAHDVATSLLGRERKGE

SEQ ID NO: 54210 - protein, 123 aa, Brassica napus
CSLGSLSRSLRPARYASSSAVATSSSSSSPGFFSWLTGGSSSSLTSLDMPLQGVSLPPPLADLVEPSKLKITTLPNGLKIASEMSPNPTASIGLYVDCGSIYEAPYFHGATHLLERMAFKSTR

SEQ ID NO: 54211 - protein, 271 aa, Actinobacillus pleuropneumoniae serovar 1 str. 4074
MNESELNQIWKNIREEAQELVDNEPMLASFFHATILKHSNLGGSLSYILANKLANPIMPAIALKEIIEEAYQTNPQIIASAACDIDAVRTRDPAVDKWTTPLLYLKGYHAIQSYRVTHYLWQQGRKALAIYLQNEISVAFDVDIHPAAKLGCGIMFDHATGIVVGETAVIENDVSILQGVTLGGTGKEHGDRHPKIREGVMIGAGAKILGNIEIGRYSKIGANSVVLQPVPDHATAAGVPARIIGQSSVQKPAFDMNQYFEDIEGTYGDGI

SEQ ID NO: 54212 - protein, 440 aa, Herminiimonas arsenicoxydans
MAQLLDTAHLWMPFTANRQFKAKPRLLASASGMYYTTDDGRRILDGTAGLWCVNAGHGHPKIVEAVQQQAAQMDFAPLFQIGHPKAFEAATALTGIAPDGMNRVFFCNDGSEGVDTALKIALAYHRMRGDAGRTRLIGRERAYHGVGFGGTAVGGIAGNRKQFGSGLTAVDHLRHPLNIEKNAYSRGLPLHGAEMADELEQRLLALHDPSTVAAVIVEPLQGSTGVILPPKGYLEKIRAICDRYGILLIFDEVITGFGRLGSPFAADFFKVKPDMIVCAKGLTNAAVPMGAVIVRQQIHDVFMDAAPADTIEFFHGYTYSGHPLAAAAAIATLAVHKEEQLFQRAADMAPYFEDAAHSLKGLPFVKDVRNLGLVAGIELEGIRGKPGARAYDLFNKAFWDKGLLTRTTADIVALSPPLIISKMQIDEMFGSIADILKTLK

SEQ ID NO: 54213 - protein, 284 aa, Euryops virgineus
PKSQITPYRVVIIIRLVILGLFFHYRITNPVESSYGLWLTSVICEIWSAISWVLDQFPKWYPINRVTFTDELSARFEKEGEPSQLAAVDFFVSTVDPLKEPPLITANTVLSILAVDYPVDKVSCYVSDDGAAMLSFESLVETAEFARRWVPFCKKFSIEPRAPEFYFSLKIDYLKDKVQPSFVKERRAMKRDYEEYKVRVNALVAKALKTPEEGWTMQDGTPWPGNNTRDHPGMIQVFLGSSGAVDIEGNELPRLVYVSREKRPGYQHHKKAGAENALVRVSAV

SEQ ID NO: 54214 - protein, 284 aa, Euryops virgineus
PKSQITPYRVVIIIRLVILGLFFHYRITNPVESSYGLWLTSVICEIWFAISWVLDQFPKWYPINRVTFTDELSARFEKEGEPSQLAAVDFFVSTVDPLKEPPLITANTVLSILAVDYPVDKVSCYVSDDGAAMLSFESLVETAEFARRWVPFCKKFSIEPRAPEFYFSQKIDYLKDKVQPSFVKERRAMKRDYEEYKVRVNALVAKALKTPEEGWTMQDGTPWPGNNTRDHPGMIQVFLGSSGAVDIEGNELPRLVYVSREKRPGYQHHKKAGAENALVRVSAV

SEQ ID NO: 54215 - protein, 219 aa, Actinobacillus pleuropneumoniae serovar 1 str. 4074
MTQQEMKKIAAQAALQFVKPDTIVGVGSGSTVNCFIDALASMKDQIKGAVAASKASEERLRAIGIEVFNANEVSELDVYIDGADEITPQGAMIKGGGAALTREKIVSSLAKKFVCIVDGSKQVDVLGTTFPLPVEVIPMARSYVARQLVALGGSPEYREGVVTDNGNVILDVHNFHIIEPLKMEHTINNIAGVVTNGIFAQRYANVTIVGTPEGAKIIE

SEQ ID NO: 54216 - protein, 397 aa, Pyrococcus horikoshii
  misc_feature (1)..(1): Xaa can be any naturally occurring amino acid
  misc_feature (75)..(75): Xaa can be any naturally occurring amino acid
  misc_feature (101)..(101): Xaa can be any naturally occurring amino acid
  misc_feature (186)..(186): Xaa can be any naturally occurring amino acid
  misc_feature (217)..(217): Xaa can be any naturally occurring amino acid
  misc_feature (281)..(281): Xaa can be any naturally occurring amino acid
  misc_feature (290)..(290): Xaa can be any naturally occurring amino acid
  misc_feature (345)..(345): Xaa can be any naturally occurring amino acid
XEIGVVGKPNVGKSTFFSAATLVDVEIANYPFTTIEANVGVTYAITDHPCKELGCSPNPQNYEYRNGLALIPVKXVDVAGLVPGAHEGRGLGNKFLDDLRXASALIHVVDATGKTDPEGQPTDYHDPVEDIEFLEREIDYWIYGILSKGWDKFAKRIKLQKIKLESAIAEHLSGIGVNENDVWEAXHKLNLPEDPTKWSQDDLLAFASEIRRVNKPXVIAANKADAASDEQIKRLVREEEKRGYIVIPTSAAAELTLRKAAKAGFIEYIPGASEFKVLRDXSEKQKRALXVIKEKVLDRFGSTGVQEVINRVVFDLLKLIPVYPVHDENKLTDQFGNVLPHVFLXKKGSTPRDLAFKVHTDLGKGFLYAINARTKRRVGEDYELQFNDIVKIVSVTR

SEQ ID NO: 54217 - protein, 655 aa, Claviceps purpurea
MDSNGNRLHLDFGSNDRLPVNDRAYPTTPSTFPQPVLSPPTAQQQQQQQQQQQTCGGLQPPQQQPNGASGSASASTPASASTSAVGYAPQGYFSQPGAAQSANNEFAQNGYLQGRSNTPGTNDPNVGLAHQFSHQNLGGSVRSAPRGPPSSQRPRTAGSQPAGAYAGYSNSNAPPLPTQSGTSTVSEFRPAPERNPDRYGPNAMSNQKKCSQLAVDFFKDSVKRARERNQRQSELEQKLQDPTQSSVRKEQLWSTAGRKEGQYLRFLRTKDKPENYNTIKIIGKGAFGEVKLVQKKGDGKVYAMKSLIKTEMFKKDQLAHVRSERDILAESDSPWVVKLYTTFQDAYFLYMLMEFLPGGDLMTMLIKYEIFSEDITRFYIAEIVLAIEAVHKLGFIHRDIKPDNILLDRGGHVKLTDFGLSTGFHRLHDNNYYQQLLQGRSNRPRDRNSVAIDQINLTVSNRSQINDWRRSRRLLAYSTVGTPDYIAPEIFTGHGYTFDCDWWSLGTIMFECLVGWPPFCAEDSHDTYRKIVNWRQTLYFPDDITLGVEAENLIRNMVCNTENRLGRGGAHEIKNHPFFRGVEFDGLRRIRAPFEPRLTSNIDTTYFPTDEIDQTDNATVLKAQALQMGHPMEESPEMSLPFIGYTFKRFDNNFR

SEQ ID NO: 54218 - protein, 508 aa, Actinobacillus pleuropneumoniae serovar 1 str. 4074
MSNPTIQSGTDYLRVILSSNIYDLAQVTPLQKMEKLSERLGNQILIKREDRQPVHSFKLRGAFAMISNLSASQKAAGVITASAGNHAQGVALSSKHLGLRALIVMPQNTPAIKVDAVRGFGGEVLLFGANFDEAKAKALELSTELGMTFVPPFDHPMVIAGQGTIGMELVQQRSDLDYVFVPVGGGGLAAGIAVLIKQILPNVKVIGVESKDSACLQHALKVGKPDNLERVGLFADGIAVKRIGDETFRLCQKYIDEVVLVDNDQICAAMKDIFENVRAIAEPSGATSLAGLKKYVKEHQLEGKNLACVLSGANLNFHTLRYVSERCEIGEKHEALLAVTIPEQKGSFLKFCEILGNRAVTEFNYRHADDNKACIFVGVRITGNAEKADIIRDLQQHNYNVVDLSDDDIAKTHIRYMVGGRPNSISSEQLYSFEFPEQKGALLKFLQTLTDWDISLFHYRAHGADYGDILAAFTLDESDKHRLNQHLDQLGYRYQNVTDSLAYQYFLK

SEQ ID NO: 54219 - protein, 338 aa, Roseovarius nubinhibens ISM
MHLARFPRRFIAHLPTPLERLDRLSAELGGPEIWIKRDDCTGLSTGGNKTRKLEFLMAEAELQGAEIVMTQGATQSNHARQTAAFAAKLGMKCHILLEDRTGSNEANYNHNGNVLLDHLHGATTEKRPGGGDMNAEMEKLADEWRADGKKVYTIPGGGSNPTGALGYVNCAFELLAQANDGGLKIDHIVHATGSAGTQAGLITGLKAMNAQIPLLGIGVRAPKPKQEENVYNLACATAEKLGCPGVVAREDVVANTDYVGQGYGIPTESGMEAIKMFAELESILLDPVYSAKGAAGFIDLIRKGHFKKGERVVFLHTGGAAALFGYDGAFDFSSRWVG

SEQ ID NO: 54220 - protein, 284 aa, Euryops virgineus
PKSQITPYRVVIIIRLVILGLFFHYRITNPVESSYGLWLTSVICEIWFAISWVLDQFPKWYPINRVTFTDELSARFEKEGEPSQLAAVDFFVSTVDPLKEPPLITANTVLSILAVDYPVDKVSCYVSDDGAAMLSFESLVETAEFARRWVPFRKKFSIEPRAPEFYFSQKIDYSKDKVQPSFVKERRAMKRDYEEYKVRVNALVAKALKTPEEGWTMQDGTPWPGNNTRDHPGMIQVFLGSGGAVDIEGNELPRLVYVSREKRPGYQHHKKAGAENALVRVSAV

SEQ ID NO: 54221 - protein, 457 aa, Lotus corniculatus
MAASSVFSVASHSVSPSNHHAHKGKTKIGGSGLRLANSRSFGSGRISMAVAVNASRFEGIPMAPPDPILGVSEAFKADKCDLKLNLGVGAYRTEELQPYVLNVVKKAENLMLNRGENKEYLPIEGWAAFNKATAELLLGADNPAIKEQRVATVQGLSGTGSLRHAAALIERYFPGAKVLISSPTWGNHKNIFNDARVPWSEYRYYDPKTVGLDFEGMLEDIKSAPEGSFVLLHGCAHNPTGIDPTPEQWVKIADLIQQKNHIPFFDVAYQGFASGSLDEDAASVRLFVSRGMEVLVAQSYSKNLGLYAERIGAINVISSSPESAARVKSQLKRIARPMYSNPPVHGARIVADIVGNPDLFNEWKAEMEMMAGRIKNVRQKLYDSISSKDKSGKDWSFILKQIGMFSFTGLNKNQSDNMTNKWHVYMTKDGRISLAGLSLAKCEYLADAIIDSYHNVS

SEQ ID NO: 54222 - protein, 482 aa, Aspergillus nidulans FGSC A4
MASNHTNGDKAMLPLIINNESVITDNVVEVHNPATGELLHRCAGASVDDANRAVAAAKAAFPIWSKTHPYERRAILSKAADIMFSRKEEFIKTQMEETGAGRMFVEVTFMASVSFLRDFAGMIPSVEGRAPIVAEEGQSALVIKQPYGVVLGIAPWNAPFILGTRSVALPLAAGNTTILKGSELSPKCFWLIGDVLREAGLPAGCLNVIYHKTSDAPAVTNALIAHPDVRKISFTGSTLVGSIIASTAGKYIKPVLLELGGKASAIVLDDADLEKAAMGCTLGAFLNSGQICMSTERIVVQRPVAEKFQKLLVETSEKIFGKNAPAPVLVATAAVKKNQGLVADAIDKGASVVFGDPKESEPCANALRPVIVGGVTKEMDLYATESFGPTVSLIVVDSEEEAIKVANDTEYGLTSAVFTSNLFRGLRVAKQIESGAVHINSMTVHDEPTLPHGGWKSSGFGRFGGTAGYDEWLQTKTITWVE

SEQ ID NO: 54223 - protein, 284 aa, Senecio vulgaris
  misc_feature (8)..(8): Xaa can be any naturally occurring amino acid
PKSQITPXRVVIIIRLVILGLFFHYRITNPVESSYGLWLTSVICEIWFAISWVLDQFPKWYPINRVTFPDELSARYEKEGEPSQLAAVDFSVSTVDPLKEPPLITANTVLSILAVDYPVDKVSCYVSDDGAAMLSFESLVETAEFARKWVPFCKKFSIEPRAPEFYFSQKIDYLKDKVQPSFVKERRAMKRDYEEYKVRVNALVAKALKTPEEGWTMQDGTPWPGNNTRDHPGMIQVFLGNSGAHDMEGNELPRLVYVSREKRPGYQHHKKAGAENALVRVSAV

SEQ ID NO: 54224 - protein, 433 aa, Chlamydophila pneumoniae J138
MNHLNKEKLHIHNWQPYRACGLLSKVSGNLIEVDGLSACLGELCKISSTKDPNLLAEVIGFHNHTTLLMSLSPLHSVALGTEVLPLRRPPSLHLSDHLLGRVLDAFGNPIDKKEDLPKTHRKPLLSLPPSPMMRQPIDQIFPTGIKAIDAFLTLGKGQRIGVFSEPGSGKSSLLSAIALGSKSTINVIALIGERRREVREHIEKHSNALKQQRTIIIAAPAHETAPTKVIAGRAAMTIAEYFREQGHEVLFIMDSLSRWIAALQEVALARGETLSAHQYAASVFHHVSEFTERAGNNDKGSITALYAILYYPKHPDIFTDYLKSLLDGHFFLTSQGKALASPPIDILSSLSRSAQALALPHHYAAAERLRSLLKVYNEALDIIHLGAYTPGQDEELDKAVKLLPSIKAFLAQPLSSYCYLDNTLKQLEALADS

SEQ ID NO: 54225 - protein, 176 aa, Triticum aestivum
  misc_feature (9)..(9): Xaa can be any naturally occurring amino acid
  misc_feature (79)..(79): Xaa can be any naturally occurring amino acid
  misc_feature (87)..(87): Xaa can be any naturally occurring amino acid
  misc_feature (108)..(108): Xaa can be any naturally occurring amino acid
QPGRPLMAXSATSLAPFQGLKSPAGFPVKRRSKGGSLGRVRNGGRIRCMQVWPIEGIKKFETLFYLPPLSTEALLKQVXYLIRSKWXPCLEFSKVGFIFREHNGSPGXYDGRYWTMWKLPMFGCTDATQVINEVEEVKEEYPDGYVRIIGFDNMPQVQWVSFIAFKPPGCEESGKA

SEQ ID NO: 54226 - protein, 228 aa, Chlamydophila pneumoniae J138
MALLILLRHGQSVWNEKNLFSGWVDIPLSQQGIEEAFSAGRAIQNLPIDCIFTSTLVRSLMTALLAMTNHHSKKIPYIVHEDPKAKEMSRIYSAEEENNMIPLYQSSALNERMYGELQGKNKKQTAEQFGEERVKLWRRSYKTAPPQGESLYDTKQRTLPYFEKNILPQLQHGKNVFVSAHGNSLRSLIMDLEKLSEEEVLSLELPTGKPVVYQWKNHKIEKHPEFFG

SEQ ID NO: 54227 - protein, 295 aa, Thiobacillus denitrificans ATCC 25259
MSKKHPVIAVTGSSGAGTTTVKRAFEHIFFREKINAAVIEGDSFHSLARVEFKEAVKKAEAEGNFSFSHFGPQANHFDKLAELFKTYGETGGGKKRYYIHSDEEADQHNKRLNTSLNPGEFTPWEDVPPGSDVLFYEGLHGLVKTDTVDVAQHVDLGIGVVPIVNLEWIQKIHRDGAERGYSADVIVDTILRRMPDYVNYITPQFSRTDINFQRVSTVDTSNPFISRDIPTPDESFIVIRFRNPQGVDFPYLLNMICNSFMSRRNTIVVPGGKMGFAMELILAPLIQDMIANKKK

SEQ ID NO: 54228 - protein, 277 aa, Acidobacteria bacterium Ellin345
MLTFVVSSMLAVGVSLTVSQIVAPLRNARLVCLSLLANFVLVPLAAVAIAKLLALDQPLAVGLVLLGAAAGAPFLPKLAGIAKGDLAFSVGLMVLLMVLTVAYLPLVLPMLLKGVSVDPMKIARSLFLLMLLPLGVGLAVKSRLEGIADRVRGPLNLTSSVTLSLLIILLLITNMKNVISLFGTRGILASILFVAGGAAIGWLLGGPGEGTKGVLSLGTGQRNIAAALVVGGSNFDDERVVVMVVVVAIVGLLILIPLTRVLGSRNAEPRASKAAAS

SEQ ID NO: 54229 - protein, 318 aa, Oryza sativa Indica Group
MADEVAFETARKIIMHPLYTPRSSPWLDLKVFYVRVSNCEVDESAPDRLTLNHIPLSPDTVIEVNGQRSSMHTEFISSSLRRDRVDKMTEEATFVSTDSIRMTGSVRFQVFDKNDLLLTGDLELCSANGVVGESKNSSKRWNMKCQPASSCNGFLKGKPSTASESVHPVIEVYLAGTFCGTPIILTKTVQHISRRKSQMKLKLDSIPENEATEQQKEELNEDSLQIFDSLYPFLPYRSFQVSESQNPKSEQDVDVDYNSLYSRQDFIEGEDGELSWFNAGVRVGVGIGLGICVGVGLGVGLLVRTYQSTSRNFRRRLP

SEQ ID NO: 54230 - protein, 66 aa, Brassica oleracea
KGRTVEIFNSFELLLDPTTQTLDRSFLEKKQELYKKMLNSRIRVLHQYLAAKFNTAYERNTRRGGR

SEQ ID NO: 54231 - protein, 294 aa, Triticum aestivum
  misc_feature (35)..(35): Xaa can be any naturally occurring amino acid
  misc_feature (67)..(67): Xaa can be any naturally occurring amino acid
  misc_feature (117)..(117): Xaa can be any naturally occurring amino acid
  misc_feature (185)..(185): Xaa can be any naturally occurring amino acid
  misc_feature (232)..(232): Xaa can be any naturally occurring amino acid
MATKRSVGTLGEADLKGKKVFVRADLNVPLDDAQXKITDDTRIRASVPTIKFLLEKGAKVILASHLXGRPKGVTPKYSLKPLVPRLSELLGVEVVMANDCIGEEVEKLVAALPEGGXVLLLENVRFYKEEEKNEPEFAKKLASVADLYVNDAFGTAHRAHASTEGVTKYLKPAVAGFLMQKELGXYLLGAVANPKKPFAAIVGGSKVSTKIGVIESLLAKVDILILGGGMIXTFYKAQGYSVGKSLVEEDKLELATSLIEKAKAKGVSLLLPTDIVVADKFAADAESKIVPATA

SEQ ID NO: 54232 - protein, 496 aa, Acidobacteria bacterium Ellin345
MSVVSAVELNSNVSQFITKPRKMLIGGNWIDSASGKFFETLNPATGEVLARVAEGDRADIDLAVAAARKAFESGPWSKMSPSQRGRLLWKLADLLEQHLEEFAELESLDNGKPLSVARVADVPLAVDLFRYMAGWATKVEGNTIPLGPQFHAYTYREPVGVIGQIIPWNFPLLMAAWKLGPALAVGCTVVLKPAEQTPLSALRLGELIMEAGFPDGVVNVVPGFGETAGAALAAHPDVDKIAFTGSTEVGKLIVQAAAGNLKKVSLELGGKSPNIVLADADLDIAISGSANAIFFNHGQCCCAGSRLFVHKSQFDKVVEGVAEAAKNIRLGSGLDPATNMGPLVSQEQLDRVCGYLESGVQQGAKPLVGGKKQTGPGYFVEPTVLVDVKPTMKVVCEEIFGPVVTAIPFNSVDEVLNSANASSYGLAAAVWTRDINKAHSLAAKLRAGTVWVNCYNVFDAALPFGGYKQSGWGREMGHDALELYTETKAVCVRLEN

SEQ ID NO: 54233 - protein, 327 aa, Picea sitchensis
MVKAITVHELGGPEVLKWEDVEVGEPGEGEILVKHKAIGVNFIDVYYRKGVYKAEKLPFIPGREAVGVVTAVGQGLTGRKVGDLVAYAGNPMGSYAEEQILPANQVVPFPSTLDPILGAAVMLKGMTVQYLLRSCFKVEPGHTILVHAAAGGVGSLLCQWGEALGATVIGTVSNEEKAAQAAEDGCHHPIIYTQENFVERVKEITKGQGVHVVYDSVGKDTFQGSLECLASRGYMVSFGQSSGMVDPVPMSVLAPKSLFLTRPSLMHYTTTRDELLRCAGEVFTAVANGVLKVRVTKTYPLSEAAKAHADLEARKTTGSIVLIPDNS

SEQ ID NO: 54234 - protein, 576 aa, Oryza sativa Indica Group
MASSALICDTEQWKGLQIGKAHYDFVFWCGEQAHVGEIQKTHLRHLMHDVERCKAMTACLLIDSEYEGIYLDYSRQRATGETMEKLFKLAEAAKLKEKIEKMFRGDKINSTENRSVLHVALRAPRDEVINSNRVNVVPEVWGVKDKIKQFSETFRSGSWVGATGKALTNVVSVGIGGSFLGPLFVHAALQTDPEAAESAKGRQLRFLANVDPVDVARSIKDLDPETTLVVVVSKTFTTAETMLNARTLKEWIVSSLGPDAVAKHMIAVSTNLELVEKFGIDPKNAFAFWDWVGGRYSVCSAVGVLPLSLQYGFPIVQKFLEGAASIDKHFRSSSFEKNIPAILPYSQALEKFAPHIQQLSMESNGKGVSIDGVQLPFESGEIDFGEPGTNGQHSFYQLIHQGRVIPCDFIGVVKSQQPVYLKGEIVSNHDELMSNFFAQPDALAYGKQFTWYFQTPEQLHSEKVPEHLIPHKTFQGNRPSLSLLLPSLSAYEIGQLLAIYEHRIAVQGFLWGINSFDQWGVELGKSLASQVRKSLHASRVEGKPVLGFNSSTTSLLTRYLAVEPSTPYNTTTLPKV

SEQ ID NO: 54235 - protein, 55 aa, Brassica oleracea
KSIQGLSASPGDLSALHGKEAEMHVLQMIQDGQIHALINQKDGMVRFLEDPEQYK

SEQ ID NO: 54236 - protein, 345 aa, unidentified eubacterium SCB49
MKEAKKVYKNVLELIGNTPLIELNEITKGMKGNYFAKVEAFNPGHSAKDRIALHILENAEAKGIIKPGDTIVETTSGNTGFSIAMVSALKGYKCILAVSSKSSKDKIDMLKTMGAEVHVCPAHVAADDPRSYYEVAKRIHLETPGSVYINQYFNELNIEAHYASTGPEIWEQTNGEITHLVACSGTGGTISGTARFLKEKNPNIQVLGIDAYGSVLQKFHETGELDKNEIYPYRIEGLGKNLIPSATDFSQIDSFTKVTDGESALTARDLAKKEGLFVGYTSGAAMQGTKQLNEQGVFDENSKVVIIFPDHGSRYMSKIYDDEWMKLNGFLDEAVQETKAVEYVK

SEQ ID NO: 54237 - protein, 284 aa, Senecio vulgaris
  misc_feature (8)..(8): Xaa can be any naturally occurring amino acid
PKSQITPXRVVIIIRLVILGLFFHYRITNPVESSYGLWLTSVICEIWFAIPWVLDQFPKWYPINRVTFPDELSARYEKEGEPSQLAAVDFFVSTVDPLKEPPLITANTVLSILAVDYPVDKVSCYVSDDGAAMLSFESLVETAEFARKWVPFCKKFSIEPRAPEFYFSQKIDYLKDKVHPSFVKERRAMKRDYEEYKVRVNALVAKALKTPEEGWTMQDGTPWPGNNTRDHPGMIQVFLGNSGAHDMEGNELPRLVYVSREKRPGYQHHKKAGAENALVRVSAV

SEQ ID NO: 54238 - protein, 504 aa, Kluyveromyces lactis NRRL Y-1140
MFRNSNTLRTLNLLRKMSSKIENDYLIQTKAFINGKWTETDDKFAVTNPSTGDTIREVTNCGVSDFNKAIEIAHDAFGTFRQTNVRERAQILDNIYNLMLENKQDLAKILTLENGKPYKDSLGEIVYSAMFFKWFAEEAPRIYGDIIPSAVSSDQKIFTIRQPLGVIGILTPWNFPSAMIARKLAPVIATGNTCVIKPAHETPLSALALGVIAEKAGLPAGVCNILPTNHTSEIGEYVCEHELVKKITFTGSTKIGQLLMGQSSKGKNIKKFSMELGGNAPYIVFKDADLDRALDGIIGCKFRQSGQTCICANRIFVHEDLYDEFSKRLVDKIDKTFKLGDGFQDGVTHGPLIHDKSIDKVASLVQDAKTKGADVLIGGSRASSLGPLFYQPTVLGNVTESMDIFYEEIFGPVAPLIKFKDVDEVIKRANDTDVGLAGYFYSQNISTIFDAAEKLNVGMVGVNTGEISEPAVPFGGVKNSGLGKEGSKYGIDDYTELKAIIVAP

SEQ ID NO: 54239 - protein, 284 aa, Senecio vulgaris
PKSQITPYRVVIIIRLVILGLFFHYRITNPVESSYGLWLTSVICEIWFAISWVLDQFPKWYPINRVTFPDELSARYEKEGEPSQLAAVDFFVDTVDPLKEPPLITANTVLSILAVDYPVDKVSCYVSDDGAAMLSFESLVETAEFARKWVPFCKKFSIEPRAPEFYFSQKIDYLKDKVQPSFVKERRAMKRDYEEYKVRVNALVAKALKTPEEGWTMQDGTPWPGDNTRDHPGMIQVFLGNSGAHDMEGNELPRLVYVSREKRPGYQHHKKAGAENALVRVSAV

SEQ ID NO: 54240 - protein, 953 aa, Pseudomonas fluorescens PfO-1
MLELTVEQISMGQSAVDKPAALQLLASHLVADGLVADGYLSGLQAREAQGSTFLGQGIAIPHGTPETRDQVFTTGVRLMQFPDGVDWGDGQIVYLAIGIAAKSDEHLRLLQLLTRALGETDLGQALRRASSPEALLKLLQGAPQELALDAQMIGLGVSADDFEELVWRGARLLRQADCVSNGFAGVLQQVEALPLGDGLWWLHSEQTVKRPGLAFVTPDKPMRYLGQPLSGLFCLASLGEAHQALLERLCALLIEGRGHELGRATSSRKVLEVLGGELPADWPSARIALANAHGLHARPAKILAQLAKSFDGEIRVRIVDGQDSAVSVKSLSKLLSLGARRGQVLEIIAEPSIAADALPALLAAIEEGLGEEVEPLPAVSQQREVIADIAEVLSAPASGSLLQAIPAAPGIAIGPAHIQVQQAIDYPLRGESAAIERERLKQALADVRQDIQGLIERSKAKAIREIFITHQEMLDDPELTDEVDTRLKQGESAEAAWMAVIEAAAKQQESLHDALLAERAADLRDIGRRVLAQLCGVQTPAEPEQPYILVMDEVGPSDVARLDPARVAGILTARGGATAHSAIVARALGIPALVGAGAAVLLLKPGTPLLLDGQRGRLHVDADAATLQRASEERDTREQRLKAAAEQRHQPAHTTDGHAVEVFANIGESAGVISAVEQGAEGIGLLRTELIFMAHPQAPDEATQEAEYRRVLDGLAGRPLVVRTLDVGGDKPLPYWPIAKEENPFLGVRGIRLTLQRPQIMEAQLRALLRSADNRPLRIMFPMVGSVEEWRQARDMTERLRLEIPVPDLQLGIMIEVPSAALLAPVLAKEVDFFSVGTNDLTQYTLAIDRGHPTLSAQADGLHPAVLQLIDITVRAAHAHGKWVGVCGELAADPLAVPVLVGLGVDELSVSGRSIAEVKARIRELSLTQTQTLAQQALAVGSANEVRALVEAL

SEQ ID NO: 54241 - protein, 284 aa, Senecio vulgaris
PKSQITPYRVVIIIRLVILGLFFHYRITNPVESSYGLWLTSVICEIWFAISWVLDQFPKWYPINRVTFPDELSARYEKEGEPSQLAAVDFFVSTVDPLKEPPLITANTLLSILAVDYPVDKVSCYVSDDGAAMLSFESLVETAEFARKWVPFCKKFSIEPRAPEFYFSQKIDYLKDKVQPSFVKERRAMKRDYEEYKVRVNALVAKALKTPEEGWTMQDGTPWPGNNTRDHPGMIQVFLGNSGAHDMEGNELPRLVYVSREKRPGYQHHKKAGAENALVRVSAV

SEQ ID NO: 54242 - protein, 265 aa, Spinacia oleracea
MACVASSTTLISSPSSRVFPAKSSLSSPSVSFLRTLSSPSASASLRSGFARRSSLSSTSRRSFAVKAQADDLPLVGNKAPDFEAEAVFDQEFIKVKLSDYIGKKYVILFFYPLDFTFVCPTEITAFSDRHSEFEKLNTEVLGVSVDSVFSHLAWVQTDRKSGGLGDLNYPLISDVTKSISKSFGVLIHDQGIALRGLFIIDKEGVIQHSTINNLGIGRSVDETMRTLQALQYTGNPDEVCPAGWKPGEKSMKPDPKLSKEYFSAI

SEQ ID NO: 54243 - protein, 284 aa, Senecio vulgaris
PKSQITPYRVVIIIRLVILGLFFHYRITNPVESSHGLWLASVICEIWFAISWVLDQFPKWYPINRVTFPDELSARYEKEGEPSQLAAVDFFVSTVDPLKEPPLITANTVLSILAVDYPVDKVSCYVSDDGAAMLSFESLVETAEFARKWVPFCKKFSIEPRAPEFYFSQKIDYLKDKVQPSFVKERRAMKRDYEEYRVRVNALVAKAQKTPEEGWTMQDGTPWPGNNTRDHPGMIQVFLGNSGAHDMEGNELPRLVYVSREKRPGYQHHKKAGAENALVRVSAV

SEQ ID NO: 54244 - protein, 488 aa, Aspergillus nidulans FGSC A4
MAQVEVPSTNGSGKSVETRLFINGEFQPSSDGKTFSLIDPFTQNSVAEVSQATEEDTNNAVAAAKAAFPAWRDRSPADRGACLHKLAALIRENNEEFARLEALSTGRPVSRYFDATVSADTFSYFAEAGWTVQGTSSLNTPGHLNMTVKQPYGVVACIIPWNVPMAFFAFKVAPALAAGNTVVLKSSEKAPLTSALAATLIAEAGFPPGVINILSGFGTPAGSTLASHMDVRCLSFTGSSFTGQRIQAAAAASNMKIVHMELGGKSPALIFEDADLENAAQATQFSIQCLSGQTCMANSRIYVQESVADEFLALFKEKFGSAVLGNPLESGTTHGPQVDGLQYERVKSYITIGEQDGKLSMGGDAGNGYFVKPTVFEGVPEDSRIVKEEVFGPVVVINTFKTEEEAIKKANASEFGLYASVFTKDLDRAVRTSKLLEAGTVGVNTTSPNVAKDMPFGGYKMSGVGREGFMHSLDNFLETKTILIKMSS

SEQ ID NO: 54245 - protein, 259 aa, Roseovarius nubinhibens ISM
MPGRDLDLLSEAAREAGAIARRFFEAGTAESWDKPDAAGPVTDADLAVNGMLSAELRRARPDYGWLSEESEDGASRLADERVFIVDPIDGTRSFIAGEKAWAHSLAVVERGEVVAGVVYLPMMDKLYAAERGGGATLNGAAIKVARTKDLSKATVLSAKPNFADKHWKKGQAPEVKRAYRPSLAYRLCLVAEGQFDAMLTLRPTWEWDIAAGDLILREAGAVTGDRTGRDLRYNNRLPQVDGVVAGNAALHAALTKALA

SEQ ID NO: 54246 - protein, 122 aa, Zizania latifolia
PVGEGKRGGEVYRLYDVGGQRNERRKWIHLFEGVNAVIFCAAISEYDQMLFEDETKNRMMETKELFDWVLKQRCFEKTSFMLFLNKFDIFERKIQKVPLSVCEWFKDYQPIAPGKQEVEHAY

SEQ ID NO: 54247 - protein, 126 aa, Zizaniopsis villanensis
PCGESKRGGRVYRLYDVGGQRNERRKWIHLFEGVNAVIFCAAISDMIIDQMLFLFEDETKNRMMETKELFDWVLKQRCFGKTSFMLFLNKFDIFKRKIEKVPLTVCEWFKDYHPIAPGKQEVEHAY

SEQ ID NO: 54248 - protein, 358 aa, Triticum aestivum
MAVDLTPRQPAKAYGGEGGAYYEWSPAELPMLGVASIGAAKLSLAAGGMSLPSYSDSAKVAYVLQGKGTCGIVLPEATKEKVVAVKEGDAMALPFGVVTWWHNTPGSATELVILFLGDTSKGHRPGQFTNFQLTGASGIFTGFSTEFVGRAWDLKQNDAAKLVSSQPASGIVKLSAGQKLPEPVAEDRKDMALNCLEAKLDVDIPKGGRVVVLNTANLPLVKEVGLGADLVRIDAHSMCSPGFSCDSAYQVTYIVRGSGRVQVVGPDGKRVLETRIEGGSLFIVPRFHVVSKIADASGMEWFSIITTPNPIFSHLAGKTSVWKAISPEVLEASFNTTPEMEKLFRSKRLDSEIFFAPN

SEQ ID NO: 54249 - protein, 122 aa, Luziola leiocarpa
PVGESKRGGEVYRLYDVGGQRNERRKWIHLFEGVNAVIFCAAISEYDQMLFEDETKNRMMETKELFDWVLKQRCFEKTSSVLFLNKFDIFERKIQKVPLSVCEWFKDYQPIAPGKQEVEHAY

SEQ ID NO: 54250 - protein, 366 aa, Physcomitrella patens subsp. patens
MGRVEDFDSAECNGSAHERKQRWILVTGGAGYIGTHTVLQLLLEGYCVMIIDNLVNSCEEAVNRVLKLAGEAGWNLEFCKGDLCKLEDVQKVFNLHRFEAVIHFAGLKAVGESASKPLLYYKNNLTSTINLMNVMSENRCKNLVFSSSATVYGQPESVPCTEEYPLSVTNPYGRTKLINEDIMRDVQHADPEWKIILLRYFNPVGCHPSGEIGEDPLGFPNNLMPFVQQVAVGRKETLSVCGHDYDTRDGTGIRDYIHVMDVACGHTKALDKLFTTPDIGCAIYNLGTGRGTTVLEMVSAFEKASGKKIPLKFDVRRPGDSSEIYAATKKAEEELGWRAKFGLMEICRDQWNWAKRHPFGYECQEQ

SEQ ID NO: 54251 - protein, 648 aa, Bacteroides fragilis YCH46
MKNEPTYSLLNAINYPKDLRQLSVDQLPEVCEELRQDIIKELSCNPGHFAASLGVVELTVALHYVYNTPYDRIVWDVGHQAYGHKILTGRREAFSTNRKLGGIRPFPSPEESEYDTFTCGHASNSISAALGMAVAAERKGEKDRHVVAVIGDGSMSGGLAFEGLNNASSTANNLLIILNDNDMAIDRSVGGMKQYLFNLTTSNRYNQLRFKTSRLLFKMGLLNEERRKALIRLGNSLKSLAAQQQNIFEGMNIRYFGPIDGHDVKNIARILHDIKDMQGPKILHLHTIKGKGFGPAEKQATIWHAPGKFDPVTGKRIVANTDGMPPLFQDVFGHTLVELAEKNKRIMGVTPAMPSGCSMNMLMDRMPDRAFDVGIAEGHAVTFSGGMAKDGLLPFCNIYSSFMQRAYDNIIHDVAIQKLNVVFCLDRAGLVGEDGPTHHGVFDMAYLRPIPNLTISSPMDEHELRRLMYTAQLPDKGPFAIRYPRGRGSLVDWECPLEEIPVGKGRKLKDGNDLAVITIGPIGKLAARAIERAEADTGISVAHYDLRFLKPLDEELLHEVGKKFRHIVTIEDGIIKGGMGCAILEFMADNGYYPEIRRIGVPDQFIEHGSVQQLYHLCGMDEEGIYKVITKNKLRMDAPVESCMATHS

SEQ ID NO: 54252 - protein, 529 aa, Pseudoalteromonas tunicata D2
MELIFFATAFVCGFIVLQLKLPPLIGFLAAGFLLNLAGYHSTPLLETIAALGVTLLLFSIGLKLKVDHLTKLQVWAPASLHIILSSALFCGFLLLLGFFGLPLFTDLSAESALLLGFALSFSSTVFAVKVLEERGEMASLHGKIAIGILVMQDVFAVLFLAVSTGKVPNYWAIALVISLFFIRPVFFWILGRSKHGEVLPLFGFFFALVVGYNAFEFAGLKGDLGALIIGMLLASHRKAGELAKSLLSFKDLLLVGFFLSIGLNAQLTVQALVVALLIISILPIKVALYYVFTNMFHLRARTSLLGAFTLANFSEFGLIVCALAASSGWLTPEWLAVVAISVAITFIIASPLNNRANDIYVKLENWLFKFESKVRLAEEMPVNLNRTKILIFGMGRIGTGAYEAIAHTYPDMVGGVDINPECIERHLKRGRFAILADATDPDFWQRINHSEVEMVMLAMPKHVQNLLALEQIKLSGYGGQVTAIANYPDQQKELELLGVDSTYNFYLEAGTGFAEHVKEHLFEPDKATP

SEQ ID NO: 54253 - protein, 172 aa, Pinus halepensis
MPNPKVFFDMQVGGAPAGRIVMELYADVVPKTAENFRALCTGEKGTGRSGKPLHFKGSSFHRVIPGFMCQGGDFTRGNGTGGESIYGEKFADENFVKKHTGPGILSMANAGPNTNGSQFFICTAQTSWLDGKHVVFGQVVEGLEVVREIEKVGSGSGRTSKPVVIADSGQLA

SEQ ID NO: 54254 - protein, 636 aa, Debaryomyces hansenii CBS767
MAPVITRLQSYTSIEEYDEQIPLGEYLFLRVCQINPRLKSVFGIPGDFNLNLLEHLYADSLVNGKGVKFVGLCNELNASYTADGYSKIIQGLSVLITTFGVGELSALNGIAGAFAEYAPVLHIVGTTSTKRAAYARTCGVQGIQNFHHLVQNKNPLIAPDHDVYKPLVEPFSVIQESLTMDGFDNEENLKKIDRVLIKICQENRPGYLFVPCDIPDITVSRARLAEEISIQELAEDDAESKQLMENIADRILNKLYQSQKPSVIGDALVSRFHQDEVFTKFISKLPSNFVKLFTANMARNIDETLPNFVGTYFGKVSPTKELQNNLEQESDLLIDFGYYNAETNTAGYTRDYSNIKDYIEIHPDYVLMDNEYVAVKDFATDKRRFSMGDLIQSLNDKIDSTRFIHNNKLVNNITYKFTPYKWHTDDTTVNQCVVPQSKLIDFFNNYLQPNDILMVETCTFLFAVPDLKFPPGVTFLSQSFYGSIGYAIPATLGVSLAEKDLGSNRRIILVQGDGSAQMTIQELSTFLRHDLVNPKIFLINNEGYTVERIIKGPTRSYNDIQGCWKWTELLKIFGDEHGARHVTATIKNAAELDNFRSLLNNNKIEFIELIMGKLDAPERFSYISGHKQPIPSVPLH

SEQ ID NO: 54255 - protein, 260 aa, Aspergillus niger
ASTQGISEDLYNRLVEMATISQAAYADLCNIPSTIIKGEKIYNAQTDINGWILRDDTSKEIITVFRGTGSDTNLQLDTNYTLTPFDTLPQCNDCEVHGGYYIGWISVQDQVESLVKQQASQYPDYALTVTGHALGASMAALTAAQLSATYDNVRLYTFGEPRSGNQAFASYMNDAFQVSSPETTQYFRVTHSNDGIPNLPPADEGYAHGGVEYWSVDPYSAQNTFVCTGDEVQCCEAQGGQGVNDAHTTYFGMTSGACTW

SEQ ID NO: 54256 - protein, 118 aa, Picea sitchensis
MTMNGFSAWSSEISPVFSQWILHDWSDDDCAKVLKNCHKALPEKGKVVVVDAILPMATETSPYARHAFHLDLLMMAYAPGGKERTEQEFRELGHAAGFAGGVQPICCVDGVWVIEFYK

SEQ ID NO: 54257 - protein, 516 aa, Listeria innocua Clip11262
MTKFSEFGLDEKIVKSVNRMGFEEATPIQEKTIPLGLAGKDLIGQAQTGTGKTAAFGLPMIHKIDQKSNNVQALIIAPTRELAIQVSEELYKLSYDKHVRVLAVYGGSDISRQIRSLKKNPQIVVGTPGRILDHINRRTLKLDHVETLVLDEADEMLNMGFIDDIETILKEVPAERQTLLFSATMPDPIRRIGERFMHSPELIRIKAKEMTALLIEQFFVKVHEKEKFDVLSRLLDVQAPELAIVFGRTKRRVDELSRALDMRGYVAEGIHGDLTQAKRMSVLRKFKEGKIDVLVATDVAARGLDISGVTHVYNYDIPQDPESYVHRIGRTGRAGKEGMAITFVQPREMGYLRIVEETTKKRMQPLQAPTWDEAFAGQLRVATEKIQEAITEENLADYKTFANELLEKYDATDIAAAMLKMLAKEPDKTPVHITEERPLPSRGGGGYKGKNGKGGKGGGYRGGSGKGGSYRDRNNSGKGRRSGGGSGSGGGGNRDRRGGGEQRSGGNKGNYSQKSK

SEQ ID NO: 54258 - protein, 193 aa, Triticum aestivum
  misc_feature (44)..(44): Xaa can be any naturally occurring amino acid
  misc_feature (60)..(60): Xaa can be any naturally occurring amino acid
  misc_feature (65)..(65): Xaa can be any naturally occurring amino acid
  misc_feature (87)..(87): Xaa can be any naturally occurring amino acid
  misc_feature (93)..(93): Xaa can be any naturally occurring amino acid
  misc_feature (97)..(97): Xaa can be any naturally occurring amino acid
  misc_feature (99)..(100): Xaa can be any naturally occurring amino acid
  misc_feature (104)..(104): Xaa can be any naturally occurring amino acid
  misc_feature (106)..(106): Xaa can be any naturally occurring amino acid
  misc_feature (127)..(128): Xaa can be any naturally occurring amino acid
  misc_feature (133)..(133): Xaa can be any naturally occurring amino acid
  misc_feature (135)..(135): Xaa can be any naturally occurring amino acid
  misc_feature (143)..(143): Xaa can be any naturally occurring amino acid
  misc_feature (146)..(146): Xaa can be any naturally occurring amino acid
  misc_feature (150)..(151): Xaa can be any naturally occurring amino acid
LIQPIANGATVLSLDTDFDGCMRLIREVTAELPIYLANSLNSLXRLEGQKTAAIRDIATXNWQVXPDWVTSQGGNLGEHFMLSYKDXNFRVLXLVDXLXXSLLXQXAANANPLYPYYNPGVTDFHPXXAGTIXIXQQFGDSIXITXGFFXXKGMIGTDQGSKGFLLTGCFPRGSPPVKPTSIMDNPGTTAQVH

SEQ ID NO: 54259 - protein, 318 aa, Prochlorococcus marinus str. NATL1A
MASASSSLASKLSPLSKSNFLSSSDLNSDQILSLFELAKQLKTGNRRIDLGNRVLGLIFKKASTRTRVSFQVAMARLGGQTVDLNPQITQLGRGEPIKDTARVLSRYCDALAIRTFSQQELEEYAEWSTIPVINALTDLEHPCQSLADYLTIQEKFGELKGINLSYIGDGNNVANSLMICGAMLGVHVKICSPKGFEADSKIVEKAKTLSEFGSKISISNDPLKAMKDAQVIYTDVWASMGQEEEHLKRKKIFENYKVDQKLIELADEGAIILHCLPAHRGEEITEEALESKSSHVFDQAENRLHVQQALLAVQLGGI

SEQ ID NO: 54260 - protein, 396 aa, Haemophilus ducreyi 35000HP
MFNHIEAALTDPILGLNDAFRADIRKTKTNLGIGVYMNAEGQTPIMNAVKLAETRLLAEESQKNYLQIDGIAHFNSYTQTLLFGQDADVIQTGRVKTAQSLGGTGALRIAMEFIKRQTDAKTIWISNPTWPNHNAIAEAVGLTIKNYRYYNPETNGLDWDNLLADLQQAERGDVVLLHGCCHNPTGIDPTAEQWDKLAILSAEKGWLPLFDFAYQGLANGLDEDAYGLRAFAKNHKELLIASSYSKNFGLYNERVGAFTLVAENAEIANNAFTQIKSIIRVLYSNPAAHGAHTVTTVLADDQLRANWIAELSEMRDRIKTMRTKMVQLLAEKGAKKDFSFISDQNGMFSFSGLTATQVDRLRDEFAIYAVRSGRINVAGLTDDNIEAFCDAVVKVL

SEQ ID NO: 54261 - protein, 391 aa, Bradyrhizobium sp. BTAi1
MKALVWHGKEDIRCDTVSDPEIEHDRDAIIKVTSCAICGSDLHLFHNYIPAMMPGDIMGHETMGEVVEVGSGVNGKLKKGDRIVVPFTIICGECEQCRRGNYSVCETTNRNKHLAEKVFGHTTAGLFGYTHLTGGYPGGQAEYLRVPFADATHIKVPDGMTDEQALFLSDIFPTGWQAAAQCDIEPDDTVAVWGCGPVGQMAIRSAILLGASRVIAIDRIPERLAMAEAGGAITINFDKESVVGRLNELTDNKGPEKCIDCVGFESHISMAQPDSVLDRAKQMFMLENDRPHALREIIYVCRPGGIVSIPGVYSGFSDMVPMGALMNKGLTIRTGQTHVNRWTDDLTQRIADGQIDPSFVITHTVPLAQGPEMYRAFRDKQDSCVKVVLKP

SEQ ID NO: 54262 - protein, 536 aa, Escherichia coli O157:H7 EDL933
  misc_feature (254)..(254): Xaa can be any naturally occurring amino acid
MLAGVDGVGGIPFDNYPFAYMVSNLALAIILLDGGMRTQASSFRVALGPALSLATLGVLITSGLTGMMAAWLFNLDLIEGLLIGAIVGSTDAAAVFSLLGGKGLNERVGSTLEIESGSNDPMAVFLTITLIAMIQQHESSVSWMFVVDILQQFGLGIVIGLGGGYLLLQMINRIALPAGLYPLLALSGGILIFALTTALEGSGILAVYLCGFLLGNRPIRNRYGILQNFDGLAWLAQIAMFLVLGLLVNPSDLXPIAIPALILSAWMIFFARPLSVFAGLLPFRGFNLRERVFISWVGLRGAVPIILAVFPMMAGLENARLFFNVAFFVVLVSLLLQGTSLSWAAKKAKVVVPPVGRPVSRVGLDIHPENPWEQFVYQLSADKWCVGAALRDLHMPKETRIAALFRDNQLLHPTGSTRLREGDVLCVIGRERDLPALGKLFSQSPPVALDQRFFGDFILEASAKYADVALIYGLEDGREYRDKQQTLGEIVQQLLGAAPVVGDQVEFAGMIWTVAEKEDNEVLKIGVRVAEEEAES

SEQ ID NO: 54263 - protein, 315 aa, Manihot esculenta
  misc_feature (303)..(303): Xaa can be any naturally occurring amino acid
MASASLLKSSPVLDKSEFVKGQSLRQPSASIIRCHPTAPSALTIRAGSYADELVKTAKTIASPGRGILAMDESNATCGKRLASIGLENTEANRQAYRTLLVTAPGLGQYISGSILFEETLYQSTTDGKKMVDVLVEQNIVPGIKVDKGLVPLPGSNNESWCQGLDGLASRTAAYYQQGARFAKWRTVVSIPNGPSALAVKEAAWGLARYAAVSQDNGLVPIVEPEILLDGEHGIDRTFEVAQKVWAEVFFYLAENNVMFEGILLKPSMVTPGAECKDRATPQQVADYTLNLLKRRIPPAVPGXMFLSGGQSEVEA

SEQ ID NO: 54264 - protein, 127 aa, Oryza sativa Japonica Group
MAAAAADEEREVRRAVEEKPVVVVGRRGCCMAHVARRLLLGQGANPAVLEVGDDADPAALVDAALQARRRKDGGDKAAAGDGGGGAAVAFPAVFIGGRLVGGLDRLMAMHMAGELVPVLKQAGALWL

SEQ ID NO: 54265 - protein, 722 aa, Desulfotalea psychrophila LSv54
MCNMNIATKLFPFLKWFHDYSGGKFKIDLLAGITVALVLIPQSMAYAQLAGLPAYYGLYAAFLPPMVAALFGSSKQLATGPVAVVSLMSAAALEPLATAGSTEFIAYSIALALTVGLFQLSLGILRLGLVVNFLSHPVVNGFTNAAAIIIATSQLPKLFGVSVDKATHHYETIIRVFQAALDYTHIPTLIFGISAIVIMAVLKKINPRIPNVLVAVGLATIISYFSGFNSDTHLSINRINNTEIQENIKTFNNLIEEITLVGDKRSTIGIKVDEEQERQTTDFETIALIKLKTDVAIMNTLIAELKKRSATIRYDLRHAKFVGIKEASGLRLYLQDQVPAGLNSDGKTWRLNVGRSQLNPDELKFMSGGAVIGKVPAGIPSLSTPDVSIKTFTKLLPTAIIISLLGFMEAIAIAKAMAAQTGQKLDPNQELIGQGLANIVGSFGSSYAVSGSFSRSAVNLGAGAVSGISSVITSVVVLITLIFFTPLLYHLPQAVLAAVIMMAVVGLLNVKGFIHSWKAQWYDGLISIISFIVTLYFAPHLDKGIMVGVALSMTVFLYKSMRPVVARLSLNKERVLANADYYRLRGCKHISVVRFDGALFFANASYLDEQVEKFRMEQPELRYILLDARGINDMDASGEEALDMLYKRVRSANLGFAICGLKGQVVDVMVRTGLYDKIGSEYIHADSKSAVSAITKIIHQLPDLPSDGCDDCPLTQYLPNAD

SEQ ID NO: 54266 - protein, 815 aa, Cryptococcus neoformans var. neoformans B-3501A
MAPKPAKTSSKTAKLPTPAATPTRQPSVDTLSKPTVVDTPPTPASPAQVSAPVPPKKFAYPIPSRLSPSTINNTESLLRFIILALICGAAIGSRLFAVIRFESVIHEFRASKVLVNKGFYEFWNWFDPSAWYPLGRTVGTTLYPGLMVTSGLIWHALRAINMPVDIRNVCVLLAPGFSGLTAWATYLFTTEMSTPSAGLLAAAFIGIVPGYISRSVAGSYDNEAIAIFLLMSSFYSWIKAVKTGSSFWGMITALFYGWMVAAWGGYVFITNMIPLHAFVLIVMGRFNNRLYTAYSSWYVIGTIASMQVPFVEFLPIRTSEHMAALGVFGLVQLIGFVEVVRRLVPGKQFQLLLKAFVVAVFCLSFAALVTLTFSGWIAPFAGRFYSLWDTGYAKVHMPIIASVSEHQPTAWPSFYFDLEMLIFFFPAGVFWCFKELRDEQIFIIIYAVLSAYFAGVMVRLMLVITPVVCVSSAIAFSKLLEAYIDPVIPESDEEAGESQTQVVSKSKAKKMAAANANKSGFSFTGILSGKSVSGIFGLDTRFAVVSILSVFLFIFVLHCTYVTSTAYSSPSVVLASRNPDGSQNIIDDFREAYYWIRQNTAEDSVIMSWWDYGYQIAGMADRPTLVDNNTWNNTHIATVGKAMASNEDVAYPILRKHDVDYVLVIFGGLLGYSGDDINKFLWMVRISQGEWPDEVQEVNYFTQRGEYAVDDRATPTMKNSLMYKMSYYRFPELYGGHPAQDRVRGQIIPPNSVTLDTLDEAFTSENWIVRIYKVKKEDPIGRDHKAVTAWNGGKKLKKSPSASEGVKRGSGRPSM

SEQ ID NO: 54267 - protein, 284 aa, Euryops virgineus
PKSQITPYRVVIIIRLVILGLFFHYRITNPVESSYGLWLTSVICEIWFATSWVLDQFPKWYPINRVTFPDELSARYEKEGEPSQLAAVDFFVSTVDPLKEPPLITANTVLSILAVDYPVDKVSCYVSDDGAAMLSFESLVETAEFARKWVPVCKKFSIEPRAPEFYFSQKIDYLKDKVQPSFVKERRAMKRDYEEYKVRVNALVAKALKTPEEGWTMQDGTPWPGNNTRDHPGMIQVFLGNSGAHDMEGNELPRLVYVSREKRPGYQHHKKAGAESALVRVSAV

SEQ ID NO: 54268 - protein, 284 aa, Petasites fragrans
PKSQITPYRVVIIIRLVILGLFFHYRITNPVESSYGLWLTSVICEIWFAISWVLDQFPKWYPINRVTFTDELSARYEKEGEPSQLAAVDFFVSAVDPLKEPPLITANTVLSILAVDYPVDKVFCYVSDDGAAMLSFESLVETAEFARKWVPFCKKFSIEPRAPEFYFSQKIDYLKDKVQPSFVKERRAMKRDYEEYKVRVNALVAKAQKTPEEGWTMQDGTPWPGNNTRDHPGMIQVFLGNSGAHDMEGNELPRLVYVSREKRPGYQHHKKAGAENALVRVSAV

SEQ ID NO: 54269 - protein, 71 aa, Zea mays
MAAAGGGAGGKVSFKIILTSDPKLPFKVFSVPEAAPFTAVLKYAAEEFKVPPQTSAIITNGTPPVHRPLAS

SEQ ID NO: 54270 - protein, 284 aa, Senecio vulgaris
PKSQITPYRVVIIIRLVILGLFFHYRITNPVESSYGLWLTSVICEIWFAISWVLDQFPKWYPINRVTFTDELSARYEKEGEPSQLAAVDFFVSTVDPLKEPPLITANTVLSILAVDYPVDKVSCYVSDDGAAMLSFESLVETAEFARKWVPFCKKFSIEPRAPEFYFSQKIDYLKDKVQPSFVKERRAMKRDYEEYKVRVNALVAKAQKTPEEGWTMQDGTPWPGNNTRDHPGMIQVFLGNSGAHDMEGNELPRLVYVSREKRPGYQHHKKAGAENALVRVSAV

SEQ ID NO: 54271 - protein, 284 aa, Senecio vulgaris
PKSQITPYRVVIIIRLVILGLFFHYRITNPVESSYGLWLTSVICEIWFAISWVLDQFPKWYPINRVTFTDELSARYEKEGEPSQLAAVDFFVSTVDPLKEPPLITANTVLSILAVDYPVDKVSCYVSDDGAAMLSFESLVETAEFARKWVPFCKKFSIEPRAPEFYFSQKIDYLKDKVQPSFVKERRAMKRDYEEYKVRVNALVAKAQKTPEEGWTMQDGTPWPGNNTRDHPGMIQAFLGNSGAHDMEGNELPRLVYVSREKRPGYRHHKKAGAENALVRVSAV

SEQ ID NO: 54272 - protein, 159 aa, Triticum aestivum
TSRDHKPELVAERERILKAGGFIRMGRINGSLNLARAIGDMEFKQNKFLPPEKQIVTSNPDINVVELCNEDDFLVLACDGIWDCMSSQQLVDFIHEHINTESSLSAVCERVLDRCLAPSTMGGDGCDNMTMILVQFKKPVSDKKKADVGEQSAKGKEES

SEQ ID NO: 54273 - protein, 189 aa, Brassica napus
  misc_feature (39)..(39): Xaa can be any naturally occurring amino acid
  misc_feature (130)..(130): Xaa can be any naturally occurring amino acid
  misc_feature (137)..(137): Xaa can be any naturally occurring amino acid
  misc_feature (143)..(143): Xaa can be any naturally occurring amino acid
  misc_feature (158)..(158): Xaa can be any naturally occurring amino acid
STHAVRVRRSLAWHYSMLFSAAVDTSPAQANMDDPFTGXKAASAFPGTRKANNDITSIVSNGGRDNCMQVWPPIRKKNYDNLCYLPDLTEVQLGKEVGYLFRNKRNPCAEFEMEHCLSHREHGSTPRILXRPYWTMXKLTLFXCTDSAQEMKEVQECXTEYPNAFITIIGLYNNRQGQCINYNAYKPPS

SEQ ID NO: 54274 - protein, 179 aa, Glycine max
  misc_feature (122)..(122): Xaa can be any naturally occurring amino acid
  misc_feature (125)..(125): Xaa can be any naturally occurring amino acid
  misc_feature (162)..(162): Xaa can be any naturally occurring amino acid
MASSMISSPAVTTVNRAGAGMVAPFTGLKSMAGFPTRKTNNDITSIASNGGRVQCMQVWPPVGKKKFETLSYLPDLDDAQLAKEVEYLLKKGWIPCLEFELKHSFIYHKHNKSPEYYDRHYXPYXKLPIFNYTNTSHILKELQEAKTTYPNHFIHIIKFNNXVRQVQYIIFITYKPPSF

SEQ ID NO: 54275 - protein, 424 aa, Solanum tuberosum
MHNDSNSGAPGTPSGRIRRRRGSNEVPPEVVKANGNHLLVNDRSKYKSMLIRAYSSVWMIGGFAFIIYMGHLYIWAMVVVIQIFMAKELFNLLRRAHEDRHLPGFRLLNWHFFFTAMLFVYGRMLSQRLVNTVTLDKFLYKLVGRFVKYHMVTCYFFYIAGFMWFILTLKKKMYKYQFSQYAWTHMILIVVFTQSAFTVANIFEGIFWFLLPASLIVINDIAAYFFGFFFGRTPLIKLSPKKTWEGFIGASITTIISAFLLANMFGRFQWLTCPRKDLSTGWLDCDPGPLFKPEYFTLPEWFPAWFLSREIAVLPVQWHALLLGLFASIIAPFGGFFASGFKRAFKIKDFGDSIPGHGGMTDRMDCQMVMAVFAYIYHQSFIVPQNLSIEMILDQIILNLTFEEQLAVYKKLGQIIQERTFGES

SEQ ID NO: 54276 - protein, 284 aa, Senecio vulgaris
PKSQITPYRVVIIIRLVILGLFFHYRITNPVESSYGLWLTSVICEIWFAISWVLDQFPKWYPINRVTLTDELSARYEKEGEPSQLAAVDFFVSTVDPLKEPPLITANTVLSILAVDYPVDKVSCYVSDDGAAMLSFESLVETAEFARKWVPFCKKFSIEPRAPEFYFSQKIDYLKDKVQPSFVKERRAMKRDYEEYKVRVNALVAKAQKTPEEGWTMQDGTPWPGNNTRDHPGMIQVFLGNSGAHDMEGNELPRLVYVSREKRPGYQHHKKAGAENALVRVSAV

SEQ ID NO: 54277 - protein, 592 aa, Vitis vinifera
  misc_feature (247)..(247): Xaa can be any naturally occurring amino acid
  misc_feature (271)..(271): Xaa can be any naturally occurring amino acid
  misc_feature (279)..(279): Xaa can be any naturally occurring amino acid
  misc_feature (297)..(298): Xaa can be any naturally occurring amino acid
MSKQTYRVCFCFRRGFKLKVAEAPSEIKALFNDYSEEGVMSLEQLQKFLIEVQGEDEASMEDVQGIMDSLHEFKHLPIFQLRKGLNLEAFFRYLCHDLNPPLSPHNTVHHDMNAPLSHYFIYTGHNSYLTGNQLSSICSDVPVINSLQCGVRVIELDMWPNSTKDDIDVLHGRTLTTPVKLSKCLISIKKYAFVASEYPVIITLEDHLTPDLQAKVAEMATQIFGDLLFSPESECLAEFPSPESLKXQIIISTKPPKEYLETKIKDKDEGXQKETASIXKKDNGSQKATKSAKKKDXXSQKAKYPSEDKTWGKEISDLKDELEPFDKDEPEEGEDINEEDMEDWDHKLQQSAAPEYRRLIAIQAGKQKGGIKEWIRLDPDKVRRLSLSEQELEKAIITHGQDIIRFTQRNLLRVFPKVMRVDSSNYNPLIGWMHGAQMVAFNMQGYDRPLWLMQGMFRANGGCGYVKKPDLLLKVGPHDKVFDPKANLPVKTTLKVGIAGVPADSLMKKTKAVEDDWTPTWNEEFEFPLTAPELALLRIEVHEYDMSEKDDFGGQTCLPVSELRTGIRAVPLHNQKGEKYNSVKLLMRFEFV

SEQ ID NO: 54278 - protein, 518 aa, Clostridium acetobutylicum ATCC 824
MSILNVKNVNHGFGDRAIFEDVSFRLLKGEHVGLVGANGEGKSTFMSIITGKLMPDEGTIEWSNNVRVGYMDQHASLQKGKTIKDVLKDAFKYLFDMEANMMEITDKMAEASEDELQKLLDEMGTIQDTLDNNDFYVIDVKIEEVAKGLGITDIGLDKDVADLSGGQRTKVLLAKLLLQKPDILLLDEPTNYLDEVHIEWLKRYLNDFENAFILISHDIPFLNSVINVIYHIDNRKLTRYAGDYDNFMRVYEANKKQVEAAYERQQQEIAKLKDFVARNKARVATTGMARARQKQLDKMDIIEKTQEKPKPEFNFKTARTSGKLIFETKDLVVGYDSPLSKPLNLTMERGQKIALVGANGLGKTTLLKSLLGKIKPISGDVELGDYQYIGYFEQEIKEANDKTCIEEVWEEFPAYTQYEVRAALAKCGLTTKHIESKVMVLSGGEQAKVRLCKLINNETNILILDEPTNHLDVDAKDELKRALKEYRGSILLVCHEPEFYKDVVTDVWNCEEWTTKIY

SEQ ID NO: 54279 - protein, 128 aa, Ehrharta erecta
VEIQFSPVGESKRGGEVYRLYDVGGQRNERRKWIHLFEGVNAVIFCAAISEYDQMLFEDETKNRMMETKELFDWVLKQRCFEKTSFMLFLNKFDIFERKIQKVPLSVCEWFKDYQPIAPEKQEVEHAY

SEQ ID NO: 54280 - protein, 507 aa, Vitis vinifera
MALVSYPEILVAVIFFLFIGGFCSKKGVPWNWPIVGMFAGLLFHVHRIHDEAAEILEKTGCTFLFKGPWFCNMDMLGTTDPANVHYIMSSNFSNFPKGTEFRKMFEVLGDGIFNADGESWRNQRKLGQSMINNPRFHRFLAKVTYNKVEKGLVPLLDHLSEQGRVVDLQDVFQRLTFDTTCMLVTGFDTKCLSIEFPEVPFATALEDVEEAVFYRHALPETLWRLLRWLGIGKEKKLRKGWKTLDHTIAEYISMKREELSKGITKLREDEDGADLLTSYMTEDNAIGLKCDGKFLRDTILNFMIAGRDTTSSALTWFFWLVSKNPLVESKIREEIETAIPEKEDRKGRHIFKTEGLNKLVYLHAAMCEALRLYPPVPFQHKAPIQPDVLPSGHKVDPKMKIFFPVYAMGRMTAIWGKDCLEFKPERWISELGKIKHEPSYKFFSFNAGPRTCIGKEVAFTQMKAVAATIIHNYHVEMVKGHHVAPNVSIILYMKRGFKVRVSKRWGG

SEQ ID NO: 54281 - protein, 292 aa, Clostridium acetobutylicum ATCC 824
MINKNTKIGFIGTGVMGKGMIKNLLKGGYTVHVYNRTKEKALPLVEIGAVLETSIKELSQRCDVIITMVGYPSDVEEVYFNDNGILNNLKPQSYVVDMTTSKPSLAKKIYAAAKERNIFALDAPVSGGDIGAAEGTLSIMVGGDKEAFDALMPIFELMGKNIVLQGSAGSGQHTKMCNQIAIASNIMGVCEALSYAKKSGLNAETVLKSIGAGGAASWQLSAYAPRILKGDFNPGFYIKHFVKDMKIALEEADEMGLKTPALELSKKLYDKLIKEGKEDLGTQALYHLYNED

SEQ ID NO: 54282 - protein, 507 aa, Vitis vinifera
MALLGYPEILLAVIFFIILGRFWNINDLPWNWPLLGMFPSVFLHLHRIHDRVTDILEKSGCTFLVKGPWFCNMDLLVTTDPANVHYIMSSHFSNFPKGSEFSKIFDFLGDGIFNSDAESWRKQRKLGQLMINNVRLYRFLGKITQNKVEKGLLPILDYLSEQEDRAMDLQDVFQRLTFDTTCMLVTGFDSKCLSIELPEVPFATALEDAEEAILHRHVLPETLWRLQRWLGIGKEKKHQKAWETLDHTIAEYISKKRDELSKGIINLQEEEDGVDLLTSYMSEDITMGLKCDHKFLRDTILNFMIAGRDTTSSALTWFFWLVSKNPLVESKIREELESAIPEKEDKKGRHTFKTEALNKLVYLHAALCETLRLYPPVPFQHKAPLQPDMLPSGHRVDPKMKILFSLYAMGRMTSIWGTDCLEFKPERWISERGRIKHEPSYKFFAFNAGPRTCLGKEVAFTQMKAVAATIIHNYHVQVVEGHHVAPNVSIILYMKHGLMVRVSKRWG

SEQ ID NO: 54283 - protein, 663 aa, Oryza sativa Japonica Group
MRGFLAATLLVLSLLLNLHTAASVSAWEDKDFFSYCPPSRCGEHGPEIRFPFKLESKNTPSSCGVPCMKLSCSGQYTILHNKYLGRPYKLTAIDYKHALLTAVPLADEDNYSSPSPCPLLKSISIRPNLITGPGYGYYNTGYQNPCQTYDTYYAALVSCSTEFALASVPGTATDNDYIAGPISCLSNQTHFSYLVAYRVTMSLLPLDCEVISDGPIPIPAFYYSGYIPSMFTTSADRILDYPSGYVLSTFRESAERILNSSETMIWWYFYKYDGRHCEQQGRRCAFSSQRNQTFCMGRGSHVKVIAATSSVAAFVILLLMVATALYLSLRTRYNEEIHLKVEMFLKTYGTSKPTRYTFSEVKKIASRFKVKVGQGGFGSVYRGELPNGVPVVVKMLENSKGEGDEFINEVATIGRIHHANIVRLLGFCLEGTRRALIYEYMPNDSLEKYIFSHDSDTSQEVLVPNKMLDIALGIARGMEYLHQGCNQRILHFDIKPHNILLDYNFSPKISDFGLAKLCARDQSIVTLTAARGTMGYIAPELYSRNFGEISYKSDVYSFGMLVLEMVSGRRNSDPSVESQNMVYFPEWIYEQVTAGQDLALGREMTEEEKATTRQLAIVALWCIQWNPNNRPSMTKVVNMLTGRLQNLQVPPKQFFSADSHPTL

SEQ ID NO: 54284 - protein, 122 aa, Phyllostachys aurea
PLGESKRGGEVYRLYDVGGQRNERRKWIHLFEGVNAVIFCAAISEYDQMLFEDETKNRMMETKELFDWVLKQRCFEKTSFMLFLNKFDIFEKKIQKVPLSVCEWFKDYQPIAPGKQEVEHAY

SEQ ID NO: 54285 - protein, 119 aa, Zea mays
  misc_feature (59)..(59): Xaa can be any naturally occurring amino acid
  misc_feature (72)..(72): Xaa can be any naturally occurring amino acid
MGMSRVPSESKGKKVKEVPADFDLSVTTQTGKTYVKKGLDTYHDKFLLPSSVQPVLHMXRGGRAVFFLVALXPGERGLLDQQHHFEEPGVHQSPDGGLSDEGARAIHVTIGRIGNRPAP

SEQ ID NO: 54286 - protein, 691 aa, Bacteroides fragilis YCH46
MKRYFIISLLTLASTVAPLTAVFAQSSFIYEKGKSFKDVNASPMPQTIRLDRTAEPVIYENAVPENATTICYRIQLPSYVRGTFFSRDSRPGDYEWPNNTNRLLPWMFNHLTDLTRDDYPGIPSNARPSTLGDALLLQLTDGSYLFTKAIAGDNSLSWFQVNTDGSLNLYVSTLGTDRLEHKVPVALVQSAGNIYQVFQQAYETLISDRNVSALQKRTEKNYFEALNYLGWCTWEHYHFDIDETKILNDLDAIETSGVPVRYVLIDDGHLANKNRQLTSFTPDPQRFPNGWAPIMAHKNKDKIRWIGLWYALSGYWMGISPDNDFPTHVKNSLYSFNGSLLPGKSTPNIDTFYQYYVHSLKTHGFDFLKVDNQAFTLPLYMGSTEVVRQAKECNLALEKQTHAQQVGLMNCMAQNVLNTDHTLHSGVARVSIDYKKYNENMAKSHLFQSYTNTLLQGQTVWPDHDMFHSSDTICGSLMARSKAISGGPVYLSDSPKEFVKENIFPLIDKEGKIFRPEAPAIPTPESVLTNPLQDGKAYRVFAPTGDEAVSVICYNLNTSPKHRKVTAEIDPKDYLLRETLTGKPTPQQKRVILFDWNNRTATELTGKQTVELDGFTDRLFHLCPIHDGWAVIGIQEKYLSPAAVRILSSTPDKLVLNVFSPGTLKIWTENSGKQELRNIQVKETGKMTIRK

SEQ ID NO: 54287 - protein, 502 aa, Vitis vinifera
MASIGYPEILLAVICFLLLHRLSNSNMLPWNWPLVGMLPWIFRNIQQIQDRCTEVLEQSSGTFLLKGPWFANMDMLITSDPANVHYIMSTNFSNFPKGPEFLKIFDVLGEGIFNSDSDLWRKQRKLAQVLINDRQFQQFLVKTTENKVDEGLIPVLEHVSKQGLLVDLQDLFQRFTFDTTCKLITGFDTKCLSIEFPRVLFAKAMDDVEEAIFFRHVVPESLWKLQRWLGIGEEKKLSKGWETIDNVIAEYISMKHEELSKGIAKLQEDEEGTDLLTSYMNEDSTMELKSNKFLRDTIVNFLLAGRDTTSAALTWFFWLVSKNPLVEAKIREELKETIPEKDQKWHIFRTEELNKLVYLHGALCETLRLYPPVPFQHKAPHQADVLPSGHRVHPKMKILFSLYAMGRMTTIWGKDCFEFKPERWITEQGGIKYEPSYKFFAFNAGPRTCLGKGVAFTQMKAVAAAIIHNYNVQLVQGHPVAPNVSIILHMKHELMVRVTKRW

SEQ ID NO: 54288 - protein, 392 aa, Debaryomyces hansenii CBS767
MSQQQGPSSTPVPLGDLSRLNIPTLPGVTPQPPKANGFWSSNPVFSYLNDVYITIGEHRKSLGLTNPGTIENLNKEVSRDVFLTQYFFTGLRADLNKAFSMAPAFQTSHTLSIGSNVLPPYAFSALYAAEDYFVQGNIDNDLSFSGRINYGWDKHNISKVTLQLANGQPSMCQLEQDYQASDFSINLKTLNPSFLNGGFSGVAVGSLLQSLTSKFAVGLEAMYSKQAGSVPPDSAVSYVARYNAGNWIASAQLQAQGALIASFWRRVTDKVEAGLETQIAATMRPVTDSLMGTPIGFEPVVEGQTTMGAKYEYRQSVFRGQVDSTGKVGVFMEKRVLPTVSILFSGEIDHSKNASKLGLGLQFESAGNEQLMMMQQGLVDANGNPVPGAAQL

SEQ ID NO: 54289 - protein, 502 aa, Microcystis aeruginosa PCC 7806
MVLLEAAVHSSLRAFLREQGRFYWSHHLTMGRLVARALRLKRSSLIQTGTTLTRYCLSYLTPALLGDTPVLIVAPESELNLLLEVEIPHLQTWLQTQRDILKSDRFPANFTGLLLTTPQQWLEDKLGNLGHFPQNIATIIDRAEDLETCLVDYLTVTITPEQWFALESAYPQHREFIDLIKAQLSQSILGHPINPYNCYLIDAKEKEYIIALLQRLDQDLTTDSVWQLLAAKIPEVNYLLWTSVDREREEFTLKISPLEVASFFKLIWQQQPFVLIGSFLDSEKSANLYRQNQGIGDILTLKFAADRESEYIHLYLPDRISAPNTPEFQPMLLKQVRELVSANHTSEQPIVILIEDVPLKAQIATQMAADYGSRVQVEKTEINSNTILVCGWQFWQTHQEKFLTPSLLIIATLPLPSPENPLVAGKIAYYKRQHLDWFRAYLLPTAVREIQQSVQSLRECQGCVAVLDNRVNARSYGRQILSALEPYAKVNYLDQQFFQDKD

SEQ ID NO: 54290 - protein, 492 aa, Physcomitrella patens subsp. patens
MRRAGLNLIPGLSFTHSVLQRQTENLKDLYRLGRKLGQGQFGTTYLCVEKATGREYACKSIAKRKLISQEDVDDVRRELHIMHHLSGHPNIVTIKGAYEDQMAVHLVMELCAGGELFDRIIQRGHYSEAQAAELCRVIVGVVETCHSLGVMHRDLKPENFLLSDQSEGAALKTTDFGLSVFFKPGEVFTDVVGSPYYVAPEVLRKHYGPEADVWSAGVILYILLSGVPPFWAETEQGIFEQVLKGELDFVSEPWPSISDSAKDLIRRMLDPNAKRRLKAHQVLSHPWIGEEGVAPDRPMDPAVQSRLKQFSAMNKLKKVAIRVIAELLSEEEIAGLREMFKMIDTDHSGTITFEELKSGLERVGSNLVESEIRQLMDAADVDQNGTIDYGEFLAATLHLNKIEREENLFAAFSWLDKDNSGYLTVDELQQACSKYNMGETSIEDLIREVDQDNDGRIDYNEFVMMMRKGNGAVGRTTLRNSLSLSDALMNPQ

SEQ ID NO: 54291 - protein, 328 aa, Oryza sativa Japonica Group
MAVVKCIRVHELGGPEVLRWEQVEVGEPKEGEIRIKNTAIGVNFIDVYYRQGVYSAPLPFVPGREAVGVVTAVGPGLTGRKVGDVVAYAGNPMGSYAQEQIIPASVAVPLPPSIDHNTAAAIMLKGMTAHVLLRRVYKVQSGDCVLVHAAAGGVGSLLCQWANALGATVIGTVSNEEKAAQAAEDGCHHVIIYTKEDVVTRVKEFTAGKGVNVVYDSVGKDTYKGSVECLAWRGMLVSFGQSSGRPDPIPLSDLASKSLLVTRPSLMHYTATRDELLESAGEVFANVGSGVLRIRVNHTYPLSQAARAHADLQARKTTGSILLIPDDA

SEQ ID NO: 54292 - protein, 458 aa, Herminiimonas arsenicoxydans
MTIRIGIIGAGPSGLAQLRAFESALSRSKHDVELVCFEKRSNWGGLWNYSWRTGLDEHGEPVHGSMYRYLWSNGPKEALEFADYSFDQHFGRPIPSYPPRAVLFDYIQGRMERNNLRQYIRFNTVTRWVNFDENTQTFEVAVEDLSKQHTYTETFDYLVVATGHFSTPHVPYFKGLDTFPGAVMHAHDFRGADQFKGKDLLLVGGSYSAEDIGVQCYKHGARSVTISYRSAPLGFKWPQGIREVPLVTRFEGKTAHFQDGTHKNVDAVVLCTGYQHKYPFLPEELRLKSHNRLYPRGLYKGVVWKNNPRLFYLGMQDQYYTFNMFDAQAWYTRDIMLGHTALPDMAGMKADIQDWGRREDAVDNSCDAVDFQTAYVRDLMDRTDYPGFEAEQVAELLKQWLRDKQESILTYRDKPFRSVVTGTMAPVHHTAWIDELDDSLERFLDPHINQDNEVNATL

SEQ ID NO: 54293 - protein, 621 aa, Actinobacillus pleuropneumoniae serovar 1 str. 4074
MAIDISHLDNPELAKIVALLATSITIVPLFKRIGLGSVLGYLVAGCLIGPSVLGLIQDPQAVVHLAELGVVMFLFIIGLEMHPELLWSMRKAIFGRGFLQVATCGVLLTLAGIYILGLTKEVAFIAGAGFTLSSTAIVMQVLEDKGIASTQKGQRIVSTLLFEDLAIVPLLATIAFLAPEQANEEKTFSLTSIGIAIVGIIILVVGSKWVMNPLFRMISKAKVREMMTAAALLVVLGAALLMEMSGLSMAMGAFVAGVVLSESSFRHQLEADIEPFRGLLLGLFFMGVGMSLDLNFVFNDLIWLLSIVAVCVLGKAFGVYIIALITRLPHREALMRTSIMSHGGEFAFVLFSAAAAAGLLDQDQQATFTAAVIVSMLISPLVMLLMQRMVARKASVEAPNMMGIEIAEDLENSVIVIGFGRFSQIVCQALLARGITVTVIDSSTDRIRAAATFGFKVYYGDGTRLDVLRASGLEKADCVVLGINNPARSALIVEQIKNEYPLTPIFARTYDRHSAIELTKLHVDFQIRETLESALVLSKAAMMKLGVDEVEATEIVENVRLLDRERFKEELIYGTSAELIRKYFTPKPFFKPQQEAEALNEDAAEILAEEAVESNAESKEK

SEQ ID NO: 54294 - protein, 338 aa, Oryza sativa
MARVRGNFSRAFWFAPGFGVGGVSSNEPPAMGMEVDLRGGDGSLPWHRRGWGRIDASLLADNPNSKLTPPRNITTLAFRLEVDGAYVGPDDAAPLKGGGVGTMEVQVRLAAVAVFDRGGWRTRRRLGAAFPTHAGVVPFPVPVPSLAGVVPVHSHAIEPCCITVAMEHKEAGCQQPEGPILCINNCGFFGSAATMNMCSKCHKEMIMKEEQAKLAASSIDSIVNGCDGGKEHIVAASGSTAVAVAQVEAKTLVVQPTDVAGTSEEVAVVPKVKEGPNRCATCRKRVGLTGFNCRCGNMYCALHRYSDKHECQFDYRTAARDAIAKANPVVKAEKLDKI

SEQ ID NO: 54295 - protein, 258 aa, Zea mays
  misc_feature (198)..(198): Xaa can be any naturally occurring amino acid
  misc_feature (224)..(224): Xaa can be any naturally occurring amino acid
  misc_feature (257)..(257): Xaa can be any naturally occurring amino acid
MADAPAPARGGFGSRGDRGGDRGRGRGRGRGRRGGKSEEKEWQPVTKLGRLVKAGKIKSMEEIYLHSLPIKEYQVVDFFLPKLKDEVMKIKPVQKQTRAGQRTRFKAIVVIGDSEGHIGLGIKTSKEVATAIRAAIIIAKLSVVPIRRGYWGTNLGEPHSLPTKESGKCGSVTVRLIPAPRGTGLVASPAVKRLLQLXAGVQDIYTASSGSTKTLENTLKATLXAVAHTYGFLTPNLWTENALTPSPLEEYSDILRXG

SEQ ID NO: 54296 - protein, 295 aa, Haemophilus ducreyi 35000HP
MKVIIPVAGLGTRMLPATKAIPKEMLTIADKPLIQYIVNECVAAGIKEIVFVTHSSKNAIENHFDTSFELETMLEKRVKRQLLDEVRSIVPNDVTLMHVRQGQAKGLGHAVLCGKAVVGKEPFAVVLPDVILADFTANPKTENLAAMIKRFSETQCSQIMVAPVPQEDVSNYGIVDCATDNIRAGETAKIAKMVEKPSIENAPSNLAIVGRYVFSATIWDLLERTPVGVGDEIQLTDAIDMLIEKETVEAFHMTGRAFDCGDKLGYMEAFVEYSLRHEKCGQQFQKIIKELAKSL

SEQ ID NO: 54297 - protein, 531 aa, Herminiimonas arsenicoxydans
MLNTTHATRGMAVAPHSLASQAALSVLRNGGNAIEAMVAAASTIAVVYPHMNGIGGDGFWVISEPGKPVQAIEACGVVGAGVSREFYSSRQLTSIPMRGPIAGNTMAGTIGGWQEALNISATWGGKQSLGDLLQDAIHYAEAGIPVTASQYASTSAKFDELVMQPGFSDTFLVDGIPPQAGSLFKQPRMGKTLRALVADGLDSFYRGALANDIAADLAEIGNPITLDDLHAYHARTCEPVHLQHSLADIYNTAPPTQGVVSLIILAILDKLNLAQYQQDSPEYIHLTVEATKQAFAIRDQYVADPAYMKVDPQSLLAEEFLAPYVAKIRIDKALPWGKGKGPGDTIWMGVIDGEGRAVSFIQSIYHEFGSGVVLSRTGINWQNRGCSFSLDPNNINSLEPGKKPFHTLNPALARFKDGRTMVYGTMGGDGQPQTQAAVFTRYAVFNQAVQQAVTAPRWLLGRTWGQSSESLKVESRFTDGLIRRLRSLGHDVDVLGEFDELVGHAGAIVRDPSGVFAGGADPRSNGTVAGF

SEQ ID NO: 54298 - protein, 350 aa, Oryza sativa Japonica Group
MASLPVPSVQAMVAAIGIDHVPPRYLRPTDADEPVASDGGEAEIPVVDFWRLQLGDGDELARLHIACQDWGFFQLVNHNVPEDVVEGMKASIKGFFELPAETKKQVVQEPGQLEGYGQLFVVSEDQKLDWADILYVKTQPLQDRNLRFWPDQPAGFRMALDRYCAAVKITADGLLAAMATNLGVESEVIAERWVGGVQSVRVQYYPPCGQADKVVGISPHSDADLVTILLQANEVDGLQIRRGGAWLPVRPLEGALIVNVGDIRQVFTNGRYKSVEHRVVVDGKKERLSMATFHSPSKNAIVGPLSEMVEHEDDAAYTSMDHDELLKLFFAKKLEGKNFLNPIKKLKNSG

SEQ ID NO: 54299 - protein, 284 aa, Senecio vulgaris
PKSQITPYRVVTIIRLVILGLFFHYRITNPVESSYGLWLTSVICEIWFAISWVLDQFPKWYPINRVTFTDELSARYEKEGEPSQLAAVDFFVSTVDPLKEPPLITANTVLSILAVDYPVDKVSCYVSDDGAAMLSFESLVETAEFARKWVPFCKKFSIEPRAPEFYFSQKIDYLKDKVQPSFVKERRAMKRDYEEYKVRVSALVAKAQKTPEEGWTMQDGTPWPGNNTRDHPGVIQVFLGNSGAHDMEGNELPRLVYVSREKRPGYQHHKKAGAENALVRVSAV

SEQ ID NO: 54300 - protein, 478 aa, Vitis vinifera
MGPRNWPIVGMLPMILLHFHCMHEKYTKILELSKGTILIKGAWFANIDMLTTSNPDNVHHVLSTNFSNYPKGPKFRRIFNILGNGLFNSDFDEWRKIRGLAQGFVNHKQFHRFMAKINHDFLENKLVPVLDNASQQNLVVDLQDVFQRLMLDATCITATSYNPNSLCIGFPEVPFLKALDNAGEAIFFRHLVPEGFLKSQRWLGIGKEKKLSKACEVLDHIVAKYISMRQEELGKGKRPEENKDSFDALKYQLTETEIFGTTPTNKYMRDAILGLIFAGQDSTSAALTWLFWLLSKNPSVETNIKEELKSKLPVNKANKLHIFTEEELNKLVYLHGALYETLRLFPPAPLQVRTCIHPDTLPSGHKVNSKMKIVFSAYAMGRMTSVWGNDCLEFKPERWITEKGGIKHVPSHKFLAFSVGPRICLGKESAITRKKSVAAVILHNYHVQVMEGQFVTPKASIVLHMKNGLRVRNKNTWP

SEQ ID NO: 54301 - protein, 1336 aa, Oryza sativa Japonica Group
MALRSPNSMLWLALLVWAALLCGSCHGRFVVEKNSLKVTSPSDMKGTYECAIGNFGVPQYGGTMVGVVAYPKANKKACKSFDDFDISYKAKPGSLPTFLLVDRGDCFFTKKAWNAQNAGAAAILVADDKTEPLITMDTPEESGNTDYLENITIPSALITKSFGDKLKKAIDNGDMVNVNLDWRESLPHPDERVEYEFWTNSNDECGPKCDSQIEFVKSFKGAAQVLEKKGYTQFTPHYITWYCPDSFILSKQCKSQCINHGRYCAPDPEQDFSKGYDGKDVVVQNLRQVCVYKVAKEHGKPWLWWDYVTDFAIRCPMKEKKYTKECADGVIKSLGLDHKAIDKCIGDPDADKENPVLKAEQDAQIGKGSRGDVTILPTLVINNRQYRGKLDKGAVLKAICAGFRETTEPAVCLSEDIQTNECLENNGGCWQDKAANISACKDTFRGRVCECPVVKGVKFVGDGYTHCEASGSGRCEINNGGCWKDSRHGRTYSACTNDGCKCPDGFKGDGVHKCEDIDECKERTACQCKECKCKNTWGSYECGCSGGLLYMKEHDTCISKNAATEVGWNFLWVIFFGLVVAGIAGYAVYKYRIRFCLVLAEKEKSGIPNINWLRDRLFRSIRRRRRRGALAPLAPTLTTAIAMPSCFTLDSASDDGRSTAQGQGWPAGVGGFLSGFFSAGAARADGGKPSPDWDAHGLAASALPVPLSRLDGKKRAQLRDELDALATSGMFDHVTLQTKPKPDGTLGLTVSYAETEWPAVEHFKCINVGGPMARPDGDELELDDDMTARERMEHLRRQEREYQQLVRRAKPCVLPEKLQRELQGMVKRQRKVSSGLLKRMAGRIERWYHDEGFHCAQVVSYHGNLDAGEVVCEVVEGDITKVEYQFLDKLGNVVDGNTSIPLIDRELPQQLRPGHIYNNGAGKQALKNIDSLGLFSTIEVQPRPDETNQGGVIVAIKLKEHDPKSAQVITDWSIVPGSQGRPTLASIQPGGTVSFEHRNICGLKRSLIGSVTSSNLLNPEDDLSFKLEYAHPYLDGIDNLSRNRTFKISCFNSRKLSPIFVAGPNMYEAPPIWVDRIGFKANITESFTKQSKFTYGLIVEEITTRDENNNICTHGSRQLPSGALSMIGPPTTLSGTGVDRMAFLQANITRDNTEFVNGATIGDRCIFQMDQGLGIGSKNPFFNRHQLTVTKFINLNKQEKGSRKPPPAVLALHGRYAGCVGDLPSYDAFALGGPHSVRGYGMGELGASRNLLEVATELSVPITVKNRHTQVYAFAEHGTDLGSSKDVEGNPTEFFRRVGHGSSYGVGVKLGAVRAEYAVDHNAGTGAFFLRFGERF

SEQ ID NO: 54302 - protein, 290 aa, Oryza sativa
  misc_feature (253)..(253): Xaa can be any naturally occurring amino acid
MVMRPRPQRAAKFEAMGARRVASSSREPWRPRPWRKYKQSRPPPFSPPRRARGEATEPKRAMAGGVVIGVAPPAAAEEPEPHVERLPADLLAHVLSLLPSFHDLSMAGGVSRRWRARFVRAAVNLRDLDICWGCQITDQGLIRISTADCVKNLTSISLWGLAGITDNGVIQLVSRAHSLQHLNIGGTFITDESLYAVAKSCINLKSIIVWSCRHVTEAGLVALVGGCRRLECINVGGMRVPPESFAGLLALRXPALQIRSIPQIFIASSSFIKHPGKIPSFHKMNVYYNK

SEQ ID NO: 54303 - protein, 160 aa, Zea mays
  misc_feature (9)..(9): Xaa can be any naturally occurring amino acid
  misc_feature (26)..(26): Xaa can be any naturally occurring amino acid
  misc_feature (37)..(37): Xaa can be any naturally occurring amino acid
  misc_feature (46)..(46): Xaa can be any naturally occurring amino acid
  misc_feature (54)..(54): Xaa can be any naturally occurring amino acid
  misc_feature (116)..(116): Xaa can be any naturally occurring amino acid
  misc_feature (127)..(127): Xaa can be any naturally occurring amino acid
ALVREFCAXTGPNQDDALARTEKLSXVNPMLGSRDCXFGLSNPELXRMPARPIXEAVMLLTNHSLWEHSNTLVGQGCPEIMVALARAPHDLGLKVTVMRPGAQKVGRIVADTIGGXAGAMVAIRSSXGLGADDTLEQAEFFFFRTNYRTHMTFGYLRDDV

SEQ ID NO: 54304 - protein, 453 aa, Hypocrea virens
MFSKLAANFAQRAAGSAAGTTRRVAFQTRFVSSQTLANGSKGRAIPFQKPGSVPATFTIRDGPVFRGKAFGANANISGEAVFTTSLVGYPESMTDPSYRGQILVFTQPLIGNYGVPSNERDEYNLLKYFESPHIQCAGVVVSDVALNYSHWTAVESLSEWCAREASPPSPASDTRAIVTHLREQGSSLARISIGDEYDADEDESFVDPGQINLVKRVSTKAPFVIESPGADLHVALIDCGVKENILRQLVSRGASLTVFPYNYPIHKVADHFDGVFISNGPGDPIHCQETVYNLARLMETSSIPIMGICLGHQLLAMAVGAKTIKMKYGNRAHNIPALDLTTGQCHITSQNHGYAVDASTLPNDFKEYFVNLNDGSNEGMMHRTRPIFSTQFHPEAKGGPMDSSYLFEKYLENVRAAKSAQRVYKDNRPSQYVLDVLSKERVGVEPVPLVGFA

SEQ ID NO: 54305 - protein, 491 aa, Clostridium acetobutylicum ATCC 824
MTSKKEQKNELKRTLTARHMNMIAIGGSVGTGLFFASGSAISTAGPGGALLAYIITGILVYVLMMSLGEMSTLLPISGSFETYATRFVDPALGFTLGWNYWFSWSICVASELVAGSLIVKFWFPHTNTTIWSIGFLLVIFILNILSAKAYGESEYWFSSIKVVTIIIFIIVGVLMIFGIMGNDSPGFKNWVISGNGSRAPFVGGIAAIINVFLVAGFSFSGTEIVGLAAGETENPEENVPKAIKSVFWRILLFYICAIIIIGFLVPFNDKNLLKSGVNNIAYSPFTMVFAKCGIAFAASAMNAVILTSVLSCGNSGLYVSSRMLYSLAKEGKAPKFLAKVNKQGVPMNALYATTLVASSAFLSSLIGEGKIYYVLYNASGITALFAWLGIGICHYRFRKAYVAQGRDLKDLKFKAKFYPYGPIMAIVLCVVIIFGANIWIFQAPKFSWFDFISNYICIPIFIALYIAYKYIKKTKLVPLEECDFEYNGKDK

SEQ ID NO: 54306 - protein, 756 aa, Zea mays
MTVTPRITVSDGRLTVRGRTVLTGVPDNVSAAHAAGAGLVDGAFVGAHAGEAKSHHVFTFGTLRDCRFLCLFRFKLWWMTQRMGVSGRDVPLETQFMLVEVPASDGDGDDAPAYVVMLPLLEGQFRAALQGNDRDELQICIESGDKAVQTDQAAHMVYLHAGDNPFDTVTAAVKAVEKHLQTFHHRDKKKLPSFLDWFGWCTWDAFYTDVTADGVKHGLQSLSKGGAPPRFLIIDDGWQQIASENKPDPNVAVQEGAQFASRLTGIKENTKFQTKPDGDGDGEQAPGGLKRLVAETKDAHGVKQVYVWHAMAGYWGGVTPTAGTAMERYEPALAYPVQSPGVTGNQPDIVMDSLSVLGLGLVHPRRVRDFYGELHAYLASCGVDGVKVDVQNIIETLGAGHGGRVAITRAYHRALEASVARSFPDNGCISCMCHNSDMLYSAKQTAVVRASDDFYPRDPASHTVHVASVAYNTVFLGEFMQPDWDMFHSLHPAAEYHGAARAIGGCPIYVSDKPGNHNFELLRKLVLPDGSVLRAQLPGRPTRDCLFSDPARDGESLLKIWNLNKCGGVVGVFNCQGAGWCRVTKRTRVHDASPGTLTGTVRADDVDAIARVAGDGGGWDGETVVYAHRTRELVRLPRGVALPVTLGPLQYEVFHVCPLRAVVPGVSFAPVGLLDMFNAGGAVEECDVISDDGGKAMALRVRGCGRFGAYCSREPARCLLDSAEVEFSYDADTGLVSVDLPVPEQELYRWTLEIMV

SEQ ID NO: 54307 - protein, 168 aa, Triticum aestivum
  misc_feature (73)..(73): Xaa can be any naturally occurring amino acid
MRSPVPAMLTAPSAAAAVAKPLPVARSNTTAALHATASSRRDVMTGVGAALLLALSPQRARAASDDEYLPETXEVIGKVRSTISMDKTDPKVADAVTELREMSNSWVAKYRREKALLGRQSFRDMYSALNAVSGHYISFGPTAPIPNKRRIRILEEMDAVEKSLKRGR

SEQ ID NO: 54308 - protein, 379 aa, Vitis vinifera
MASLWLEFGVFSDDENRPFQLSPGFHSQQIPKVAYYQTYSSARRGDDVALQCIARVPRSRHPHLLLVCKSWRSILNSPDFFSTRSLLNCMQHSLYLIVRVNCTLKWFVLNQNPRILASLPPNPSPAIGSAFAAIGSKIFVLGGSVNDVASPTVQVFDCRFGTWELGPRMRVGREFAAAGVVGRKIYVMGGCLVDTWAKSANWAEVFDPAAGRWAGVESPVEVREKWMHASAVVEEKIYAMADRGGVVFEPGTAEWGGVSTELDLGWRGRACVVDGVLYCYDYLGKIRGFDVKEGLWKELKGLEKGLPKFLCGATMANVGGNLVVLWEGKGNGKEMEISCAEIAIQKCSDGGLRGSIVWSDVILSVPIGSAIVHCLAVAV

SEQ ID NO: 54309 - protein, 523 aa, Beta vulgaris subsp. vulgaris
MEGRNVKNGDTNNNKIVGSSLSIEKNPISPPEASSLKKLALVASIAAGVQFGWALQLSLLTPYVQLLGIPHTWAPYIWLCGPISGMIVQPTVGYYSDRCTSKFGRRSPFIAVGATLVGFAVSLIGFAADIGHATGDPNGNVPKPRAIAVFVVGFWILDVANNTLQGPCRALLADMAAGSQAKTRYANAFFSFFMALGNIGGYAGSYGRLYTVFPFTHTKACDTYCANLKSCFFISITLLIVLTILALSVVRERPFTLDEIQEEENLKNNTGGCARLPFFGQLFGALKDLPKPMLILLLVTCLNWIAWFPFLLFDTDWMGKEVYGGTVGEGKAYDMGVHAGALGLMINSVVLGIMSLGIEKLARLVGGVKRLWGIVNLILAVCLAMTILVTKSAEHYRATHHVPGAIGPPLPPPGVKGGALAIFAVLGIPLAITFSIPFALASIFSASSGSGQGLSLGVLNLAIVVPQMFVSVTSGPWDALFGGGNLPAFVVGAVAATASAILSFTLLPPPPPEAKIGGSMGGH

SEQ ID NO: 54310 - protein, 466 aa, Roseovarius nubinhibens ISM
MESFMMDGKFLDNDIEKIVDADRAHVWHHLTQHKPFETGEPRIILEGKDMRVWDQKGKEYVDAVSGGVWTVNVGYGRERIANAVRDQLVKLPYFAGSAGSIPGALFSEKLISKMPGLTRVYYTNSGSEANEKAFKMVRQIAHKRYGGKKHKILYRDRDYHGTTIATLSAGGQDERSAQYGPYVPGFVRVPHCLEYRAQWDLSGEEYGIAAANAIEEVILAEGPDTVGALCLEPITAGGGVIVPPEGYWPRVQEICEKYDILLHIDEVVCGVGRTGTWFGYQHYGVKPDFVTMAKGVASGYAAIACCVTSERVFELFKDDASDPLNYFRDISTFGGCTAGPAAALENMAIIEEENLLDNCNAMGAYMLDQLHALKDKHAVIGDVRGKGLFLGAELVADRSSKEPVDEKQAQAVVGDCGAQGVIIGVTNRSIPGFNNTLCYSPALIATKDDIDQIIEATDKALTKVFG

SEQ ID NO: 54311 - protein, 382 aa, Triticum aestivum
MGTYLSTPKTEKQTADGEGARVRYGLASMQGWRTTMEDAHTAMPQLDERTSFFAVFDGHGGKAVAKFCAKHLHMQFLRSAAYCSGDLASSARKAFLRMDEMMKGQRGWRELAELGEKGPKFTGMLESIIWSPKAGDADKLGDGWHSEEGPHSDFSGPTCGSTACVAIIRNDQLVVANAGDSRCVISRKGRAHDLSRDHKPELQSEKERIENAGGYIVAGRVNGSLNLTRAIGDMEMKENKLLPAEKQTVSAEPEVNTVTLSEDDEFIVLACDGIWDCMSSQQVVDFVHEKLKTEDSLSAVCEKVLDRCLAPESGGEGCDNMTMILVVLKKPTDSAATSSSEQSPVMPTKSAAATSSSEQSAVTNEEMRPSEPDAPKTPTSSK

SEQ ID NO: 54312 - protein, 170 aa, Zea mays
MAPTVMMASSATAVAPFQGLKSAASLPVARRSTRSLGNVSNGGRIRCMQVWPAYGNKKFETLSYLPPLSTDDLLKQVDYLLRNGWIPCLEFSKLGFVYRENSTSPCYYDGRYWTMWKLPMFGCTDATQVYKELQEAIAAYPDAFHRVIGFDNVRQTQCVSFIAYKPPGSE

SEQ ID NO: 54313 - protein, 653 aa, Thiobacillus denitrificans ATCC 25259
MAVTTNKAAKTEGMTWRRYKDGESEANIRSAQDRIFQSSWTHKCPEYMLSTPPCQGSCPAGEDIRGYLNIVRGIEKPPAGVTWQEYAFRRVTEANPFPGVMGRVCPAPCESGCNRNMVEDHVGINSVEHFIGDWGIENNMAYTSTAAETGKKIAIIGAGPAGLAAAYQLRLRGHGVTIFDEHEELGGMMRYGIPGFRTPREMLDAEINRIIALGVETRLKTRVGSDISFDELDKNYDAIFMAMGAQAGRPLPVPGAEAPNCVTAVAFLRAFNEGRLQHVGNRVVVIGGGDTSIDVATVARRLGNVTKSGTHDDRPEAVIAGHMASDVASISAREGAEVVLVSRATVDKMAANKHEVEHAQQEGIEIIGGVTPVSVVVDANGRATALRVADFVMEGKETKIVEGTERDLPADLIVSAIGQGVDFTGLEQFNNNNGLIKADKNYRFPNNEKVFVGGDVIRPHLLTTAIGHASIAVDGIDAFLAGKELDKRPKVDVHHFDEIRKWLESGHEYSEVKGQIWGTSERKDILHNFEDRSQRHVIPHNELFLGHFPNEARHIREVTVLDKEGALGNFEERLHALSEKDVVAEAKRCMSCGQCFECDNCVVYCPQTAVFKVKKKDNPTVGRYVDTDYGKCIGCHICADVCPTGYIVMGMGD

SEQ ID NO: 54314 - protein, 994 aa, Botryotinia fuckeliana
MAETFTGNRSQGLMRRLSNKISRRQSTNTSREQSAGPVMLRRRSDSTSTAPDSRHYLLNSDSDEDVHEDTIEWVDSPLGIEGLVGDYPSSNASFACSSTMTGGNAGLAFGPVIPTVLLQGTTMIKITKKKRKVLTFVLEDEACKVSWDKTRPAKSFLIDNIKEIRLGSDALNYREEFKVDSQDEPRFFSILYVVPDNKSTGRSTKIMHLIAPDEQTFDLWTTTLEAISKHRYENMSSLVAFNEKAVRNYWRGEMTKQFSDTPHAEDEEALDFEGVEQLCKNLHINTSSRFLRERFQQADATKSKKLIFSEFQEFVKLMKRRGDVSEIYRELASDNVKGITLEEFIDFVNVVQGENVEKDRAKWESIFAKFARRSRSRDQPLQEGEAARMSEEALATFFTSVHNVPLETVPETFTLDRPMHEYFISSSHNTYLMGRQVAGESSVEAYISALIKGCRCVEIDCWDGKDGRPIVNHGHTMTRPIMFSDVMYTIAKYAFVKSHFPLWISLEVHCNDAQQAAMAQIIKEACGDLLVTEPLDPSSQVLPSPSQLMDRILIKVKKPRISDESSPKVNGRSRGNSLSSPRVYPAGLDNSTISSGSLLPPPTANPSGSHIKQNIRRTGTDETTSSSSSDSEGNEDRPKDKPKTSKIVKVLGELGIYSAGVKFRGFDDPESKAYNHIFSFMESTFDRNSKTQIDRRAMTRHNMRYLMRVYPNGWRVASTNFDPLKYWRRSVQMVALNWQTHDLGMQMNDAMFAGGTDQSGYVLKPSELREIKMLPSVPEEAGADHVKRERKNVNFSIDIISAQQLMRPKGLPSNRSVDPYIEVEVYHADDKSKETKGVIGEGGLDASAKDGSSGLGAPHKRRTHIVQENGFNPVFNKKFNFALTTKFPELVFVRWTVRCSSDGHSYNDKTLPLATYTAKLSSLKQGYRTLPLYDTNGDQFLFSTLFCRVKIDPATSIYVNAESNESVGVLKSLGRTVFNRTPLSPKPSVDSNHQ

SEQ ID NO: 54315 - protein, 99 aa, Prochlorococcus marinus str. MIT 9313
MASYKVTLISESEGLNKTIEVPDDQYILDAAEEQGIDLPYSCRAGACSTCAGKLTGGSVDQSDQSFLDDDQLEAGFVLTCVAYPTSDCTIKTHAEEELY

SEQ ID NO: 54316 - protein, 451 aa, Brucella suis 1330
MICIMKSAYSLITPLSERKEKQPERTINQLPSGICRRKALFGLQAQSLAEVTVISKAAAVIVAAGRGERAGQSAEGPKQYRLIGAEAVLARTLRAFTDCPLIGTIAVVIHPDDHALYRRAVPEKHENVILVTGGPTRQESTRLGLLALKDEAPQYVLIHDGVRPFIGQDLLERIIANLTPDNGVLPALAVPDTLKRAAADGMVETTISRTGLFAAQTPQAFPYAPILDAHEKAFAINRTDFTDDAAIAEWQEIAVRIIEGSADNTKLTWAKDIEMADKRLRQDHAVFPDIRTGNGYDVHSFEPGDHVTLCGVKIPHEAKLNGHSDADVALHALTDALLATRGAGDIGTHFPPSDSQWKGAASRIFIEHAAKIVREAGGRIANVDVTLISEAPKIGPHRAAMTQALCDMLGIAADRVSIKATTNEKLGFVGRREGIAAIATATVIYPGEVPE

SEQ ID NO: 54317 - protein, 500 aa, Schizosaccharomyces pombe
MAKKDKTSVKKSVKETASKKGAIEKPSKSKKITKEAAKEIAKQSSKTDVSPKKSKKEAKRASSPEPSKKSVKKQKKSKKKEESSSESESESSSSESESSSSESESSSSESESSSSESSSSESEEEVIVKTEEKKESSSESSSSSESEEEEEAVVKIEEKKESSSDSSSESSSSESESESSSSESEEEEEVVEKTEEKKEGSSESSSDSESSSDSSSESGDSDSSSDSESESSSEDEKKRKAEPASEERPAKITKPSQDSNETCTVFVGRLSWNVDDQWLGQEFEEYGTIVGARVIMDGQSGRSKGYGYVDFETPEAAKAAVAANGTKEIDGRMVNLDLPNPRPANPQPYAQQRAGNFGDQLSEPSDTVFVGNLSFNATEDDLSTAFGGCGDIQSIRLPTDPQSGRLKGFGYVTFSDIDSAKKCVEMNGHFIAGRPCRLDFSTPRTGGGSRGGRGGFGGRGGFGGRGGFGGGRGRGRGGARSGNPNRGSVAPFSGNKVTFD

SEQ ID NO: 54318 - protein, 131 aa, Allium cepa
ATAMEAMAATAMAKDPTGQMMLSGFQGLRSVGSVPVGRSVKALPIPSSFSSSVITAVAVPEVKRSKVEIFKEQSNFLRYPLNEELLTDAPNINEASTQLIKFHGSYQQYDRDERGKRSYSFMLRTKNPCES

SEQ ID NO: 54319 - protein, 551 aa, unidentified eubacterium SCB49
MLLQQTIKNFTQNPKNDILSGLTVALALVPEAVAFAFVAGIDPLVGLYGAFMMGIITSLFGGRPGMISGATGAMAVVMVALVSKGNEVGLALETPVENLGLQWLFITLLFVGIIQISAGVLRLGKFVRLIPHPVMMGFVNGLAIVIFRSQLGLFPELATEGISFIENTGDWFSAFFSSVDFWKMMGLVGLTMGIMFGLPKLTKKIPAALAAIIVVAAIVIFGKVDVSTVGSFIQDGGGTGLKGGLPTFQDQIFTLFYTVKGHFWSTIAPFAAILAAIGLIESLMTLNLIDEMTETRGSGNRECIAQGGANMLNGLFGGMGGCAMIGQSIINVNSGGRGRLSGTVAAIALLCFILFAAPLIEQIPIAALVGVMFMVVIGTFAWSSFRILHKIPLSDAIVLISVSIITVWQDLAIAVIAGVIMSALTFAWNSATRIRARKSIKEDGTKVYAIWGPLFFGSTTAFNSKFDFTTDPEKIEIDFMESKVSDHSGVEALRNITNKYMDQGKKVTLTHLSPDCKDMLIKWNPEFKTIIQDAIDDPRYHVVTSMLDSEV

SEQ ID NO: 54320 - protein, 136 aa, Allium cepa
SLALLATTMEAMAATAMAKDPTGQMMLSGFQGLRSVGSVPVGRSVKALPIPSSFSSSVITAVAVPEVKRSKVEIFKEQSNFLRYPLNEELLTDAPNINEASTQLIKFHGSYQQYDRDERGKRSYSFMLRTKNPCES

SEQ ID NO: 54321 - protein, 516 aa, Solanum lycopersicum
MKSTVHLGRVSTGGFNNGEKEIFGEKIRGSLNNNLRINQLSKSLKLEKKIKPGVAYSVITTENDTETVFVDMPRLERRRANPKDVAAVILGGGEGTKLFPLTSRTATPAVPVGGCYRLIDIPMSNCINSAINKIFVLTQYNSAALNRHIARTYFGNGVSFGDGFVEVLAATQTPGEAGKKWFQGTADAVRKFIWVFEDAKNKNIENILVLSGDHLYRMDYMELVQNHIDRNADITLSCAPAEDSRASDFGLVKIDSRGRVVQFAENQRFELKAMLVDTSLVGLSPQDAKKSPYIASMGVYVFKTDVLLKLLKWSYPTSNDFGSEIIPAAIDDYNVQAYIFKDYWEDIGTIKSFYNASLALTQEFPEFQFYDPKTPFYTSPRFLPPTKIDNCKIKDAIISHGCFLRDCTVEHSIVGERSRLDCGVELKDTFMMGADYYQTESEIASLLAEGKVPIGIGENTKIRKCIIDKNAKIGKNVSIINKDGVQEADRPEEGFYIRSGIIIISEKATIRDGTVI

SEQ ID NO: 54322 - protein, 461 aa, Thermococcus sp. GU5L5
MKPAKLLVFVLVVSILAGLYAQPAGAAKYLELEEGGVIMQAFYWDVPSGGIWWDTIRQKIPEWYDAGISAIWIPPASKGMGGAYSMGYDPYDFFDLGEYDQKGTVETRFGSKQELVNMINTAHAYGIKVIADIVINHRAGGDLEWNPFVNDYTWTDFSKVASGKYTANYLDFHPNEVKCCDEGTFGGFPDIAHEKSWDQYWLWASNESYAAYLRSIGVDAWRFDYVKGYGAWVVKDWLDWWGGWAVGEYWDTNVDALLNWAYSSDAKVFDFPLYYKMDAAFDNKNIPALVEALKNGGTVVSRDPFKAVTFVANHDTDIIWNKYPAYAFILTYEGQPTIFYRDYEEWLNKDRLKNLIWIHDHLAGGSTDIVYYDNDELIFVRNGYGDKPGLITYINLGSSKAGRWVYVPKFAGACIHEYTGNLGGWVDKWVDSSGWVYLEAPAHDPANGYYGYSVWSYCGVG

SEQ ID NO: 54323 - protein, 97 aa, Zea mays
MAARNFLVRSPKEEESSAAVREAVLLGGKNAAIAGTVVAVPTLVACRVLPWAKHNLNYTAQALIISAVCIAGFFITADKTILRNARQNTIGRIDKST

SEQ ID NO: 54324 - protein, 311 aa, Aspergillus nidulans FGSC A4
MASQSDKSVLGMPGFVVDFLMGGVSAAVSKTAAAPIERVKLLIQTQDEMLRSGRLDRKYNGLMDCFRRTTQAEGVVSLWRGNTANVIRYFPTQALNFAFRDTYKSMFAYKKDRDGYAKWMAGNLASGGMAGATSLLFVYSLDYARTRLANDAKSTKGGGERQFNGLIDVYKKTLASDGIVGLYRGFGPSVLGIVVYRGLYFGMYDSLKPVVLTGALEGSFLVSFLLGWGVTTGAGIASYPLDTVRRRMMMTSGEAVKYSSSFDAFRQIIAREGVKSLFKGAGANILRGVAGAGVLSIYDQVQLILFGKKFK

SEQ ID NO: 54325 - protein, 68 aa, Zea mays
MTTSRRLADRKSAKFQKNITKRGSVPETTVKKSNDYPVGPIVLGFFIFVVIGSSLFQIIRTATSGGLA

SEQ ID NO: 54326 - protein, 461 aa, Thermococcus sp. 'AEPII 1a'
MKKFVALFITMFFVVSMAVVAQPASAAKYSELEEGGVIMQAFYWDVPGGGIWWDTIRSKIPEWYEAGISAIWIPPASKGMSGGYSMGYDPYDFFDLGEYNQKGTIETRFGSKQELINMINTAHAYGIKVIADIVINHRAGGDLEWNPFVGDYTWTDFSKVASGKYTANYLDFHPNEVKCCDEGTFGGFPDIAHEKSWDQHWLWASDESYAAYLRSIGVDAWRFDYVKGYGAWVVKDWLNWWGGWAVGEYWDTNVDALLNWAYSSGAKVFDFPLYYKMDEAFDNKNIPALVSALQNGQTVVSRDPFKAVTFVANHDTDIIWNKYLAYAFILTYEGQPVIFYRDYEEWLNKDRLNNLIWIHDHLAGGSTSIVYYDSDEMIFVRNGYGSKPGLITYINLGSSKVGRWVYVPKFAGACIHEYTGNLGGWVDKYVYSSGWVYLEAPAYDPANGQYGYSVWSYCGVG

SEQ ID NO: 54327 - protein, 518 aa, Solanum lycopersicum
MDALCAGTAQSVAICNQESTFWGQKISGRRLINKGFGVRWCKSFTTQQRGKNVTSAVLTRDINKEMLPFENSMFEEQPTAEPKAVASVILGGGVGTRLFPLTSRRAKPAVPIGGCYRVIDVPMSNCINSGIRKIFILTQFNSFSLNRHLARTYNFGNGVGFGDGFVEVLAATQTPGDAGKMWFQGTADAVRQFIWVFENQKNKNVEHIIILSGDHLYRMNYMDFVQKHIDANADITVSCVPMDDGRASDFGLMKIDETGRIIQFVEKPKGPALKAMQVDTSILGLSEQEASNFPYIASMGVYVFKTDVLLNLLKSAYPSCNDFGSEIIPSAVKDHNVQAYLFNDYWEDIGTVKSFFDANLALTKQPPKFDFNDPKTPFYTSARFLPPTKVDKSRIVDAIISHGCFLRECNIQHSIVGVRSRLDYGVEFKDTMMMGADYYQTESEIASLLAEGKVPIGVGPNTKIQKCIIDKNAKIGKDVVILNKQGVEEADRSAEGFYIRSGITVIMKNATIKDGTVI

SEQ ID NO: 54328 - protein, 717 aa, Alteromonadales bacterium TW-7
MAHRIMLIPISTGVGLTSVSVGLVRALEQKAVKVNFFKPIAQPRSGETGPEKSTQIIKQGSPIDPPTPFALDYAEQMIGDAKGDDLLEEIVERFESKINDDEVAIIEGMVPTRKQPYAGRVNREIAQTLGADIVFVLTPGNDNITQLEDRLEIAAGNYGGIDHPRVLGCIFNKVNAPLDEEGRARADLVDSYKPDEVDNELNRLASLPIFRKNPFMLLGAIPWDFDLVAPRVKDLSAYLKATIINEGDMLHRRLRRITFCARTVSNILNHFTPGALLVTPGDRSDILVAACLSAMNGTKIGAILLTGGFMPEQRIMALCEQAMQTGLPILATEADTWRTSLLLHNFNMEVPSDDDQRIEKVKSHNAEYIDSDWLNSLAKNVGKTRKLSPPAFRYLLTDKARKAGKTVVLPEGNEPRTIKAAAICGQRGIAKTILLGDREEIMRIAEQQGIELNENVSIVEPSSIINDYVEPMVEIRKSKGLTAVVAQEQLLDNVVLGTMMLEQGKVDGLVSGAVNTTANTIRPPLQLIKTAPGSSLVSSVFFMLLPDQVLVYGDCAINPDPNAEQLADIAIQSADSAAAFGIEPRVAMISYSTGTSGTGADVEKVREATKIAQQKRPDLIIDGPLQYDAAIMENVALKKAPNSPVAGKATVFIFPDLNTGNTTYKAVQRSADLISIGPMLQGMRKPVNDLSRGALVDDIVYTIALTAIQAAQVEALN

SEQ ID NO: 54329 - protein, 846 aa, Roseovarius nubinhibens ISM
MQHNDPDITLITPDAPMAAETHGGRAKCLQRLVRLDLPVPTTVALSFKAVRAIAAGDITCAEALLRPFGAHPLLCVRPSSEDPDWGGPRAVLNIGMNDAQFEALSERIGREAAAKLYLRFVQSYAIHVARLDPDDLDDVSDAPVKGLQEALDIYEDEAEEPFPQDPAVQLIEVLRSMARAWEGTTARLLRQAKGAPADAGLGLVVQSMALGVGQGECGSGVMQLVNSVSGERKITGRYLSQSQGRDALTSGAGAMYLERDPRGPSLEELAPEAFARLKSYTQLMREKLREEMQAEFTIENGEVFLLDGVRVVRNARAAVGIVVALAEDKIISREEALMRIEPRALNELLHRQVDPEAHRDVLAKGVAASPGAASGVIVFSPEAAQAHAAQGVASILVRRETSPEDIRGMHAAAAVLTERGGMTSHAAVIGRGIGLPCVVGASSLRFQTTRKLLTAPDGRVFREGDKITIDGTNGEVLAGEPALLEAGNLDSLRVLMAWADAVRDIEVRANADTPRDAETARWFNAEGIGLCRTEHMFFEADRLIVMREMIFAKTSKDRAAALERLLPMQRADFADLFRIMEGKPVCIRLLDPPLHEFLPTGRSGHRELAEALDLPLSDVTRRVEALGEYNPMLGMRGVRLGITVPEIYEMQARAIFEALLSQGEGRDPVVPEIMIPLVSASREVDLVKSRIDAVASAVRNESGREFTYRLGVMVETPRAALRAGDIAPKVAFLSFGTNDLTQMTYGLSRDDAGRFMSDYVQQGVYPEDPFHSLDVYGVGELLSLGAARARETNPNLVLSICGEHGGNPESIAFCRAAGFDYVSCSPFRVPVARLAAAQLAIKDKIG

SEQ ID NO: 54330 - protein, 479 aa, Pseudomonas fluorescens PfO-1
MTKRYDNYINGEWVAGNDYSANINPSELSDTIGDYAKADLAQVNAAIDAARAAFPAWSTSGIQARHDSLDKVGTEILARREELGTLLAREEGKTLPEAIGEVTRAGNIFKFFAGECLRLSGDYVPSVRPGVNVEVTREALGVVGLITPWNFPIAIPSWKIAPALAYGNCVVLKPADLVPGCAWALAEIISRAGFPAGVFNLVMGSGRVVGEALVNSPKVDGISFTGSVGVGRQIAVNCVSRQAKVQLEMGGKNPQIILDDADLKQAVELSVQSAFYSTGQRCTASSRLIVTAGIHDKFVEAMAERMKSIKVGHALKAGTDIGPVVSQAQLEQDMKYIDIGQSEGARLVSGGGLVTCDTEGYFLAPTLFADSEASMRISREEIFGPVANIVRVADYEAALAMANDTEFGLSAGIATTSLKYANHFKRHSQAGMVMVNLPTAGVDYHVPFGGRKGSSYGSREQGRYAQEFYTVVKTSYIGS

SEQ ID NO: 54331 - protein, 176 aa, Picea sitchensis
MGKGGLTVQKPSRSEEILEAQQQLQIAEQIKSHFESLAPKRHRKPLRSESSDDYDNVEDDPCDGIPPELKKYQELESRSESLFVSENGERLPEEFVETDYYKDLNAIDKVHHPPGEAFIKLDCNGGSYFRLAFQEETGLMERIPVRSNPATNDWLPAPVDDQEMVMAASLKPVRSG

SEQ ID NO: 54332 - protein, 395 aa, Lentinus tigrinus
HWHGFFQKGTNWADGPAFVNQCPISSGHSFLYDFRVPDQAGTFWYHSHHSTQYCDGLRGPIVVYDPKDPQKHLYDVDNESTVITLSDWYHVAAKLGPRFPPGSDLTLINGLGRSGSTPTADLAVITVTHGKRYRFRLISMSCDPNYVFSIDNHDLTIIETDAINTKPHVVDSIQIFAAQRYSFVLNANQNVSNYWVRANPNFGTTGFADGVNSAILRYDGAPVAEPAPSDPPASVKPLVETDLHPLASMPVPGKPVAGGVDKAINLDFNFNGTNFFINNASFIPPTAPVLLQILSGAHLAQDLLPSGSVIPLPAHKTIEISMPATTHAPGAPHPFHLHGHAFAVVRSAGSTSYNYKDPIWRDVVNTGTPQAGDNVTIRFHTDNPGPWFLHCHIDF

SEQ ID NO: 54333 - protein, 195 aa, Picea sitchensis
MASSIMALSSTAAVAAVAAPPKTSNGNGSSNGNVVSAFTGLKSTAQFPSSMKISNAGAEWERKTTSNGGRVRCMQVWPPYNNPKFETLSYLPRLTQEQLLKEVEYLLRNKWVPCLEFDEDGIIKRKYGSTPGYYDGRYWVMWKLPMFGCTEASQVLNEVNECAKAYPKAFIRVIGFDNVRQVQCISFIVHKPEYN

SEQ ID NO: 54334 - protein, 394 aa, Lentinus tigrinus
HWHGFFQKGTNWADGPAFVNQCPISTGNSFLYDFQTPGQAGTFWYHSHLSTQYCDGLRGPMVVYDDADPHASLYDVDDDSTVITLADWYHTAARLGARFPIGSDSTLINGLGRAAGGDADAALSVISVTSGKRYRFRLINISCDPNFTFTIQGHTMTVIEADAVSVQPYEVDSIQIYAGQRYSFVLTADQAVDNYWIQAIPNVGTITTDGGVNSAILRYDGADEVEPTAATVTGSNPLAETSLVPLENLAAPGTAAVGGVDYALNLDFSFDGTDFAINGATFTSPSVPVLLQIMSGASDVADLLPSGSIYALPSNSTIELSFPITATNAPGAPHPFHLHGHTFHVVRSAGSTDYNYVNPVQRDTVSTGTAGDNVTIRFTTNNPGPWFLHCHIVF

SEQ ID NO: 54335 - protein, 229 aa, Listeria monocytogenes str. 4b H7858
MTKQANLQKVTAQIERACEESNRQPEDVTLVAVTKTIDVAGITELYDLGIRHFGENRADVFQEKTVALADKEDICWHYIGSLQTRKVKDVLPKIDYLHSLDRSSLAKEIEKRATKPVKCFLQVNISGEESKHGFSKEEALSFLQEANFTFIEIVGLMTMAPITNSDIELHHVFHELKQLQQEIHALQLNNIPCTELSMGMTNDYGVAITEGATFIRVGRALVSDDNMEV

SEQ ID NO: 54336 - protein, 394 aa, Lentinus tigrinus
HWHGFFQKGTNWADGPAFVNQCPISTGNSFLYDFQTPGQAGTFWYHSHLSTQYCDGLRGPMVVYDDADPHASLYDVDDDSTVITLADWYHTAARLGARFPIGSDSTLINGLGRAAGGDADAALSVISVTSGKRYRFRLINISCDPNFTFTIQGHTMTVIEADAVSVQPYEVDSIQIYAGQRYSFVLTADQAVDNYWIQAIPNVGTITTDGGVNSAILRYDGADEVEPTAATVTGSNPLAETSLVPLENLAAPGTAAVGGVDYALNLDFSFDGTDFAINGATFTSPSVPVLLQIMSGASDVADLLPSGSIYALPSNSTIELSFPITATNAPGAPHPFHLHGHTFHVVRSAGSTDYNYVNPVQRDTVSTGTAGDNVTIRFTTNNPGPWFLHCHIDF

SEQ ID NO: 54337 - protein, 472 aa, Debaryomyces hansenii CBS767
MEEFQFIKYKGFDHVFKYSGPWLWWLVGFYLCLPILAYTLLPYLTMNGTISGKRKTVSIFVLGDLGHSPRMCYHAKSFSKLDYYVNLCGYLEEQPPFDIIDDINIDIYPITVTKNTSNLPFILFAAKKMVVQFFQLLKLLLDFRGTDYVLIQNPPSIPILLIVLAYIKVFSRKTKLIIDWHNLNYTILNLKFQNLKHPLVRILKTYERVLGQFADYNITVTRQMKEFLIKEFNFNKKKIITLHDRPGEQFKPLESLGVTKQEILESHDIFRDIQNISKYKILVSSTSFTPDEDFNLLLSALNQYDNSLAERGLPPILIIITGKGPLKSQFLQKVKQLNFLDNVIIKNAWLSSEDYPLILSVADLSISLHTSSSGIDLPMKIVDFFGCGIPVITLRFPAIGELVTHGTNGLITKSDKDSSVNESQEIYRLLTEAFKNDELLDKIKQGALKESNLRWEENWNNKMGKRFEYSTD

SEQ ID NO: 54338 - protein, 240 aa, Allium cepa
RSYSFMLRTKNPCGKVPNELYIAMDTLADEFGIGTLRLTTRQTFQLHGILKKNLKTVMSTIIHNMGSTLGACGDLNRNVLAPAAPYTKKEYVFAQETADNIAALLTPQSGFYYDMWVDGEKIMTSEPPEVTKARNDNSHGTNFPDSPEPIHGTQFLPRKFKIAVTVPTDNSVDILTNDIGLVVISDSNGEPQGFNLYAGGGMGRAHRTDTTFPRLAEHLGYVPKEDILYAIKAIVVTQRE

SEQ ID NO: 54339 - protein, 127 aa, Allium cepa
LFCGLHIDNGRLKGQAKETLREIIEKHNLSVRITPNQNMILCDIDPSWKESINAALSQVGILEPQYVDPLNITSMACPALPLCPLAIAEAESGIPDILKRVRAVIDKVGMGKEESVVIRITGCPNGC

SEQ ID NO: 54340 - protein, 141 aa, Aeropyrum pernix K1
MAVQRTLLVVKPDGVERGLIGEVVSRVERKGLKIVAMKMMRLTREKAEEFYSVHRDKPFFGELVEFITSGPVVAMVVEGDEAVSVVRLMIGSTDGRKAAPGTIRGDFSLDIMKNIVHASDSPESFEREFRVLFSESEIVEW

SEQ ID NO: 54341 - protein, 597 aa, Herminiimonas arsenicoxydans
MIKSSLVICLFATLLGGCNSLPSGHHFASRHAVPIEPEGSSGYIEKHGWIARKFMVVAANPLAVDAGYQMLKAGGSAVDAAIATQMVLGLVEPQSSGIGGGGFMLHFDGDKVQAFDGRETAPAHANEKLFQTAAGKTMPFQEAVVGGRSVGVPGVLRMLELTYKQYGKLPWSTLFAPAIRLATDGFAVSPRLATLLESETYLKNDPVAAAYFYDAQGKPRPVGYLLKNPALAATLQKIARDGADAFYTGQIAHDIARKVTHHPDNPGSLTTQDMAAYRAKERTPVCSDYKAWTVCGMPPPSSGGIAVAQMLGMLETKDMRVLAPTEGDLRTDAVHLFTEAGRLAFADRNRYIADPDFVPLPDGGVRALLDKKYLARRAALIGERSMGQAQPGMPFGQQLAWGSDTSPELPSTSHVSIVDASGHALAMTTTIENGFGARQMVDGFLLNNELTDFSMESADADGPIANRVQPGKRPRSSMAPTLVFEKGSKKLVLAIGSPGGSAIINYVAKVLIGTMDWGLNVQQAINLPNIGSRNGPTELEQGRVPASLIAQLQGRGHQVQVVELTSGLHGIMRLPVHGEEIWFGGADPRREGIAQGD

SEQ ID NO: 54342 - protein, 333 aa, Triticum aestivum
MYPLEMEGNSNPKTTNKPKYSKFTQQELPACKPLLTPEIVIAAFALIGALFVPIGLASLHASRQVVELVHRYDASCVPVDDKVGFIQNSRTDKTCTVTMTVPKYMKSPIHVYYLIDGFYQNHRRYVRSRSDKQLRYKSAAHLTSDCVPEGETADHAPIVPCGLVAWSLFNDTYTVRVNGVVTQVNKKDIAWKSDKNNKFGKNIYPSNFQKGRLIGGATLNESIPLSEQEDLIVWMRTAALPTFRKLYGRIEKDINANDNVTVVIQNNYNTYSFGGSKALVLSTASWIGGKNNFIGMAYLTIGGLCLSLAMGFLVLYMVKRRNFADPSNLSWNR

SEQ ID NO: 54343 - protein, 430 aa, Candida glabrata CBS 138
MATRSREYTGAEGLGVRVGVEGDSDDESMGRDEDVPRGSRVTVFGEGRVPETPSPPRNSSHARRSSTSLGFLGTPTHPGRYFDVPNSPSSNKGRKTSISHESGSGRTRLLPPTTPKSRQTEVFMSPSPKLRSPQVSKEIEKKPIKEISNELKTRLNYALMKLQNGWVDKSLPELEHTLATDRGDGINEIGQGQNSGEVFSKLDNNDAGKDFLQQRRKSGYVNQFAGDDSSSATFKFEGLKGNTQSNDKGGDERAGTKTAIKTESNEMYSEVQSDSDENSNDEGNSAHSAFLKALSSPKKKQKSSSSTSYPVSPLRWTSTSRPKPLTLDTNLENTKKNTKGPPLEVEAIETLMSLASPKKSSGSLDEALASNDSASGRPGSVTGKGATPIFLRNDVLRQKNASNEGQLRLGNNEILAEKKSDVETEVDESD

SEQ ID NO: 54344 - protein, 169 aa, Mycobacterium leprae TN
MVGLPTHTLSVLVEDTPGVLARVAALFSRRGFNIESLAVGATECKTMSRMTIVVSAEETPLEQVTKQLHKLINVIKVVEQEADNSLSRELALIKVRAEAGTRSQVIEAVHLFRARVIDVSLESLTVEATGDCSKIEALLRVLEPFGVREIVQSGVVSLSRGPRGIGTVR

SEQ ID NO: 54345 - protein, 461 aa, Zea mays
MAPANVRAAQAQAQAPSADRRLSTLVGHLLPSSPRRAAADTSATSTLESFPTMASQGSSVFAALEQAPEDPILGVTVAYNKDPSPVKVNLGVGAYRTEEGKPLVLNVVRRAEQMLINNPSRVKEYLPITGLAEFNKLSAKLIFGADSPAIQENRVATVQCLSGTGSLRVGGEFLARHYHERTIYIPQPTWGNHPKVFTLSGLNVRSYRYYDPATCSLHFEGLLEDLGSAPSGSIVLLHACAHNPTGVDPTIEQWEQIRQLMRSKSLLPFFDSAYQGFASGSLDKDAQSVRMFVADGGELLMAQSYAKNMGLYGERVGALSIVCKSADVAVRVESQLKLVIRPMYSNPPLHGASIVATILRDSEMFNEWTLELKAMADRIINMRQQLFNALKSRGTPGDWSHIIKQIGMFTFTGLNSEQVAFMRQEYHIYMTSDGRISMAGLSMRTVPHLADAIHAAVTQLK

SEQ ID NO: 54346 - protein, 544 aa, Listeria innocua Clip11262
MKKVLSNSVKGYTWARFRKDLLAGIIVGIIALPLGMSFAIASGVKPEYGIYSSFVAGIIVSIFGGSRFQIAGPTGAFIPVLLGIVLTYGYQDLLVAGMMAGVLLCLMGIFKLGTLIKFIPRPVTIGFTAGIAVTIFMGQVGNFLGLTGMEKHESFIANMKEIWLHLDSWNFYSVLISCICMFVLFVFPKILPRIPAPLIGLVITTGIAMLFFKDALPTIGSAYGEIPSTFPPFQFPDMTFANMSKLIGPAFVIAMLGGIESLLSAVVADGMTNTKHNSNRELIGQGIANIVTPMFGGIPATGAIARTATNINNGATSRVSGVIHGIFVLLTLLVLAPVAINIPIAAMAPILMLVAWNMSERKTFQHIIKLKSGDTLVLVITFLLTVFASLTVAVEVGLLLAVVLFAKQMGSSMQIEEIEPEGAEIAPHLHDKISIFTIRGPLFFGAAQIFQQNIIKAIHVKPEFLILRMGKVPIIDATAEGYFHQIEKEFSKQGGQILITGLTDKAKESLKGSGLYDRIGEEHFFLHTEDAVHYAENALSELSR

SEQ ID NO: 54347 - protein, 654 aa, Cryptococcus neoformans var. neoformans B-3501A
MTRDFGSLFFTGPIFVDYSFTARHLESFLSSFPPQVSHAMSSASTPTAPYLEDLVRNSLDQTLPWVVQKYGGTSVGKSLDNITKIVGSYIDNGSKVAIVCSARSTQTKSLGTTNLLLQASREALQPALSSSGDGRSGSMSGTATPFYPKRVGSGFFGKDQSTSMVSSVSSLSQLEPQLGRSGSPSPFQSSSSRSPPRSPATPSQDSSVSQEPAFHATVDLIKKGHLEAARASLKEGPLRDELEEEIERDCESLRSFLYAAQIIDEISPRSQDSIVGTGERLACKIVAAALRDRGVDSELVVLDNIVDASMSAASEAISVDAGDQGVAQLGQEFYDQLSFRLGERLRECGQRVPVVTGYFGPVPGSLLAQIGRGYTDLCAALCAVGLKASELQVWKEVDGIFTADPRKVPSARLVPIITPDEAAELTYYGSEVIHPFTMEQVIRARIPIRIKNVENPSGAGTVIYPDLGFPRGLDTEPPKAERIVEGVDERMPTAVTIKDEIIVLNIHSNRKTLSHGFLARIFGTLDRAGVVVDLISTSEVHVSMAMQDFLNRKRLERLVKDLEKIGEVTVSKDMAILSLVGRNMRNAIGSAGLMFASLARAMINIEMISQGASEINISCVIENKDAIKALNVIHESCLSYPRSPATEMAGLQLQ

SEQ ID NO: 54348 - protein, 284 aa, Jacobaea maritima
PKSQITPYRVVIIVRLVILGLFFHYRITNPVESSYGLWLTSVICEIWFAISWVLDQFPKWYPINRVTFTDELSARYEKDGEPSQLAAVDFFVSTVDPLKEPPLITANTVLSILAVDYPVDKVSCYVSDDGAAMLSFESLVETAEFARKWVPFCKKFSIEPRAPEFYFSQKIDYLKDKVQPSFVKERRAMKRDYEEYKVRVNALVAKAQKTPEEGWTMQDGTPWPGNNPRDHPGMIQVFLGNSGAHDIEGNELPRLVYVSREKRPGYRHHKKAGAENALVRVSAV

SEQ ID NO: 54349 - protein, 520 aa, Trametes pubescens
MSRFQSLLAFVVASLAAVAHAGIGPVADLTISNAAVSPDGFSRQAVVVNGGTPGPLITGNKGDNFQLNVIDNLTNHTMLKSTSIHWHGFFQKGTNWADGPAFINQCPISSGNSFLYNFQVPDQAGTFWYHSHLSTQYCDGLRGPFVVYDPNDPSADLYDVDNDDTVITLVDWYHVAAKLGPAFPLGADATLINGKGRSPSTTTADLAVISVTAGKRYRFRLVSLSCDPNYVFSIDGHNMTIIETDSINTQPLVVDSIQIFAAQRYSFVLEANQAVDNYWIRANPNFGNVGFTGGINSAILRYDGAAAIEPTTTQTTSTQPLNEVNLHPLVATAVPGSPVAGGVDLAINMAFNFNGTNFFINGASFTPPTVPVLLQIISGAQNAQDLLPSGSVYSLPSNADIEISFPATTAAPGAPHPFHLHGHAFAVVRSAGSTVYNYDNPIFRDVVSTGTPAAGDNVTIRFRTDNPGPWFLHCHIDFHLEAGFAVVFAEDIPDVASANPVPQAWSDLCPIYDALDPSDQ

SEQ ID NO: 54350 - protein, 284 aa, Jacobaea maritima
PKSQITPYRVVIIVRLVILGLSFHYRITNLVESSYGLWLTSVICEIWFAISWVLDQFPKWYPINRVTFTDELSARYEKDGEPSQLAAVDFFVSTVDPLKEPPLITANTVLSILAVDYPVDKVSCYVSDDGAAMLSFESLVETAEFARKWVPFCKKFSIEPRAPEFYFSQKIDYLKDKVQPSFVKERRAMKRDYEEYKVRVNALVAKAQKTPEEGWTMQDGTPWPGNNPRDHPGMIQVFLGNSGAHDIEGNELPRLVYVSREKRPGYQHHKKAGAENALVRVSAV

SEQ ID NO: 54351 - protein, 526 aa, Trametes pubescens
MGKFHSFVNLALSLSLSGRVFGAIGPVTDLTISNADVTPDGITRAAVLANSVFPGPLITGNKGDEFQINVIDNLTNETMLKSTTIHWHGIFQAGTNWADGAAFVNQCPIATGNSFLYDFTVPDQAGTFWYHSHLSTQYCDGLRGPLVVYDPDDPNASLYDVDDDTTVITLADWYHTAAKLGPAFPAGPDSVLINGLGRFSGDGGGATNLTVITVTQGKRYRFRLVSISCDPNFTFSINGHNMTIIEVDGVNHESLDVDSIQIFAGQRYSFILNANQTIDNYWIRAIPNVGTTDTTGGVNSAILRYDTAEEIEPTTNATTSVIPLAETDLVPLDNPAAPGDPQVGGVDLAMSLDFSFNGSNFFINNETFVPPTVPVLLQILSGAQDAASLLPNGSVYTLPANSTIEISFPIITTDGASNAPGAPHPFHLHGHTFSVVRSAGSSTFNYANPVRRDTVSTGNSGDNVTIRFTTDNPGPWFLHCHIDFHLEAGFAIVFAEDTADTASVNPVPTAWSDLCPTYDALDSSDL

SEQ ID NO: 54352 - protein, 377 aa, Streptococcus agalactiae A909
MKIDKYTAILGNTVSYPDMHSLTDNRPLASLPFDGKYRLIDFQLSSLANAGVRSIYGIFRGNNVRSVFDHIRSGREWGLGTLLSHYSLGFYDTDDDTRTVNGDYYDQILTYLRRSGSDQTIYMSCDMLCNIDLSQVIHLHNANGAQATVVYKKMPRSAIAEANQVLTIDESDHVVSLGKAVDNDDNQKMSAEIYVIDTPWLIEKMEEEAQNNEPRKLRFLLRDLIVESNALAFEYTGYLSNISSIKSYYDANMDMLTPNKFYSLFFSNQKVYTKVKNEEATYFDKQSNVSNSQLASGSIIKGYLDHSIVSRNCLLEKGTRVVNSIIFPKVKIGEGATIENTIIDKCVKVASGVTLKGSLDKPLVIPKFSEINEDIIQ

SEQ ID NO: 54353 - protein, 375 aa, Roseovarius nubinhibens ISM
MTALLDNVDPDGLLEFSVVFTDRSLNHMSAAFQQVMRDISGMLKDVYSADAVALVPGGGSYGMEAVARQFGHDAHALIVRNGWFSYRWSQIFEAGDFAAKTTVCMARQAGNDVTAPFAPAPIDEVVSKIRAEKPDVVFAPHVETSAGLILPEEYVTALAEAAHEVGALMVLDCIASGCAWIDMKKTGVDVLISAPQKGWSASPSAGLVMMSERALERLESSSSDSFAIDLKKWHAIMQAYENGGHAYHATMPTDALRAFRDTMVETRDYGFERLREAQWALGDGVRKMLAEKGIKSVAAEGFGAPGVVVSYTSDPEIQNGKKFAAEGMQIAAGVPLACDEPEGFRTFRLGLFGLDKLYDVPATLGRLKTVLDKVL

SEQ ID NO: 54354 - protein, 128 aa, Coprinopsis cinerea okayama7#130
MSGKGKAGKSGGKAGGSDKAQSRSSKAGLQFPVGRVHRLLKKGNYAQRVGAGAPVYLAAVLEYLAAEILELAGNAARDNKKQRIVPRHLQLAIRNDEELQKLLGNVVISQGGVVPHIAPGSPCASGSR

SEQ ID NO: 54355 - protein, 284 aa, Jacobaea maritima
PKSQITPYRVVIIVRLVILGLFFHYRITNPVESSYGLWLTSVICEIWFAISWVLDQFPKWYPINRVTFTDELSARYEKDGEPSQLAAVDFFVSTVDPLKEPPLITANTVLSILAVDYPVDKVSCYVSDDGAAMLSFESLVETAEFARKWVPFCKKFSIEPRAPEFYFSQKIDYLKDKVQPSFVKERRAMKRDYEEYKVRVNALVAKAQKTPEEGWTMQDGTPWPGNNPRDHPGMIQVFLGNSGAHDIEGNELPRLVYVSREKRPGYQHHKKAGAENALVRVSAV

SEQ ID NO: 54356 - protein, 405 aa, Alteromonadales bacterium TW-7
MSDIKKSHKLEGVCYDIRGPVLAQAKKMEDDGQKVLKLNIGNPAAFGFDMPEDMHRDIIRNLYSAQGYCDSKGLYSARVAVYQHYQQRGLNNLDVDNIYIGNGVSELIQMITQALLNNDDEVLIPAPDYPLWTASVKLAGGNPVHYLCDEEQDWFPDIDDIKSKITSKTKALVLINPNNPTGAVYSDDLLKQLIDIAREHKLLLLSDEIYEKILYDGVSHTSIASLCDDVPMITFNGLAKTYRAAGLRMGWMVLSGKTSAMDDLSKGLDILSSMRLCANVPAQYAIQQALGGVQSIDNLINPGGRLYEQRDIAWRGLNAIEGISCKKPKGALYAFAKVDTAHFNVKNDEQMMFDLLKAEKILLVHGRAFNWPEPDHFRLVFLPNKDDLTDAMQKMQRFFKDYRQL

SEQ ID NO: 54357 - protein, 370 aa, Roseovarius nubinhibens ISM
MALADGSIFYGYGFGATGVTTAELCFNTAMTGYQEIMTDPSYAGQIVTFTFPHIGNTGVNPEDDETADPVAAGMVVKWDPTQPSNWRATETLSDWLAKRGRIAIGGLDTRRLTRAIRQQGAPHVALAHDPDGNFDTDALVEQARAFPGLEGLDLALDVTCSQSYRWDEMRWAWPDGYPRQTAPKHKVVAIDFGAKRNILRCLASAGCDVTVLPATATAAEVLAHEPDGVFLSNGPGDPAATGAYAVPMIKGVLEAGKPMFGICLGHQMLALALGAKTIKMNHGHHGANHPVKDNETGKVEITSMNHGFAVDSQTLPKGVIETHISLFDGSNCGIRMEDRPVFSVQHHPEASPGPQDSFYLFERFAASMAG

SEQ ID NO: 54358 - protein, 162 aa, Melampsora medusae f. sp. deltoidis
TLTEIDSDHESSHQKVDINDTLGDDNLLMNKSERKARKTLAKLGLKKVLGINRVTMRKFKSQQFFVIANAEVFKSATANVYIVFGEAKTEETAPGLNLGGGGGGGGGGGFGAESMVSAGKQVAGKITDVNEDDQEPMDESGLDPNDIETVMTQVNCSRNKAV

SEQ ID NO: 54359 - protein, 384 aa, Mycobacterium sp. JLS
MARDYYGLLGVSKGASDQEIKRAYRKLARELHPDVNPDEEAQARFKEISAAYEVLSDPEKRRIVDLGGDPLESAGASGGNGFGAGFGGLGDVFEAFFGGGGGSRGPIGRVRPGSDSLLRMRLDLAECATGVTKQVTVDTAVLCDLCHGKGTHGTSTPATCDTCGGRGEIQTVQRSLLGQVMTTRPCPVCGGVGEVIPDPCHRCGGDGRVRARREISVKIPAGVGDGMRVRLAAQGEVGPGGGPAGDLYVEVHEKPHDVYVRDGDDLHCTVSVPMVDAALGTTVSVDDILGGPLELIIAAGTQPGAVSTLRGHGMPHLRSGVRGDLHAHIDVVVPAKLDHTDIELLRQLKEHRSRDVAEVRTSSSPAASNAGGLFSRLRETFTGR

SEQ ID NO: 54360 - protein, 181 aa, Melampsora medusae f. sp. deltoidis
STLTEIDSDHESSHQKVDINDTLGDDNLLMNKSERKARKTLAKLGLKKVLGINRVTMRKFKSQQFFVIANAEVFKSATANVYIVFGEAKTEETAPGLNLGGGGGGGGGGGFGAESMVSAGKQVAGKITDVNEDDQEPMDESGLDPNDIETVMTQVNCSRNKAVKALKENDGDLINAIISAS

SEQ ID NO: 54361 - protein, 327 aa, Zea mays
MKDIPSSFIRIIVHRDNECVDARAITIQREQYEASKKAKQSPHAERLQKGMGHLRGLTAARLLAAAFLLSVAVPAARAQEETEHEEEFSYVVGDENGPEHWGSIKAEWGNCSAGRMQSPIDLSHERVSLVRSLGYLTHSYRPAEAAIANRGHDIMVRFKGDAGFLVINGTAYYLKQMHWHSPTEHTVDGRRYDMELHLVHESSANKAAVIGMLYEIGAEDPFLQALEPSIHRIADRQDREEAIGVVDPRRARGRASVYYRYVGSLTTPPCTEGVIWTVVKRVRTVSRHQLELLREAVHDGMEKNARPVQDVNDRDISIFRPKPHKHY

SEQ ID NO: 54362 - protein, 432 aa, Synechococcus sp. WH 7803
MVTFVLPCVMAAKTLPSTGAVTGIKETLDFFGDPQFAQKRFKAHGDVFETRLLNQRLVFIRGEQTMADLFAQGDALEGWWPESVRQLLGSRSLANRSGDGHKARRRVVGQLFSAAALSRYTPSIAALVEELADELIQAKAPVQLVPCMRRFAFAVIATTVLGLDASDRQALFADFEIWTRALFSIPVAIPGTPFAKALEAKKRLLGRLKQVVAQTSAERGGLDLLSGGLDEAGIPLTDDDLVEQLLLLLFAGYETTASSLSCLMRALLLNPEIEQWLLPELLDQPWPNLESRSCPRLDATVLEVMRLTPPVGGFFRRTKQTIQLAGVAVPPDRVIQVALAPDLGDGSCDLAEIRPERHLDGSFTQTLLPFGGGGRVCLGKALAELEIRLMAIGLLQRVHLGLTPNQDLTLQQIPSPSPRGGLLVTASARHKS

SEQ ID NO: 54363 - protein, 572 aa, Acidobacteria bacterium Ellin345
MVRRTWGNGTGMSSQEPNNILPTKVDTTTARFSHNQHAMAKLVTELRNQENVIFQGGGDKAIENQHKKNRKTARERIDMLLDPATGLFELGEFVAHGMYEEWGGAPCAGVVTGIGEVHGRKFMLIVNDATVKAGAFFPMTAKKVIRAQNIAIENHIPTIYLVDSAGVFLPLQEDVFPDQDDFGRVFRNNAVMSAMGIPQITAIMGMCVAGGAYLPVMCDHILMTEGSGLFLAGPALVQAAIGAKYSAEELGGAEMHSQISGTVDFREPNDHLCIARIRSLVSKMGQRSKSVFSRVESEPPKFAAEELYGVYDGDAAKQYDMKEIIARIVDGSRFDEYKAEYGETVLCGYARVGGFAVGIVANQKTHQHQTDHNGNKRVEFGGVIYTESAEKAARFIMDCNQNLVPLVFLHDVNGFMVGRDAEWSGIIRAGAKMVNAVSNSVVPKISVIVGGSFGAGHYAMCGKAYDPRFVFAWPSAKYAVMSGGAAAGTLVEIKVKQLERGGKKLSDEEKKELFDSVKATYDEQMDPRYGAARLWIDKIIDPLDTRAALIEALEACALNPDVKEFKVGVLQT

SEQ ID NO: 54364 - protein, 381 aa, Physcomitrella patens subsp. patens
MVDTLVFSSPVSAGPSHSQQVVGKGMFVVKGEEWEMQRRMLKPCFSNESLKPMVELMVKSAAQEMLNWEEMAAQAGGRVKHDVQLLISALIKRDKSWGISLQPLATLLSGSQVLLPTKQATAIAQLNGRTEKLIMELVKDRMDAVQKVERESYGDDILGRMLTATDRFDGSFHKFSLDAVIDNCKKFFFAGTDSGANLTTFPLLILANYPEWQDKDPCEMNDISRLKIARMISQEIARIFAVSPSIARLAVKDCELGDLLIPKGLVIEIATLAMHRDPELWGKDVAEFRPERFANGASAACTHHQAFLPFGAGPRSCIAEKISWLEVKVVLCMILRRFRILPSPKYKHHPHFAIVNKPKYGLPLILELLSQSRSDSIMAEI

SEQ ID NO: 54365 - protein, 115 aa, Melampsora medusae f. sp. deltoidis
  misc_feature (18)..(18): Xaa can be any naturally occurring amino acid
FVIANAEVFKSATANVYXVFGEAKTEETAPGLNLGGGGGGGGGGGFGAESMVSAGKQVAGKITDVNEDDQEPMDESGLDPNDIETVMTQVNCSRNKAVKALKENDGDLINAIISA

SEQ ID NO: 54366 - protein, 251 aa, Bradyrhizobium sp. BTAi1
MDYTGKVALVTGASSGMGLATAQAFAVAGAAVVLADIREDAVVAAARELVGRGHNALAIRCDVSDDADVAALVDRTVATFGRLDAAFNNAGVMARIAPITDSPREDWDRVIGINLRGVWSCMAYELRQMQKQGSGAIVNNASVGALTGNPGIASYIASKHGVVGLTRTAALEVVRHGIRVNAVNPGLIDTQIARDVVAGDETAYDGIANTVPIGRAGRPEEIASAVLWLCSPGASYVIGHALTVDGGMTVA

SEQ ID NO: 54367 - protein, 623 aa, Pisum sativum
MKCWRLSAILFLGFMLTSLSTARFVVEKNSLSVTSPEKIKGKHDSAIGNFGIPQYGGSMAGNVVYPKDNSKGCKDFDSSFKSRPGALPTILLLDRGSCFFALKVWNAQKAGASAVLVADDIEEPLITMDTPEEDVSSAKYIENITIPSALIGKSFGEKLKDAISGGDMVNVNLDWREAVPHPDDRVEYELWTNSNDECGVKCDMLIEFLKDFKGAAQILEKGGYTQFTPHYITWYCPHAFTLSKQCKSQCINHGRYCAPDPEQDFNTGYDGKDVVVENLRQLCVFKVAKETEKSWVWWDYVTDFQIRCPMKEKKYNKECANSVIKSLGLDVEKIDKCMGDPNADTENSILKEEQDAQIGKGTRGDVTILPTLVVNNRQYRGKLEKGAVLKAICSGFEETTDPAVCLSNDVETNECLTNNGGCWQDKTANIAACKDTFRGRVCECPLVDGVQFKGDGYTTCEVSGHGRCKINNGGCWHDARNGHAFSACLDDGGVKCQCPAGFKGDGVKNCEDIDECKDKKACQCPECSCKNTWGSYNCSCSGDLLYIKDQDTCISKTASQAKSTWAAFWVVLIALAMIAGGGFLVYKYRIRQYMDSEIRAIMAQYMPLDSQEEGPNHVNHQRG

SEQ ID NO: 54368 - protein, 338 aa, Bradyrhizobium sp. BTAi1
MRGAVLYGPHDVRFEDRETPDIIEPTDAIIRIAATCVCGSDLWPYRGLQPLNGPTPMGHEYCGVVEEVGRAVRRIKPGQFVVGSFATSDNTCPHCNFGYQSSCVKREFISRAQAPFLRVPQADGTLVPTPGVPSPEQLASILTTSDVLGTGWFAADAANVKPGTTVAVVGDGAVGLLGILSARQMGAERIIAMSRHESRQKLALEFGATDIVTQRGDAGVAEIMDMTDGIGADSVLECVGTQQSMLQAIHAARPGGYVSYVGVPHGVELNGEELFFAHVHLHGGPAPVRKYLPKLIDLVMSGAITPGKVFDLTLPLEKVADAYRAMDERRAIKVLLQP

SEQ ID NO: 54369 - protein, 719 aa, Herminiimonas arsenicoxydans
MASSIWFAIACGVIAVIYGLISRSWILKQDAGNSRMQEIASAIQTGAAAYLARQYRTISIVGVVLFIIIAVVPGLGLTTAVGFLIGAVLSGACGFIGMNVSVRANVRTAQAATKGMNEALDVAFKGGAITGMLVVGLGLLGVAIFYLILTSSARHGLGYTVSLHDVITPLIGLAFGASLISIFARLGGGIFTKGADVGADLVGKVEAGIPEDDPRNPAVIADNVGDNVGDCAGMAADLFETYVVTLIATMLLGTLVMKGMELQAAIYPLLLGGVSIIASIIGCSMVKAKPGKKIMSALYTGLWWAAGLSLIGFAIVTWIVIPPELRVAMMGAAAVGIVLTGLMVYITEYYTGTDFKPVQHVAQASTTGHGTNIIAGLGVSMRSTAWPVVSVCAAILSSYWLGGLYGIAIAATAMLSMAGIIVALDAYGPITDNAGGIAEMSGMPESVRAITDPLDAVGNTTKAVTKGYAIGSAGLAALVLFADYTHALDSVGKSTSFDLSNPLVIVGLFIGGLIPYLFGAMAMEAVGRAAGAVVMEVRRQFRDIKGIMDGSGKPEYDKAVDMLTTAAIKEMIIPSLLPVVIPILVGMILGPAALGGLLMGAIVTGIFVAISMTTGGGAWDNAKKYIEDGHHGGKGSEAHKAAVTGDTVGDPYKDTAGPAVNPLIKIINIVALLIVPLLPATGLQAITGHGSVVETTIIVPATTIVVPVTEIVVPAPIKP

SEQ ID NO: 54370 - protein, 1103 aa, Candida glabrata CBS 138
MSAISSNTVSVIKNNQIGPWKLGETLGSGSTGKVLLASNETTKQQAAVKVISKAVFEAMNNSESNGDATNALPYNIEQEIIIMKLLNHPNVLRLFDVWETNSDLYLVLEYAEKGELFNMLVERGPLPENEAVRAFRQIIIGISYCHSLGVVHRDLKPENLLLDNKLNIKIADFGMAALESEDKLLETSCGSPHYAAPEIISGLPYEGFSSDVWSCGVILFALLTGRLPFDEEDGNIRNLLLKVQKGEFEMPDDDEITKEAQDLLARLLTVDPSKRITIREILKHPLLQKYPSIKDSRSIRNLPREDTYLSPLADTNSKIDDAILQNLVILWHGKDAREIAAKLREPGANTEKTLYALLYRFKCDTQREANRARRQSKIVQRNSTIRSTAPESPSKKKTYTPQKKNKRASIIASSSKRPVSVTKTATNITVNSSITGTPKSAKRMSMNNSARKRMSALYGTRDSPTKTSRSRRSSIITKDFLGNRPRDSVISMSHNKRASKSSKRISLVPNLKRQSVTTKLMATYAKLSEDDDWEYIERETKRTSSDFATLIDEIFEYEKYEQIRKEKAELERKVRETKEREERERKERQEKELQERLERERIEKQKEDIARQMDEEISNLKKELVGDQDNEDKFRSVSEPLESKSKKIEDIEEDIDGILRNRKYSLQTRPVSRLDPGIGFIDKPRQSEQHVPETVNLEPELEETEQKILETIRRSKFLGSSFDIKKELENVKRHRQTSQPIEKEMAPPALPETLPKAVEKKNVSMDPSLRKISDIKVPQFTRKSRHFSTSNRRLSVLSMYSTKESYSNLADILKNGPGEKEMIQTAPTPKSADDSDQLFDTIDEADTPASVSREERLYEVAEESENELANKKIDIADLLNSEGSNLKSVEEQEDSMKLPKLPPLFEDGSTKETKEQSKSMIPENMQSSESQKQIEKNNSDEGGSLNPFMTKHRDVSDKGVTKEKPTVTMKTTSEQVSADKKRNMSFLRKLSKGSSSSKDNVDVTLSTSVSSKQLFSGLVNLLKGWTKYGLKGIAIDSTSQTITGKLANDNILSFRSTAFSILIFSQEKGSAVTFRKVSGSGKAVRRLSDEVKKVLSKEGVLRD

SEQ ID NO: 54371 - protein, 130 aa, Triticum aestivum
  misc_feature (51)..(51): Xaa can be any naturally occurring amino acid
  misc_feature (59)..(59): Xaa can be any naturally occurring amino acid
  misc_feature (69)..(69): Xaa can be any naturally occurring amino acid
  misc_feature (75)..(75): Xaa can be any naturally occurring amino acid
  misc_feature (90)..(90): Xaa can be any naturally occurring amino acid
  misc_feature (99)..(99): Xaa can be any naturally occurring amino acid
  misc_feature (102)..(102): Xaa can be any naturally occurring amino acid
  misc_feature (104)..(105): Xaa can be any naturally occurring amino acid
  misc_feature (112)..(112): Xaa can be any naturally occurring amino acid
  misc_feature (116)..(116): Xaa can be any naturally occurring amino acid
  misc_feature (121)..(121): Xaa can be any naturally occurring amino acid
  misc_feature (125)..(125): Xaa can be any naturally occurring amino acid
MSRRGDWVYENNGGTCVAIAGADYCVVAADTRLSVGYSILTRDHSKICDLXADKCVTSXSPGFKGDIKXLHKNLXARELLYQHQHNKRIXCPAMDILSXTLXYXXFFPYYPXMCSXGFYSXGKVXFTKMH

SEQ ID NO: 54372 - protein, 501 aa, Desulfotalea psychrophila LSv54
MKKIIRDILTSRVYEAAVETPLEQAVQLSHQLGNKILLKREDQQPVFSFKIRGAYNKIAHLSEEERARGVITASAGNHAQGVAYSAKKLGISALIVMPTTTPKIKVDAVRRMGGQVILHGDNYSEAATHTEQIMAETGRYYIPPFDDELVIAGQGTIADEILRQNPGKIDAIFIPVGGGGLIAGIAAYMKNLRPEIRIIGVEPTDSNAMHCSLKAGKRVELSTVGIFADGVAVRKVGEQTFALCQEYVDEIIEISSDELCSGIKAIYQATRSIVEPAGGLGMAGLLKYIRETGCKDKTLIAINSGANMNFERLRYVAERTLIGEEQEALFAVTMPEEAGSLKTFCQRIVEKRNITEFNYRHISPEKAHIFVGISIEQAKERQEFSQQLTAAGYENIDLTDNDLAKNHIRYMVGGKPASVQEERLFRFWFPETPGALVRFLDATRGALSISLFHYRMQGGNYSRVLVGFNSCRDDDELLERLDILGYRFKEETDNPAYKMFL

SEQ ID NO: 54373 - protein, 327 aa, Pectobacterium atrosepticum
AENLPNIVILATGGTIAGSAAANTQTTGYKAGALGVETLIQAVPELKTLANIKGEQVASIGSENMTSDVLLTLSKRVNELLARSDVDGVVITHGTDTLDESPYFLNLTVKSDKPVVFVAAMRPATAISADGPMNLYGAVKVAADKNSRGRGVLVVLNDRIGSARFISKTNASTLDTFKAPEEGYLGVIIGDKIYYQTRLDKVHTTRSVFDVTNVDKLPAVDIIYGYQDDPEYMYDASIKHGVKGIVYAGMGAGSVSKRGDAGIRKAESKGIVVVRSSRTGSGIVPPDAGQPGLVADSLSPAKSRILLMLALTKTTNPAVIQDYFHAY

SEQ ID NO: 54374 - protein, 284 aa, Jacobaea maritima
PKSQITPYRVVIIVRLVILGLFFHYRITNPVESSYGLWLTSVICEVWFAISWVLDQFPKWYPINRVTFTDELSARYEKDGEPSQLAAVDFFVSTVDPLKEPPLITANTVLSILAVDYPVDKVSCYVSDDGAAMLSFESLVETAEFARKWVPFCKKFSIEPRAPEFYFSQKIDYLRDKVQPSFVKERRAMKRDYEEYKVRVNALVAKAQKTPEEGWTMQDGTPWPGNNPRDHPGMIQVFLGNSGAHDIEGNELPRLVYVSREKRPGYQHHKKAGAENALVRVSAV

SEQ ID NO: 54375 - protein, 449 aa, Listeria innocua Clip11262
MEKHYDYIAIGGGSGGIASINRAAMHGAKCALIEPKFLGGTCVNVGCVPKKVMWYGAQIKEAMDLYADAYGYQVDSSFNFQKLVENREAYIERIRGSYKNGLDNNKVEWIKGYAEFVDEKTLRVNGELVTADHILIATGGEPALPSIPGAEYGITSDGFFALKELPKKVAVVGAGYIAVELAGVLQQFGSDTHLFVRKHAPLRNFDPILTDTLTELIEQSDMTLHKHAVPQKVEKNSDGSLTIFLEDGRTETVDTLIWAIGRKPVIKGLQIEKAGVELVDSGHIAVDKFQNTNVDGIYAVGDVTGHYELTPVAIAAGRRLSERLFNNKKDAHLTYENIPTVVFSHPAIGTVGLTEPEAIEKYGKENIKVYTSSFTSMYTAITDHREPCRMKLICEGKTERVIGLHGIGYGVDEMIQGFAVAINMGATKADFDNTVAIHPTGSEEFVTMK

SEQ ID NO: 54376 - protein, 660 aa, Candida glabrata CBS 138
MVFGGRRRNERSQSPDSEEADVSNYELHNIDDSKKGYDNLGSGSRGATTSAVEYFDKENVDGVNIDEKLQSTTEFGGDEMPRGNIRRFIDSFKRAEQQPNQQHNLAEDLENDLTTAISMNSLDRVQNKPTGNGQMKFEEEALKKSIKPRHVVMISLGTGIGTGLLVGNAKALHNAGPAGLVIGYAIMGSCIYCIIQAAGEMAVVYSNLLGGFNTYPSMLVDPGFGFAVAWVYCLQWLCVCPLELVTTSLTIKYWTTTVNPDAFVVIFYVVIIFIQIFGARGYAEAEFFFNCCKILMIIGFYILGIIINAGGAGNDGYLGAKYWHDPGAFRGTNGIQRFKGIMATFVSAAFAFGATEFIALTAAEQSNPRKAIPSAAKKVLYRVICIFVGTIALLGFLVPWDSDQLMGAGGSATKASPYVLAISIHGVRVVPHFINAVILISVFSVANSAFYSSSRLLLGLAQQGYAPKFFDYVDRQGRPFRAMCCAALFGVIAFCAASPKEDQVFTWLLAISGLSQLFTWIAICVSHIRFRRAMTVQGRSLGEIGFKAQLGVYGSYYATIMMVLALIAQFWVAIAPIGNNGDLDAEGFFENYLAMPILIAFYFGYKLWKRDWRLFIRAKDIDLDSYRQVFDEELLKQEDEEYKEKLKNGPMWKRVVDFWC

SEQ ID NO: 54377 - protein, 767 aa, Sinorhizobium meliloti 1021
MPERISCFVMSGGVGSRLWPLSREDNPKQFHDLAGHGSMLVNTVRRLKARPAGDTPVHVIASERHSERVRADLAGIDLAGGHAIFEPVGRNTAAAVAVAALETIATHGDGLVLVVPSDHEISTEEQFWNTVEKGVPAAEAGRLVVFGIPPDSPETGYGYIESVGKGNVRDVARFVEKPGLEMAKAYVASGTFFWNAGIFLFRAGAMRAAFREHQAAIWQKTECAFAAAATEVSGTYLPIEQYSTIPSASIDYAIMEHASGIAMVPASFYWSDLGSWQSLLDISPTDGNGNVVIGDVVAIDCERSYLRSQGRLLSVIGLRDVAIVSTADATFVAPVAKSQEVKRIVEQLEKSGRLETKFTPAHARVLQPGAWRERVAHWLFEETLPLWSTAGVDERHGGFHEALSFEAAPLIKPKRMRTMARQVYAFSVAKLRGWDGDADGLIGHGIAFMEKGRTQRGGWARVLQEDGTIADACEDAYDHACVLLMLAHAYQAGNPDALRLGQETFAFLDEHLEDDRLTGFLETSDGTELRRSNPHMHLLEAFLAWYAATGERGYLRRAARIIDLFRSHFFDTESWTLGEYFDEAWNPAVGPKGQWTEPGHHFEWASLLVEFAAKSRQTDLIAFARKLYASAIATGLNRSTGLAYGAVSRAALPLDLISRSWPQAEAVKAALALEGTGGPDLKPEIEARVGRLFRWHIDPAPLGMWIDRVDEKGSAVATEVPASIFYHLVTALMQYLDKTEEAVYRSPSFPQSINAAEPLAALNRETV

SEQ ID NO: 54378 - protein, 587 aa, Desulfotalea psychrophila LSv54
MKPTDIKKPEYFHKIIDCQYACPTHTPVPQYIQHIARREYDQAYIINWISNVFPGVLGRICDRPCEPACRRGRIEETPVAICRLKRLAADKKSSIDILPTKCRAPNGKKIALIGGGPASLTVARDLRLLGYEIHLFDQQKKAGGFIRTQVPSFRLPEKILEEEVDIILNMGVITHFNGYISSLKSILGQNFDAVFVGTGAPRGRDLAKLPGREAGRKNIAIGTEWLAAVLYRHVKKIGPRVLVLGGGNTAMDCCRTARRLGGENVSIIVRSPKETMKASLWEIEEALLEGVHLIDNHLPLAFVTEGDRLTGMNFDRVEARQNDRGERELISSGEAPVFIPCDDVILAVGQENAFPWIERDIGLHYKNGLPLIDPETLQSNIPRLFFGGDAAFGPKNVITAVAHGHQAAISIDLFCQGQSLDERPPTLLSLSSQKMGLQEWAYDNDISIAHRNKVPRESPVKSIRNRLMEVELGFDQEVGLQEASRCLNCDIQTVFEAATCIECDACVDICPVSCINFMDSTENELRTSLRIPAENLSQALYVSEPTPIGHIMVKDENVCLHCALCANRCPTSSWQMLKSTLSYPGQK

SEQ ID NO: 54379 - protein, 284 aa, Petasites fragrans
PKSQITPYRVVIIIRLVILGLFFHYRITNPVESSYGLWLTSVICEIWFAISWVLDQFPKWYPINRITFTDELSARYERKGEPSQLAAVDFFVSTVDPLKEPPLITANTVLSILAVDYPVDKVSCYVSDDGAAMLSFESLAETAEFGRKWVPFCKKFSIEPRAPEFYFSQKIDYLKDKVQPSFVKERRAMKRDYEEYKVRVNALVAKAQKTPEEGWTMQDGTPWPGNNTRDHPGMIQVFLGNSGAHDIEGNELPRLVYVSREMRPGYQHHKKAGAENALVRVSAV

SEQ ID NO: 54380 - protein, 284 aa, Petasites fragrans
PKSQITPYRVVIIIRLVILGLFFHYRITNPVESSYGLWLTSVICEIWFAISWVLDQFPKWYPINRITFTDELSARYERKGEPSQLAAVDFFVSTVDPLKEPPLITANTVLSILAVDYPVDKVSCYVSDDGAAMLSFESLAETAEFGRKWVPFCKKFSIEPRAPEFYFSQKIDYLKDKVQPSFVKERRAMKRDYEEYKVRVNALVAKAQKTPEEGWTMQDGTPWPGNNTRDHPGMIQVFLGNSGAHDIEGNELPRLVYVSREKSPGYQHHKKAGAENALVRVSAV

SEQ ID NO: 54381 - protein, 310 aa, Oryza sativa Japonica Group
MAYKINSHVGVRLIKQQQAPHVAVAAITAASSPTQPPPPRALPRPPPMASAAAPTTSSLSLAARRAAAVGPAAASPLRRGGLAAGCQPARSLAFAAAADPRLATHVASRCRQAASSSSRGTRAVATMAKKSVGDLTAADLEGKRVFVRADLNVPLDDNQNITDDTRVRAAIPTIQYLIKNGAKVILSSHLVTKAEDVIGPDVEKLVSELPNGSVLLLENVRFYKEEEKNDPEFAKKLASLADLYVNDAFGTAHRAHASTEGVTKFLKPSVAGFLLQKELDYLVGAVSSPKRPFAAIVGGSKVSSKIGVVV

SEQ ID NO: 54382 - protein, 424 aa, Oryza sativa Japonica Group
MGRKRAVLVGINYAGTEGELKGCLNDVARMRRCLVDRFGFDEADIRVLADADPSTPQPTGANIRLELERLVGDARPGDTLFFHYSGHGLQLPIETGGDDDDTGYDECIVPCDMNLIKVYMAITHLTRELDDADQDFTELVQKVPDGCLFTMVSDSCHSGGLIDKTKEQIGSSTKQSKIQQRERELRRQQAPSPGTCSCASLLQIALRHLPRRGGQRIIGSRSRDGVGEDQPPRSQAELLAADATRAGIKNRSLPLSTFVEMLRERTGKDDVGVGSIRTTLFHHFGDDASPKIRRLVNAMLGRRHGSATASEEHPDKAKPERVDGEGEAAAAKQGAPETRPLPRNGVLISGCQTDETSADATTPEGVSYGALSDAIQSVLAEERRGKVTNMELVRRARELLAKQGYTQQPGLYCRDKHANVAFIC

SEQ ID NO: 54383 - protein, 472 aa, Vitis vinifera
MAFRRALISTALKRSKSDLHLHRRWLSGGAVSAPPVLPAFDHQPKPYTGPLADEVLQKRKKFLGSSLFYYYQKPVNVVEGKMQYLFDENGKRYLDAFAGIVTVSCGHCHPEILNAIIEQSKLLQHATTIYLHHAIADFAEALASKMPGNLKVVYFVNSGSEANELAMLMARLYSGNLGMISLRNAYHGGSSGTIGLTALNTWKYSIPEGEIHHVVNPDPYRGIFGSDASSYARDLKDHIDYGTSGKVAGFISETIQGVGGAVELAPGYLKLVYDIVRKAGGVCIADEVQTGFGRTGSHYWGFETQGVIPDIVTMAKGIGNGLPLGAVVTTPEIADVLAQKIQFNTFGGNPVCSAGGLAVLRVLDKEKRQEHCADVGSHLIERLRALQQKHDIIGDVRGRGLMVGVELVTDRKEKTPAKAETAVLFENLREIGILIGKGGLHGNVFRIKPPMCFTKDDADFLVDALDYSISKL

SEQ ID NO: 54384 - protein, 284 aa, Petasites fragrans
PKSQITPYRVVIIIRLVILGLFFHYRITNPVESPYGLWLTSVICEIWFAISWVLDQFPKWYPINRITFTDELSARYERKGEPSQLAAVDFFVSTVDPLKESPLITANTVLSILAVDYPVDKVSCYVSDDGAAMLSFESLAETAEFGRKWVPFCKKFSIEPRAPEFYFSQKIDYLKDKVQPSFVKERRAMKRDYEEYKVRVNALVAKAQKTPEEGWTMQDGTPWPGNNTRDHPGTIQVFLGNSGAHDIEGNELPRLVYVSREKRPGYQHHKKAGVENALVRVSAV

SEQ ID NO: 54385 - protein, 191 aa, Cryptococcus neoformans var. neoformans JEC21
MSRQLDNVNPTIFAPSAPSFVRRSTGKSAKSSLWAPEALSDDGEDYYSPGARSSGSVSDEEEGREDIDAQEVYDLLRSITDPEHPVSLEQLRVVNPEDIHVAGNRVLVYLTPTIPHCSMSTLIGLSLRVRLLRALPPRYRVDIRIKSGTHQSEHAVNKQLNDKERVQAALENKHLLSVVEGCLATAGKRGE

SEQ ID NO: 54386 - protein, 200 aa, Triticum aestivum
  misc_feature (89)..(89): Xaa can be any naturally occurring amino acid
  misc_feature (146)..(146): Xaa can be any naturally occurring amino acid
LSKTSLYKKAGLPTGPEFPGYRRPTRPNISSAPVSVSSAAAELAMMKLPKSECLSARMLLIGAGKMGKLVVKHLIAKGCKKVVVANRSXQRVDAIREEMKNIDIAHRPLTEMHEAAADADVVFTSTASESLLFPKDHAKALPPISXAEVGVRLFLPNNLSPATSVPRVLEGEPLPRAYIRGTPYKTSWLGNPLKADSPSR

SEQ ID NO: 54387 - protein, 351 aa, Zea mays
  misc_feature (9)..(9): Xaa can be any naturally occurring amino acid
FKGQNRSEXGHSKGKQTSIFIYDGLYEVLECWQEGPKGERVFKYKLQRIAGQPELALHAVKATRKSKVREGLCLPDISQGRERIPICVINTIDDMKPAPFKYITEVIYPDWYEKEPPKGCNCTNGCSDSITCACAVKNGGEIMFNFNGAIVEARPLIYECGPSCRCPPTCHNRVSQHGVKIPLEIFKTGKTGWGVRSLSSISSGSFICEYTGELLEDEEAEKRENDEYLFDIGHNYHDKELWEGLKSVVGLGSATSSSETMEGFTIDASECGNVGRFINHSCSPNLYAQNVLWDHDDMRMPHVMFFAVENIPPLQELTYHYNYKIGEVYINGEEKVKHCYCGASDCCGRLY

SEQ ID NO: 54388 - protein, 383 aa, Arabidopsis thaliana
MTTMSDLDEIMVAEILCRTPMTCLKTVRSVCKKWNALSKKWFFFGKAKQFLGFMMMDSRVCSLRFDLRKDLVVEPPSIKQVSILDQIEVSKIFHSDGLLLCIIKNDTTRLLVWNPYLEQTRWIQPRHNFHILDCYAIGHDKNRKHKILRFVDDFLPVENVVFGYEIYDFSLDSWRVLDCFQRGVSLRGNTYFFAKERYIFEGKGPEEIDITETEDFLLCFDFTAERFGPRLPLPFHSYYAETVTLSCVKEDQLSVLCQRQPSEPSEILEIWVSTNIQPNAVSWSIFLKVDMRPLTGFQFNDMAGSFFIDQENKVAVVFDLDPSQICRYQTAYIIGQEYGGYFNSVNIGEVPNLWIPGSVGYADTTSCIPPVCSSYVPSLVQIG

SEQ ID NO: 54389 - protein, 503 aa, Triticum aestivum
MDLRVAAPASVAAAARRGVLGCARVRPLQGRRQCRPSVRVSVATTESAAAAAAVAASADEDEETTNPRTVVAVILGGGAGTRLFPLTKRRAKPAVPIGGAYRLIDVPMSNCINSGINKVYVLTQFNSASLNRHLSRAYNFSNGVGFGDGFVEVLAATQRPGSEGKTWFQGTADAVRQFAWLFDDAKSKDIEDVLILSGDHLYRMDYMDFVQSHRQRDAGISICCLPIDGSRASDFGLMKIDDTGRVISFSEKPRGADLKAMQVDTTLLGLPKEEAEKKPYIASMGVYIFKKEILLNLLRWRFPTANDFGSEIIPAAAREINVKAYLFNDYWEDIGTIKSFFEANLALAEQPSKFSFYDASKPMYTSRRNLPPSMISTSKITDSIISHGCFLDKCRVEHSVVGIRSRIGSNVHLKDTVMLGADFYETDMERGDQLAEGKVPIGIGENTSIQNCIIDKNARIGKNVTIANAEGVQESDRASEGFHIRSGITVVLKNSVIADGLVI

SEQ ID NO: 54390 - protein, 172 aa, Microcystis aeruginosa PCC 7806
MDLKSLIRDIPDFPKPGIVFRDITTLLNHPQGLRYTIDTLTAKCRDYGLSPDYIVGMESRGFLFGVPLAYQLEAGFIPVRKPGKLPAAVHSIEYDLEYGSDSLEIHQDAVASHHKVLIVDDLIATGGTAKATADLLEKIGCEVLGFAFIIELIDLGGREKLPDLPIITIIDY

SEQ ID NO: 54391 - protein, 106 aa, Zea mays
MRKRERENPCGICGHYHKYEEGEVCGVCGHRPPAASPVGARQQDSAFPSEILKEFLFLGSYDNASRSELLKTIGVSHILNWVRDMEIKCHRWISWEHSSIDILVWQ

SEQ ID NO: 54392 - protein, 135 aa, Physcomitrella patens subsp. patens
MLLGYVYPAYECFKVVERNRPDLEHLRFWCQYWIIIASLTVFERVGDIFVSWVPMYNEAKLAFIIYLWYPKTLGTTYVYSSFLRPFVVKHESEIDHQLNELTTRAGDLAFFWWQRGSAYIQAQVYQILAYVASQS

SEQ ID NO: 54393 - protein, 612 aa, Schizosaccharomyces pombe 972h-
MRLKSFSTTLDTLRRRFNDSSSEEDKLEKNIQDETSIKEVSLQDAKQSDEKGVEEKVFNDESFSIDVAPKPEDELSGIVKARYLTEHSSRISFYICYFSIFLLFFAISFQAECYYSLTAYATSAFAGHSLLSTIAVANNIISAAIKPPLARLSDVFGRLEAFLFSLLLYLVGLILMAASTNVQTYAGGSVLYNAGYTGVELIMTIFMADTSSMANRSLVLGISYLPFVVTIWIGPRVAQEFYMHSTWRWGIAVWTILIPACSIPFLAVYSYYQFRAWREGALKGTLTINPVELFKKLDIIGLILMTAGLALVLLSISLASYDTGKWSDAKFIVMIIIGGLCLIAFVLYEIFVASFPALPFRLMREPTIGACCAMSFLFYITFYCWDNYYYSFLQVVHYTSITAAGYISYTYSFTSCATGFFLGILIRLTKRYKWYFVASIPVYILGQGLMIRYRGEQYNWGYQIMPQIIVGIGGGVIANLLTVAVQTVVSTENFAIVTALVSTVTPIGGAVGSAISGAIWNSVMPKRLEKNLPSDLKDQAYTIFESLTVQLSYTRGTDARNAIILSYSEVQKILTSVATGFAGAMIFPVWFVANPRLSTVKTHIFDSKESKV

SEQ ID NO: 54394 - protein, 537 aa, Debaryomyces hansenii CBS767
MSSRDLPKSFNELAFSWRRHLNDEVTLRRRRGPDIELSSDSEATDKKKDKVQMKTLWPAFCSGAGLFSDGYVNNSIGTVSTCLKSIYGDAYSKSNAISNVSSIAFAGTVVGQLVFGYISDNIARKGGMLSANIMLIFFTLLCTVGTWERNGDPTSLFTALTVFRFFLGIGIGAEYPTASVIASEFANQLPEGKRNRYFVWFTNFMIDTGFVVSAFVPLVCLWIFREHNLEPVWRLTLGIGAIPPISLFFMRLKMKDSESFQKMSMKKVKKVPYLLILKFYWFRLTIVSLIWFIYDFSAYSFGIYSSVILQHVVPDGNLYQTFGWNVVFNLFYIPGAFLGALLSDYIGPRFSIVLGTFLQGIVGFIMSGCYPKLKEHIGAFVVVYGIFSTLGELGPGDNIGAVASKTSATSVRGTYYGIAAAMGKIGAFVGTYVFPIIIKNAGGEETDKGNQAPFYVSSALCMFSAFLALFFCPSVGQNAINQEDYDFINYLKANNYDVSQIGDGSFDSDNGIEEVFVNDKEKKSEGINVESDVESSD

SEQ ID NO: 54395 - protein, 350 aa, Streptomyces avermitilis MA-4680
MIHRRCVGGRRNHGGRVAQGSSRSRLPQQGTPVTMSSTSSTPPWNVQRLPGADGRVFLVTGGNAGIGYFVAEQLSATGATVVLGSRNPAKAEAATASIRARVPGSRVRAVRLDLADLSSLETAVESLEVERLDAVVHNAGVALDDPPREETGDGHELMFGTNHLGHFALTQWLMPLLSAAPAARVVTMGSFAAKSERLDLDDLQSRKDYQPKRTYGRSKLAQMYFGVELDRRLRAAGSTVASVVVHPGGALDSLTPSRPPVHVRSTGARLSAAPAALLLQGKHAGAWPAVRAVLDPAVRGGQLWGPRVFGLRGEPRREPVWDHLADPSVAARLWDASCDLMGTDLSTISG

SEQ ID NO: 54396 - protein, 390 aa, Chlamydomonas reinhardtii
MAAASTTNPDPLASEGTFHKIKDLGSGSFGHVALYSRLGHDEPVAVKCLPVRVVDYNMVKREVRSHCSLNHPHVILFKRLGLTPDKRYLFMVMEYADCGDLFKYVQQHGRLPEADARWFFQQIILGLDYCHRRGVVNRDLKLENLLLRSAAEVPPPPGQLEQPRNLHIKVADFGLCKASVNSLPKSRVGTLYYLAPEVLRASADRPYDAKLSDIWSVGVILYVLLFKAYPFGVISDRDNKAQRDAILRRIANAEWQLPAHPVIGEACRDLLSRILVSDPAKRITMEGIMSHSWFREDLPEGALEFNEGLVEEQAADPPRCEQSMEEIDAILSAAEDPLHGGGLGAGLAGGGGAAGGGTAAGVMAMIGSSGIDDEIDELHAEHPSQFGMND

SEQ ID NO: 54397 - protein, 488 aa, Listeria innocua Clip11262
MSIKETSLPKVQTKLFINGKWIDGDNKETKDIVNPANGEVIAKIAQAGPKETKQAIKAAKDAFPDWAKMELADRVKLLHNIADLMEERADTLAKIMTLEQGKPLKESKGEVLTGAENFRFAAEEARRLYGETIPAPNNHAFIVKKQPIGVVAAITPWNFPGGMVTRKLAPALATGNTIVLKPSGDTPLSALAIFEIFEEAGLPKGVANIVMGSSKEIGETLTDSDDVRKLTFTGSTKVGQTLFKQSADTLKKISLELGGHAPFIVFADANLEAAVDDLITAKFRNNGQVCVSPNRIFVAKEIKEKFTKTLVAKVEKLKVGNGLDDVNVGPLIREDAIDKIDKQLKNATDKGAKVLTGGERLTGSDYDKGNFYKPTVLDNVTREMDIFYEETFGPVIPLIVFENEDEAIEMANDSEFGLASYFYTKDLARVEKVGAALEYGMVGANEIAISNPETPFGGVKHSGFGRENGHYGMEEYIQVKFINLKYRD

SEQ ID NO: 54398 - protein, 361 aa, unidentified eubacterium SCB49
MEPFIVSARKYRPTTFKQVVGQQAITSTLENAIDNNHLAQALLFTGPRGVGKTSCARILAKKINSDGTEKEDEDFAFNIFELDAASNNSVDDIRNLTDQVRIPPQTGKYKVYIIDEVHMLSSAAFNAFLKTLEEPPKHAIFILATTEKHKIIPTILSRCQIFDFRRITVQDIKGHLKDVANAENVNAEDDALHIIAQKADGALRDALSIFDRVVSFSGKNLTREAVTQNLNVLDYTYYFKITELLLTNNIPQSLVDFNDILSKGFDGHHFVMGLASHFRDLLVCQNQETIALLEVGEQVKKMYFEQSQKAEKSFLIEAIKIANDCDLKYKTSRNQRLLVELCLMQLASITANEEKKSLVTN

SEQ ID NO: 54399 - protein, 218 aa, Oryza sativa Japonica Group
MEVEEAAYRTVWSEPPKRPAGRTKFRETRHPVYRGVRRRGGRPGAAGRWVCEVRVPGARGSRLWLGTFATAEAAARAHDAAALALRGRAACLNFADSAWRMPPVPASAALAGARGVRDAVAVAVEAFQRQSAAPSSPAETFANDGDEEEDNKDVLPVAAAEVFDAGAFELDDGFRFGGMDAGSYYASLAQGLLVEPPAAGAWWEDGELAGSDMPLWSY

SEQ ID NO: 54400 - protein, 309 aa, Capsicum chinense
TWFHVTCNNDNSVIRVDLGNAALSGQLVPQLGLLKNLQYLELYSNNISGPIPSDLGNLTNLVSLDLYLNVFTGPIPTSLGKLSKLRFLRLNNNSLSGDIPMSLTNISSLQVLDLSNNRLSGAVPDNGSFSLFTPISFANNLDLCGPVTGRPCPGSPPFSPPPPFVPPPPISTPGGNGATGAIAGGVAAGAALLFAAPAIAFAWWRRRKPQEFFFDVPAEEDPEVHLGQLKRFSLRELQVATDSFSNKNILGRGGFGKVYKGRLADGSLVAVKRLKEERTPGGELQFQTEVEMISMAVHRNLLRLRGFCM

SEQ ID NO: 54401 - protein, 284 aa, Petasites fragrans
PKSQITPYRVAIIIRLVILGLFFHYRITNPVESSYGLWLTSVICEIWFAISWVLDQFPKWYPINRITFTDELSARYERKGGPSQLAAVDFFVSTVDPLKEPPLITANTVLSILAVDYPVDKVSCYVSDDGAAMLSFESLAETAEFGRKWVPFCKKFSIEPRAPEFYFSQKIDYLKDKVQPSFVKERRAMKRDYEEYKVRVNALVAKAQKTPEEGWTMQDGTPWPGNNTRDHPGMIQVFLGNSGAHDIEGNELPRPVYVSREKRPGYQHHKKAGAENALVRVSAV

SEQ ID NO: 54402 - protein, 420 aa, Phaseolus vulgaris
MHSFSRLSIFCLFISLSPLFSSSALLFQGFNWESSKKGGWYNSLKNSVPDIANAGITHVWLPPPSQSVSPEGYLPGRLYDLDASRYGSKDELKSLIAAFHEKGIKCLADIVINHRTAERKDGRGIYCIFEGGTPDARLDWGPSFICKDDTTYSDGTGNNDSGESYDAAPDIDHLNPQVQRELSEWMNWLKTEVGFDGWRFDFVKGYAPSISKIYMEQTRPDFAVGEKWDPLSYENGKPTYNQDSHRGALVNWVESAGGAITAFDFTTKGILQAAVQGELWRLIDPNGKPSGMIGVKPENAVTFIDNHDTGSTQRLWPFPSDKVMQGYAYILTHPGTPSIFYDHFFDWGLKEQIAKLSSIRVRNGINEKSTVEIMAAEGDLYVAKIDNKIMVKIGPKMDLGKLIPSNFHVATSGQDYAVWE

SEQ ID NO: 54403 - protein, 246 aa, Oryza sativa Japonica Group
MDMAGHEVNSSSSSSGAESSSSSSGRQQYKKRPAGRTKFRETRHPVYRGVRRRGGAGRWVCEVRVPGKRGARLWLGTYVTAEAAARAHDAAMIALRGGAGGGGAACLNFQDSAWLLAVPPAAPSDLAGVRRAATEAVAGFLQRNKTTNGASVAEAMDEATSGVSAPPPLANNAGSSETPGPSSIDGTADTAAGAALDMFELDFFGEMDYDTYYASLAEGLLMEPPPAATALWDNGDEGADIALWSY

SEQ ID NO: 54404 - protein, 509 aa, Mycobacterium avium 104
MTAHTTLIPHFIDGRRSAGQSGRSADVFDPSTGGVQATVPMAGQADIDAAVASAVEAQKGWAATNPQRRARVMMRFVELVNEHNDELAELLSREHGKTLADAKGDIQRGIEVIEFCVGIPHLLKGEYSEGAGPGIDVYSLRQPLGVVAGITPFNFPAMIPLWKAGPALACGNAFVLKPSERDPSVPVRLAELFVEAGLPPGVFQVVHGDKEAVDAILNHPDIQAVGFVGSSDIAQYIYAGAAATGKRAQCFGGAKNHMIVMPDADLDQAVDALIGAGYGSAGERCMAISVAVPVGDQTADRLRARLIERVNNLRVGHSLDPKADYGPLVTEAALARVRDYIAQGVDAGAELVIDGRERASDDLAFGDANLEGGFFIGPTLFDHVTPDMSIYTDEIFGPVLCIVRAHDYEEALALPSQHEYGNGVAVFTGDGDAARDFVSRVQVGMVGVNVPIPVPVAYHTFGGWKRSGFGDLNQHGPASITFYTKTKTVTQRWPSGIKDGAEFSIPTMI

SEQ ID NO: 54405 - protein, 516 aa, Desulfotalea psychrophila LSv54
MDIHKEKIIILDFGSQTTQLIARRVREMKVYSEIHPFSLPLEKLKELNPTGIILSGGPCSVYDDDAPHSDAGLFELGVPVFGICYGAQLMIQQLGGSVEKAEKREFGKAEIQILNDSDLFAGLDVARSHQVWMSHGDRVEVIPDQFEVSAESAHSPYAALRHRSKPFVAVQFHPEVVHSIIGTDLLRNFVFGLCKCQATWTMQGFIESNVAAIKEKVGDAHVICALSGGVDSSVVAAMIHKAIGSQLTCVYVNNGLMRIGESEGIIKFFKENTDLHLIDVDASDYFLGKLEGVTDPEVKRQHIGLGFIKIFEEEAHKIDGDVKFLAQGTLYPDVVESVSFRGAAPIKSHHNVGCLPDIMKLSLIEPLRELFKDEVRELGVELGLPDEAVHRQPFPGPGLSIRIMGEVTPERLDIVRRADVIVLDEMKKHGYYNKVWQSFAVLLPIQTVGVMGDFRTYEHVVALRVVDSRDAMTADWSRVPYDILGDISTRIINEVRGVNRVVYDISSKPPATIEWE

SEQ ID NO: 54406 - protein, 426 aa, Mycobacterium avium 104
MRIASVVARQLLDCKARPLVEVEITTDTGHVGRGAAPTGTSVGAHEAFVLRDGEPTRYRGRSVHRAVAAVRDEIAPVLTGAELDDPRSLDRVMIELDGTPDKHRLGGNAIYSTSIALLRAAAAAAGTPTYTYVGALLGLTPPTTVPMPSFNMINGGRYGDVEQSFSEFLVVPYRAESIQAAVEKGVSLFEVLGEVLAEHLGRTPLLASSYGYIAPSGDPHAVLELLAEAVERAGCADVMAFALDCASSEVYDNGSATYAFNGGRVTAEALIDYARALSQEFPMLFIEDLLDGDDWAGFTKAVQTVNRSIIVGDDLIVTNRDRLRRAVETSAVDGFILKPNQVGTIAEALDCFEYASQNGLLAIPSGRSGGVIDDVVMDLAVGLGAPLQKNGAPRSGERIEKLNFLLRAAEGIPDCALADVPALARF

SEQ ID NO: 54407 - protein, 414 aa, Cryptococcus neoformans var. neoformans JEC21
MTRLPSLKQLSEHLHYTPPTPPSQQPNLHEQSPGSSSSNPLRISTNPVPLQSSSAASHTSIVMTPTSTGRLKLPASAMMRSLSAGSSGSATGGLAPVTSSPAIAPNLGSVQGQGHSPTSAHSPTPAQQLAKFVPGGLGDFRPESGPEASTSMSRSASHEVHAEHHREIPSLDEIKKKVNVSKGEDQHRLDLPNERVTEKEKSKTSVESTGERISISSAKGGKKEHPLQHSWTLYYDSKTYKPDPSLIASKQGDKILADYEMTLLTIGKFDTVEGFARHFNNVRLPSQLTPSSNYHLFKSGIRPMWEDPANANGGKWVILFRSSPGTLDIAWANLTMALVGEILDPENQVCGIVGSTRPKVDRLQVWTRGKDDVEGLNQLGKRIVEVMALEGRDADSMSMEYQVSHKIWASKSQL

SEQ ID NO: 54408 - protein, 280 aa, Petasites fragrans
ITPYRVVIIIRLVILGLFFHYRITNPVESSYGLWLTSVICEIWFAISWVLDQFPKWYPINRITFTDELSARYERKGEPSQLAAVDFFVSTVDPLKEPPLITANTVPSILAVDYPVDKVSCYVSDDGAAMLSFESLAETAEFGRKWVPFCKKFSIEPRAPEFYFSQKIDHLKDKVQPSFVKERRAMKRDYEEYKVRVNALVAKAQKTPEEGWTMQDGTPWPGNNTRDHPGMIQVFLGNSGAHDIEGNELPRLVYVSREKRPGYQHHKKAGAENALVRVSAV

SEQ ID NO: 54409 - protein, 385 aa, Methanocaldococcus jannaschii DSM 2661
MKIDAVKKLLMIPGPTMVPPEVLNAMALPVIGHRTKDYSNLLEDTIEKLKKVFITENDTFLITGSGTAAMDMAISNIIKRGDKVLNIVTGNFGERFANIVKAYKGEAIRLDVEWGDMAEPEAVKEILDKYDDIKAVTVVHNETSTGARNPIKEIGEVVKDYDALYIVDTVSSLGGDYVNVDKFHIDICVTGSQKCLAAPPGLAAITVSEKAWEVIKKNDDKVGFYLDLLAYKKYYEEKKQTPYTPSVNLTYALNVALDLVLEEGIENRVKRHERLAKATRAGLEAMGIELFAKERARSVTVTSAKYPEGIEDSKFRGILSNKYNIVVAGGQKHLAGKIFRIGHMGICGEKEVLATLACVELALKELGFEVKESGVEVAKEVLLKE

SEQ ID NO: 54410 - protein, 284 aa, Pericallis appendiculata
PKSQITPYRVVIIIRLVILGLFFHYRITNPVESSYGLWLTSVICEIWFAFSWVLDQFPKWYPINRVTFTDELSARYEKEGEPSQLAAVDFFVSTVDPLKEPPLITANTVLSILAVDYPVEKVSCYVSDDGAAMLSFESLVETAEFARKWVPFCKKFSIEPRAPEFYFSQKIDYLKDKVQPSFVKERRSMKRDYEEYKVRVNALVAKAQKTPEEGWTMQDGTPWPGNNPRDHPGMIQVFLGNSGAHGIEGNEIPRLVYVSREKRPGYQHHKKAGAENALVRVSAV

SEQ ID NO: 54411 - protein, 165 aa, Oryza sativa Japonica Group
MQLEISPRQRSQQQKEEEGEHQQRAGEEAVGAVFSIEPWVDAAAVLVPPLNFAEVNDGIFRSGFPAADNFAFLLSLKLRSIVYLCPEPYPEENTRFLEQNGIKLHQFGIDGSKELLVNIPEEKIREALKVILDVRNQPVLIHCKRGKRYSSRSLADSDKIWKLDT

SEQ ID NO: 54412 - protein, 362 aa, Mycobacterium leprae TN
MKSHVSKHRRKRRLGAMTTVSAYAATSATEPLTKVTINRRAPGPHDVAIQIKFAGICHSDIHTVKAEWGQPNYPVVPGHEIAGVVTAVGTEVTKHKVGDRVGVGCMVGSCGECSSCLAGIEQYCKRGATFTYNSIGTDGQSTQGGYSQAIVVDENFVVHIPDALPLDAAAPLLCAGITLYSPLRHWNAKPGTRLAIIGLGGLGHMGVKLGRKMGCEVTVLSQSLKKMEDGLQLGASNYYATADPDTFRKLRGSFDLILNTVSANLDLGKYLNLLDVNGTLVELGIPEHPMLVPAFALALMRRSLAGSNIGGITETQEMMNFSAEHSVTPEIELIEPDYINEAYERVLASDVRYRFVINISSL

SEQ ID NO: 54413 - protein, 208 aa, Zea mays
MAEHLASIFGTEKDRVNCPFYFKIGACRHGDRCSRLHNRPTTSPTIVLANMYQRPDMITPGVDAQGVAIAPEKMQEHFEDFYEDIYEELSKFGEVETLNVCDNLADHMIGNVYVQFREEEQAVAAHNALQGRFYSGRPIIVEYSPVTDFREATCRQFEENSCNRGGYCNFMHVKQIGRELRRKLYGGRSRRSHGRSRSPSPQHRRDNP

SEQ ID NO: 54414 - protein, 399 aa, Treponema denticola ATCC 35405
MNLKQDTALEALKDTFISFYGNSEEKIIFAASPARINIIGEHIDYNGGLVLPAAVNLYLRIALRKRKDKKILYRSMKTEKIFEFELDGNLGFDKENDFANYLNGMFLFLKERGLKADTGFELLITSDIPQGSGISSSAALELCFGKIISHAFGFELDGIEFAKIGRRVENEFLGLKSGIMDQFAIAMGKKNQAILLDTSSLNYEYIPLETEPYRIVIMNSNKPRKLTESKYNERKEECEKALAFLQKKTDIDFLCDLSVSDFEKLEEDLISNLGEKLFRRVRHCVTEMDRVRRSAEALKNKDLKLLGASLNQSHLSLKDDYEVTGKELDALFFAAIKEKSCIGARMTGAGFSGCAIAIVHKDGFEEFAERVGKAYTENTGFTASFFACQASDGVSVISI

SEQ ID NO: 54415 - protein, 230 aa, Vibrio harveyi
MSSTSLLDEFGTPVQRVERAIEALKNGLGVLLMDDEDRENEGDLIFSAQHLTEAQMALMIREGSGIVCLCLTEERANWLDLPPMVKDNCSKNQTAFTVSIEAKEGVTTGVSAKDRVTTVKTATYFDAQPEDLARPGHVFPLVAKTNGVLARRGHTEGTIDLMYLANLVPSGILCELTNPDGTMAKLPETIEFARRHGMPVLTIEDIVDYRTGIDLRNEYKSGLVREVSWS

SEQ ID NO: 54416 - protein, 428 aa, Bordetella petrii
MSAIVDIIGREILDSRGNPTVECDVLLESGAMGRAAVPSGASTGEREAIELRDGDKSRYLGKGVLRAVENLNTEISEALMGLDAQEQTFVDRTLIELDGTDTKERLGANALLAASMAVARAAADESGLSLYRYFGGSGPMSMPVPMMNVINGGAHANNTLDLQELMILPVGATSFREALRWGAEVFHALKKLIHGQGMSTAVGDEGGFAPNVPNHEAAIQLILKAIAEAGYEPGSQIALGLDCASSEFYRDGKYTLAGEGGLSLSSQEFANLLATWCDKYPIISIEDGMAENDWEGWKLLTDQLGKKVQLVGDDLFVTNTRILKEGIQKGVANSILIKINQIGTLTETFAAIEMAKRAGYTAVVSHRSGETEDSTIADIAVATNAMQIKTGSLSRSDRMAKYNQLLRIEEELAEVASYPGLDAFYNLR

SEQ ID NO: 54417 - protein, 477 aa, Oryza sativa Japonica Group
MGQKLALNIAEKGFPISVYNRTAAKVDATVSRAEAEGALPVLGHRDPRGFVLSLSRPRTVVLLVQAGRAVDATIDALVPYLDAGDAIVDGGNEWYQNTERRIEEAAARGILYLGMGVSGGEEGARNGPSLMPGGHIDAYNNIRDILEKAAAQTEDGACVTFVGPGGAGNFVKMVHNGIEYGDMQLIAEAYDVLRRVGGLSNSEIADVFAEWNRGELESFLVEITADIFTVADPLDGSGGGGLVDKILDKTGMKGTGKWTVQQAAELAIAAPTIAASLDGRYLSGLKDERVAAAGVLKAEGMPSGLLETINVDKKMLVDRVRQALYASKICSYAQGMNLLRAKSVEKGWNLNLAELARIWKGGCIIRAKFLDRIKKAYDRNPELANLIVDREFAREMVQRQNAWRWVVARAVEAGISTPGMSASLSYFDTYRCSRLPANLIQAQRDLFGAHTYERIDRPGSFHTEWTKLARKSNGAAI

SEQ ID NO: 54418 - protein, 150 aa, Rhizobium leguminosarum bv. trifolii
VLAKHKPAAILHFAALIEVGESVKDPVSFYENNVIGTLTLLSAAQAAGINAFVFSSTCATYGLPQSVPLDETHRQVPINPYGRTKYIVEQALADYDQYRSLRSVVLRYFNAAGADFEGRIGEWHQPETHAIPLAIDAALGRRQGFKVFGS

SEQ ID NO: 54419 - protein, 115 aa, Debaryomyces hansenii CBS767
MFRLAVRAARAPVARAPLASNFVKPIRFYAVAPITKEEVTTRAFDALKTVAALQESKLSLEASFQKDLGLDSLDTVEALVALEEEFDLEIPDKISDDIKTVGEAVNYIYEEEQKL

SEQ ID NO: 54420 - protein, 180 aa, Schizosaccharomyces pombe 972h-
MGLSISKLFQSLFGKREMRILMVGLDAAGKTTILYKLKLGEIVTTIPTIGFNVETVEYRNISFTVWDVGGQDKIRPLWRHYFQNTQGIIFVVDSNDRERISEAHEELQRMLNEDELRDALLLVFANKQDLPNAMNAAEITDKLGLHSLRHRQWYIQATCATSGDGLYEGLEWLSTNLKNQ

SEQ ID NO: 54421 - protein, 173 aa, Bordetella petrii
MPIYQLDEQTPAIDPTVYVADSADIIGDVTLQAGVSIWSHVSIRGDNAPIVIQAGSNIQESSVLHVDEGCPLTVGPGVTVGHQAMLHGCTIHEGALIGMQAIVLNNAVVGRNCLVGAGAIIPEGRIIPDNSLVIGIGKVVRELTAEEIATMHKNTRHYETRGRHYKQALKRIG

SEQ ID NO: 54422 - protein, 238 aa, Cryptococcus neoformans var. neoformans JEC21
MATTDFLSGHPGHLSEAQQSTLEAFRTELLSSGLIPADADKEAFVQRIGYDRFDDQTLLRFLRARKFDIPKAKIMWEANEKWRKEFGADDIAANGFDYPEYEKVAQYYPQYYHKSDREGRPVYIEQLGKLDIPKLYALTTQERQLKRLVSEYEKFLRDRCPACSEEIGHLVETSCTILDLYNAGISSFYKVKDYVSAASTIGQNNSRDNGPHVHHQRPLPLFHRLVPHQTLAGRSYRS

SEQ ID NO: 54423 - protein, 496 aa, Zea mays
  misc_feature (171)..(171): Xaa can be any naturally occurring amino acid
  misc_feature (258)..(258): Xaa can be any naturally occurring amino acid
MGCVFGRTAASSSAAPKKKGLWGGRARHYKSEPSLQATEQNGIKGHSMLAPFTAGWQSTDVHPLVIERSEGSYVYDSNGKKYIDALAGLWCTALGGNEPRLVKAATEQLNKLPFYHSFWNRTTKPSLDLANDILSMFTAREMGKVFFTNSGSEANDSQVKLVWYYNNALRXPDKKKFIARSKSYHGSTLIAASLSGLPALHQKFDLPAPFVLHTDCPHYWRFRLPDETEEEFSTRLANNLENLVLKEGPETIAAFIAXEPVMGAGGVILPPKTYFEKIQAVLKKYDILLIADEVITAFGRLGTMFGCDMYNIKPDLVSIAKALSSAYMPIGAILVSPEITDVIYSQSNKLGSFAHGFTYSGHPVSCAVAVETLKIYKERNILEHVNKIAPRFQEGIKAFSGSPIVGEIRGLGLILGTEFVDNKSPNDPFPAEWGVGSIFGAECEKRGMLIRVAGDSIMLSPPLIMTPNEVEEIISKFGDALKATEERIGELKSRKN

SEQ ID NO: 54424 - protein, 382 aa, Aeropyrum pernix K1
MARLLMIPGPTPVDPEVLLAMARPVISHTSPDFDEIHGETVSMLQKLFRTSGKVFLLPGSGSLGMEFAVRSVAGRGSRALVLKAGYFGGYFERILRSLGASVTVVESPVGRGFTGADVEEALDRAGDVDVVFVQHVETSTSVANPVREIAGVVKKNGARLVVDGIASVGGMDLRLDEWGVDVALTGSQKALSTPPGLAIVAFSSEYSVELEKREPSGIYFDFLSLSREMESTRNYHITPAVNLVFALNASLKRILGEGLENRFERHRVLARAFTRAMEALGLRLVAEEPFRAWTVTAVYLPQGIDWSRFYSVMRKRGVEVAGGLGGLKGKIFRVGHMGEVDANDLIATIAAIERSLVELGYREARLGQGLEAAQKELSSLGL

SEQ ID NO: 54425 - protein, 547 aa, Glycine max
  misc_feature (325)..(325): Xaa can be any naturally occurring amino acid
  misc_feature (341)..(341): Xaa can be any naturally occurring amino acid
MAASAGGQITLSSTVQLHGVACSRNWKLVKFCNGEVMGRKLVLKSAYGGSTKDVRHHQQQQHICMSLTADVSTESKLRDLDMERRNPRTVLAVILGGGAGTRLFPLTKRRAKPAVPIGGAYRLIDVPMSNCINSGINKVYILTQFNSASLNRHIARAYNSGNGVTFGDGYVEVLAATQTPGEAGKKWFQGTADAVRQFHWLFEDPRSKDIEDVLILSGDHLYRMDYMDFVQNHRESGADITLSCLPMDDSRASDFGLMRIDNKGRILSFSEKPKGEELKAMQVDTTVLGLSKDEAQKKPYIASMGVYVFKKEILLNLLRNMHREXLILFQSLFFKCYKLIXFRWRFPTANDFGSEVIPASAREFYMKAYLFNDYWEDIGTIRSFFEANLALTEHPPRFSFYDAAKPMYTSRRNLPPSKIDNSKIVDSIISHGSFLNNSFIEHSVVGIRSRINSNVHLKDTVMLGADYYETDAEVVALLAEGRVPIGIGENTKIKDCIIDKNARIGKNVVIANSEGIQEADRSSEGFYIRSGVTIVLKNSVIEDGFII

SEQ ID NO: 54426 - protein, 77 aa, Zea mays
MLRAEGRQLLARVLPRLGLGTGAAGEVGPAAAATVIKAYHERVVDHYNNPRNVRSFYKGDPNVGTGLVGAPDCGDIM

SEQ ID NO: 54427 - protein, 358 aa, Streptococcus agalactiae A909
MKRLLLLEDGSVFEGEAFGADVETSGEIVFSTGMTGYQESITDQSYNGQIITFTYPLIGNYGINRDDYESIRPTCKGVIVYEWAEYPSNWRQQMTLDEFLKLKGIPGISGIDTRALTKIIRKHGTMKACLINEGNSIHEALENLQKSVLLNNQIEQVSTKLAYASPGVGKNIVLVDFGLKHSILRELSQRQCHITVVPHTTTAQEILNLNPDGVLLSNGPGNPEQLPNALQMIQEIQGKIPIFGICMGHQLFAKANGAKTYKMTFGHRGFNHAVRHLQTGQVDFTSQNHGYAVSREDFPEALFITHEEINDKTVEGVRHKYYPAFSVQFHPDAAPGPHDTSYLFDEFINMIDDFQQKS

SEQ ID NO: 54428 - protein, 229 aa, Triticum aestivum
LYRTSLYKKAGWYRSGIPGISSTHASAAFEYHGTDPRFNRVFNEGMKNHSIIITKKLLESYKGFEGLGTLVDVGGGVGATVAAITAHYPTIKGINFDLPHVISEAPPFPGVTHVGGDMFQKVPSGDAILMKWILHDWSDEHCATLLKNCYDALPAHGKVVLVECILPVNPEATPKAQGVFHVDMIMLAHNPGGRERYEREFEALAKGAGFAGMKTTYIYANAWGIEVTK

SEQ ID NO: 54429 - protein, 334 aa, Opitutaceae bacterium TAV2
MNTATTTEATGRCREHAWWRVKGRSLRAGPKRTSRNSEKGRKVWRKLQPRAWCYTMRMIPTLPLSDGTSIPQLGLGVWQMPDDGAGVPIQAAFNAGYRAIDTAPIYGNEEGVGRAIRASGLPRKELYITTKVWNSAQGYDSTLRAVRESLGRLQLEYVDLYLIHWPVPKIDRYVDTWKALAKIKADGLARSIGVSNFTPVYLQRLFDETGIVPVVNQVELHPRLQQHELRAFHAKHRIVTEAWSPLGQGTLLADPVLAGIAQKHGRSAAQVIIRWHIQQGLVVIPKSVTPSRIAENANVFDFTLDAEDMAAIASLDAGEAGRIGSHPDKMAMGV

SEQ ID NO: 54430 - protein, 529 aa, Flavobacteria bacterium BBFL7
MHNIHIDNSFTDALPQDPITENYTRQVTGTAYSLAQPVEFKKSQVIHVSKLARELGFTDEEVQSLAFKNVVTGREFPDGVAPYAMVYAGHQFGNWAGQLGDGRAINLFEMVHNDQRWALQLKGAGPTPYSRNGDGFAVLRSSIREHLCSEAMHHLGVPTTRSLSLSLSGQQVLRDMLYDGHAAHEKGAIVCRVAPSFIRFGNFELAAAQGNTDVLKQLTDYTIKTFYSQITTTGKEAYLQFFKEVTDRTLEMIIHWQRIGFVHGVMNTDNMSILGLTIDYGPYGWLEPYDHGWTPNTTDRQNKRYRYGAQPEIGLWNLLQLANALYELIDDGPALEKILNSYKENYQTKHLDMMRSKMGLSRPQENDRELIATLEHHLQLHETDMTIFFRELAQVDPQMDTDKAFLHISMAFYDLENLSEPHQWSWLEWLESYLKRLQKEQDESGLDGIAFAKAKQQQMNAVNPKYVFRNYIAQLIIDDADKGDYTLLNEVYRMLQRPYDEQPEFDKWYDLRPDWARTKVGCSMLSCSS

SEQ ID NO: 54431 - protein, 190 aa, Pseudomonas syringae pv. apii
DPKRFSQFTLSSAGLFLDYSKNLITAETRDLLVALAGEVGLKDAIKAQYDGELVNSSEGRPALHTALRRPVGDKLKVNGVDVIPDVHRVLNQMTELVGRIHDGLWRGYTEKPITDVVNIGIGGSFLGPELVSEALVAYAHKGVRCHYLANIDGSEFHELSMKIRAETTLFIVSSKSFNTLETLKNAQAAR

SEQ ID NO: 54432 - protein, 221 aa, Roseovarius nubinhibens ISM
MSMTIPNILTILRLLAAPAIAVMFLYFHRPWADWFALILFVGAAITDWFDGYLARSWAQESKLGAMLDPIADKAMVLIALMVIVGYSSMSPWLVLPATFIVFREVFVSGLREYLGDVAGTLKVTKLAKWKTTAQMVAIACLFAQGVFEHYLGMSVFGMDEAMVAEILAGREEDLLGLWWKYEGMIWAGRLGLWLLWLAAALTLITGYDYFRKSVPYLKEDA

SEQ ID NO: 54433 - protein, 291 aa, Oryza sativa Japonica Group
MMLTKPHPSSNLLLPTTTALPNPSPNPSRKTVVVKYGGAAMKSPELQSSVIRDLVLLSCVGLRPVLVHGGGPEINSWLGRVGVEPQFRNGLRVTDALTMEVVEMVLVGKVNKQLVSLISVAGATAVGLCGKDARLLTARPSPDAAALGFVGEVTRVNPSVLHPIIESGHIPVIATVAADETGQAYNINADTAAGEIAAALGAEKLLLLTDVSGILADRNDPGSLVKEIDIAGVRQMVADGKVGGGMIPKVECCVRALAQGVHTASIIDGRVPHSLLLEILTDEGTGTMITG

SEQ ID NO: 54434 - protein, 354 aa, Glycine max
MASPTHFDDDFDFGGGFGGRHSGNKRSSPDYDDEDYDNDPFAPKKAITKAEEASGVTTGMILSLRESLQNCKDTLATCQNELEAAKSEIQSWHSTLKNQPSILAGITPEPKMLINYLQALKSSEESLREQLEKAKKKEAAFIVTFAKREQEIAELKSAVRDLKVQLKPPSMQARRLLLDPAVHEEFTRLKNLVEEKDKKVKELQDNIAAVSFTPQSKMGKMLMAKCRTLQEENEEIGNQASEGKMHELGMKLALQKSQNSQLRNQFEGLQKHMEGLTNDVERSNEMVLMLQEKLEEKDRQIQRLKHEIKQKNLEDQRLKHELQQKNLEDQRLKHELQQKNLEDGNDNNAGEAAN

SEQ ID NO: 54435 - protein, 176 aa, Glycine max
MHDSSPIQRFNHGPGTKARQPPIGIGSSWNRIQSCDTYRDSYYWLAMQDPRKKKNLTQKASLFQLQANGVKEDGQTSLSLKSRQKGSKRHLMTEVSPPFQKQEGSNSDSLPDSSAAGNEYRALRRKYMLLEDESFALGKEEREVEDEVKTLEDEKFALLDQLIVMEGLVDPTEKHS

SEQ ID NO: 54436 - protein, 410 aa, Vitis vinifera
MEVDISLSPRVNSVKPSKTVAITDQATALVQAGVPVIRLAAGEPDFDTPAVIAEAGINAIREGYTRYTPNAGTLEVRSAICHKLKEENGLSYTPDEILVSNGAKQSILQAVLAVCSPGDEVIIPAPFWVSYPEMARLADATPVILPTLISENFLLDPKFLESKLTEKSRLLILCSPSNPTGSVYSRKLLEEIAQIVARHPRLLVLSDEIYEHIIYAPATHTSFAALPGMWERTLTVNGFSKAFAMTGWRLGYLAGPKHFVAACGKIQSQFTSGASSISQKAAVAALGMGYAGGEAVSTMVKAFRERRDFLVKSFGELEGVKISEPQGAFYLFLDFSSYYGAEAEGFGIIENSESLCRYLLDQAQVALVPGDAFGDDKCIRISYAASLSTLHAAVERIKKAVVPLWPPVPV

SEQ ID NO: 54437 - protein, 335 aa, Zea mays
MAPLGDGGAAAAAASNNLVVSFGEMLIDFVPDVAGLSLAESGGFVKAPGGAPANVACAIAKLGGSSAFVGKFGDDEFGHMLVNILKQNNVNAEGCLFDKHARTALAFVTLKHDGEREFMFYRNPSADMLLTEAELDLGLVRRARVFHYGSISLISEPCRSAHMAAMRAAKAAGVLCSYDPNVRLPLWPSPDAAREGILSIWKEADFIKVSDDEVAFLTRGDANDEKNVLSLWFDGLKLLVVTDGDKGCRYFTKDFKGSVPGFKVDTVDTTGAGDAFVGSLLVNVAKDDSIFHNEEKLREALKFSNACGAICTTKKGAIPALPTVATAQDLIAKAN

SEQ ID NO: 54438 - protein, 436 aa, Neocallimastix patriciarum
MLANVTRSTSKAAPALASIAQTAQKRFLSVHEYCSMNLLHEYNVNAPKGIVAKTPEEAYQAAKKLNTEDLVIKAQVLAGGRGKGHFDSGLQGGVKLCYTPEQVKDYASKMLGHKLITKQTGAAGRDCNAVYVVERQYARREYYFAILLDRATRGPVLVASSEGGVEIEEVAKTNPDAIITVPFSIKTGLTKEIALDTAKKMGFTEKCVPQAADTFLKLYKIFIEKDATMVEINPMAENNRGEVVCMDAKFGFDDNASYKQKGIFALRDTTQEDPREVAAAKWNLNYVGMEGNIGCLVNGAGLAMATMDIIKLNGGVPANFLDVGGSATAKQVKEAFKIISSDKAVSAILVNIFGGIMRCDIVAEGVIQAVKELGLDIPLVVRLQGTKVEEARELIRNSNLSLYAIDDLDKAAKKVVQLANVVGLAKKNGIKIKIEN

SEQ ID NO: 54439 - protein, 533 aa, Parachlorella kessleri
MAGGGVVVVSGRGLSTGDYRGGLTVYVVMVAFMAACGGLLLGYDNGVTGGVVSLEAFEKFFPDVWAKKQEVHEDSPYCTYDNAKLQLFVSSLFLAGLVSCLFASWITRNWGRKVTMGIGGAFFVAGGLVNAFAQDMAMLIVGRVLLGFGVGLGSQVVPQYLSEVAPFSHRGMLNIGYQLFVTIGILIAGLVNYAVRDWENGWRLSLGLAAAPGAILFLGSLVLPESPNFLVEKGKTEKGREVLQKLRGTSEVDAEFADIVAAVEIARPITMRQSWASLFTRRYMPQLLTSFVIQFFQQFTGINAIIFYVPVLFSSLGSANSAALLNTVVVGAVNVGSTLIAVMFSDKFGRRFLLIEGGIQCCLAMLTTGVVLAIEFAKYGTDPLPKAVASGILAVICIFISGFAWSWGPMGWLIPSEIFTLETRPAGTAVAVVGNFLFSFVIGQAFVSMLCAMEYGVFLFFAGWLVIMVLCAIFLLPETKGVPIERVQALYARHWFWNRVMGPAAAEVIAEDEKRVAAASAIIKEEELSKAMK

SEQ ID NO: 54440 - protein, 404 aa, Acidobacteria bacterium Ellin345
MSTLTKATPIQAADRMVNVRYAIRDLAVLADQVASQGNKILYCNIGDPCKYDFPVPVHIMEAAIKAMRDGYNGYGESLGIKPAVEAIRNEAERDGFKNIQGVFVGLGSGEAIDSCLTALLNPGENFLAPSPEYPLYGAITAKLGAEPNAYFLDESNDWQPDVEDLERRINAKTRALLIINPNNPTGAVYSRETLEKIADVARRHNLLLISDEIYNKLVFDPSAKHISIATLAPDVPCITFNGLSKAYLVPGWRIGWGVGTGPAELIKPFLENIYKLLRARLSAPHPYQYAVKAALEGPQDHLKWVNEKLAARAKVTKDWAASEPRVNLVAPKGAFYAFPSLDIPEDDLTFVSELLIQKHVLLVHGSGFGQKPGTHHCRIVTLPQEAVLTNAYAKVSEFLKERYQ

SEQ ID NO: 54441 - protein, 505 aa, Acidobacteria bacterium Ellin345
MATTTAETAKATVYKNLIDGEWVESKSGQTFENLNPADTREVVGIFQRSGKEDVEHAIDAASEAYKKWRLVPAPRRAELLFKAAAILEQRKEKYSQEMTREMGKVIKETRGDVQEAIDAGYYNAGEGRRMFGPTTPSELPNKFAMAVRQPLGVCAMITPWNFPMAIPSWKLFPALVCGNTAVIKPAQDTPLSTFNFVQALNDAGVPKGVINIVTGYGGEVGTPMTEHPEVKAVSLTGSTAVGRIVGQAAAKSFKHCSLELGGKNPMIVLDDANLDLALEGALWGSFGTTGQRCTATSRIILQKGIYKKFADELVARARKLKVGNGLDETVDMGPAVNENQMNTDLKYIEIGKGEGAKLAHGGHRLDKGDYAHGWFLEPTIFTDVNHKMRIAQEEIFGPVVALIPCDDLDEAIEIANGIEYGLSSAIYTRDVNKSFRAMRDLHAGITYVNAPTIGAEVHMPFGGVKATGNGHREGGIGALDFYTEWKAIYVDYSDTLQRAQIDNRE

SEQ ID NO: 54442 - protein, 164 aa, Dickeya dadantii
SVGFDNFEQLLSGAHAMDQHFATTPAEKNLPVLLALIGIWYNNFFGAETEAILPYDQYMHRFAAYFQQGNMESNGKYVDRNGNPVDYQTGPIIWGEPGTNGQHAFYQLIHQGTKLVPCDFIAPALTHNALSDHHSKLLSNFFAQTEALAFGKSREVVEAEFAAA

SEQ ID NO: 54443 - protein, 147 aa, Triticum aestivum
  misc_feature (85)..(85): Xaa can be any naturally occurring amino acid
  misc_feature (90)..(90): Xaa can be any naturally occurring amino acid
  misc_feature (100)..(100): Xaa can be any naturally occurring amino acid
  misc_feature (120)..(120): Xaa can be any naturally occurring amino acid
  misc_feature (123)..(123): Xaa can be any naturally occurring amino acid
  misc_feature (132)..(132): Xaa can be any naturally occurring amino acid
  misc_feature (138)..(138): Xaa can be any naturally occurring amino acid
MAPAVMASSATTVAPFQGLKSTAGLPVSRRSSGSLGRVSNGGRIRCMQVWPIEGIKKFETLSYLPPLSTEALLKQVDYLIRSKWXVPCLXFNKVGFSFRXEHNSSPRVLRRPYWTMWELXMFXCTDAPSVKXVEEVKXGYLILSFQP

SEQ ID NO: 54444 - protein, 164 aa, Pectobacterium carotovorum subsp. carotovorum
SLGFDNFEKLLSGAHAMDKHFASTPAEKNLPVLLALIGIWYNNFFGAETEAILPYDQYMHRFAAYFQQGNMESNGKSADRNGNPVDYQTGPIIWGEPGTNGQHAFYQLIHQGTKLVPCDFIAPAVSHNPLSDHHSKLLSNFFAQTEALAFGKSREVVEAEFAAA

SEQ ID NO: 54445 - protein, 443 aa, Desulfotalea psychrophila LSv54
MAELQKKYGFWTATAMVVGIVIGSGVFFKADNVLRAAGGSLPIALLAWAIGGAIMIVTAYVFSLVANRMSKVNGVSDYFESAYGKTASYFVGWFMAIVYYPSLVAVLAWVSANYSTGLIGKPDWLWPLAFAYMVVFFLLNVFSPVLAGKWQVSTTIIKLIPLGLVAIVGAISGLMTGQTLESFSVSATVVGDNAGGLAVATLATAFAYEGWILATSINAELEDAKKNLPRALVVGTLAVALIYMLYYLGISGVLSNADLIAAGDAAPVNVISIVFGNIGGTVLTVFVVLSCLGTLNGLIMASSRGMYVVAYHGQGPKPKFFAAVNATYNSTLNSALVGFVISTFWLGVWYGNFAGWWGGFLDISELPIAFLYVCYIAIYIWVIRAFDELGPLSRYLAPFCAGLGSLYIIWGASQKDFFSLFLVILAAIFAVGFILKDEQSCLR

SEQ ID NO: 54446 - protein, 220 aa, Herminiimonas arsenicoxydans
MGIDIDVIALLASGLLLLAYYLFLMMRVKRDPNFTVHSVNQKARALWVMDVMRSQGKKDVMAVQTLRNFGMTATFKASSSILLILGTLTLSGQAENMAKAWHVLDIAGSRAADLWVIKIMCLLSVLLVAFFAFSMTLRLLNHVVFMVNLPEADAQGSLSPQRIAQRLNSAGVFYTLGMRAFFVAVPLTFWLFGPLFLFLSTAGLIVALYHLDRSPLAENV

SEQ ID NO: 54447 - protein, 504 aa, Arabidopsis thaliana
MVVINSLRRLARTTQVHLHSRYATCMSGNSTSRRIFTTEAAPEKKNTVGSKGHDMLAPFTAGWQSADLDPLVIAKSEGSYVYDDTGKKYLDSLAGLWCTALGGNEPRLVSAAVEQLNTLPFYHSFWNRTTKPSLDLAKVLLEMFTANKMAKAFFTSGGSDANDTQVKLVWYYNNALGRPEKKKFIARKKSYHGSTLISASLSGLPPLHQNFDLPAPFVLHTDCPHYWRFHLPGETEEEFSTRLAKNLEDLIIKEGPETIGAFIAEPVMGAGGVIPPPATYFEKVQAVVKKYDILFIADEVICAFGRLGTMFGCDKYNIKPDLVTLAKALSSAYMPIGAILMSQEVADVINSHSSKLGVFSHGFTYSGHPVSCAVAIEALKIYKERNIPEYVAKVAPRFQDGVKAFASGSPIIGETRGTGLILGTEFVDNKSPNEPFPPEWGVGAFFGAECQKHGMLVRVAGDGILMSPPLIISPEEIDELISIYGKALKATEEKVKELKAQHKK

SEQ ID NO: 54448 - protein, 190 aa, Pseudomonas syringae pv. tomato
DPKRFSQFTLSSAGLFLDYSKNLITAETRDLLVALAGEVGLKDAIKAQYYGELVNSSEGRPALHTALRRPVGDKLKVNGVDVIPDVHRVLNQMTELVGRIHDGLWRGYTEKPITDVVNIGIGGSFLGPELVSEALVAYAHKGVRCHYLANIDGSEFHELSMKIRAETTLFIVSSKSFNTLETLKNAQAAR

SEQ ID NO: 54449 - protein, 385 aa, Oryza sativa Japonica Group
MAGVSAASAAGKIGSFLSKRPYAPPSWASHLSPAPSQTFSLGHFPTPIHKWNLPNLPNGTEVWIKRDDISGMQLSGNKVRKLEFLMADAVAQGADCVITVGGIQSNHCRATAVAAKYINLDCYLILRTSKLLVDKDPGLVGNLLVERLVGAHIDLVSKEEYGKIGSVALADLLKKKLLEEGRKPYVIPVGGSNSLGTWGYIEAIREIEHQIQISGDVQFDDIVVACGSGGTIAGLALGSKLSSLKAKVHAFSVCDDPGYFHSYVQDLIDGLHSDLRSHDLVNIENAKGLGYAMNTAEELKFVKDIATATGIVLDPVYSGKAAYGMLKDMGANPAKWEGRKILFVHTGGLLGLYDKVDELSSLSGSWRRMDLEESVPRKDGTGKMF

SEQ ID NO: 54450 - protein, 405 aa, Flavobacteria bacterium BBFL7
MLYKMPHMFQKIFKNIGPGTLVAAAFIGPGTITVCILAGANYGYSLLWAMLLSVFATIVLQEMAARLGLITGKGLPEILRSTINNKAIRVAIIILVLAAIAVGNAAYEAGNISGGVLGLNIIFGTQWYFPLILGMIAFSLLIYGNYKVLERVLITLVVIMGISFIVTAIAIGPDFTSILKGLFTPSINEGDLLTIVSLIGTTVVPYNLFLHASLVSEKWNDATDLSAVRKDTIVSVFLGGLVSMSIIVAATALQSTTVSSGADVAKALEPIFGMASTYVFSIGILAAGITSAITAPLAAAYVVKGCLGWRGNMKSWSFRAVWIIILGLGVVFSSIGLKPLDIITFAQIANGLLLPVIAILLLWLVNQKNLGNYQNRNWQNVMAIMVIAIAILLGIKTLLKVFEII

SEQ ID NO: 54451 - protein, 315 aa, Microcystis aeruginosa PCC 7806
MLIARDITQLVGRTPLVQLNRIPVAEGVKARIVVKLESMNPAASVKDRIGVSMVEDAEAAGLIHPDKTILVEPTSGNTGIALAMVAAAKGYRLVLTMPETMSLERRAMLKAYGAQLELTPGSQGMEGAITRAEEIVENTPNAYSLQQFRNPANPKIHRETTAEEIWADTDGLVDIVIGGVGTGGTITGIAETIKPRRPQFQAIAVEPSNSPVLSGGQPGPHKIQGIGAGFIPAIFRPELIDEVIIVDDTEAFAYARRLARQEGLLSGISAGAALWAAIQVGKRPENEDKLIVMIQPSFGERYLSTALFKDLEDID

SEQ ID NO: 54452 - protein, 517 aa, Bacillus anthracis str. Ames
MSLLTVEKLGHTFGDRTLFKDVSMRLLAGEHVGLVGANGVGKSTFMNIITGQLIHDEGRVEWTPGTNYGYLDQHTILTPGRTIRDVLADAFLPLFEKEKALNEVTEKMGTATPEELEELLEQMAEIQDALEAGGFYLLDIKIEEAARGLGIDAIGLDRDVVALSGGQRTKVLLAKLLLEQPEVLLLDEPTNYLDVEHIHWLTNYLKEYPHAFLLISHDTEFMNKCVDVIFHLEFTKMTRYTATYEKFLELAEINKNQHINAYEKQREFIKKQEDFIAKNKARYSTTGRAKSRQKQLDRMERIDRPETAIKPEFSFKESRASSRFVFEGENVEIGYTHPLLPKLTMTIERGEKIAIVGCNGVGKSTLLKTILGKIKPLSGKTSLGDFLNPSYFEQEVKADNITPIDDVWNTFPSLDQHQIRAMLAKCGLKNEHISRPLNQLSGGEQAKVRLCKLMGEESNWLLFDEPTNHLDVTAKEELKKAMKAYKGTILLVCHEPDFYEDWVTKTWDVEKWAQENS

SEQ ID NO: 54453 - protein, 517 aa, Sulfolobus metallicus
MDKLIEEMKSLKAKAMAGGGEDKIKAQHEKGKMTARERIALLFDEGTFSEIMTFARTQSTEFGLDKTDLYGDGVVTGWGKIDGRTAFVYSQDFTSLGGTLGEMHASKIGKVYELALKVGAPVIGINDSGGARIQEGAASLEGYGLVFKNNVMASGVIPQITIMAGPAAGGAVYSPALTDFLIMVKGDAYYMFVTGPEITKVVLGEDVSMQDLGGAVVHASKSGVVHFMVDSEQEAINTAKRLLSYLPSNNMEEPPYMDTGDTNDREVKDAESIVPTDSAKTFDIRDLVYAVVDNGEFLEVHKHWAQNITVGFARVAGNVVGIVANNSAYASGAIDIDAADKAARFIRFCDAFNIPLVSIVDTPGYIPGTDQEYRGIIRHGAKMLYAFAEATVPKITVVVRRSYGGAHIAMSIKSLGADVIYAWPSAEIAVTGPEGAVRILYKKELQAASNPDELLKQRIAEYKKLFANPYWAAKKGLIDDVIEPKDTRKVIMSALSMLKNKREYRYPKKAWEYASLT

SEQ ID NO: 54454 - protein, 274 aa, Oryza sativa
MAGSSHVSAETRKLVGKVAVITGGASGIGACTARLFVKHGARVVVADIQDELGASLVAELGPDASSYVHCNVTNEGDVAAAVDHAVATFGKLDVMFNNAGVTGPPCFRITESTKEDFERVLAVNLIGPFLGTKHAARVMAPARRGSIISTASLSSSVSGTASHAYTTSKRALVGFTENAAGELGRHGIRVNCVSPAAVATPLARAAMGMDMDDETIEAIMEKSANLKGVGLKVDDIAAAALFLASDDGRYVSGQNLRVDGGVSVVNSSFGFFRD

SEQ ID NO: 54455 - protein, 393 aa, Oceanicola granulosus HTCC2516
MRALTYQGKHDVRVETVPDPQIVNPRDAIIEITATAICGSDLHLYDGVIPAVMPGDILGHEFMGRVVETGPGSTLEKGQRVVVPFTISCGQCFHCAQQQFSACDNSNPAEKQDLTEPLYGHPVSGLFGYSHLTGGYPGGQAEYVRVPFSDVGPIVIPDGMDDEEVLFLSDILPTGWMAAENADITEGDTVAVWGCGPVGLFAVQSARVMGAHKVIAIDHYPNRLALARQMGAEVIDYTQTHVLEALMEMTGGIGPDAVIDAVGMESHGFAPDNMLDTIKQTVGMGADAPHALRMAIMACRKGGRISMPGVYGGMADKFPLGALMEKGLQLRTGQTHVQRYTSDLLRRIQEGELDTTFMISHRLPLEEAARGYANFANNQNDWTKVVLKPGMAA

SEQ ID NO: 54456 - protein, 561 aa, Acidobacteria bacterium Ellin345
MKSSALRTLSLTVAALLLSTIGAFAQERAYGRSMVVTQYGIVATSYVQASQAGARILEQGGSAVDAGIAANAALGVVEPMTNGIGGDLFAIYWEKKTGKLYGINASGWAPKGQSLERLRAKGLTEVPTYGIEAVTVPGAVDGWAKLHGRFGKLVWADIFKPAISLAKNGNPVAEVIHGYWAGAEDALKTDPESQRLYMPDGKIPAIGQIFLNPELAQTLTLIANGGRDAYYKGPIGQAIVKTSSSFGGTMTTEDLREYSAEWVEPLSTTYRDWKVYELPPNGDGMAALEMLNIMEQSPAATGGPESAAELHTRIEAMKLAYADVLAYDGDPRFGKIPVAELLSKEFAAARAKKIDPAHANCTVAPGALKGSDTTYLTVIDREGNILSLIQSNYESFGSGITVKGMGFVLHDRGALFNLDPKSPNAIASRKRPFHTIIPGFMEHGDQHIGFGIMGGMNQPLAHAQFVSNVVDYHMNIQAALEEARFTVSSKLGCNIVIESRVPEKTRDELTGMGHVLDVRNKYSTRMGRGQAVLDDAAAKVHYGASDPRADGAAFPEAPPKD

SEQ ID NO: 54457 - protein, 445 aa, Physcomitrella patens subsp. patens
MMNSNSLRLKVGKYELGKTLGEGTFAKVKIAKNLETGASVAIKILDKDKILKHRMVQQIKREISTMKLVKHPYVVQLLEVMASKTKIYIVLEYVTGGELFDKIVHQTRLKEDESRKYFQQLIDAVDYCHSRNVYHRDLKPENLLVDASGNLKISDFGLSALPQQCRADGLLHTTCGTPNYVAPEVINDKGYHGATADLWSCGVILYVLMAGYLPFDEPNLTTLYKKIHRAEFTCPSWFSPGARRLIMKILDPNPRTRVTAAQIYKNEWFRKGYTPAKFDKDASVNLDDIDAVFNESNEYMVTEERDAKPAPMNAFELISLSRGLNLSGLFETRDQEPGPEKETRFTSTKPAKEIISTIEEAAKPLGFNVQKRDYKMKLQGDKHGRKGHLSVATEVFEVAPSLFVVELRKKGGDTLEYHTFYRDLSKGLKDIVWKSDVDGKVSPLK

SEQ ID NO: 54458 - protein, 336 aa, Treponema pallidum subsp. pallidum str. Nichols
MTFVESMQRRAVLAQKRLVLPEACEQRTLEAARLIVFRNIAAKVFLVGCERDIKNTADRCGIDLTDMVVIDPSVSKHRDQFAERYFQKRKHKGISLAQAAEDMRDPLRFAAMMLDQGHADAMVAGAENTTARVLRAGLTIIGTLPSVKTASSCFVMDTNNPRLGGTRGLFIFSDCAVIPTPTAEQLADIACSAAESCRTFIGEEPTVALLSYSTKGSGGDSDENILRVREAVRILHERRVDFTFDGELQLDAALVPKITEKKAPHSPITGKVNTLVFPDLSSGNIGYKLVQRLSDADAYGPFLQGFAKPLSDLSRGCSVEDIVAACAVTLVQSNGR

SEQ ID NO: 54459 - protein, 164 aa, Pectobacterium carotovorum subsp. carotovorum
SLGFENFEKLLSGAHAMDKHFASTPAEKNLPVLLALIGIWYNNFFGAETEAILPYDQYMHRFAAYFQQGNMESNGKSADRNGNPVDYQTGPIIWGEPGTNGQHAFYQLIHQGTKLVPCDFIAPAVSHNPLSDHHSKLLSNFFAQTEALAFGKSREVVEAEFAAA

SEQ ID NO: 54460 - protein, 262 aa, Arabidopsis thaliana
MDKRWSLKGMTALVTGGASGIGYAIVEELAGFGARIHVCDISEAKLNQSLSEWEKKGFQVSGSVCDVASRPEREELMQTVSSQFDGKLNILVSNVGVIRSKPTTEYTEDDFAFHISSNVEAAYHFSQLSHPLLKASGYGSIIFVSSIAGVISFDAGSIYGLTKGALIQLAKNLACEWAKDGIRANAVAPNVINTPLSQSYLEDVSFKKALLSRTPLGRVGEPNEVASLVAFLCLPAASYITGQTICVDGGLTVNGFSYQPEV

SEQ ID NO: 54461 - protein, 164 aa, Pectobacterium carotovorum subsp. carotovorum
SLGFDNFEKLLSGAHAMDKHFASTPAEKNLPVLLALIGIWYNNFFGAETEAILPYDQYMHRFAAYFQQGNMESNGKSADRNGNPVDYQTGPIIWGEPGTNGQHAFYQLIHQGTKLVPCDFIAPAVSHNPLSDHHSKLLSNFFAQTEALAFGKSRDVVEAEFAAA

SEQ ID NO: 54462 - protein, 762 aa, Bordetella petrii
MDETLTKLALDYHAHPTPGKISVMPTKTLANQDDLSLAYSPGVAAACMAIFDQGDDAASKYTSRANLVGVITNGTAVLGLGNIGPLAAKPVMEGKGCLFKKFAGIDVFDIELAENDPNKLVDIIAALEPTLGGVNLEDIKAPECFYIEKKLRERMKIPVFHDDQHGTAIISSAAILNGLKVVGKDIAQVKLAVSGAGAAAIACLDLLVHLGIKREHIYVVDSRGVIWDGRDENMEPNKKRYAQKTDARTLADVVRGADVFLGCSTAGVLTADMVKTMADRPLILALANPEPEIRPEVARAARPDCIIATGRSDYPNQVNNVLCFPFIFRGAMDAGATRITEEMKLACVKAIAELAQAEQNDEVARAYAGQELSFGPEYIIPKPFDPRLIVQIAPAVAQAAVDSGVATRPIEDIEAYRQKLMGFVYHSGQLMRPLFAQAKKAPKRVIYADGEDERVLRAAQTVIDENLARPILVGRPAVIEMRVKKAGLRLVAGQNIEIVDPEDDSRFNETWNAYYQLKGREGVTPAIAKAMIRKHNTLIGAMLLRRGDADALLCGVASKYDNQLKYVDEIIGRKPGQTYAALNVLMLPDQTLFIADTHVNENPSAEEVASITVQAADEMLRFGVVPKIALLSHSNFGSRMTSSSRKMAEARRIIEERAPELEVDGEMHADAALSEKIRVLAYPDSKLKGPANLLIMPNLDTGNITYNILKMTGSNGIAMGPILLGSARPVHILTTSATVRRIVNMTALAVVDAQQEAARARS

SEQ ID NO: 54463 - protein, 164 aa, Dickeya dadantii
SLGFDNFEKLLSGAHAMDKHFASTPAEKNLPVLLALVGIWYNNFFGAETEAILPYDQYMHRFAAYFQQGNMESNGKSADRNGNPVDYQTGPIIWGEPGTNGQHAFYQLIHQGTKLVPCDFIAPAVSHNPLSDHHSKLLSNFFAQTEALAFGKSREVVEAEFAAA

SEQ ID NO: 54464 - protein, 828 aa, Oryza sativa
MRPQSYAFLGLVLLLFSLLPLAPCSAANLNNDTLLAGQALAVGDKLISNNGKFTLGFFQPDAGTSKSSDTSTNSPGWYLGIWFNKIPVFTTVWVANRERPITIPELNLTQLKFSSDGNLVIFNHATESIIWSTRVIIDSHRTQETSSTNTSVVLLNTGNLVIESTTNVVLWESFDSPTDVVLPGAKFGWNKITGLNRQCISKKSLIDPGLGSYSVELDTNGTKGVILMLRNPPKVYWYGLTSPTLIPELRSLLAMDPRTRGLIIPTYVDNSQEEYYMYTLSNESPSSFLSLDMSGQIMLNVWSEANQSWQIIYAQPADPCNPFATCGPFTICNGNSNPVCECMESFTRKSSQDWDLGDRTGGCSRNTPLDCTISGNRTSSADMFHPIAHVKLPYDSESIQDATTQSKCAQACLSSCSCTAYSYQNNICSVWHGDLFSVNQNDGIENHFDDVLYLRLAAKDLQSLSKNKRKPIVGVVTTISIIILVLLIMLMVLVMVWRNRFKWCGVPLHRSQGGSGIIAFRYSDLDHATKNFSEKLGEGGFGSVYRGVLRDLTVVAVKRLDGARQGEKQFRAEVSSIGLIQHINLVKLIGFCCQGDKRLLVYEHMLNGSLDTHLFQSNATILTWSTRYQIAIGVARGLSYLHQSCHECIIHCDIKPQNILLDESFTPKIADFGMAVFVGRDFSRVLTTFRGTVGYLAPEWISGVAITPKVDVYSFGMVLLEVISGMRSLPNVHSSNSHHAAYFPVQAISKLHEGDVQSLVDPRLSGDFNLEEAERVCKVACWCIQDNEFDRPTMGEVVLVLEGLQEFDMPPMPRLLAAITRSSNVAEM

SEQ ID NO: 54465 - protein, 535 aa, Schizosaccharomyces pombe 972h-
MLINEHVRERYHFLRVSLTRVAHLVFANSHESNDLKMVENVSSTPKKGVLEDPSTLTPEVVTPRTPGHRIIKAKGAYTKDRSAKRRRGRIEIERHLLGEFDDNVGSNSLLDVPLYSLEAEPLSPSVMLEDESMEGINQSPQGISVEKLGKEDNRSRSSTPASPSLESHEFSESREAGLSQSNGFEARSHGTGFDEYFDKFSQRKTSSNTLSQLPVLDNQVYLDTVKEICTETEQHTQTLVHFQSRNFHQWYFELVNNFNLLFYGFGSKEHFLSSFVEKKLPCFPIFVVKGYFPQLQLKNVLSSFLEFLEVTPAASVSDMLIQSLSIINSPSFSLGKIVFLVHNIDGESLIDERFQSALAAIASSKNVYFIASVDHVNFALLWDTSLESSFNFVMHDATTFARYYNETTYENSLGIGRANVSNKEKAIKHVLYSLPANSRGIFKFLLIHQLERMMDTQDFDARQGEKVGIEYRSFFQKCSAEFLCSNEPNFRSQLTEFFDHNIIESKRDVSNSEILWVPYPKNLLEILLEDMMEDV

SEQ ID NO: 54466 - protein, 512 aa, Aeropyrum pernix K1
MAKTLDSPGVLVVDFGGQYAHLIARRIRELGVYSEIVPATSLDALGEALPRAAGVVLSGGPGSVWGSRHDEAAAMVLQLGKPVLGICYGHQLLAKVLGGEVGRSPLPEFGPTEVEVLDYGILLNGLPSRFKVWMSHYDAVLRPPGEAKVLARTPGSPVAAMELWGRVFGVQWHPEVRHTQYGREVLDNWLSLVGAPRTWRPGDMVSELVESVKKEVGDALAVAAVSGGVDSTVAALIAKKAIGSRLYPVFIDHGLHPEGEVERVVKLLSRLGLEPVMVDAGEEFLAALEGVGDPEEKRRVVGRVYAEVLERAARDIGAEYLVQGTIYPDVIESGARPGADTIKTHHNVGGLPKDMRLKLVEPLRYFYKDEVRLLAEKLGVPRELIWKQPVPGPGLAVRVEGPITREKLRIVRRADAIVREEVEAAGLGGKLWQYFAVLTASMATGVRGDSRSYGYVVAVRAVESVDAMTAKPAELPWWLLERIARRITSEIPEVVRVVYDITSKPPSTIEWE

SEQ ID NO: 54467 - protein, 657 aa, Saccharomyces cerevisiae
MSDNGSPAVLPKTEFNKYKIGKVKSTPAIQRDAKTNLTYIKLRKRSSEKVYGCTVFQNHYREDEKLGQGTFGEVYKGIHLETQRQVAMKKIIVSVEKDLFPITAQREITILKRLNHKNIIKLIEMVYDHSPDITNAASSNLHKSFYMILPYMVADLSGVLHNPRINLEMCDIKNMMLQILEGLNYIHCAKFMHRDIKTANILIDHNGVLKLADFGLARLYYGCPPNLKYPGGAGSGAKYTSVVVTRWYRAPELVLGDKQYTTAVDIWGVGCVFAEFFEKKPILQGKTDIDQGHVIFKLLGTPTEEDWAVARYLPGAELTTTNYKPTLRERFGKYLSETGLDFLGQLLALDPYKRLTAMSAKHHPWFKEDPLPSEKITLPTEESHEADIKRYKEEMHQSLSQRVPTAPRGHIVEKGESPVVKNLGAIPRGPKKDDASFLPPSKNVLAKPPPSKIRELHQNPRPYHVNSGYAKTAIPPPAAPAGVNRYGPNNSSRNNRFSGNSTAPNNSRNPVNRFHPETNVSSKYNKVPLPLGPQSRYQGNSNESRYKNSPNDSRYHNPRYVNKPETNFNRQPQKYSRQESNAPINKNYNPSNGSRNMAGDHHQGSRPSHPQFPISPSQGQHQLTSKPIEKKNGSFKDERAKPDESKEFQNSDIADLY

SEQ ID NO: 54468 - protein, 441 aa, Physcomitrella patens subsp. patens
MPPSVLDEFPSTPGKVKMERSNYFGRVGSRWHSSVSAKLLCLTSILLLLTISAFFWVSSAGIDSQRPPTFQRSHEWEKRVRQSCLPRREDNPLVVLVTGAAGFVGSHVSLALRKRGDGVVGLDNFNSYYEVSLKRARQELLAKHSVFVIDGDINDKFIIESILEAVPITHVMHLAAQAGVRYAMQNPQSYIHSNIAGLVNIFEVCKAANPQPAIVWASSSSVYGLNTKVPFSEADRTDQPASLYAATKKAGEGIAHTYNHIYGLSITGLRFFTVYGPWGRPDMAYFSFTRDILKGNPISVYSGAGGKDLARDFTFIDDIVKGCVASLDTAEKSTGSGGKKTGPAMLRVFNLGNTSPVTVPTLVDILEKHLNTKAKRQIIKMPRNGDVPFTHANISSAQAQLGYRPTTNLDTGLKKFVKWYLSYYGDNTNRRLWVGNHEKII

SEQ ID NO: 54469 - protein, 164 aa, Dickeya dadantii
SVGFDNFEQLLSGAHAMDQHFATTPAEKNLPVLLALIGIWYNNFFGAETEAILPYDQYMHRFAAYFQQGNMESNGKYVDRNGNPVDYQTGPIIWGEPGTNGQHAFYQLIHQGTKLVPCDFIAPAMTHNPLSDHHSKLLSNFFAQTEALAFGKSREVVEAEFAAA

SEQ ID NO: 54470 - protein, 511 aa, Glycine max
MANIDIEGILKQQQPYDGRVPKTKIVCTLGPASRSVEMTEKLLRAGMNVARFNFSHGTHDYHQETLNNLKTAMHNTGILCAVMLDTKGPEIRTGFLKDGKPIQLKEGQEVTITTDYDIKGDPEMISMSYKKLPVHLKPGNTILCSDGTITLTVLSCDPDAGTVRCRCENTATLGERKNVNLPGVVVDLPTLTEKDKEDILGWGVPNKIDMIALSFVRKGSDLVNVRKVLGPHAKNIQLMSKVENQEGVLNFDEILRETDAFMVARGDLGMEIPVEKIFLAQKMMIYKCNLVGKPVVTATQMLESMIKSPRPTRAEATDVANAVLDGTDCVMLSGESAAGAYPELAVKIMARICIEAESSLDYGAIFKEMIRSTPLPMSPLESLASSAVRTANKAKAKLIVVLTRGGSTAKLVAKYRPAVPILSVVVPVLSTDSFDWTCSDETPARHSLIYRGLIPILGEGSAKATDAESTEVILEAALKSATQRGLCKPGDAVVALHRIGTASVIKICIVK

SEQ ID NO: 54471 - protein, 432 aa, Aeropyrum pernix K1 [sequence omitted]

SEQ ID NO: 54472 - protein, 152 aa, Pneumocystis murina
IDREGNLKLADFGLARAFGVPLRGYTHEVVTLWYRAPEVLLGGRQYATALDIWSIGCTFAEMATKKPLFPGDSEIDEIFRIFRILGTPDENSWPGITSYPDFKATFPKWSPKNLGELITELDGDGIDLLQKCLRYYPAERISAKKALDHPYF

SEQ ID NO: 54473 - protein, 361 aa, Mycobacterium leprae TN
MSQTVRGVISRKKDEPVELVDIVIPDPGPGEAVVDVTACGVCHTDLTYREGGINDRYPFLLGHEAAGTVEVVGPGVTAVEPGDFVILNWRAVCGQCRACKRGRPSYCFDTFNAQQKMTLIDGTELTPALGIGAFADKTLVHSGQCTKVDPAADPAVAGLLGCGVMAGLGAAINTAAVSRDDTVAVIGCGGVGDAAISGAALVGANRIIAVDIDDTKLEWARTFGATHTVNALELEVVKTIQDLTSGFGVDVVIDTVGRPETWKQAFYARDLAGTVVLVGVPTPDMRLDMPLLDFFSHGGSLKSSWYGDCLPERDFPTLVDLYLQGRLPLGKFVSERIGLGDVEEAFHKIHGGKVLRSVVML

SEQ ID NO: 54474 - protein, 470 aa, Escherichia coli
MPLNKKDTQGKGVKNASTVSEDTASNQEPTLHRGLHNRHIQLIALGGAIGTGLFLGIGPAIQMAGPAVLLGYGVAGIIAFLIMRQLGEMVVEEPVSGSFAHFAYKYWGPFAGFLSGWNYWVMFVLVGMAELTAAGIYMQYWFPDVPTWIWAAAFFIIINAVNLVNVRLYGETEFWFALIKVLAIIGMIGFGLWLLFSGHGGEKASIDNLWRYGGFFATGWNGLILSLAVIMFSFGGLELIGITAAEARDPEKSIPKAVNQVVYRILLFYIGSLVVLLALYPWVEVKSNSSPFVMIFHNLDSNVVASALNFVILVASLSVYNSGVYSNSRMLFGLSVQGNAPKFLTRVSRRGVPINSLMLSGAITSLVVLINYLLPQKAFGLLMALVVATLLLNWIMICLAHLRFRAAMRRQGRETQFKALLYPFGNYLCIAFLGMILLLMCTMDDMRLSAILLPVWIVFLFMAFKTLRRK

SEQ ID NO: 54475 - protein, 613 aa, Desulfotalea psychrophila LSv54
MTIKKFFPCTQWFKLLNAETVKLDFMAGLTGAIIVLPQGVAFATIAGLPPQYGLYTAIVIPIIAALFGSSYHLVSGPTTAISIIVFASVSRFAEAGTPEFISMALMVTFLAGVYQLIFGALRLGSLINFVSHSVITGFTAGSAILVMTSQLKSVTGISFAKGQSFYNTWISLFAQLEKINPYALGIALATLAVALISKKIFPRAPNLLAGMIFGSILALFLKNYTETITFVAEIPAQLPQLSSPTFSMASLRRLAPEGLAIALIGLIEATSISRSIAAKSNQKLDSNQEFIAQGLANITGSFFSCYAASGSFTRSGLNYEAGAKTPLSAIFAAILLMLIVLLVAPMTAYLPVSAMGGVIFLVGYNLINFKQIKEIIEHHRSETAILAVTFFGTLFVHIEFAISFGVLLSLMIFLARTSTPYIPSLCPIPTRTGSNHFIEVCEDVCAECPQFKIIRIDTPIYFGSVSYILNHISNIIEKEKIKHILIVAFGINGIDLTGAEALVNENNQLRKIGGGLYFVDHDLAHKASTEHQYLLDHIGQKHFFQSKVEAINTIFQKLDRNICADCTVRIFAECLSEEHNKELLALKEDYLKRELYMGSCSHGKVQKKGASHK

SEQ ID NO: 54476 - protein, 535 aa, Sinorhizobium meliloti 1021
MTVLRSHISPSSEEFKANRAAMTEAIATIEDAVRLAAAGGGETARERHVSRGKLLPRDRLATLIDPGTPFLEVGATAAYGMYNDDAPGAGLITGIGRISARECMIVCNDPTVKGGTYYPLTVKKHLRAQEIAAENRLPCVYLVDSGGANLPNQDEVFPDRDHFGRIFYNQANMSAAGIPQIAVVMGSCTAGGAYVPAMSDEAIIVEKQGTIFLAGPPLVRAATGEVVSAEDLGGADVHTRLSGVADHLARDDAHALALARRAVSALNREKPWTVERIEPEPPLYDPEEIAGIVPADLKTPYEIREVIARLVDGSRFDEFKARFGTTLVCGFAHVHGIPVGIVANNGVLFSESAVKGAHFVELCAQRRIPLVFLQNITGFMVGRKYETEGIAKHGAKLVTAVATVKVPKITMLVGGSFGAGNYGMCGRAFSPRFLWTWPNSRISVMGGEQAAGVLSSVRGEALKRSGKPWSEEEEARFRQPVLDLFERQSHPLYASARLWDDGVIDPRKSRDVLALSLSAALNAPIEETRFGLFRM

SEQ ID NO: 54477 - protein, 819 aa, Candida albicans SC5314
MVNEFYDRQFECSQYIPSGPGYENVDSKNKVCTAVGSVPGEPFVNGTNYLKYAYEYYNSHKWRNLGIAIAFAVVFLGVYIWLTEYNKGAMQKGEIVLFLKSGLKKHKRKNQKATGTALEDIETGKFSNDKLIYPSDIEEEEGGATDKRLNLSGTDNRPEIFFWKDLTYQIRIKKEDRIILDHVDGWVVPGQITALMGATGAGKTTLLNCLSGRLTVGVVTEGARLVNGHSLDSSFPRSIGYVQQQDLHLPTSTVREAFRFSAYLRQPNYVSKQEKDEYVEYIIDLLDMKTYADAIVGVAGEGLNVEQRKRLTIGVELVAKPKLLLFLDEPTSGLDSQTAWSICKLMRKLANHGQAILCTIHQPSALIMAEFDRLLFLQKGGQTVYFGELGQNCQTMINYFERNGADPCPKEANPAEWMLEVVGAAPGSHAKQDYFDVWRNSNEYQVVKDEISRMEIELSKLSPLPSSSNGRDEKESRLTYACPLWKQYLLVTWRTIVEDWRTPGYIYSKLFLVVSSSLFNGFSFFKADKTIQGLQNQMFAIFMSFIPFNTLLQQMLPFYVKQRDLFEVRESPARTFSWFAFIAAQITSEIPFQIVLGTIAYFCWYYPVGLYVNAEPTNQVVSRGVLTWLLQVSFYVYVSTMGHLCNSFLELPDAAANLANLLFSLCLMFCGVLAGPSQLPRFWIFMYRCNPFTYLIQAILSTGLANTRVVCSEHEYVVIEPPAGQTCQEYMSVFITMHGGYLLQSNNGAAESGTCSYCTMDETNTFLKSVNALFSQRWRNYGIFNAFIVINVALAIFFYWLARVPKGNRESRIKHRKEE

SEQ ID NO: 54478 - protein, 373 aa, Oryza sativa Japonica Group
MVSGGGVAAENGEMVGNGEGRKGAGASVLVTGGAGYIGTHTVLRLLEKGFAVTVVDNFHNSVPEALDRVRLIAGAALSARLDFIAGDLKSKDDMEKVFAAKRYDAVIHFAGLKAVGESVAHPQMYYENNVAGTMNLYSAMTKYGCKKIVFSSSATVYGQPEKTPCVEDSKLSALNPYGTTKLVLENYFRQVQAADPEMRVILLRYFNPIGAHRSGDIGEDPRGIPNNLLPYIQQVAVGRRPELNVYGVDYPTRDGTAIRDYIHVVDLADGHIAALEKLFATPDIGCVAYNLGTGCGTTVLEVVKAFEEASGKKIPIKICPRRPGDCTEVYASTDKAKKELGWSARFGIEDMCRDQWNWAKKNPYGYSANAEQN

SEQ ID NO: 54479 - protein, 354 aa, Gibberella zeae PH-1
MSLPSTMKAVVFDGLYKISVQDRPVPQIRDGRDIIIKVHAAGLCGSELHIYRGHQPSGTGFIMGHEFTGTVVQVGSDVKTIHIGDKVVAPFTASCGNCFFCNNGCSARCVESQLFGCEILNGGQAEYVRIPMADGTAVKAPETISDEALLLMADIFPTGFYGVKSAMELVPSQNIQEATMVVVGCGPVGLCAILAATHFKPRHLFAIDSVESRLEQARKLGAEPLNFETDRAGLEARIREVTEGRGADMVVEVVGQAPALRTAFDIVRPFGAISSIGVHNKEIPWTGDDAYTRNIRVQMGRCPVRSVFNEALHLLEQKQDKIGFLFDHKMPLAQAPEGYTLFEQRKTQKVVFTL

SEQ ID NO: 54480 - protein, 606 aa, Arabidopsis thaliana
MWKNIAGLSKAAAAARTHGSRRCFSTAIPGPCIVHKRGADILHDPWFNKVVCFPLTERDRLGIRGLLPPRVMTCVQQCDRFIESFRSLENNTKGEPENVVALAKWRMLNRLHDRNETLYYRVLIDNIKDFAPIIYTPTVGLVCQNYSGLYRRPRGMYFSAKDKGEMMSMIYNWPAPQVDMIVITDGSRILGLGDLGVQGIGIPIGKLDMYVAAAGINPQRVLPIMLDVGTNNEKLLQNDLYLGVRQPRLEGEEYLEIIDEFMEAAFTRWPKAVVQFEDFQAKWAFGTLERYRKKFCMFNDDVQGTAGVALAGLLGTVRAQGRPISDFVNQKIVVVGAGSAGLGVTKMAVQAVARMAGISESEATKNFYLIDKDGLVTTERTKLDPGAVLFAKNPAEIREGASIVEVVKKVRPHVLLGLSGVGGIFNEEVLKAMRESDSCKPAIFAMSNPTLNAECTAADAFKHAGGNIVFASGSPFENVELENGKVGHVNQANNMYLFPGIGLGTLLSGARIVTDGMLQAASECLASYMTDEEVQKGILYPSINNIRHITAEVGAAVLRAAVTDDIAEGHGDVGPKDLSHMSKEDTVNYITRNMWFPVYSPLVHEK

SEQ ID NO: 54481 - protein, 423 aa, Desulfotalea psychrophila LSv54
MSFNTLGLSAPLLKAVAEKGYDTPSPIQAKAIPVIMEGKDVMAAAQTGTGKTAAFTLPILELLSQSKRRVQANQARVLILTPTRELAAQIGESVTTYGKGLSLTSAVIFGGVNINPQMKRLRGGVDILVATPGRLLDLHRQNAIKFNRLEILVLDEADRMLDMGFINDIRKVLAFLPKERQNLMFSATFSSSINNLARGMFNNPVEISVTPPNSTVEIIDQCIYPVDKKQKPALLIQLIRDNKWGQTLVFSKTKHGANRLVGQLQKKGINAAAIHGNKSQSARTKALAEFKNGTVQILVATDIAARGLDIDLLPHVVNFDLPHVQEDYIHRIGRTGRAGASGEAISLVCADEFALLADIERLIKKILPRKSVEGFEPVHPLPESCLNTRPFRAKSPKKNTEGRTRRQGSRPNSRGPKKPSGDK

SEQ ID NO: 54482 - protein, 407 aa, Arabidopsis thaliana
MALSSLLRSAATSAAAPRVELYPSSSYNHSQVTSSLGFSHSLTSSRFSGAAVSTGKYNAKRVQPIKATATEAPPAVHSFGRIGRLVLRIATFRDDIEVVAVNDPFIDAKYMAYMFKYDSTHGNYKGTINVIDDSTLEINGKQVKVVSKRDPAEIPWADLGAEYVVESSGVFTTVGQASSHLKGGAKKVIISAPSADAPMFVVGVNEKTYLPNMDIVSNASCTTNCLAPLAKVVHEEFGILEGLMTTVHATTATQKTVDGPSMKDWRGGRGASQNIIPSSTGAAKAVGKVLPELNGKLTGMAFRVPTPNVSVVDLTCRLEKDASYEDVKAAIKFASEGPLRGILGYTEEDVVSNDFLGDSRSSIFDANAGIGLSKSFMKLVSWYDNEWGYSNRVLDLIEHMALVAASR

SEQ ID NO: 54483 - protein, 256 aa, Opitutaceae bacterium TAV2
MILRKKLIAGNWKMNKTSAEATPLVQEIVAAVGKQTDVDVVVGPPYTALESAGKALEGSVVKLSAQNMHPEKSGAYTGEISAEMLRNLYVTHVILGHSERRTYFAETDAFINKKVLAALKNELKPILCVGETLAEREGNQTLKVVQTQIEAGLEGVTKEQALNIVIAYEPVWAIGTGKVATTEQAQEVHAFIRSLLVKLFGDAIAQKVRILYGGSMKPSNAPELLAQKDIDGGLIGGASLEARSFVELVTAAAAIK

SEQ ID NO: 54484 - protein, 154 aa, Arabidopsis thaliana
MAGGLGKCSKIRHIVRLRQMLRRWRDQARMSSSFSRCVPSDLPSGHVAVYVGSSCRRFVVRATYLNHPVLRNLLVQAEEEFGFVNQGPLVIPCEESVFEESIRFISRSDSTRSRRFTCPDDFQKNCHVVGIRSKPDLWIESRPLLHGVTEKAVW

SEQ ID NO: 54485 - protein, 1039 aa, Arabidopsis thaliana
MSERAKLQKKKKVTEDLLDSLLLLPPWRNFAISQSHQSIIESSSQRLPEKMRIDENEGVSASSKHLVFAYYVTGHGFGHATRVVEVVRHLIAAGHDVHVVTGAPDFVFTSEIQSPRLKIRKVLLDCGAVQADALTVDRLASLEKYVETAVVPRAEILETEVEWLHSIKADFVVSDVVPVACRAAADAGIRSVCVTNFSWDFIYAEYVMAAGYHHRSIVWQIAEDYSHCEFLIRLPGYCPMPAFRDVIDVPLVVRRLHKSRKEVRKELGIAEDVNVVILNFGGQPSGWNLKETSLPTGWLCLVCGASETLELPPNFIKLAKDAYTPDIIAASDCMLGKIGYGTVSEALSYKVPFVFVRRDYFNEEPFLRNMLEFYQCGVEMIRRDLLMGQWTPYLERAVSLKPCYEGGINGGEIAAHILQETAIGRHCASDKLSGARRLRDAIILGYQLQRVPGRDIAIPEWYSRAENELGQSAGSSPTVQANENNSLVESCIDDFDILQGDVQGLSDTCTFLKSLAMLDAIHDSEKSTEKKTVRERKAAGGLFNWEEEIFVARAPGRLDVMGGIADYSGSLVLQMPIREACHVAVQRNLPGKHRLWKHAQARQQAKGQVPTPVLQIVSYGSEISNRAPTFDMDLSDFMDGDEPISYEKARKFFAQDPAQKWAAYVAGTILVLMIELGVRFEDSISLLVSSAVPEGKGVSSSAAVEVASMSAIAAAHGLSIDPRDLAILCQKVENHIVGAPCGVMDQMTSSCGEANKLLAMICQPAEVVGLVEIPNHVRFWGIDSGIRHSVGGADYRSVRVGAYMGRKMIKSMASSILSPSASSANGGNPEELEDEGIDLLEAEASLDYLCNLSPHRYEARYADKLPDIMLGQTFIEEYADHDDPVTVIDQKRSYSVKAPARHPIYENFRVKTFKALLTSATSDEQLTALGGLLYQCHYSYSACGLGSDGTNRLVQLVQGMQHNKSNSEDGTLYGAKITGGGSGGTVCVVGRNSLRSSQQILEIQQRYKAATGYLPLIFEGSSPGAGKFGYLRIRRRISL

SEQ ID NO: 54486 - protein, 415 aa, Arabidopsis thaliana
MTIPDLCNDLVDEILCRVPARNLKRLRSTSKRWNRLFKDDRRFAREHMHKAPKEYLPLMLTSEYRICPVSINLQGDVPSVVLKRDLSLPDPDYSHQFDIGRVFHCDGLLVCNHVGKNPRYGSKIVVWNPLTGQTRWIEAGYRWKEYEVRFVLGYCYQQDENNSCNKKIYKILCFYPNGQDTEIYELNYSDRWTRTIPDGDLTPGWTLIYSEQTVSMNGNLYLFASEKSKPHLGVSLLRFDFSTEKSSLCVTLPYQRPRYEILSISAVRGGENLSLLLQLDFESKTEIWVTNKIDDTTTKGAAVSWTKVLAFDLSPDLQLFSEEVNFLLDEDKKVTVCCERWLEPQEHHRYQCRREYKITDKIYILGEDNKVDEVGSGEGEATDSLEGISQVILNYAPSLVQIEQAGGGKTKRGDD

SEQ ID NO: 54487 - protein, 321 aa, Bacillus anthracis str. Ames
MAVNEKVELATFAGGCFWCMVSPFEEMVGIIKVVSGYTGGHKENPTYKEVCSETTGHYEAVQITFDANKMPYEELLNIYWRQIDPTDVGGQFHDRGQSYETVIFYHNEEQHKKAEASKEELAKCGRFSKPIATKILPAATFYPAEEYHQGYHKKNTFRYELYRKGSGRDAFIKQHWPKDNAHLKEKLNDMQFYVTQENGTEPPFRNEYWNHKEEGLYVDIVSGEPLFTSIDKFDSGCGWPSFTKPVMSASVKEKMDVSHNMTRTEVRSKEGDSHLGHVFPDGPGPNGLRYCINSAALRFIPKEELEKEGYGDFLMLFGNKK

SEQ ID NO: 54488 - protein, 498 aa, Arabidopsis thaliana
MAFAKAPRLSRDDILGNRVSTRSFKIFSDNQKTDPASTIGTSQKKTRIPLRRKIRESQERAKAVLKTGEMERCKNGKSEKENVSKRTTELGNNNLYKTASKASNQAVPQLSSAGTYTWKTRTSVGSIQSDGNKQSKNNVRFIQTTVKTSLQNRSSLKKPPVGRSKSRSISSIPSSAVASTLSLPEKVETKCLEEDTQGESSSSGNKDPTTKVLDVTAKPKSKRRKSFTSLLVNGSKFDEKNGETTEPEKLPSIDDESNQLEVAEYVDDIYQFYWTAEALNPALGHYLSAHAEVSPVTRGILINWLIEVHFKFDLMHETLYLTMDLLDRYLSQVPIHKNEMQLIGLTALLLASKYEDYWHPRERSMLKQLKFRLNAPTPYVFMLRFLKAAQSNKKLEQLAFYLIELCLVEYEALKYKPSLLCASAIYVARCTLHMTPVWTSLLNNHTHYNVSQMKDCSDMILRFHKAAKTGNLRVTYEKYINPDRSNVAVLKPLDKLPL

SEQ ID NO: 54489 - protein, 455 aa, Methanococcoides burtonii DSM 6242
MSIRPKMPQQAPEDRITNFDEVALGYTEEQAILEAERCLECKNPKCVEGCPVNIDIPGFISKIKEGDFQEAINIIKATNILPAVCGRVCPQEEQCEKLCILGKKSEPIAIGRLERICADIERKVGVKDPVVAQSTGKTVAIVGSGPAGLTAASDLAKAGHSVTIFEALHEAGGVLVYGIPEFRLPKAIVKEEVDHIRKLGADIKMDYVIGRILTLDQLTDRFDAVFLGTGAGLPKFMGIEGENLNGVYSANEFLTRVNLMKAYNNDFDTPIKRGSNVIVVGGGNVAMDAARSALRLGADEVSIVYRRSDEELPARREEIEHAKEEGIVFRLLTNPVRIIEGENMSVNGVECIKMELGEPDDSGRRRPEVVEGSEHIVDADIVIMAIGTSPNPIIFDGSKGLEVTPWGTIVVDESGMSSIEGVCAGGDAVTGAATVISAMGAGKLAADTINNYLSK

SEQ ID NO: 54490 - protein, 524 aa, Triticum aestivum
MPIPQIHWQLLPQVQLPQQWRQLLLGLGLLLPVLVLIVRRRKGFKLPPGPARLPVLGNLHQLGSLPHRSLRELARRHGPVMLLRLGATHMLVVSSASAAREVLKEHDADCCSRPACPGPKRLSYGFKNMAFAPYGEHWREMRKIFIVELLSMRRVKAAWGARQEQVDKLMAALAPDEPVALGEHIFAFTDGIIGTVALGNVYGADMLARKKHFQHVLDEAMDMLATFSAEDFFPNAAGRLVDRLTGLVARRDRLFSSLDDFFETVIEQHLDPARPKPENGGDLVDVLIDLWKQEHRGFTKDHVKAIIMDTFVGGIDTSSVTILWAMSELIRNPRVMKKAQEEIRAAVGEQRARVQPDDLPKLNYLKMVLKETLRLYPPATLLLPRETMRHVRIGGYDVPAGTRVAVNAWALGRAGASWGEDADEFNPDRFEAGARHGAVDLHGAHFELVPFGAGRRVCPGMAMALMNVEFALGNLLCGFDWALPEGAKAEDLCMEEAGGLTFHRKTPLVLVPTPYVPPSAASLN

SEQ ID NO: 54491 - protein, 353 aa, Arabidopsis thaliana
MSTKKHNLLANFASSDSRFTQQELPACKPILTPKWVILTFLVSGVVFIPLGVICLFASQGVCFKSFLTFLSYNYIYFVIEIVDRYDTDCIPLSSRDNKVRYIQGLEDKRCNRTITVTKTMKNPVYVYYQLENYYQNHRRYVKSRQDGQLRSPKDEHETKSCAPEDTLGGQPIVPCGLVAWSLFNDTYDFTRNNQKLPVNKKDISWKSDRESKFGKNVFPKNFQKGSLIGGKSLDQDIPLSEQEDLIVWMRTAALPTFRKLYGKIDTDLQAGDTIKVLLQNNYNTYSFNGKKKLVLSTTSWLGGRNDFLGIAYLTVGSICLFLAVSFSVLYLAKPRQLGDPSYLSWNRSAGGGR

SEQ ID NO: 54492 - protein, 379 aa, Zea mays
MATAGKVIKCRAAVTWEAGKPLSIEEVEVAPPQAMEVRIKILYTALCHTDVYFWEAKGQTPVFPRILGHEAGGIVESVGEGVTDVAPGDHVLPVFTGECKECAHCKSEESNMCDLLRINVDRGVMIGDGKSRFTISGQPIFHFVGTSTFSEYTVIHVGCLAKINPEAPLDKVCILSCGISTGLGATLNVAKPAKGSTVAIFGLGAVGLAAMEGARLAGASRIIGVDINPAKYEQAKKFGCTEFVNPKDHDKPVQEVLIELTNGGVDRSVECTGNVNAMISAFECVHDGWGVAVLVGVPHKDDQFKTHPMNFLSEKTLKGTFFGNYKPRTDLPNVVEMYMKKELELEKFITHSVPFSEINTAFDLMLKGESLRCIMRMED

SEQ ID NO: 54493 - protein, 404 aa, Bordetella petrii
MAITDVVVPQLSESVSEATLLTWKKQQGAAVEADEILIEIETDKVVLEVPAPASGVLSEIVEGDGSTVTSGQLLAKIDTAAKAAAAPAPAAEAKAEPAAEKAAAAPAPASNAAAGVASPAASKILSEKGVDPATVAGSGRDGRITKADAQGASAAPKAAAAPAAPASLSLDGRPEQRVPMSRLRARIAERLLQSQQENAILTTFNEVNMQAVIDLRNKYKEKFEKEHGIKLGFMSFFVKAAVAALKKFPLINASIDGKDIIYHGYFDIGIAVGSPRGLVVPILRNADQLSIAEIEKTIADFGKRAADGKLGIEEMTGGTFSISNGGVFGSMLSTPIINPPQSAILGVHATKERAVVEKGQIVIRPMNYLALSYDHRIIDGREAVLGLVAMKDALEDPQRLLLDL

SEQ ID NO: 54494 - protein, 475 aa, Bordetella petrii
MSKQFDVVVIGAGPGGYIAAIRAAQLGMSVACIDAWQNGQGGPAPGGTCTNVGCIPSKALLQSSEHFEQANHHFAEHGIEVKGVSLKLDTLIGRKNTVVKQNNDGILYLFKKNKVTFFHGKGAFAGKADGGYAIKVTGTAEEDLVAKHVVVATGSSARELPGLPFDEKVVLSNDGALNIDGVPKKLGVIGAGVIGLEMGSVWRRLGAEVTILEAMPEFLAAADQQVAKEALKAFTKQGLDIQMGVKIGEIKATAKQVTVPYTDAKGGEQKLVVDKLIVSIGRVPYTGGLNAEGVGLKLDQRGFIEVDGDCKTNLPNVWAVGDVVRGPMLAHKAEEEGVAVAERIAGQHGHVNFDTVPWVIYTSPEIAWVGKTEQQLKKEGREYKAGSFPFLANGRARALGDTTGFAKVIADAKTDEVLGVHIVGPMASELISEAVTIMEFRGAAEDIARICHAHPTLSEAVKEAALAVDKRALNF

SEQ ID NO: 54495 - protein, 646 aa, Oceanicola granulosus HTCC2516
MSDGPVSVRREGAVAVVTIDNPPVNATSQAVRAGLLDAVAACDGMDVTKVVLACAGRTFVAGADVREFDKPPAPPHLPDVLAAIEGAAVPWVAAIHGTALGGGLELAMACHARVAAADAKLGLPEVTLGLIPGAGGTVRLPRLVPAETALGMVAGGRPVPARQAQAAGLVDALAEGDLLEAAKAHAAERTPTLARPVRRLGDRAAYDEAAEAQRRKARGQLSVGAAVDAVDRALTLPPDEALAAERAAFLELKASEQSAALRHLFFAERATLSDPRCKGAPRPVEQVGVVGGGTMGAGIAAACLLAGLAVTLAERDTEAAAAARGRVEEILAASVARGKIDDARRATLLAGFAATADTADLAGADLVIEAVFEDMDVKAAVFAELERHTRPDAILATNTSYLDVAALARSLRDPSRVIGLHFFSPAHVMKLLEIVLPDGVADDVVATAARLARRLGKIAVLAGVCDGFIGNRIMSAYRREADYLVEDGASPWEVDAAMRDFGFPMGVFEMQDLAGLDIAWAMRKRRAATRPASERYVAIADRLCEAGRLGRKTGAGWYDYAAGARAPSPATERIVAEERAAKEIVARPVSREDIMARLLGAMQAEGAAVLAEGIAARSGDIDVVMANGYGFPRWRGGPMFMAERTD

SEQ ID NO: 54496 - protein, 556 aa, Saccharomyces cerevisiae
MSEITLGKYLFERLKQVNVNTVFGLPGDFNLSLLDKIYEVEGMRWAGNANELNAAYAADGYARIKGMSCIITTFGVGELSALNGIAGSYAEHVGVLHVVGVPSISSQAKQLLLHHTLGNGDFTVFHRMSANISETTAMITDIATAPAEIDRCIRTTYVTQRPVYLGLPANLVDLNVPAKLLQTPIDMSLKPNDAESEKEVIDTILALVKDAKNPVILADACCSRHDVKAETKKLIDLTQFPAFVTPMGKGSISEQHPRYGGVYVGTLSKPEVKEAVESADLILSVGALLSDFNTGSFSYSYKTKNIVEFHSDHMKIRNATFPGVQMKFVLQKLLTNIADAAKGYKPVAVPARTPANAAVPASTPLKQEWMWNQLGNFLQEGDVVIAETGTSAFGINQTTFPNNTYGISQVLWGSIGFTTGATLGAAFAAEEIDPKKRVILFIGDGSLQLTVQEISTMIRWGLKPYLFVLNNDGYTIEKLIHGPKAQYNEIQGWDHLSLLPTFGAKDYETHRVATTGEWDKLTQDKSFNDNSKIRMIEIMLPVFDAPQNLVKQAKLT

SEQ ID NO: 54497 - protein, 164 aa, Brenneria nigrifluens
SLGFDNFEQLLSGAHAMDKHFASTPGEQNLPVLLALIGIWYNNFFGAETEAILPYDQYMHRFAAYFQQGNMESNGKYVDRNGNPVDYQTGPIIWGEPGTNGQHAFYQLIHQGTKLVPCDFIAPAVSHNPLSDHHSKLLSNFFAQTEALAFGKSREVVEEEFAAA

SEQ ID NO: 54498 - protein, 381 aa, Synechococcus sp. WH 7803
MNAASSGNTAMLMLADGTVFQGLACGALGTVVGEVVFNTGMTGYQEVMTDPSYSGQLVTFTYPELGNTGVNAHDQEADHAHVRGLIARQLSPVSSNWRSTQSLQTWLEQQGVVGIQGIDTRALVRHLRETGAMNGIISSSGRHPVDLREELLAAPSMEGLNLADRVSTAEAYTWEKPCSVAFDRRLQPGRRDHPFRVVAIDFGIKRAILDRLVGHGCAVTVLPASVDLNTVLSHEPEGVFLSNGPGDPAAVTHGIELARGLLAQQTLPLFGICLGHQILGLALGGETFKLGYGHRGLNHPCGTTGQVEITSQNHGFALDAASLPQDQVDITHLNLNDRTVAAMAHRHQPVFSVQYHPEASPGPHDADHHFSRFVTLMSDRR

SEQ ID NO: 54499 - protein, 164 aa, Pectobacterium betavasculorum
SLGFENFEKLLSGAHAMDKHFASTPAEKNLPVLLALIGIWYNNFFGAETEAILPYDQYMHRFAAYFQQGNMESNGKSADRSGNPVDYQTGPIIWGEPGTNGQHAFYQLIHQGTKLVPCDFIAPAVSHNPLSDHHSKLLSNFFAQTEALAFGKSRDVVEAEFAAA

SEQ ID NO: 54500 - protein, 336 aa, Schizosaccharomyces pombe 972h-
MAIPKVGINGFGRIGRIVLRNALVAKTIQVVAINDPFIDLEYMAYMFKYDSTHGRFDGSVEIKDGKLVIDGNAIDVHNERDPADIKWSTSGADYVIESTGVFTTQETASAHLKGGAKRVIISAPSKDAPMYVVGVNEEKFNPSEKVISNASCTTNCLAPLAKVINDTFGIEEGLMTTVHATTATQKTVDGPSKKDWRGGRGASANIIPSSTGAAKAVGKVIPALNGKLTGMAFRVPTPDVSVVDLTVKLAKPTNYEDIKAAIKAASEGPMKGVLGYTEDAVVSTDFCGDNHSSIFDASAGIQLSPQFVKLVSWYDNEWGYSRRVVDLVAYTAAKDN

SEQ ID NO: 54501 - protein, 40 aa, Glycine max
LEGTKFENVDLSTGEYAEYDEKGECPVMISNLRATFEVTK

SEQ ID NO: 54502 - protein, 201 aa, Magnaporthe grisea 70-15
MSLTYGLGGTGSALAVVGAYMLFTGSGESFDIGATIEEISPFAWASLGIALCIGLSVVGAAWGIFITGSSILGGGVKAPRIRTKNLISIIFCEVVAIYGVIMAIVFQAKINTLDRTGYYSANAYFTGYALFWSGLTVGACNLICGVAVGINGSGAALADAADPTLFVKILVIEIFSSILGLFGLIIGLLTSGKANDFGSSG

SEQ ID NO: 54503 - protein, 218 aa, Arabidopsis thaliana
MSMNQFRTMEEEKQDGGELFHTIEVAKVDRNNVSQPPPAATAALLEVPGDELNLIPPLNFSMVDNGIFRSGFPDSANFSFIKTLGLRSIISLCPEPYPENNMQFLKSNGISLFQFGIEGSKSKEPFVDILDQKIREALKVLLDEKNHPLLIHCKRGKHRTGCLVGCMRKLQKWCITSILDEYKRFAAAKARVSDQRFLESFDVSGLKHTPMSFSCSNR

SEQ ID NO: 54504 - protein, 94 aa, Glycine max
MASGQEKGRSELDSLAREGQTVVPGGTGGKSYEAQEKLAEGRSRGGQTRKEQMGEEGYSEMGRKGGLSTNDESGGEHAAREGIDIDESKFKTKS

SEQ ID NO: 54505 - protein, 387 aa, Streptococcus agalactiae A909
MSENLGQLAINQARENGGKLEVISKVKVEDKRDLSIAYTPGVASVSSAIAEDVELAYELTTKKNTVAVVSDGSAVLGLGDIGPEAAMPVMEGKAALFKRFANVDAVPIVLKTNDTEEIISIVKAISPTFGGINLEDISAPRCFEIEQRLIEECDIPVFHDDQHGTAIVVLAALFNSLKLVKKDIEDIKVVVNGGGSAGLSITRKLLSAGAKHVTVVDRFGIINDKDRESLAPHHKAIAKLTNREFQSGSLEDALENADVFIGVSAPEALHAEWISKMADKPIVFAMANPIPEIYPDQALKAGAYIVGTGRSDFPNQINNVLAFPGIFRGALDARAKTITVEMQIAAARGIASLIPEEELSTTHIIPNAFQNDVADVVAKSVSNAVQK

SEQ ID NO: 54506 - protein, 379 aa, Prochlorococcus marinus str. MIT 9312
MINSYKKNAKLVLSNGLIFPGFSFGYSGTAVGEIVFNTGMTGYQEVITDPSYYGQILTFTYPEVGNTGINTEDSESSICVKGIIVRNYSTNNSNWRSLKNFNEWLVEKKIIGLYGIDTRALVKILRSNGSMNAVLTSEERTLDNCLEIINETPKMEGLNLSKEVSTKQQYLWRNPTGTDFDVRKRYSENTNKLKVVAIDFGIKKSILNRLVSHGCEILVLPSSSSLKDVISNKPDGIFFSNGPGDPSSVTEGIDLARSLIEYGEIPMFGICLGHQIFGIALGGSTYKLPFGHRGLNHPCGINNQIEITSQNHGFALDPNSLSKDIVKITHYNLNDNTVAGLEVNNKPIFSVQYHPEAGPGPHDSDYLFKKFVSLMLERC

SEQ ID NO: 54507 - protein, 240 aa, Treponema denticola ATCC 35405
MSFLSRFEPLLGSENLKKIEDARIAVFGLGGVGSYTAEALARSGVARNGAGQLILIDGDEIEESNINRQLYALYSTIGKAKTEIAMERIADINPACKIEAVNSFILPDNFYKILGEDFFKRVDFIVDAVDTIALKIFLAAEAEKNEVPIISAMGCGNRLNADFEFADIYKTSVCPLCKVMRTELKKRNVKYLKVLYSKTECTVKQNPPASAAWVPSIAGLLIAGEVIKSLYQPASFKETL

SEQ ID NO: 54508 - protein, 404 aa, Arabidopsis thaliana
  misc_feature (267)..(267): Xaa can be any naturally occurring amino acid
MAAFLQTNIRLEIIPGRYSSLTDHKFRAPYRIRCAAASPVKKRYNITLLPGDGIGPEVISVAKNVLQKAGFLQGLEFDFQEMPFGGAALDLVGVPLPEETSTAAKQSDAILLGAIGGYKWDKNEKHLRPEMGLLNIRRDLNVFANLRPATVLPQLVDASTLKKEVAQGVDMMIVRELTGGIYFGEPRGITINENGEEVGFNTEIYAAHEIDRIARVAFETARKRRGKLCSVDKANVLDASILWRKRVTALASEYPDVELSHMYVDNXAMQLVRDPKQFDTIVTNNIFGDILSDEASMITGSIGMLPSASLGESGPGLFEPIHGSAPDIAGQDKANPLATILSAAMLLKYGLGEEKAAKMIEDAVVDALNKGFRTGDIYSPGNKLVGCKEMGEEVLKSVDSKVPV

SEQ ID NO: 54509 - protein, 483 aa, Oryza sativa Japonica Group
MDLTITSLVAACLSMAVLFVATKMIQQRPRTLCLYEKENKEEELLLPPVMSVVSVLTAYLPTLIAKGLPAVIHDLHSRLVTLLVTAHFFQASESEIRQSNIYKVTVPVFGRGVLYDVDLATRSRQISFCTDSIKPINLRGHVDSMVHEVEGYFAQWGEDGVVDIKYEMGNLILLIANRCLLGKQFGESKLEQVSTLLHELFDNGFHLISLFFPYLPTPQHRRRDKARAMLGEMIHEAVRSRRNSGVAEDDVLQKFLDSKYINGRCMTENEIAGLLICMMFAAQHTSSSTSTWTGACLLSHGHRSYLAAAIQEQKRIIQQHGDRINWGILLQMTTLTHCIKEALRLHPPANLLIRHASKSFSVQTRQGHRYQIPKGHTLATCTTVGNRLPYIYKDPNVYDPSRFGPGREEDKVGGKFSYTPFSAGRHVCLGEDFAYMQIKVIWSHLLRNFDLELISPFPEEEWEKFIPGPKGKVMVTYKRRRLL

SEQ ID NO: 54510 - protein, 460 aa, Triticum aestivum
MARATSAALALLIFLLCRHAHADAGTTLSQGQSLAGNEKLLSANGAFSLSFFSPRGGDGSRVYLGVMFARAAEPTVPWVANRDAPVRATAPSYSATVTDSGDLRVLEGERVVWRTNTTSSAGNFTLTIQDTGNLVLAGGSGAQAVQLWQSFDHPADTFLPGMNITLARRGGAVVRQTLFRSWRSPDDPAPGNFTLGQDPLGSAQLFIWRRGQDGKDVTHWRSGQWAKGSFVGIPYRPLNLYGFQLSGDPSQSNGLFYTFQRFNSSQYRFVLQPNGTETCYQLVDATGAWEVVWSQPTMPCQAYNTCGPNAECSAADHCTCLRGFEPKSEEEYSNGVWTQGCVRSSQLTCSERNVSMSGSDAFAVLSGVKLPDLAAWESAVISADACRQWCLANCTCNAYSYSGGTGCLTWAHELVDVYQFPSGQFPNGQGFDLHIKVPASLLGKLINVDDLLTFEVLNWV

SEQ ID NO: 54511 - protein, 181 aa, Yarrowia lipolytica CLIB122
MMFNRITRSAGLLARARPTTTAVMSPMTPLAISRRGYHEKVLDHYNNPRNVGSMNKNDEDVGTGLVGAPACGDVMKLQIRVDDNGVIQDVKFKTFGCGSAIASSSYVTELVRGKSLAEAGKIKNTVIAKELSLPPVKLHCSMLAEDAIKSAISDYNSKRKTKNPTLGAEAAETPAAATATA

SEQ ID NO: 54512 - protein, 68 aa, Glycine max
MTTSRRLADRKSAKFQKNITKRGSVPETTVKKGNDYPVGPIVLGFFIFVVIGSSLFQIIRTATSGGMA

SEQ ID NO: 54513 - protein, 734 aa, Ostreococcus tauri
MSARDTTCKFALASKSLNSSYRESFSTHVRIDPKELRAYSTPSDPAPPGPAPTFGRTPLAAASALVRPETTPGRKKASASASFTVRISPSSVSSAIARRALLPDIVSSCAIDMSVDMTNPSVGAVSVFRRASRVPDAPKAHAERSARTASVVTPSCAPRLGSVSTPAIVSTHVRPSRSLSISNPSPNASTNARSKVSRARANAVGLLLCSSVWRPTTAKEKKEKKEKKEKREKKEKSAKRDRDGGAEKKTSDGGHKKSKVSSSNEYAAVGDRELASTSSAFQRVFYEPPKKLASMSAKDVAAARETLAITQVEGLDVDLAPVSTFEDAGFSKELLRVTANFQKPSPIQAQSWPIVMSGRDMVGIAATGSGKTLAFGMPALTQIRSQPPCKPGQPICLVLAPTRELAQQTAKVFDDAGEASGVRCVCVYGGAPKYEQKNAMKAGGGAAVIVATPGRLRDFMEEGVIKLDRVTMLVLDEADRMLDLGFEPEIRAIAGATRADRQTVMFSATWPMSVQSLASEFMCNPVRVRIGSEGLKASQSITQIVEVVEPQDKDRHLARVMKQYLGSPKDCPRTLIFGLYKKECANLHQRLSREWPAVCIHGDMSQADRERSVEAFKKGTSRILIATDVAARGLDIKGVEYVINYTFPLTTEDYVHRIGRTGRAGATGLAHTFFTQHDKARAGELVNVLRKAGAEVPEDLTKFGTHVKKKESKLYGAHFKEVDMTVKATKITFD

SEQ ID NO: 54514 - protein, 222 aa, Zea mays
MKMSASVAAASPTLRFSSATHPLHRPLRRRLPSVRCSLAAAAAGPGVRAPPELVDSILSKVKGTDRGVLLPKDGHQEVAEVALQLGKYCIDDPVKSPLIFGEWEVVYCSVPTSPGGLYRTPLGRLVFKTDEMVQAVEAPDVVRNKVSFSVFGLEGAVSLKGKLNVLDSKWIQVVFEAPELKVGSLGFQYGGESEVKLEITYVDEKIRLGRGSRGSLFVFLRR

SEQ ID NO: 54515 - protein, 341 aa, Salmonella enterica subsp. enterica serovar Typhi str. CT18
MKALSKLKAEEGIWMTDVPEPEVGHNDLLIKIRKTAICGTDVHIYNWDEWSQKTIPVPMVVGHEYVGEVVGIGQEVKGFKIGDRVSGEGHITCGHCRNCRGGRTHLCRNTTGVGVNRPGCFAEYLVIPAFNAFKIPDNISDDLASIFDPFGNAVHTALSFDLVGEDVLVSGAGPIGVMAAAVAKHVGARHVVITDVNEYRLELARKMGVTRAVNVAKESLNDVMAELGMTEGFDVGLEMSGAPPAFRTMLDTMNHGGRIAMLGIPPSDMSIDWTKVIFKGLFIKGIYGREMFETWYKMAALIQSGLDLSPIITHRFSVDDFQKGFDAMCSGQSGKVILSWD

SEQ ID NO: 54516 - protein, 338 aa, Bacillus anthracis str. Ames
MAILITGGAGYIGSHTCVELLNNNYKIIVVDNLSNSSIESLNRVKEITGKQFEFYKENVLNREKMNEIFLENNIEAVIHFAGFKAVGESTTTPLAYYYNNIISAIVLCDVMQKHNVKNFIFSSSATVYGIPKTLPITEEFPLSVTNPYGQTKLMIEQIMRDVAKADDEWSIALLRYFNPFGAHQSGRIGEDPNGIPNNLMPYVTQVAVGKLKELNIFGNDYPTKDGTGVRDYIHVVDLAKGHVKALEKVLKTKGIEAYNLGTGKGYSVLEMVKAFEKVSGKKIPYKVIGRRPGDVAICFADVSKAKRELGWEAEYGLEEMCVDSWRWQVNNKNGYQMI

SEQ ID NO: 54517 - protein, 396 aa, Oryza sativa Indica Group
MGAADKWLLPLVSVSFVSLLLFLSALSGFSASSSLFARLPPPSYVRRGAAAPPSFAYVLSGGRGEGRKLLRLLLAVYHPRNRYLLHLSADAPESERVELAAAVSRAAPAVRAFGNVDVVGRPTAGTPMGSSGLAATLRAAAALLRLDSEWDWFVTLNAADYPLVTQDDLIHVFSSVPRHLNFIDHTSDIGWKETQRVQPIIVDAGIYLAGRNQFFQATEKRDTPDGSPWVILNRRFIEYCIFGWENLPRTLLMYFTNVMLPQEGYFHSVVCNSDFRNSTVNSDMRYMEWDDPPQMEPHFLNTTHYDEIVESGVPFARKFRENEPLLDKIDERVLHRWRHRPVPGAWCTGRKRWFNDPCSQWSNVNIVRPGPQAEKFRKHMNQIIEESASGNNSCKQ

SEQ ID NO: 54518 - protein, 181 aa, Chlamydomonas reinhardtii
MSGQRCLCHNFNASVTIPPAGHGPFVRALVQLITVSKENSKGATLFADELLEKVQRYAPVQSINIKPNPRNSPDPAVQRETEGEKVLKALDSRDLVVVLDERGSELKSEDLAKLVAAAGDEGRPIAFCIGGPYGHSDAVRGRADRMIRLSSMVLNHQVAVVVLLEQVYRAWTILRGVPYHH

SEQ ID NO: 54519 - protein, 542 aa, Aspergillus fumigatus
MIEAKMTPFEFNQHVNADRLARKLSARQVQMIAIGGTIGTGLFLGTGKALATGGPASMLISYAICGGIVFVTMLSLGEMAAFIPIAGSFCTFAGRFVDDALGFALTWNYWFNDAVSTAADVIALQLLLQYWTDNFPGWAISLIFLIFVILLNVMSVRIYGEIEYWLSLLKVITIIIFIILGIVVNCGGNKDHKYIGDKYFYVGDAPFVGGIGGFASVFVTASFAYGGTESIAITAGETKDPAKNLPRVVRNVFWRIVLFYIISIILIGLNVPYNYPNLSKKTTATSPFTIVFMEAGSAVAGSFINAVLMTSVISAANHALFAGSRLLYTLAVDGHAPHFFGHLNRFQIPWVAVLATSLVSGLCFGASYIGAGQLWTWLQNETSIVGVSNQISWVCIGIASLRFRAAIRRQNLEHLLPFKNWTYPVGPIIAVGLNIVLILVQGWSCFSPSFQAVDFVSFYIEIPIMIVMFLAWKLVKQTRFVHLDEMDLVTDRYDLNAEHAESDGNADGDSPSRVGRILHIKQLQSEKGVLGKLKRVGMWLFL

SEQ ID NO: 54520 - protein, 397 aa, Arabidopsis thaliana
MDYRPSDSSGTDDDLPPSHQGRYQRNARPTGNGRPSVLNSAPLSRVHNEMETQIHLIEQEAYSSILRAFKAQSDAITWEKESLITELRKELRVSDEEHRELLSRVNADEMIRRIREWRKANSLQSSVPQLVHDAPSPAVSGSRKKQKTSQSIASLAMGPPSPSLHPSMQPSSSALRRGGPPPGPKTKKPKTSMQYPSTGIAGRPQAGALTNEPGESGSYDPLVGRKVWTKWPDDNQYYEAVITDYNPVEGRHALVYDINSANETWEWVNLKEISPGDIRWEGEDPGISRKGGHPGQGRGTKTMARGGPASNAGGRGRGSMRMQQPKTQNGIGKKALGEIEILHTETLLKEVEKVFGSVNPNPAEVEKAKRVLRDHELALMDAIAKLEEISDGESGNI

SEQ ID NO: 54521 - protein, 164 aa, Brenneria salicis
SLGFANFEQLLSGAHAMDKHFASTPAEQNLPVLLALIGIWYNNFFGAETEAILPYDQYMHRFAAYFQQGNMESNGKYVDRNGNPVDYQTGPIIWGEPGTNGQHAFYQLIHQGTKLVPCDFIAPAMSHNPLSDHHSKLLSNFFAQTEALAFGKRREVVDAEFAAA

SEQ ID NO: 54522 - protein, 364 aa, Cryptococcus neoformans var. neoformans JEC21
MTFSLLEKGALQHILIALAWLAIARADSIDAIADSADSSCASGDVAGHYDLGLHIASVFVLLVASGLGVFLPVILGEKGSRSVWFGNTFFVLKYFGTGIIISLAFCHLLQESFKTFSNECIGELAYEPTAPAIAMGSMFVIWLIDFFGSRRLANRKALSSLDAHQSCEPCEPSSPDTKSPVADLCCDSGLKSVAETSDRANRRAHWDVQLLEGGIVFHSIMIGVSLGAQTDGFSATFAALIFHQLFEGLGLGARISLLIWPSGITSSVKKHLLCLAYTLTTPVGIAIGIGVHQSFNENGEAELLAIGVLNSVSAGILLYSGLCQLLYSEWVVGDMRNASNMRVAVALIALVSGLFGMSLIGKWT

SEQ ID NO: 54523 - protein, 475 aa, Ostreococcus tauri
MEASLDVVRRVAVCCIGAGYVGGPTMAMIAQKCPDIEVTVVDISQPRIDAWNSSELPIYEPGLDEIVFARRGKNLFFSTDVEGAIRKCEMIFVSVNTPTKKTGLGKGKAADLTYWELAARTIAACSESDKIIVEKSTVPVRTAEAIEKVLQRNCPHEGVRFDILSNPEFLAEGTAMTDLNAPDRVLIGGKIENPEGQAAVDALVEVYANWVPRAQILTANLWSAELSKLAANAFLAQRISSINAMSALCEATGADVKQVSHAIGTDSRIGPKFLNASVGFGGSCFQKDILNLAYICECHGLHEVANYWHSVVGMNDYQKSRFVRRMISAMFNTISGKKIAMLGFAFKKDTGDTRESPAIDVGHGLIEDGAKLNIYDPKVAADQIKMDMGDEAMKRITCCTSHTEALTGAHAVCIMTEWDEFKEYDWEAIYGVMEKPAFVFDGRLILDHQKLKDIGFIVYALGKPLDPFLKGAEGV

SEQ ID NO: 54524 - protein, 297 aa, Synechocystis sp. PCC 6803
MPPLVVAHLGPRGTNTETVALVYGEQHQERTGQAVEFFPCPSIGKTLEAAAQRLVDVAIVPVENSTEGGIAITLDCLWAAENLKIQQELVLPITHVLLSRGKLLADLTKVVSHPQALGQCQKWLGAHLPQVSLVPANSTTEAIQIIGDDPTAAAIASPRAATLFDLSVLQTDIQDYPDNCTRFWAISSEGYLAGSHTTLAFSVPRNVPGALVAPLQLLAQRNINLSRIESRPTKRSLGEYVFFMDLEASQTEPRLQEALEKLKQYTEVLKIFGSYPTKVLQLADLQHFHPPGWSSPS

SEQ ID NO: 54525 - protein, 164 aa, Dickeya dadantii
SVGFDNFEQLLSGAHAMDQHFATTPAEKNLPVLLALIGIWYNNFFGAETEAILPYDQYMHRFAAYFQQGNMESNGKYVDRNGNPVDYQTGPIIWGEPGTNGQHAFYQLIHQGTKLVPCDFIAPAMTHNPLSDHHSKLLSNFFAQTEALAFGKSREAVEAEFAAA

SEQ ID NO: 54526 - protein, 406 aa, Arabidopsis thaliana
MFGPTGGLGMNPSMDDMNLIQQAQRHQLVVSNLGEEIDLEIGPGEDDAAFANNSLIGGPPREPSTGEHDETKHMVLVSDLPSEDQDISKGTPAKRKKKVVKRWREEWADTYKWAYVDMKDGTARIFCSICREYGRKHRRNPYGNEGSRNMQMSALEEHNNSLLHKEALRLQTASKDKIVVDKPIYVKTVMSKSAGSIVEGALKRDPNEIEFVQSVQESVHALERVIAKNSHYVNIMERLLEPERMIVFRVPWIDDRGETHVNRGFRVQFNQALGPCRGGIRFHPSMNLSIAKFLGFQQTLKNALSPYKLGGASGGSDFDPKGKSDNEIMRFCQSFMNEMYRYMGPDKDLPSEEVGVGTREMGYLFGQYRRLAGQFQDRGYIGLLLASELKLVAMAWCTLHDLYLQI

SEQ ID NO: 54527 - protein, 213 aa, Thellungiella halophila
MGCFHSTASREFPGHENPVKLASETAFSVSEVEALFELFKSISSSVVDDGLINKEEFQLALFKNRKKENLFANRIFDLFDVKRKGVIDFGDFVRSLNVFHPNASLEEKTDFTFRLYDMDCTGFIERQEVKQMLIALLCESEMKLADDTIEVILDQTFEDADVDRDGKIGKTEWSDFVIKNPSLLKIMTLPYLRDITTTFPSFVFNSEVDEIAT

SEQ ID NO: 54528 - protein, 553 aa, Oryza sativa Japonica Group
MATPEDTGSWLLYLSLAAKCSGDGDGQPHRLLGFVVVCAVAGLVTCLLHWSFPGGPAWGRWWWTRRRRRGSPCGVAAVPGLRGLPVIGSMWLMTGLAHRKLAAAAEAAGAGRLMALSLGETRVVVAAHPDVAREILHGAAFADRPVKESAYGLLFHRAIGFAPHGAYWRALRRVASTHLFSPWQVAASAPQRAVIARQMVRAIKLQQRSRSGDSAAGAAVEVRRVLRRASLHNVMWSVFGRRYELQLDPGKESDEVRELRALVDEGYDLLGQLNWSDHLPWLARFDLQSTRARCSRLVPRVNRFVTRIIDEHRSSAPVAAAIDFTDVLLSLQGSDKLADSDMVAVLWEMVFRGTDTVAVLIEWVLARLVLQQDVQARVHDELGRVVGLDRDVTESDTASLVYLHAVIKETLRLHPPGPLLSWARLATSDVHVDGYLIPAGTTAMVNMWAIAHDPDVWAEPMEFRPERFIGKAAEFSVMGSDLRLAPFGSGRRSCPGKSLAMATVAFWLATLLHEFALLPSPDPAHGVDLSEVLRLSCEMATPLAVTAWPRRVV

SEQ ID NO: 54529 - protein, 266 aa, Mycobacterium leprae TN
MGALTRLRSRRVVPQRSVGELDAMAAAGAVVAAALHAVRDAAGPGVSSLSLDEIAESVIREAGATPSFLRYHGYPATICTSVNDRVIHGIPSAVEILAPGDLVSIDCGAVLDGWHGDAAITFGVGTLTSVDEALSQATRESLEAGIAAMIVNNRLTDVAHAIEVSTRTSEIRYRLTFGIVQGYGGHGIGRHMHMDPFLPNEGAPGRGPLLVPGSVLAIEPMLTLGTGKTIVLDDEWTVTTADGSRAAHWEHTVAVTEDGPRVLTLA

SEQ ID NO: 54530 - protein, 339 aa, Salmonella enterica subsp. enterica serovar Typhi str. CT18
MNQSNASMTVIGAGSYGTALAITLARNGHQVVLWGHDPKHIATLEHDRCNVAFLPDVPFPDTLHLESDLATALAASRNILVVVPSHVFSDVLRQIKPLMRPDARLVWATKGLEAETGRLLQDVAREALGDQIPLAVISGPTFAKELAAGLPTAISLASTDETFADDLQQLLHCGKSFRVYINADFIGVQLGGAVKNVIAIGAGMSDGIGFGANARTALITRGLTEMSRLGAALGADPATFMGMAGLGDLVLTCTDNQSRNRRFGMMLGQGMDVKGAQDKIGQVVEGYRNTKEVRELAHRFGVEMPITEEIYQVLYCGKNAREAALTLLGRARKEELSRH

SEQ ID NO: 54531 - protein, 413 aa, Methanococcoides burtonii DSM 6242
MNTLTAKDFLTIDDFDIGDRTILVRVDLNSPMSPGGGILDDMRIKSHIPTLMDLEDAKVVLLAHQSRPGKNDFTTMQLHADVMSSSLGRKVTYIDDIFGTHARDSIASMEKGDVILLENVRFYSEESLRRPVDEHQGTHMVRKLAPLFDIFLNDAFAVSHRSHLSITGFSGVLPSGAGRLMEREITSLDVSLKGSESPCIFVLGGAKVDDSLKVAEHVLSSGGADRVLVTGVVANVVLAASGVDIGGPNMKFIESQGYLDQIDKAKNILERFDGKLGFPRDVALNDNGERIEANIDDVASSNLPINDIGLETIVAYSSEIENAKTVVLNGPAGVSEIEGFEIGTSEIIKAATNAGYSIAGGGHITAEVRNMGYEKMFSHISTGGGACIDYLAGDLLPGIEALKVAAKRYREFE

SEQ ID NO: 54532 - protein, 182 aa, Bacillus anthracis str. Ames
MWVTIVDMWISYVDNMFVRWGIRVNISIISIGKLKEKYLKQGIAEYLKRLSAYAKVEVIELPDEKAPENLSEAEMLIVKEKEGIRILDKISDDTHVIALAIEGKQKSSEEFAVSLDRLATYGKSKVAFVIGGSLGLSSEVMKRSNESLSFSKMTLPHQLMRLVLLEQVYRAFRINRGEPYHK

SEQ ID NO: 54533 - protein, 523 aa, Yarrowia lipolytica CLIB122
MIILTTLNNMGIPVEGWHILAGLAILAVITEIYVIGSQLLARRNKTLAPMAFYWIPWVGSSIPYGIDPYEFFEDCRNRYGDVFSFYMLGRVMTVSLGTKGHEFVFNSKLADVSAEEAYTHLTTPVFGTGVIYDCPNSRLMEQKKFCKGALTRDAFRSYVPKIVEEVTNFFAVNFEGKTGKADVMTTQPQMTIFTASRCLLGDEIRSKLNGDFAKLYSDLDNGFTPINFVFPNLPLPSYRKRDLAQQKIRDTYMSVIQRRRMEKDVQDRDLIDALLKNHTYKDGKRMTPQEIAHLLIGVLMGGQHTSASTSAWMLLRLGLDPAIQDELYQEQVDILGEADGSFRQPTYEDILTMTKLQNTIKETLRLHMPIHSIFRQVMRDLPVPGTSFVVPKGHFVMASPGYSQQAERYFPNAKKFDPRRWMTPTEKMAESETDAEAGETVDYGFGAISKGVSSPYLPFGGGRHRCIGEQFANCQLTTLMSCYIQNFKWTVPEGSKLPAVDTTSMITLPVHPSYIVWSKRERN

SEQ ID NO: 54534 - protein, 273 aa, Salmonella enterica subsp. enterica serovar Typhi str. CT18
MPCEELEIVWKNIKAEARALADCEPMLASFYHATLLKHENLGSALSYMLANKLASPIMPAIAIREVVEEAYAADPEMIASAACDIQAVRTRDPAVDKYSTPLLYLKGFHALQAYRIGHWLWNKGRRALAIFLQNQVSVSFQVDIHPAAKIGRGIMLDHATGIVVGETAVIEDDVSILQSVTLGGTGKTSGDRHPKIREGVMIGAGAKILGNIEVGRGAKIGAGSVVLQPVPPHTTAAGVPARIVGKPGSDKPSMDMDQHFNGLHHTFEYGDGI

SEQ ID NO: 54535 - protein, 468 aa, Ostreococcus tauri
MEEIVVAEAAAARAAEMNLDTLTEIEIEPVAFETPVQTPVQTPEEKISIEEDFVAAPARPQKSAVGNGREILLQGFNWESCKNGAWYQNVERLAPTIAQLGFSVIWLPPPTDSVSQEGYMPRDYYCLESRYGTKDELKACINALHENGVLVLGDAVLNHRCAHFQDDKGIWNRFGGKLAWDARAIVSDDPNFHGQGHRSDGDFFHAAPNVDHSQAFVKADLEDWMSWLMREVGYDGWRLDYVRGFWGGHVKDYMEATNPQFAVGEYWDALSYKYDNPEYNQDAHRQRIVNWLNATGGNASAFDVTTKGILHAVFERQEYWRLSDPQGKPPGVMGWWPSRSVTFIENHDTGSTQGHWRFPRGKELQGYCYILTHPGTPTVFWDHMFDNDWGHLHKPIEDMIRIRRQSGIHCRSEVKIVKCEQTMYAAVIDNNLLMKIGPGHFSADGNWELQLSGQDFAIWRKKGAASTR

SEQ ID NO: 54536 - protein, 1076 aa, Zea mays
  misc_feature (425)..(425): Xaa can be any naturally occurring amino acid
MDGGDATNSGKHVAGQVCQICGDGVGTAADGDLFTACDVCGFPVCRPCYEYERKDGTQACPQCKTKYKRHKGSPPVHGEENEDVDADDVSDYNYQASGNQDQKQKIAERMLTWRTNSRGSDIGLAKYDSGEIGHGKYDSGEIPRGYIPSLTHSQISGEIPGASPDHMMSPVGNIGRRGHQFPYVNHSPNPSREFSGSLGNVAWKERVDGWKMKDKGAIPMTNGTSIAPSEGRGVADIDASTDYNMEDALLNDETRQPLSRKVPIPSSRINPYRMVIVLRLAVLCIFLRYRITHPVNNAYPLWLLSVICEIWFALSWILDQFPKWSPINRETYLDRLALRYDREGEPSQLAPVDIFVSTVDPMKEPPLVTANTVLSILAVDYPVDKVSCYVSDDGAAMLTFDALSETSEFARKWVPFCKKYNIEPXAPEWYFAQKIDYLKDKVQTSFVKERRAMKREYEEFKVRINGLVAKAQKVPEEGWIMQDGTPWPGNNTRDHPGMIQVFLGHSGGLDVEGNELPRLVYVSREKRPGFQHHKKAGAMNALVRVSAVLTNGQYMLNLDCDHYINNSKALREAMCFLMDPNLGRNVCYVQFPQRFDGIDRNDRYANRNTVFFDINLRGLDGIQGPVYVGTGCVFNRTALYGYEPPVKKKKPGFFSSLCGGRKKTSKSKKSSEKKKSHRHADSSVPVFNLEDIEEGIEGSQFDDEKSLIMSQMSLEKRFGQSSVFVASTLMEYGGVPQSATPESLLKEAIHVISCGYEDKTDWGTEIGWIYGSVTEDILTGFKMHARGWRSIYCMPKRPAFKGSAPINLSDRLNQVLRWALGSIEILFSRHCPIWYGYGGRLKFLERFAYINTTIYPLTSIPLLLYCILPAVCLLTGKFIIPKISNLESVWFISLFISIFATGILEMRWSGVGIDEWWRNEQFWVIGGISAHLFAVFQGLLKVLAGIDTSFTVTSKATDEEGDFAELYMFKWTTLLIPPTTILIINLVGVVAGISYAINSGYQSWGPLFGKLFFAFWVIVHLYPFLKGLMGKQNRTPTIVVVWAILLASIFSLMWVRIDPFTTRVTGPDIAKCGINC

SEQ ID NO: 54537 - protein, 104 aa, Zea mays
MKLNMVNIASACQKKLEIDDDEKLRAFYVRRISQDVSAYALGEEFKVYVFKIMGGCDKQGFPMKQGVLTSGRVRLLLHRGTPCFRGYGRRNGERRRKSVRGCIV

SEQ ID NO: 54538 - protein, 367 aa, Pseudomonas syringae pv. syringae B728a
MGALLKQEKFLLLAIIAMFVAYPLEHVLVGNGQVVALVSGLALVAFIICASMRVAHHAEMLAEKVGDPYGTMILTLSAVTVEVVILAIMMSNEPSPTLVRDTIYSAVMLDINGILGLAALMGGIKHGEQSYNDDSARTYSVMILTAMGVSMVVPEFIPKGDWKIYSAFTIGAMILLYTLFLRMQVGPHSYFFSYSYPEKKKRQSQGSNPAEEHAEPVNLTRSIATLVVGVVVIGALAEVMSKTVDLGLEGTGAPPVMTAILVAAISAAPEILTALRAALANRMQSVVNIALGASLSTVILTVPVMEAMALYSGQPFQMAMTPVQTVMILITLLVSAINLNDGETNAIEGMTHFVLFATFIMLSCLGL

SEQ ID NO: 54539 - protein, 784 aa, Bacillus cereus ATCC 14579
MKGVILAGGKGRRLRPLTCNTPKPMLPLLEKPVLEYNIELLRQHGIREIAITVQYMSTTIKQYFGDGSKWGVNLYYFEDSPPLGTAGSIKQAEQFLDETFVVISGDALTDFQLSEGIRFHEQKKRMVTMFVKEVENPLSFGLVVMNKDQEVTRYIEKPGWNEVVSNVVNTGIYIMEPEIFSYIPPRQFFDFSHDVFPLLANKNVLFAYLSEGYWLDIGTFNQYRQAQFDLLTKKLQVPIPYTEVLPMVWMGEGVTIGKGTKIHGPSFIGEGAKIGTGAVIEPYSIIGKNSIVSNYSHLQKSIVFANTHIGKYCELLETTIGERTIVEDDVTLFQKSVVADHCHIGRSTVIKQKGKLWPYKAIDSHSIVGAAGIQESEMSAGWLQKSRIVGRGNVEITPQFIVKIAMAYGSLFKKGESILIGSQENIETTSYKNLFLHAIHGIGIHTMECKEMNESLFQYSVHHLQCAGGVFIQVENENEIVIKLYGQAGMPLTYKQQKEIEQVYMSELFYYVHEKEMGRNKLVHVSMNEYIEVILEHIDIEKIQMQKFHLLINKRNDTLQHLLMLFLQRLGCTVTWIYASEQKDHVKALMKSSKANMALMFSEQGNHFELYDKHSNIYQGTDLEEVDIPDFLLESTGNIYPMSLKLGECYLLFYTQDERKSFQVRWKRDILYRIGKLFELIALQGKTFLSIVEQSPPLYLLYDEVVCSWNEKGEIMRKLLDDIERKGEGIFEGVQFKYTEKEWSYIVSDTKQPKFLVYSHARNPVIARENMKNLIEKIRQYQKV

SEQ ID NO: 54540 - protein, 164 aa, Pectobacterium atrosepticum
SLGFDNFEKLLSGAHAMDKHFASTPAEKNLPVLLALIGIWYNNFFGAETEAILPYDQYMHRFAAYFQQGNMESNGKSTDRNGNPVDYQTGPIIWGEPGTNGQHAFYQLIHQGTKLVPCDFIAPATSHNPLSDHHSKLLSNFFAQTEALAFGKSREVVEAEFTAA

SEQ ID NO: 54541 - protein, 223 aa, Aspergillus fumigatus
MFYSYFGPHRTTILAEHLSPGTSSTAASSLASIILPKITHDKPQKLTYTHERLFIHYIADSPSGSSDDAGRRIPFAFLLEMKRKFLSTYPPSSTDFSSLPAYGCAAFNSELRSLLQTYNTAPPSDSLASARREIDSVRDIMTENIERVLERGERIDLLVDKTDRLGGSAHDFRVRSRGLRRRMWWKNIKLMVLLAVVVVFLIYLFVGMGCGLPAWGKCVGHSA

SEQ ID NO: 54542 - protein, 214 aa, Staphylococcus aureus subsp. aureus Mu50
MTKLYPSLLSVDFLDLQHELKRLEEAGVDGVHFDVMDGQFVPNISIGLPILDAVRKGTTLPIDVHLMIENPEKYIASFAEHGADMISIHVESTPHIHRAIQMIKHLDKKAGVVINPGTPISQIEPILDIVDYVLVMTVNPGFGGQSFIDQCVEKIAGLNAIKMERQLNFDIEVDGGVNTDTAKVCVENGATMLVTGSFFFKQEDYKKVTQALKG

SEQ ID NO: 54543 - protein, 425 aa, Hordeum vulgare subsp. vulgare
MGNCWGTRIKDGSTHPGASGMFSRGSGKDGSRLSACSSRASSASMPPSAKTECEILQSANVKVFSYNDLRLATRNFRPDSVLGEGGFGSVYKGWIDEHTLSACKPGTGIPVAVKRLNLEGLQGHREWLAEVNYLGQFCHQNLVKLIGYCLEDEYRLLVYECMPRGSLENHLFRRGSHFQPLSWNLRMKVALGAAKGLAYLHSAEAKVIYRDFKTSNILLDTDYTAKLSDFGLAKDGPVGEKSHVSTRVMGTYGYAAPEYLSTGHLTAKSDIYSFGVVLLEMLSGRRAIDKNRPQGEHNLVEWARPYLTHKRKIFRVLDTRLEGQYSLNGAQTIAALAVECLSFEAKMRPSMEAVVSILEGIQDSSDPTRRPADPARRPAAERPQDPKSGSKTAPGASNSGKGRRKSSGDLLKEPGRDPKPSAYSS

SEQ ID NO: 54544 - protein, 238 aa, Synechocystis sp. PCC 6803
MSNSLLTQPTQESVQQIFARIAPQYDDLNTFLSFGQHHIWKAMAVKWSGVSPGDRLLDVCCGSGDLAFQGAKVVGTRGKVVGLDFCAELLAIAAGKHKSKYAHLPMQWLQGDALALPFSDNEFDGATMGYGLRNVGNIPQALTELQRVLKPGKKVAILDFHQPGNALAANFQRWYLANVVVPMAKQWRLTEEYAYLQPSLDRFPTGPKQVQFALEVGFAKAVHYPIAAGLMGVLVAEK

SEQ ID NO: 54545 - protein, 546 aa, Kluyveromyces lactis NRRL Y-1140
MAIRSSSSSRIDQSPREMFQRSNSNTSSSPNIVGSLLKSWKKSTDSFTDSKKHSSRNSPSARHMSPLRAPSHNGSQTHLHHHNHHLHHTTRDKYFKDLDEDWSAVIDDYNMPIPMINNGGIETTLRPPAVIQDDRAIESQKSSMDSYQGTIPNLNRTISNDLKLQYQIEVEKDVQELNSLMVRIEKFKKLIKPKDSTTQVNLPEIRKLAWNGIPMVHRPVVWKLLIGYLPSNLKRQEQVLNRKRLEYKQGVDHIFSDNHEKDVTTWHQIEIDIPRTNPHIPLYQFESVHNSLKRILYFWAIRHPASGYVQGINDLVTPFFQVFLSEYLSPSAKDDVYSLDPLTYLTAEQLSDVEADCFWCLSKLLEQITDYFIHGQPGILKQVKHLSQLVKRIDCDLFSHFESEHVEFLQFSVRWMNCLLMREFQMSMVIRMWDTYLSETSLETSIVSEDLMSDASTSLDRKSRTSSSGPSSSDSRQTTLSEFHVFVCAAFLVKWSDELMKMDFQEIITFLQNPPTKSWKESDIEMLLSEAYIWQSLYKDATSHWR

SEQ ID NO: 54546 - protein, 251 aa, Magnetospirillum magnetotacticum MS-1
MTNRRKLIAGNWKMNGLKADGLALAKGLADKLASASPNCDMLVCPPFTLIAPVADALAGSKLAVGGQDCHAKTSGAHTGDTSPAMLADLGCKYAIVGHSERRTDHAETDNVVKAKAAAALSAGLVAIVCIGETLAQRDAGQTIEVNRSQLNGSLPEGANAANTVIAYEPVWAIGTGRVATPAQAQEVHAAIRAELVKLVGAAEAGKMRILYGGSMKPDNAKELLALPDVDGGLIGGAALKVADFWAIAESC

SEQ ID NO: 54547 - protein, 407 aa, Synechococcus sp. WH 5701
MLTIESVELLLLVAAVVAMVARRLRLPYSVGLVLGGIVLAWLPFAPDIALTRELIFNAFLPPLIFEAAFYIAWPSLRKDLPVVLTLATVGVVLSAGITTVGMHVLAHWSWPASLLFGVLISATDPVSVIATFKEAGVHGRLRELVEAESLLNDSTAAVGFGIAIAFATGAAITPLGTTQFLAVTIVGGVACGAAVAAALLALAGRTEDPLVEITFTTIAAYGSFLLAEHLEVSGVLATLTAGIMLGNLGPLGAISPKGREAVQSFWDYAAFVVNSLIFLLMGMLEAHQNFTRVLLPIGIAIALVTVGRALSTYLCCSLFQGSPLRVKASHQHVLFWGGLRGALALALSLGLPTSLPYRDTVVTVAFAVVAFSVIVQGLSITPLMRSLGEIGPASADIAGDIALEASR

SEQ ID NO: 54548 - protein, 164 aa, Pectobacterium carotovorum subsp. carotovorum
SLGFENFEKLLSGAHAMDKHFASTPAEKNLPVLLALIGIWYNNFFGAETEAILPYDQYMHRFSAYFQQGNMESNGKSADRNGNPVDYQTGPIIWGEPGTNGQHAFYQLIHQGTKLVPCDFIAPAVSHNPLSDHHSKLLSNFFAQTEALAFGKSRDVVEAEFSAA

SEQ ID NO: 54549 - protein, 217 aa, Mycobacterium leprae TN
MAAQSAGLLGDSREGRSRREGGSRGGRDRDRDGEKGNYLERVVAINRVSKVVKGGRRFSFTALVIVGDGHGMVGVGYGKAKEVPAAIAKGVEEARKSFFRVPLIDGTITHPVQGEAAAGVVLLRPASPGTGVIAGGAVRAVLECAGVHDILAKSLGSDNAINVVHATVAALKLLQRPDEVAARRGLRSGMLPRSWDPAGVAGERSVDRPVGRVREQA

SEQ ID NO: 54550 - protein, 355 aa, Arabidopsis thaliana
MEMENHRPGSFTYMGRKFSDLSLNDDSSAFSDCNSDRSGEFPTASSESRRLLLSCASENSDDLINHLVSHLDSSYSIDEQKQAAMEIRLLSKNKPENRIKIAKAGAIKPLISLISSSDLQLQEYGVTAILNLSLCDENKESIASSGAIKPLVRALKMGTPTAKDNAACALLRLSQIEENKVAIGRSGAIPLLVNLLETGGFRAKKDASTALYSLCSAKENKIRAVQSGIMKPLVELMADFGSNMVDKSAFVMSLLMSVPESKPAIVEEGGVPVLVEIVEVGTQRQKEMAVSILLQLCEESVVYRTMVAREGAIPPLVALSQAGTSRAKQKAEALIELLRQPRSISNGGARSSSQL

SEQ ID NO: 54551 - protein, 127 aa, Flavobacteria bacterium BBFL7
MVEKTEAEWKKELTPEQYRILREKGTERPFTGEYNTHYEDGTYSCAACGNDLYKSETKFDSGCGWPSFDDEIEGAIMRKRDISHGMIRTEIMCANCGSHLGHVFNDGPTATGIRHCVNSVSVDFKAE

SEQ ID NO: 54552 - protein, 250 aa, Mesorhizobium loti
MHRRNLIRGFIALGVCPICAQTARAASAHWGYGGSVGPEHWADLDTRNFACSAGRQQSPIDIAGTVKADIPRIDISWLKGGGRMVNNGHTIQINMPEGSTLTRGDRVYQLAQLHFHAPSEHHVAGMSFPMEAHFVHKDTKSDTLGVLSALLTPGATNKSFAGLAKVFPARPGEEMAVDEFDPNGLLPASLGYWTYEGSLTTPPCTENVEWMVAMEPVEVDTADIKRFTTLYASNARSIRPSNRRFILGLS

SEQ ID NO: 54553 - protein, 350 aa, Lingulodinium polyedrum
HEEATKVISKLVKQAPLSQAELLGLQGEINVQGEDQKKLDVITNDVLKKALQYSGKLGTLASEEEDSPVLGSFETRGDDGQVISRGETLVADTGKYVCVFDPLDGSSNVDAGIAVGTIFGIFEEPDLEACNLPEDIKDMDATQMACLASTLQPGKALVAAGYVLYSCSTEMVFTTGNGCIGFTLDESIGEYVLTRPSIQIPPRGKIYSMNEANVEEWDEPMKRYVEDIQTGKGETGTQYSLRYIGSMVGDVHRTLLYGGIFAYPADSKNKDGKLRLLYEAAPMSFILEQAGGKAITGFSRVMDIPPAAVHQRVPVILGSKDDVEECQKYFEASKDEALRKRCESRLQVPA

SEQ ID NO: 54554 - protein, 163 aa, Glycine max
ADYSETMKALAWYGKNDVRMIDTPKPKILEDRDVIVKVTGSTVCGSDLHLLHGAVVEMQKGDILGHEFCGVVDECGPGVTKFKKGQRVVASFQIACGDCYYCKQKLSSQCEKTNSNTIENAMYGGRTAGMFGYSHFTGGYAGGQAEYTRVAYGDVNLLPLPDD

SEQ ID NO: 54555 - protein, 184 aa, Arabidopsis thaliana
  misc_feature (59)..(59): Xaa can be any naturally occurring amino acid
MEAPTETKGISKQKWLEGRKKKIGKLLDANGLDMTQAYMLDTQEAAESKYKKWEKEPTXAGWDVFNQKTLYNAYKKRTKNIQVDLEEYNRMRAADPEFYREASSLQYGKAPKTSQDKIDKMAKELLDREQKRQEFSRRRKFREEKDIDSINDRNEHFNKKIERAFGKYTLEIKNNLERGTALPD

SEQ ID NO: 54556 - protein, 723 aa, Vibrio vulnificus YJ016
MIYQAETLQVKEVQDGVAEILFCAQNSVNKLDLATLASLDKALDALTAHSGLKGVMLTSDKEAFIVGADITEFLGLFAKPEEELDQWLQFANSIFNKLEDLPVPTVAVVKGHTLGGGCECVLATDLRIGDKTTSIGLPETKLGIMPGFGGCVRLPRVIGADSAMEIITQGKACRAEEALKIGLLDAVVDSDRLYASALQTLTDAINEKIDWKARRQQKTSALTLSKLEAMMSFTMAKGLVAQVAGPHYPAPMTAVVTIEEGARFARNQALDIERKHFVKLAKSEEAKALVGLFLNDQYIKGIAKKAAKSANKETQRAAVLGAGIMGGGIAYQSALKGVPVIMKDIAQASLDLGMTEASKLLNKQLERGKIDGFKMAGILASITPSLHYAGIDNADIIVEAVVENPKVKAAVLSEVEEQVSEETVLTSNTSTIPINLLAKSLKRPENFCGMHFFNPVHRMPLVEIIRGEHTSDETINRVVAYAAKMGKSPIVVNDCPGFFVNRVLFPYFGGFSMLLRDGADFTQIDKVMERKFGWPMGPAYLLDVVGIDTAHHAQAVMAQGFPERMGKQGRDAIDALFEANKYGQKNGSGFYTYTMDKKGKPKKAFSDEIVPILAPVCAAQQAFDDQTIIQRMMIPMINEVVLCLQEGIIASAQEADMALVYGLGFPPFRGGVFRYLDSVGIANFVAMAQQHVELGAMYQVPQMLIDMAERGQTFYGAQQQGSI

SEQ ID NO: 54557 - protein, 173 aa, Ostreococcus tauri
MPRSPGESNPVFVTVGTTSFDALIEALDSERTVKVLEQRGFTELTLQIGRGTYAPTTLRTRGAFKVRVVEYLPSIEREIARAGLVISHAGAGSVFETLRSGTPLLVVVNERLMDNHQVELAEELAERGCLRWCVADGIFGAIEALELDGSGFARKAYDPGECSIKERLEELLF

SEQ ID NO: 54558 - protein, 183 aa, Triticum aestivum
MKIAWVSLRRNTSLRISLRSVSQCCSGPKSMSTQSSKGHMDPPLYLSSIDAEPLHRYRQGGYHPIILGEFLHSGRYKVLHKLGWGGYSTVWLARDQRDEVYVAIKIGVAEAYDKVIRELQVMKRLVTCYPRPKHMVLMLDHFHLKGPNGRHNCLVFELLGPNIPDIIGAHFPHGRLPGKLAKV

SEQ ID NO: 54559 - protein, 477 aa, Nicotiana benthamiana
MEPLMKIWSFDLVAWRAFLFSALILNFVFACQFLFLQPLVSALDTKPGDAAALFERVSQNVKVKKYSEALNDLNSAIEADPALSEAYWHRASLLRQLCRYEESERSYKRFLEMKPGDSAAEKELSQLHQSKSAFDSATNLLDTGDIKRALEYIDKVVLVFSPACSKAKLLRRSYCSQIKIIPVTYLRRDTYLKKMRIIWRLYCYEAVPTTIWLIMMSPKALPKRSSVRPRAWELKKAYLLEKLTEKTKSAEDNASKGKLRLAVEEYKATLTMDPNHSAHNVNLHLGLCKVLVKLGRGKDAISSCSEALELDGELIDALVQRGEAKLLTEDWEGAVADLKEAAEKSPQDRNIREALMRAERSFKLSQRKDWYKILGVSKTASVSEIKKAYKKLALQWHPDKNVENREEAENKFREIAAAYEILGDEEKRTRYDQGEDIEDMDSGMGGGGFNPFGGGGQQYTFHFEGGFPGGGFGGFHF

SEQ ID NO: 54560 - protein, 646 aa, Arabidopsis thaliana
MGNACVGPNISGNGFLQTVTAAMWRPRIGAEQASSSSHGNGQVSKEAASEPATDQVQNKPPEPITMPSSKTNPETKLKPDLEIQPEEKKEKVLAEETKQKVVPEESKQEVPPEESKREVVVQPESAKPETKSESKPETTKPETTSETKPETKAEPQKPKHMRRVSSAGLRTESVLQRKTENFKEFYSLGRKLGQGQFGTTFLCLEKGTGNEYACKSISKRKLLTDEDVEDVRREIQIMHHLAGHPNVISIKGAYEDVVAVHLVMELCSGGELFDRIIQRGHYTERKAAELARTIVGVLEACHSLGVMHRDLKPENFLFVSREEDSLLKTIDFGLSMFFKPDEVFTDVVGSPYYVAPEVLRKRYGPESDVWSAGVIVYILLSGVPPFWAETEQGIFEQVLHGDLDFSSDPWPSISESAKDLVRKMLVRDPKRRLTAHQVLCHPWVQIDGVAPDKPLDSAVLSRMKQFSAMNKFKKMALRVIAESLSEEEIAGLKQMFKMIDADNSGQITFEELKAGLKRVGANLKESEILDLMQAADVDNSGTIDYKEFIAATLHLNKIEREDHLFAAFSYFDKDESGFITPDELQQACEEFGVEDARIEEMMRDVDQDKDGRIDYNEFVAMMQKGSIMGGPVKMGLENSISISLKH

SEQ ID NO: 54561 - protein, 213 aa, Brassica napus
  misc_feature (79)..(79): Xaa can be any naturally occurring amino acid
GSYQIHASRGKEDLEIVRKLADYAIKHHFPHIESMNRSDDSLSFITGKEDDSVVDLTSNKYAAWVVEIAERTATLVARXQGVGFTHGVLNTDNMSILGQTIDYGPFGFLDAFDPSFTPNTTDLPGRRYCFANQPDIGLWNIAQFAKSLAVAELINQKEANYAMERYGDKFMDEYQAIMSKKLGLSKYNKDIISKLLNNMAVDKVDYTNFFRLL

SEQ ID NO: 54562 - protein, 396 aa, Ostreococcus tauri
MASHASPSIARASRGADRGRANERASARAGKRGKRATTRSRRPSAPPGRDGRPPTTNSTSEGDDDADPEAPLGRRSRRPVLRVGARAQTLPPPEGRHVSEKRMKKVALEGAARRAADAPAADGVAEVALIGRSNVGKSSLLNLVTFGAGAAVVSAKPGTTCSMNHYSVDGRWRLVDLPGYGYAEAEPGEIEAWDAFTKEYFATRENLAGVLLLIDASVPPTANDEKYANWLIENETPFTIVFTKCDRDKPKGPSVEDNKAAFRAKLEERWHRLPSMISTSSVTTQGRDEVLKFISSLIVYRRMRNEERKKAKRQEKVKAMKEERYEAKGEAMRKARGGKPAKKPVSKVEEEWDDEEELDEDWDDESSFTVNAKGKGAKTIQDMIRAELEEINREGR

SEQ ID NO: 54563 - protein, 610 aa, Methanococcoides burtonii DSM 6242
MESIYLLQVALAVLVMSLVAQSLSRLFKMPVLIFLLAEGIIAGPEVLGLLDPSLLGEGLAAIVSLCVAVIVFDGGLHIDLKSIRSIQQGVLSLITVGVIITFIFATLFTHYIVGLSLEISAVFGALVTATGPTVITPVVRQVRVNHRVSKTLELEGVLNDAVCVILAALVFEVIISQLSGFEAVSFIVYRTMIGLTMGIASGLLLTRFLSSSVLSEQVVRFVTFTSVIATFVIAESLGAESGILAVALFGIIVGSSNVRYKAALKEFKSDLVLMMLSLIFILLAAMLKFEDIFRIGFAGIIVVLLLVFFVRPLSVFVSTARTNFRTKEKLFISFVGPRGVVPASIATYFAIKMNSLNIEGGQELVGLVFLTVIITVLMTGSLSKYVAKFLGVIPMEILVVGGGEVGRILAERFEKRGENVVVVESSEEHCQRLMKSGIRVVHGDAEDVNVLKKAGIENAKYVVASTNQDNTNLLVCQIAKTKFGFKEDQIVARVNNMENLHAFWDLEIRAMSPAMSTALFLDNMVGRPHMFSMCEVGEGGDILEVKVTNPKVAGKSIKELSLPEDSLLLMVRRGDQSFIANGNLVLEFDDVVTVIGEGDAAKIVADLLGR

SEQ ID NO: 54564 - protein, 347 aa, Silicibacter pomeroyi DSS-3
MRAAQLTAWRQPLTLATLPDPTPGPGEVVLRVLACGVCRSDWHAWTGADPDVELPLVPGHEFCGEVVALGTGVSRWRLGDRVIAPFILACGRCGDCAAGHQTICANQQVPGFTRNGAFAELIAVPFADTNLTALPDSLPPHVAAGLGCRVTTAWQALVGRAELRPGEWLAVFGGGGVGLSALLLGRALGARVVVVDVVEDKLTHAKSLGADAVVNAADTDAAEAVRELTGGGAHVAVEALGIAATMTGAMRSLRKLGRLVMIGMPAGEHTAMTLPMDVLYSGQLTLQGTRGMPAWRYPSLLSLIDGGHVDLSPLVTRTIALSQASDELAAFDRPAPPGVAVITDFAT

SEQ ID NO: 54565 - protein, 512 aa, Salmonella enterica subsp. enterica serovar Typhi str. CT18
MTNNPPSTRIQPSEYGYPLKLKARYDNFIGGDWVAPADGEYYQNLTPVTGQPLCEVASSGKKDIDLALDAAHKAKDKWAHTSVQDRAAILFKIADRMEQNLELLATAETWDNGKPIRETSAADIPLAIDHFRYFASCIRAQEGGISEVDSETVAYHFHEPLGVVGQIIPWNFPLLMASWKMAPALAAGNCVVLKPARLTPLSVLLLMEVIGDLLPPGVVNVVNGAGGEIGEYLATSKRIAKVAFTGSTEVGQQIMQYATQNIIPVTLELGGKSPNIFFADVMDEEDAFFDKALEGFALFAFNQGEVCTCPSRALVQESIYERFMERAIRRVESIRSGNPLDSGTQMGAQVSHGQLETILNYIDIGKKEGADILTGGRRKELDGELKEGYYLEPTILFGKNNMRVFQEEIFGPVLAVTTFKTMEKALEIANDTQYGLGAGVWSRNGNLAYKMGRGIQAGRVWTNCYHAYPAHAAFGGYKQSGIGRETHKMMLEHYQQTKCLLVSYSDKPLGLF

SEQ ID NO: 54566 - protein, 356 aa, Coffea canephora
MDLINSVLNLVVPPASLLMLAFAWPTLSFINACEWLYNTYFSEEMDNKVVVITGASSGIGEQIAYEYAKRGANLVLVARRDNRLHGIADNAQRLGSRHVLIMAADVVKEEDCRRFINETINYFGCVDHLVNTASLGHTFFFEEATDASVFPILLDINFWGNVYPTYVALPYLRQTNGRIVVNASIENWLPLPRMSLYSAAKAALINFYETLRFEVKDEVGITIATHGWIGTEMTRGRFMVEEGAEMQWKEEREVQVTGGPAEDFAKLIVAGACRQAAYVKYPSWYDIFFVFRVFSPNVLYWTFHLLSTSHVSRRTSFIGTGRPLLEGSPPRKLLTGASPGTSSQSQAPVYQQQKVE

SEQ ID NO: 54567 - protein, 448 aa, Pseudomonas syringae pv. syringae B728a
MNMFEVSDVPVTRQLKLDAHWMPYTANRNFQRDPRMVVAAHGSYLTDDKGRKIYDALSGLWTCGAGHTRKEIQEAVSRQLGVLDYSPGFQFGHPLSFQLAEQITDLTPGNLNHVFYTNSGSECADTAVKMVRAYWRLKGQATKTKMIGRARGYHGVNVAGTSLGGVNGNRKMFGQLMDVDHLPHTLLASNAYSKGMPEAGGIALADEMLKLIELHDASNIAAVIVEPMSGSAGVIVPPQGYLKRLREICDQHNILLIFDEVITGFGRTGSMFGADSFGVTPDLMCIAKQITNGAIPMGAVIASSEIYHTFMNQPTPEYAVEFPHGYTYSAHPVACAAGLAALELLQRENLVQQAAAVAPHFERALHGIKGAKNVVDIRNYGLAGAIQLAPRDGDAIVRPFEAGMKLWKAGFYVRFGGDTLQFGPTFNSQAQDLDRLFDAVGETLNLID

SEQ ID NO: 54568 - protein, 164 aa, Pectobacterium carotovorum subsp. carotovorum
SLGFDNFEKLLSGAHAMDKHFASTPAEKNLPVLLALIGIWYNNFFGAETEAILPYDQYMHRFSAYFQQGNMESNGKSADRNGNPVDYQTGPIIWGEPGTNGQHAFYQLIHQGTKLVPCDFIAPAVSHNPLSDHHSKLLSNFFAQTEALAFGKSRDVVEAEFAAA

SEQ ID NO: 54569 - protein, 184 aa, Synechococcus sp. WH 7805
MIPGLEPVALKELLALGQPREWDVDGIHDELSSLTPIRGRVCAEHRGNVLEVEGSLQTIICVCCDRCLGNFNQQLTVNTRELIWLGAEPSEATIGDADHNSDSAEGLMESLDPRGCFEPERWVFEQLSLQMSVVNRCGDHCPGPPVQPSAAAPPSATTSFKDPRWQALRDLQASMESTPDRQHD

SEQ ID NO: 54570 - protein, 497 aa, Pseudomonas syringae pv. syringae B728a
MSSIQHLIHGEFVSAEGRSANVFNPSTGQVIHTVALADRETVQKAIDSAKAAFPAWRNTPPAKRAQVMFRFKQLLEQNEARIAQLISEEHGKTLEDAAGELKRGIENVEYACAAPEVLKGEYSRNVGPNIDAWSDFQPLGIVAGITPFNFPAMVPLWMYPLAIACGNCFILKPSERDPSSTLLIAELLHEAGLPKGVLNVVHGDKVAVDALIEAPEVKALSFVGSTPIAEYIYKEGAARGKRVQALGGAKNHAVLMPDADLDNAVSALMGAAYGSCGERCMAISVAVCVGDQIADALVAKLVPQIQSLKIGAGTTCGLDMGPLVTGQHRDKVGGYIEDGVQAGATLVVDGRNLQVAGHERGFFMGGCLFDRVTPEMRIYKEEIFGPVLCIVRVDSLEQAMQLINDHEYGNGTCIFTRDGEAARLFCDEIEVGMVGVNVPLPVPVAYHSFGGWKRSLFGDLHAYGPDGVRFYTRRKAITQRWPQRASHEASQFAFPSL

SEQ ID NO: 54571 - protein, 476 aa, Triticum aestivum
  misc_feature (412)..(412): Xaa can be any naturally occurring amino acid
  misc_feature (430)..(430): Xaa can be any naturally occurring amino acid
  misc_feature (448)..(448): Xaa can be any naturally occurring amino acid
MAMTSPNSRALERYKSAVTTATSVLGAAMLLRRVLADVLPGTALGALLLLPPASARRHAVLIEEFDGALHNRVFLAAKAYVSTLLAAAPSVPLMKASLPRGAGAEHVLLALRPGTAVVDVFDGAKVTWRLSRKHDGGAGRRRTTEDAREVFKLSFDAEHKDMVLGSYLPAVMARVEAMSQEQRQTKLYSNEWGKWRTVRLRNASTFATVAMDDALRQAVVDDLDRFLTRKEYYRQTGRAWKRGYLIHGPPGTGKSSLVAAISNHLHFDVYDLDVGSVRSNTELRKLLIRMKNRSILLVEDVDCALATAPRREATGSSDGGNPVSKNHKVTLSGLLNMVDGLWSSSGHERILIFTTNHKDRLDPALLRPGRMDMHVHMGYCGFVAFRELAANYHGIQDHPLYPEVEALLREVXEVAPAEVAERLLMTDDAXPAVEMAAKLLRDRKAGTXEDGGYIKQNLHVGPKRPRRPPAARRGGA

SEQ ID NO: 54572 - protein, 246 aa, Staphylococcus aureus subsp. aureus Mu50
MKMTKSALVTGASRGIGRSIALQLAEEGYNVAVNYAGSKEKAEAVVEEIKAKGVDSFAIQANVADADEVKAMIKEVVSQFGSLDVLVNNAGITRDNLLMRMKEQEWDDVIDTNLKGVFNCIQKATPQMLRQRSGAIINLSSVVGAVGNPGQANYVATKAGVIGLTKSAARELASRGITVNAVAPGFIVSDMTDALSDELKEQMLTQIPLARFGQDTDIANTVAFLASDKAKYITGQTIHVNGGMYM

SEQ ID NO: 54573 - protein, 324 aa, Oryza sativa Japonica Group
MEKAAGFLSSLLGGGEEVPPEPAATVRSILIYPIKSCRGISVPQAPITSTGFRWDRQWVVVNSKGRAYTQRVEPKLALVEVEMPPEAFAEEWRPTADSYLVGRAPGMDPLKIPLSAEQAIINDVSVWEWSGSAYDEGAEAAEWFSSYFGNPSRLVRFKEGSEIRPTNPDYAQGYKIMFTDCFPFLMASQGSLDALNEVLKEPVPMNRFRPNILVDGCHPYSEDLWKTIKINKLTFQGVKLCNRCKVPTINQENGILGTEPTETLLTFRSDEVLRPSHKNKRQVYFGQNLVCKESLSAKGKGRIIKVSDPVYVLERFPSSDEAPA

SEQ ID NO: 54574 - protein, 77 aa, Staphylococcus aureus subsp. aureus Mu50
MENFDKVKDIIVDRLGVDADKVTEDASFKDDLGADSLDIAELVMELEDEFGTEIPDEEAEKINTVGDAVKFINSLEK

SEQ ID NO: 54575 - protein, 671 aa, Ostreococcus tauri
MALLTLVHVARARAWTTAVVGSVNVDVIARVGMIPREGDTVVTRTASTTTAMGGKGANQAIAASRMTCEDGGRDWRGVGFVGRFGADAAGDATREAMAREVDLEYSARSAIGSATGLGFVMVANDGGTSAVVVPGANALDWNDDDAALEDEFRDALRGTATLMLQREIPHRVNVIAAKIGREMGAHTIVLDAGGSHEVVDGDLLALVDYVAPNESELAGMAGVDVDTLSSEEAVLCTLGARGSLLVSASGVARGAPSRLPDGAREVDATAAGDAFRAAFAVAMGEGKNETQALRFAGAAGALAVTKMGAMPSLPTRREVDALLGEESRCADRASTSTSSTIEDELAAQHFASRLNSMKSRLDLFLDRNESAPEVFNLVKRMGRARGISHVFFNYPEHFITKTGEEIEPEILRRKVLEQSLRIGAVCVRFPEEPYRLGAFTNPDPAVRRLAEGLVRRSCETAVALDANEVIIWPRYDGYDYYLQADYASAWDVMVQSYKIVASSAECASLKVSVEFKPTDEKSRFSFIPSTGAALLLVDAVGEPNFGLTIDVGHALAAGENPAQSIVMTASRGRLFGVQLGDGHSRLGAEDGLMFGSVHTNAALEIVSALRAHGYAGFLYFDTFPLNEDPVEEASRNVRTFRDFHKKVAASASALADAAARRDALRAADAFA

SEQ ID NO: 54576 - protein, 385 aa, Kluyveromyces lactis NRRL Y-1140
MEVYVRMNDDLEYDYAFQVQKDDTLEQKIALIFNKEKGLSRFMVLKPSIFYKNEPSGFRKSMHPGFLTENGCLLFDYSADDSEYLEDLEVSKKTVWEQLWPGQLVLPKWEKDWKTIWTFVTIMLVWLYTDLPDCISPTPGICLTNQLSKRFASLADNAGLTFVAEKLREELEINSVSVTAQWLFFVFHIVKIVILSSFFYTGLVNPVSFNPLRSLLNKKSAISNGNSELKSTLQTIGWVGARRAIYDDYRDKYYQYVIDKSGGPLHAYRKGIMKQAANPGVTLSAGEGFQTELSNRFNHNTFETMKSSGKFKLSEDYFLQLETDLKENIKACDGDVAKINAEIRNFRKYGLFECGPELTELVQLRKKVDAAPETEPLPEQEKKEQ

SEQ ID NO: 54577 - protein, 387 aa, Escherichia coli K12
MSVIKMTDLDLAGKRVFIRADLNVPVKDGKVTSDARIRASLPTIELALKQGAKVMVTSHLGRPTEGEYNEEFSLLPVVNYLKDKLSNPVRLVKDYLDGVDVAEGELVVLENVRFNKGEKKDDETLSKKYAALCDVFVMDAFGTAHRAQASTHGIGKFADVACAGPLLAAELDALGKALKEPARPMVAIVGGSKVSTKLTVLDSLSKIADQLIVGGGIANTFIAAQGHDVGKSLYEADLVDEAKRLLTTCNIPVPSDVRVATEFSETAPATLKSVNDVKADEQILDIGDASAQELAEILKNAKTILWNGPVGVFEFPNFRKGTEIVANAIADSEAFSIAGGGDTLAAIDLFGIADKISYISTGGGAFLEFVEGKVLPAVAMLEERAKK

SEQ ID NO: 54578 - protein, 540 aa, Campylobacter coli RM2228
MDNFLEIFLITAALAIVLNVIFKKFEIPTIIGYIAAGEIISKIYHLSGKGEITHIAEFGIVFLMFTIGLEFSFKHLIAMKQEVFLNGSLQMLTCGFVFMLLAIEILGLGDKSATIVGFALALSSTAVVLKILNDNGDINEQYGRKALGILLFQDIAVIPLLLLVDIFSSNNQNIGQLLLTTLLSAVILIALLFFIGKYLVDRIFRLIIRASSQEIFISTILFMVIGASFLANYFGFSYSLGAFIAGALIAETKYKHKIEADLIPFRDLLLGLFFITVGMQIQLHIVAQNWFIICVLTLLIMGLKFGIVCGFLFLYTKKRVALKTAFSIAQVGEFALAIFSLLQAKSMLDVETAQILIVVSIVTMIITPFVLNNIRKIANVVEDMTLNTNVVQQSTHSTLKNHLVIFGYGRLGQEIVQKIKNTGVPYLVLESDLNLVELGISRGENVVFANAAQEETLKIANITECAVAIVTITNEAKLEMICQVLASYPKPIDTIIHVNGSLEKMLFSSIDENIRIVRSEKVIARNLVQEALECRIHKNT

SEQ ID NO: 54579 - protein, 164 aa, Pectobacterium carotovorum subsp. odoriferum
SLGFDNFEKLLSGAHAMDKHFASTPAEKNLPVLLALIGIWYNNFFGAETEAILPYDQYMHRFAAYFQQGNMESNGKSADRNGNPVDYQTGPIIWGEPGTNGQHAFYQLIHQGTKLVPCDFIAPAVSHNPLSDHHSKLLSNFFAQTEALAFGKSRDVVEAEFAAV

SEQ ID NO: 54580 - protein, 490 aa, Physcomitrella patens subsp. patens
MAKLDEDGCEQRNAPVYGVFIHPKAEVVLYRTQVSVSLASQSGREKVGLGSVSGEAGQEVGGAMAGLLAWAADVVVGNGSESADRTLHFTPQQRQAVSALDARAAALQHSLQLLRQRMPPSNIAQRLPHLHADSLASHSALALEKHAHSATLNQLQAREASLQAENENYAKALAARQQHAREKAQETLQLAATLEEIEATEVKLRADLERLQKAVALRDGLASSAVSTDKKGLQDDSKRSDFSAIQDVSTLEEQELQSIKLELDSRCICAKFTTITVMVFIRRSLSLVADALECLGSVCVCNVDRVSRLGSARWEGKVIRLEKEWEALQHNTSRTPSPAQREKELERRLRTLTEQLVTKQAQAESLANERNALELRLVQANEARQNLLSGNGDLDFKRNKIGRSSSGLSSQTATLALEIASQRSAVIRQRGAKVTENVARVARTVDAFSMHAGSQLRRSMLMRTLTVCYVLGLHVVVLLILSSVGLGRLH

SEQ ID NO: 54581 - protein, 161 aa, Brassica napus
MEVERAKKDDDLNSADGGGGSAEEISVERIFEESADAPPPWQNQLTFRAMIVSFILSILFTFVVMKLNLTTGIIPSLNISAGLLSFFFVKTWTKILNKAGILKQPFTRQENTVIQTCVVASSGIAFSGGFGSYLFGMSEVVAKQSPEANTPLNIKNPHLGR

SEQ ID NO: 54582 - protein, 192 aa, Bacillus halodurans C-125
MNVPNKITLSRIGLIPLFMLFLLAPIPLGTAVLFGVEIPVSHLVALFLFVLAAATDWLDGYYARKWKLVTNFGKFLDPLADKLLVTAALVGLVEIGTIPAWMAIIIISREFAVTGIRLVAASDGAVIAASKLGKWKTVSQIVAIIACLLYNVPFAAVGFPFMIIALWVATILTIVSGVDYFLKNKEFLLKSK

SEQ ID NO: 54583 - protein, 170 aa, Kineococcus radiotolerans SRS30216
MSQHTLSVLVENRPGVLMRVTSLFARRNFNIHSLTVGPTERSDISRMTIVVDVESQPLEQVTKQLNKLINVLKIVELEDGASVQRELLLVKVRADASARGEVLDTVALFRAHVVDVAPDAVTVEATGSPDKLAALLRVLEPFGIRELVQSGSVALARGGRAISDRALRSA

SEQ ID NO: 54584 - protein, 459 aa, Zea mays
MAPANVRAAQAQAPSADRRLSTLVGHLLPSSPRRAAADTSATSTLESFPTMASQGSSVFAALEQAPEDPILGVTVGYNKDPSPVKVNLGVGAYRTEEGKPLVLNVVRRAEQMLINNPSRVKEYLPITGLAEFNKLSAKLIFGADSPAIQENRVATVQCLSGTGSLRVGGEFLARHYHERTIYIPQPTWGNHPKVFTLSGLNVRSYRYYDPATCSLHFEGLLEDLGSAPSGSIVLLHACAHNPTGVDPTIEQWEQIRQLMRSKSLLPFFDSAYQGFASGSLDKDAQSVRMFVADGGELLMAQSYAKNMGLYGERVGALSIVCKSADVAVRVESQLKLVIRPMYSNPPLHGASIVATILRDSEMFNEWTLELKAMADRIINMRQQLFNALKSRGTPGDWSHIIKQIGMFTFTGLNSEQVAFMRQEYHIYMTSDGRISMAGLSMRTVPHLADAIHAAVTQLK

SEQ ID NO: 54585 - protein, 518 aa, Oryza sativa Japonica Group
MAAAAATSPARAAAWTFAAATCVKLLLVPTYRSTDFDVHRYWLALTHALPARRWYTDASSQWTLDYPPFFAYFSRLLALPAPLVDASLVSLPVPDAPPSFAYLLYLRLTVAFSDLLLLLSSVLLLATDALTRRRRRPFLSLALVLWSPALLAVDHVHFQYNGFLMGLLLLSLHFLEQGRDLAGGVVFAALLCSKHLFLVAAPVYFVYLFRHYCCGRGVVRGLGRLVLMGAGVAAVFAAAFVPFLYYGQMQQLFNRLFPFGRGLCHAYWAPNFWVFYILLDKIFAFLLRRLGFNIQIPEASFTGGLVGNSSPFAVLPKVTPITTFLLVILAMSPCLMKAFSKPQPRHIIRWVSYATTCGFMFGWHVHEKASLHFTIPLALIAMDSLEDAKHYFVLSIVSCYSLFPLLFENQEYPIKVMLLLTYATLMWVGFSSHFAAKSPQEGKKVNESGSVVRKNSFIGWISFSYLLGIVAIELWSQVFHHYVFGSRFPFLPLIMVSLYCGVGMMYSWMWQLAWIVRH

SEQ ID NO: 54586 - protein, 246 aa, Flavobacteria bacterium BBFL7
MKSNGLFFILVLFLTISCKDSSQKETPVIDIVEETRTKEEVLIERKEKGIAKFYKRSVNRKGDTLLPYIPQDSVEVFFTRYGKEHPETIVRMTTSFGDIEMELFKETPLYRASFLFLINNGYFDETVVHRAVKGFIVQAGNSDNMITAQKKGSAGNYQLPMQILPGVQHSYGTLSSAKYWENNPENWHNPFDFFISLRATDHLDGEHTIFGRVIKGMKVAEAISKVETDSRDWPKNDIYIEMSVVN

SEQ ID NO: 54587 - protein, 179 aa, Thermoplasma acidophilum DSM 1728
MESFYHSVPVGPKPPEEVYVIVEIPRGSRVKYEIAKDFPGMLVDRVLYSSVVYPVDYGLIPRTLYYDGDPMDVMVLISQPTFPGAIMKVRPIGMMKMVDQGETDNKILAVFDKDPNVSYIKDLKDVNAHLLDEIANFFSTYKILEKKETKVLGWEGKEAALKEIEVSIKMYEEKYGKKN

SEQ ID NO: 54588 - protein, 366 aa, Bacillus anthracis str. Ames
MGLTAGIVGLPNVGKSTLFNAITQAGAESANYPFCTIDPNVGIVEVPDERLNKLTELVEPKKTVPTVFEFTDIAGIVKGASKGEGLGNKFLSHIRQVDAICQVVRCFEDENITHVSGKVDPIDDIETINLELILADLESVDKRIERVAKLARQKDKEAVYEHEILVRLKEAFEEGKPARTVEFTEEQMKIVKGLHLLTTKEMLYVANVSEDDVIDPSENKYVQMVKEFAANENSQVIVVCAKIESEIAELDEEEKKVFLEELGIEESGLDQLIRAAYDLLGLATYFTAGVQEVRAWTFKQGMKAPQCAGVIHTDFERGFIRAETVSYEDLMTNGSMTAAKEAGKVRLEGKEYIVKDGDVMHFRFNV

SEQ ID NO: 54589 - protein, 473 aa, Prochlorococcus marinus str. MIT 9312
MSKSPQDVLSQIKDEGIELIDLKFTDIHGKWQHLTLTSDMIEEDSFTEGLAFDGSSIRGWKAINASDMSMVPDSSTAWIDPFYKHKTLSMICSIQEPRSGEPYDRCPRALAQKALKYLDSTGIADTAFFGPEPEFFLFDDVRYDSKEGGCFYSVDTIEAPWNTGRIEEGGNLGYKIQYKEGYFPVAPNDTAQDIRSEMLLLMGELGIPTEKHHHEVAGAGQHELGMKFDSLIKAADNVMTYKYVVRNVAKKYGKTATFMPKPVFNDNGTGMHVHQSLWKSGQPLFFGESAYANLSQTARWYIGGILKHAPSFLAFTNPTTNSYKRLVPGFEAPVNLVYSEGNRSAAVRIPLTGPSPKAKRLEFRSGDALANPYLAFSVMMLAGIDGIKNQIDPGDGVDVDLFELPAEELAKIDTVPSSLNDSLNALKADKDYLLAGGVFTEDFIDNFIDIKYEEVQQLRQRPHPHEFFMYYDA

SEQ ID NO: 54590 - protein, 394 aa, Prochlorococcus marinus str. MIT 9312
MTEAKLISALNEENLSHFSKTYVPSRLLLGPGPSNAHPEVLNALSLNPIGHLDEAYISLMSDVQKLLRYTWQCNNRLTLPMSGTGSAAMEASIANFIEEGETILIAKKGYFGDRLVDMATRYKAEVSVMEKPWGESFSYEEIKYEIETKKPAIFAIVHAETSSGVLQPLDGIGDVCRKNNSLFLVDAVTSLGALELLIDEWKIDLAYSCSQKGLSCPPGLSPFTMNERAEEKLSSRKTKVPNWYLDLSLLNKYWGSDRVYHHTAPVNMNFAIREGLRLIANEGLENVWNRHNTNARKLWNGLESLGMELHVSKDYRLPTLTTVKIPPAVDGDGFRNHLLRNFGIEIGNGLGELSGKVWRIGLMGFNSSEENVDRLLNLFDTELKKYSIFESSTF

SEQ ID NO: 54591 - protein, 410 aa, Yarrowia lipolytica CLIB122
MSENQPLLGAPTRGPLKTHVIGPSASSNASSSATARKRPPVDQSTPPQLNHRIGPQRTSRTTQKLKLLPEEPDRDDDDESGREVYSQVTRIKDPPARKDAERLGKAHRDLLPRVTAYCTASSYRMRDITKYLQSRKHRRAHPKLFDECLYTPYSYRDQEISAQEDFIRIDDEGGDIDVVITRTDVFLFEYGVVVLWGFTEAEEKRFLKELARFETEKLADEDVQVEEFNYYITQSYQPRIYNDFITLRDGRNYMMKLSISHAIAQSAKISLFEELVENTIEDTQDFPQEIAVTGKIDMDRSDIIKSIGELFILRININLHGSILDSPELMWAEPHLEPIYQATRGYLEINQRVSLLNNRLEVISDLLSMLKEQLGHSHGEYLEFIVIVLIAVEVVVAILNVIVDLTAENL

SEQ ID NO: 54592 - protein, 449 aa, Streptococcus agalactiae A909
MSKQYDYIVIGGGSAGSGTANRAAMYGAKVLLIEGGQVGGTCVNLGCVPKKIMWYGAQVSETLHKYSSGYGFEANNLSFNFTTLKANRDAYVQRSRQSYAANFERNGVEKIDGFARFIDNHTIEVNGQQYKAPHITIATGGHPLYPDIIGSELGETSDDFFGWETLPNSILIVGAGYIAAELAGVVNELGVETHLAFRKDHILRGFDDMVTSEVMAEMEKSGISLHANHVPKSLKRDEGGKLIFEAENGKTLVVDRVIWAIGRGPNVDMGLENTDIVLNDKGYIKTDEFENTSVDGVYAIGDVNGKIALTPVAIAAGRRLSERLFNHKDNEKLDYHNVPSVIFTHPVIGTVGLSEAAAIEQFGEDNIKVYTSTFTSMYTAVTTNRQAVKMKLVTLGKEEKVIGLHGVGYGIDEMIQGFSVAIKMGATKADFDDTVAIHPTGSEEFVTMR

SEQ ID NO: 54593 - protein, 355 aa, Prochlorococcus marinus subsp. marinus str. CCMP1375
MALSYYKEELKKTASSLATSGKGILAVDESTKTIGKRLASINVENTEENRKAYRGLLFTTEGLGEYISGAILFEETLFQAHPDGEPMVKKLEKLGVIPGIKVDKGLRPLAGGNDVETFCSGLDGLVERSSDYYAQGARFAKWRAVLQITNNGSPSKLSIKENAWGLARYARSVQESGLVPIIEPEILMDGSHSINKTAEVQEEVIKEVYMACQLNGVFLEGTLLKPSMTVQGADCKDKADPQKISELTIRTMERCVPASVPGIVFLSGGLSEEAASIYLNLMNKQPRKANWNVGFSYGRALQHSCLKEWGGKNLEAGQKALLARAQANSEASKGIYVAGSQPSSDEALFVAGYKY

SEQ ID NO: 54594 - protein, 539 aa, Flavobacteria bacterium BBFL7
MLSVSNLSVQFGKRVLFDDVNAKFGGSNCYGIIGANGAGKSTFLKILTGQMEPTSGHVSLESGKRMSVLEQNHNAYDESTVLDTVLQGNKPLYKLKKEIDALYADYTDENAEKIGELQVQFEEMDGWNADSAAASLLSNLGIGEEYHYTLMGDMDNKLKVRVLLTQALFGTPDVLIMDEPTNDLDYETISWLEHFLANYENTVIVVSHDRHFLDAVCTHIADIDFGKVNQYSGNYTFWYESSQLAARQKAQANKKAEEKKKELQEFIARFSANVAKSKQATSRKKMIDKLNIEEIKPSSRRYPAIIFEREREAGDQILNVEKLAASIDGEVLFKNVDINLAKGDKVVVFSRDSRATTAFYEIINDKMKADSGTFNWGITTLQSYLPVDNAEFFDVDLNLVDWLRQYAQTEEEREEVHLRGFLGKMIFSGEEALKSAKVLSGGEKVRCMLSRMMMKRANVLIVDEPTNHLDLESIQALNNSLKNFKGTVMLTTHDHEFAQTVGNRVIELTPNGVIDRYTTFEEYMDDKAIRELRNKMYNS

SEQ ID NO: 54595 - protein, 190 aa, Brassica napus
MFAAENGLKGDPRLEAISAAIRVVPDFPKKGIMFQDITTLLLDHKAFKHTIDIFVDRYKDMHISLVAGVEARGFMFGPSTALAIGAKFVPLRKPGKLPGKVISESYELEYGHDRLEMHVGAVEPRERVIIIDDLVATGGTLSAAISLMESQGAEVVECACLIGLPEVKGQHKLEGKPLYVLVAPSGLMNL

SEQ ID NO: 54596 - protein, 429 aa, Bordetella pertussis Tohama I
MSQAPAHSLPSYLDAEHLGPWGIYLQQVDRVTPYLGPLARWVETLKRPKRALIVDVPIEMDNGSIAHFEGYRVQHNTSRGPGKGGVRFHQDVTLSEVMALAAWMSIKNAAVNLPYGGAKGGVRVDPRTLSHSELERMTRRYTSEIGVIIGPSKDIPAPDVNTNAQTMAWMMDTYSMNEGATATGVVTGKPIALGGSLGRVEATGRGVFVVGCEAARDLNLDVSKARIVVQGFGNVGGTAARLFHEAGAKVIAVQDHTGTIHNDGGLDVHKLLAHVGNQGGVAGFTGAQQLADDDFWGLETDFLIPAALEGQINENNAARVRAKVVVEGANGPTTPEADDILRENGVYVVPDVLANAGGVTVSYFEWVQDFSSFFWSEEEINQRLERLMREAYSAVSQVAKEHKVTLRTAAFIVACTRILQARQVRGLYP

SEQ ID NO: 54597 - protein, 181 aa, Vibrio campbellii AND4
MTTETISLIKSSIKSIQDYPKPGILFRDVTSLLEDANAYQATINLLVERYKDMGFTKVVGTEARGFLFGAPLALELGVGFVPVRKPGKLPRPTIAQSYELEYGVDTLEIHTDAIVAGDKVLVVDDLLATGGTIEATTKLIRQLGGEVEHAAFVINLPEIGGDKRLESLGLNVYSICDFEGN

SEQ ID NO: 54598 - protein, 730 aa, Vibrio campbellii AND4
MSYLALARKWRPSKFDQVVGQSHVLTALENALAQNRLHHAYLFSGTRGVGKTSIGRLFAKGLNCETGITANPCGKCDTCREIDEGRFVDLLEIDAASRTKVEDTRELLDNVQYKPARGRFKVYLIDEVHMLSRHSFNALLKTLEEPPEYVKFLLATTDPQKLPVTILSRCLQFHLKPISVDVIHQQLDHILAKEQVSAEARALGMISHAADGSMRDALSLTDQAIALGNGTIQTDIVSHMLGTIDTDQAIHLLESISSKQPQLAMDKIKQLASNGVEWDGLLQQLASQLHRVAIYQALPSTLDLAKPDAEKIELLSKALTPQDVQLYYQIALKGREDLALSPNGRVGMEMIVLRMMAFRLSESQGANVISPSSQPQVASTTSTSQSKAVSQQQPSQQQASSPRQQSTFQAPDPQRPTPSVSQQAASQPVGQSATYNPAIMHEAPQYQPEHQDGYDMAPPQYDMAPPMSENPAPTQQAPQPSQSQEGAPAPARSSLSGLRHQLRSQRQGQQQSAAAPNGGPKKSNATSAQKESVIDRLAQLHGNSAQVSPKSAPQAEKQAPEDQAYRWRPTKPVEKKANTQLTPTQLKQALEHKKTPEMAQKLIDESLEKNEWANIISKMNMPKLVEQLALNSHFHKEGSTVSLQLRGSQAHLSTDRAQSELLSALNEVLGQECHLSIGVGENGETPLELRDRLYQEKLQQALNCLESDPHVQFIERRFAAELDKDSVRPI

SEQ ID NO: 54599 - protein, 450 aa, Silicibacter pomeroyi DSS-3
MIPPKPPARPDKVSLWRYLRLFRQDLLSAQPARLYRAWMAEFRTPFFRSYLVNQPDLVDTVLKGRPDDFPKSNRISEGLRPLLGNSVFLTNGETWKRQRRIIDPAFEGGRLRDTFPAMWAASEAAVNRLAAQAGQETEIEEVTSHAAADVIFRTLFSIPIEHEVAAQVFTRFRAYQRAQPLLNLAAFVPVPQWVPRFHSRETRRNAAVIRGLIRQLTDTRMGEIRAGTAPDDLATKIMTTTDPQTGDRFDTDEMVDQVAIFFLAGHETSASALAWTLYLMALYPDWQEKLAEEARTLDSGTDFSVMSKLRLSRDVFREALRLYPPVPMMVRETTCPERFRDRDVPKGAQIVLSPWHLHRHERLWERPDDFDPARWQTENGKTCQRNAYMPFSAGSRVCTGAGFAMVEGPLILSMLLLRFRFERIAGREPVPVAHLTVRAADGIWLRVVER

SEQ ID NO: 54600 - protein, 528 aa, Magnaporthe grisea 70-15
MATALDHLYIGGRINWLAQLNTAAQPDKNYRRSSIICTIGPKTNSVEAMNDLRKAGMNVVRMNFSHGSYEYHQSVIDNAREAEKQMPGRQLAIALDTKGPEIRTGNTKNDEDLPISAGKELNFTTDEQYATSCDTDNVYVDYKNITKVIEKGRIIYVDDGVLAFEVLDVIDEKTVRVRARNNGFICSKKGVNLPNTDVDLPALSEKDKADLRFGVKNNVDMVFASFIRRGQDIKDIREVLGQDGAHIQIIAKIENRQGLNNFPEILKETDGVMVARGDLGIEIPAAEVFAAQKKMIALCNMAGKPVICATQMLESMIKNPRPTRAEISDVGNAVTDGSDCVMLSGETAKGSYPCEAVREMSDACLKAENTIPYVSHFEEMCGAVHRPVSIVESCAMAAVRASLDINAGGIIVLSTSGVSARLLSKYRPVCPIFMVTRNASASRYSHLYRGVYPFLFPEAKPDFSKVNWQEDVDRRIKWGVKHALDLGVLEKNDSIVVVQGWKGGMGNTNTIRVLKADTESLGIGQADI

SEQ ID NO: 54601 - protein, 322 aa, Kluyveromyces lactis NRRL Y-1140
MNLYSYSRIIKFPGHNALVLKRLFHRPYQFKSVPDDIKNNLVTECECFVKRLNEKLPDKSQLDISLTLPNKVPEYHKHVLMLSKDPKGWKNWPSKLEMAHEYPHSMVGTLKSSLKDTRDGSGVLVNELALDGYTSSETHLKFLVIPDMKVYEVHRDRVSDFALFLGDGKQDSRKKLSFNDFLKGSDAVGQTAIHSSGSVANSIPNFQSEPFHSDIAMVCGHYLRDARCGELAPLLIAKLNSIKPNLKTGIVSHFGGHKFAGNLIYYQFNGLKIHNDNETGKIDGLWLSKLLPQNLEFVFRHLDKDIILQDFYRGHMSTAAYT

SEQ ID NO: 54602 - protein, 508 aa, Pseudomonas syringae pv. syringae B728a
MNASLNHTTTSIARVKLLINGEWTDSQSSEWQDIVNPATQEILAQVPFATASEVDAAVAAAHAAYRTWRETPIGVRMRIMLKLQALIREHSKRIAAVLSAEQGKTLADAEGDIFRGLEVVEHACSIGTLQMGEFAENVASGVDTYTLRQPIGVCAGITPFNFPAMIPLWMFPMAIACGNTFVLKPSEQDPLSTLLLVELAIEAGVPPGVLNVVHGGKEVVDAICTHKDIKAVSFVGSTAVGTHVYDLAGRHGKRVQAMMGAKNHAVVLPDANREQTLNALVGAGFGAAGQRCMATSVVVLVGASKQWLSDLKARAQKLKVNAGQEPGTDIGPVISRRAKQRILDLIESGVREGATLELDGREVSVPGYEGGNFVGPTLFSGVTTDMQIYTQEIFGPVLVVLEVDTLDEAIALVNANPFGNGTGLFTQSGAAARKFQSEIDVGQVGINIPIPVPAPFFSFTGSRGSKLGDLGPYGKQVVQFYTQTKTVTSRWFDDDSVNDGVNTTINLR

SEQ ID NO: 54603 - protein, 453 aa, Synechocystis sp. PCC 6803
MRVCVIGTGYVGLVTGVCLAHIGHQVICVDNNEEKVKLMRAGQSPIYEPGLSELMVANMESGRLVFTTDLGKGVQESAILFIAVGTPALEDGSSDTRYVEAVARSIGEHLDEQYRVIVNKSTVPIGSGDWVRMIVTEGNEAHQQQTGQAIAVNFDVVSNPEFLREGSAVYDTFNPDRIVLGGNNPQALALMRELYTPLIERRVGENPELPPVPVVMTDLSSAEMIKYAANAFLATKISFINEVANICDRVGADVTQVAQGIGLDSRIGSKFLNAGIGWGGSCFPKDVSALIHTAKDYGYTTSILNAVVEVNQVQRLIVVEKLQQELKILKGKVIGLLGLTFKPDTDDMRDAPALNIIQQLNRLGAKVKAYDPIVSQSGVSHGLSGVKIESTPAMLADQCDALILVTEWQEFLKLDFPVLASRMHQAVIIDGRNFLDKEKLQGAGFRYLGVGRS

SEQ ID NO: 54604 - protein, 575 aa, Pseudomonas syringae pv. syringae B728a
MKFEPLARSLIATALIVAYSPTFAASQAPVAAENGMVVTAQHLATHVGVDVLKAGGNAVDAAVAVGYALAVVYPAAGNLGGGGFMTIQLADGRKTFLDFREKAPLAATANMYLDKDGKVIPDLSAKGHLAVGVPGTVSGMEMALSKYGTRKREEVIAPAIKLAEDGFVLGQGDVDMLSSATDVFKADMADSGSIFLDKGEPMQVGQKLVQKDLAKTLKEVSEKGSDGFYKGWVAKALVDSSQAGKGIITQADLDHYKTRELAPVECDYRGYHVVSAPPPSSGGVVICQILNILEGYPMKELGFRSAQGMHYQIEAMRHAYADRNSYLGDPDFVKNPVEHLLDVKYAAKLRAAIDPQKAGDSNKIKPGVAPHEGSNTTHYSIVDKWGNAVSVTYTLNNWFGAGVMASKTGVILNDEMDDFTVKVGVPNMYGLVQGEANAIAPGKTPLSSMSPTIVTKDGKAVMVVGTPGGSRIITATLLTMLNVIDYGMNIQEAVDAPRFHQQWQPEETNIDTFAVSPDTLKILQSWGQKFAGPQPLNHVAAILVGAPSLGGKPVGNNRFYGANDPRRNTGLSLGY

SEQ ID NO: 54605 - protein, 121 aa, Clostridium perfringens
MTKEQIIEAIKEMSVLELNELVKACEEEFGVSAAAPVAVVGGAAAGATAEEKSEFDVVLTNAGANKIKVIKAVRELTGLGLKEAKEIVDGAPKTLKEAVAKEEAEDMKAKLAEVGAEVELK

SEQ ID NO: 54606 - protein, 388 aa, Staphylococcus aureus subsp. aureus Mu50
MNIHEYQGKEIFRSMGVAVPEGRVAFTAEEAVEKAKELNSDVYVVKAQIHAGGRGKAGGVKIAKSLSEVETYAKELLGKTLVTHQTGPEGKEIKRLYIEEGCAIQKEYYVGFVIDRATDQVTLMASEEGGTEIEEVAAKTPEKIFKETIDPVIGLSPFQARRIAFNINIPKESVNKAAKFLLALYNVFIEKDCSIVEINPLVTTADGDVLALDAKINFDDNALFRHKDVVELRDLEEEDPKEIEASKHDLSYIALDGDIGCMVNGAGLAMATMDTINHFGGNPANFLDAGGSATREKVTEAFKIILGDENVKGIFVNIFGGIMKCDVIAEGIVEAVKEVDLTLPLVVRLEGTNVELGKKILKDSGLAIEPAATMAEGAQKIVKLVKEA

SEQ ID NO: 54607 - protein, 164 aa, Yersinia pestis
SVGFEHFEQLLSGAHAMDKHFAETPAEKNLPVLLALIGIWYNNFFGAETEAILPYDQYMHRFPAYFQQGNMESNGKYVDRNGHPVDYQTGPIIWGEPGTNGQHAFYQLIHQGTKLIPCDFIAPAISHNPLSDHHAKLLSNFFAQTEALAFGKSLEDVEAEFAAA

SEQ ID NO: 54608 - protein, 148 aa, Zea mays
  misc_feature (49)..(49): Xaa can be any naturally occurring amino acid
FTREIITTNTLGLMICCREAINMMRNQPRGGHIFNLDGAGSDGRPTPRXELQMNEVNNVMVHNLSPGMVTTDLLMSGATTKQAKFFINILAEPPDVVADYLVPNVREIPTKQSMKPTYIRFLTGLKAYSRIFSRLAFGARRNKYVTED

SEQ ID NO: 54609 - protein, 506 aa, Pseudomonas putida
MRYAHPGTEGAKVSFKSRYGNYIGGEFVPPVKGQYFENTSPVNGKLIAEFPRSTAEDIDKALDAAHAAADAWGRTSVQDRSNVLLKIADRIEQNLELLAITETWDNGKPIRETLNADIPLAVDHFRYFAGCIRAQEGGAAEINEGTVAYHIHEPLGVVGQIIPWNFPILMAAWKLAPALAAGNCVVLKPAEQTPLGITVLLEVIGDLLPKGVLNVVQGYGREAGEALATSKRIAKIAFTGSTPVGSHIMKCAAENIIPSTVELGGRSPNIFFEDIMQAEPAFIEKAAEGLVLAFFNQGEVCTCPSRALIQESIYEPFMAEVMKKIAKITRGNPLDTATMVGAQASEQQYDKILSYLQIAREEGAQLLTGGAVERLDGDLASGYYIQPTLLKGNNKMRVFQEEIFGPVVGVTTFKDEAEALAIANDSEFGLGAGLWTRDINRAYRMGRGIKAGRVWTNCYHLYPAHAAFGGYKKSGVGRETHKMMLDHYQQTKNLLVSYDINPLGFF

SEQ ID NO: 54610 - protein, 515 aa, Zea mays
MAERWRSRARRDPDLDEDASPPSRQPRHSGGDEEDDELGNEDLSLEIVARAQRKRRGESAGGVPVFADLLSVSSADEEGAVVELDEADEPRRKQKKKQRRKQRKKHRKETTEAAAGAAVEVDENAVCSTEEGPIGTAESVLTENGADAPASDNMVLRKLLRIPRYFDPGETLLETCFNCSEEGHVAANCPLEKRKKPCFVCGLFGHNAKQCTQGQDCFICKKGGHMAKDCPDKHRRNDHQSTLCLKCGEIGHDMFGCTNDYPPDDIEKIRCYVCNQKGHLCCSDFSDDCPKQISCYNCAQSGHSGLGCAKRRETSAVTTPTLCFKCGEEGHFARGCTKNAKSDRSKGKSSSHIQRKEKWKKASSSARSAPYDARKTSKRKSPHLEERVGTPRHKPKSRGGWTGGDDLPLKKYKSNGWGSPSTPKKSYANHQFLSGCDYLTPQPSRRHNYHGTMSSPNHQFLSGCDYFTPESSRGHSHGTMSPNWNYSPSARKHGFSSSRFAAAAASNTHVRFGRN

SEQ ID NO: 54611 - protein, 633 aa, Magnaporthe grisea 70-15
MSGTGSRQPLDASAGRDVVYCHACENEWFQDQNGLVCPQCHSEATEIVTPENDPRPVNTHDSRTEPQGHRDRYDDSDPEEEDIEEHSHRAPGGIYFTSRVFRMPVNHGAGTESPHVHPSDGNAVMERFYEMMNRDMGSSAAPGASNSDGTRSATGQGASENSGTRHYTTRTTMFPGGSTSFTITTAPLQRDGNNPPIGEFDAYADPHPRTRRRIVIVMLDSRGADSNASILSTIMGNITNPVGNTPHRGGETSSNDEASGLPPHGFPIAFQQLLGALMTGYGGTRNWGDVVTSQEEFDRIISQMMEANPMSNAAPPASEAAIEKLERKKLDEKMLGTDETVECTICMDDLSLGDEATVLPCKHFFHGECVTIWLKEHNTCPICRTPMEQRSSAERTQAPQNQSSSGPRAARPEPPRGIFPWAFQPSGSGTGSFVNSSSQRPSQSSQQSPIDIQQNDSGHTSHRRELLRSPSTNEERLRAIRDLANSDRHGGSDRPTTPPFAGRRRNSLSPPSPSMQAPWNLSYDPVHDFTSASRDRTRERDGDRSNSQSSSRFTSTNRDQEGHRDRERYRQQTYESSQPPSREQRDQERNDDNGSRRGDPNQTSSGSTFDPFSWIRDRLPGGGNSSGDSHRRG

SEQ ID NO: 54612 - protein, 456 aa, Gibberella zeae PH-1
MSSKSRWADTEEDARLDAKLKEEKRRKKAEKARKLEEEKKLQDTAKQSNLEADDDRPSKRRRITPEPGAKQDEKLPPAKLLRFPTGSWGKSRSVENYEKLNDIEEGTYGWVARATNKATGKVVALKRLKLEPQDRNGLPVTGLREIQILKDCQHRNIVTMEEVVVGDDVSRPDNSLFLVLEFVEHDLKSILEDMPEPFLSSEVKRLLLQLTSGIAYLHDNWILHRDLKTSNLLLNNRGQLKIADFGMARYVGDPPPKLTQLVVTLWYRAPELLLGAKTYDAAVDMWSVGCIFGELLTREPLLQGKNEVDQVSRIFELCGVPTEETWPGFRRLPNARSLRLPKTQVATGSVVRARFPSLTSAGAGLLGDLLSLNPERRPSAQEMLQNEYFRQDPKPKPESMFPTFPSKANQERRRRVEPHAPVRGGQAASLGDADLSGIFQGRDKEEKGAGFQLRMI

SEQ ID NO: 54613 - protein, 251 aa, Oryza sativa
  misc_feature (238)..(238): Xaa can be any naturally occurring amino acid
MSTVYKIVLVRHGESDWNLQNRFCGWHDADLSPKGIEEAKTAGKALKQGGYTFDVAFTSVLKRAIKTLFLIQEELDLHWIPVQKTWRLNERMYGGLQGLNKSETAAKHGEDQVKIWRRAYDIPPPPMDLDNPELPANDPRYANYDKAILPVTECLKDTVDRFLPYWHDTIVPEIKNGKKVVIAAHGNSLRALVKYLDKVPDNEIVELNIPTGIPLVYELDANLKPVKHYYLADEETVXEAMSAVANQGKAK

SEQ ID NO: 54614 - protein, 385 aa, Physcomitrella patens subsp. patens
METVEEITVGKVITCKAAVAWEPKGKFIVQDVQVDPPLAMEVRIKVTHTSLCRSDLFFWTNEALGHTFPRIFGHEAAGIVESVGEGIDDLKPGDHVLPVFTGECKECKYCASPKTNLCSKFGTESLATGMKGDGKSRFSVNGKPVSRFLGSTFSEYTVVEYPYVVKINPVAPLDKVCLLGCGVTAGIGAVRRIAQLEPGATIAVFGLGTVGLSVVKEAQRRGASRIIGVDININKAAEGNFFGVTDFFNPDNLDKPVEEVIKELTGGGVDYAFECVGNPKVMATAFASCQDGWGTTIVLGVAGPATVSIPTRSLLTGRCMKGTLYGGYKPKTDVPALVEQYLHKDFDVEEFITHNLPFSRINDAFKLLQAGECLRTVLHYNETVN

SEQ ID NO: 54615 - protein, 631 aa, Olimarabidopsis pumila
MTAVLFLCFILFCFSFTPSLQNVRESEPLLRFKTSVNITKGDLNSWRTGTNPCNGKWFGIYCQKGQTVSGIHVTRLGLSGTINVEDLKDLPNLRTIRLDNNLLSGPLPPFFKLPGLKSLLLSNNSFSGEIADDFFKETPQLKRVFLDNNRLSGKIPSSLMQLSGLEELHMQGNQFSGEIPPLTDGNKVIKSLDLSNNNLEGEIPKSIAERKNLEMKFEGNQKLCGPPLNTICEETPTSFGEKKEVTGKAIFMVIFFLLLFLIIVAIITRWKKKRQPEFRMLGKDHLSDHESVEVRVPDSIKKPIESSKKRSNADGSSKKGSAHGKGGGGGPGGGGMGDIIMVNSEKGSFGLPDLMKAAAEVLGNGSLGSAYKAVMANGLSVVVKRIRDMNKLARDAFDIEMQRFGKLRHPNVLTPLAYHYRREEKLVVSEYMPKSSLLYVLHGDRGVYHSELTWATRLKIIQGVARGMDFLHEEFASYDLPHGNLKSSNVLLSETYEPLISDYAFLPLLQPNNASQALFAFKSPEFVQNQQVSPKSDVYCLGIIILEVMTGKFPSQYLNTGKGGTDIVEWVQSSIAQHKEEELIDPEIASNTDSIQQMIELVRIGAACIASNPNERQNMKEIVRRIERVTL

SEQ ID NO: 54616 - protein, 403 aa, Streptococcus pneumoniae
MKIAVAGTGYVGLSIAILLAQYHKVIAVDVIPEKVELINRRQSPIKDDDIETYLVEKELDLVATLDGNEAYRDADFVIIAVPTNYDSKKNYFDTSVVEAVIEQIIAVNLKATIVIKSTIPVGYTESLRTRFGQFKILFSPEFLRESKALYDNLYPSRIIVGADLRDTEQVVQAERFATLLQEGSLKPDVETLIMGVTEAEAVKLFANTYLALRVSYFNELDTYAEIKGLDTKSIIDGVGLDPRIGSHYNNPSFGYGGYCLPKDSKQLLANYHDVPQNMMTAIVESNRTRKYFIADRILKNALELSDGNQTIIVGVYRLTMKSGSDNFRQSSIQGVIKCLKAKGVEVIIYEPTLEDHSFFFGNQVVNDLEVFKSSSQVIVANRMEKSLYDVLEKVYTRDIFQRD

SEQ ID NO: 54617 - protein, 597 aa, Prochlorococcus marinus str. MIT 9312
MSNIDLKRRTKIVATIGPATQSEEIITNLIKAGVTTFRLNFSHGDHNDHAERIKTIREVSQKLDIDIGILQDLQGPKIRLGRFKDGPVKVKKGDKFTLTSNEVECSNTIANVTYENLSQEVSEGKRILLDDGKIEMIVEKVDTKANLLECLVTVGGVLSNNKGVNFPDVQLSVKALTEKDKEDLKFGLSEGVDWIALSFVRNPSDINEIKDLINKNGHSTPVVAKIEKFEAIDQIDAVLPLCDGVMVARGDLGVEMPAEEVPLLQKDLIRKANSLGIPIITATQMLDSMASNPRPTRAEVSDVANAILDGTDAVMLSNETAVGDYPVEAVQTMATIARRIERDYPLKAIESHLPSTIPNAISGAVSNIARQLDAGAIIPLTKSGSTARNVSKFRPPTPILATTTERSVARRLQLVWGVTPIVVNNDERTAKTFSLAMQIAQEMGILKQGDLVVQTAGTLTGISGSTDLIKVGLVRKILSRGISIGEIGVTGKARKINTKLDLSLICPGEILFVNKELLENVPLSKNIAGIVTNQNVDDVYAFFNKNNKKISTICNVENIDNNQIINGDLVTLQLNEGVIYMGQIEDDEEAIDKYKYV

SEQ ID NO: 54618 - protein, 299 aa, Prochlorococcus marinus subsp. marinus str. CCMP1375
MSKRHPVVAVTGSSGAGTSTVKRAFEHIFAREEIIPAVVEGDSYHRFERSPMKEAMAEALAKGENFSHFGPEANLFDKLEELFQTYGQNGGGKKRYYLHSPEEAEEHNSRLGTKLIPGQFTPWEEIPKGTDVLFYEGLHGGVVGDNYDVAKYADLLVGVVPITNLEWIQKIHRDNAERGYSAETIVETILRRMPDYINHICPQFSRTDINFQRVPTIDTSNPFICRNIPTPDESFVIIHFRKGAREKWGIDFQYLLGMINDSFMSSPTSIVVNGGKMGFAMELILTPIIHRMIEEKKSA

SEQ ID NO: 54619 - protein, 362 aa, Prochlorococcus marinus subsp. marinus str. CCMP1375
MASHKITLLTGDGIGPEISIVAKKILAALSEKHSITFTIEEKPFGGQAIELTGKPLPEDTLNSCKASDAVLLAAIGDPKYDDLPRDLRPETGLLNLRAGLNLFANIRPIKIRQALISSSSLKSEIIKDVDLVVVRELTGGIYFGQPKGRISTEEAGERAFNTMTYSDYEIDRIAKIAFDLSETRRKKICSIDKANVLEVSQLWRERVIKAQEQYPNIELTHQYVDNAAMQLVREPAQFDVILTSNLFGDIISDEAAMLTGSIGMLPSASLGEDGPGVFEPVHGSAPDIAHKNLANPIAMILSTAMMLRTGLMEYKAATDLENAIDKVLGKGFRTIDLNRDQSNTKLGCREMGDQIIKAINGI

SEQ ID NO: 54620 - protein, 164 aa, Brassica napus
MSVFEDSFVIVGDDASESVPVSASLDDSIDDVFAAPSSDYAAYSNGDDVFGSNGGGNDGPILPPPSEMESDEGRALREWRRQNANQLEEKEKREKEMRNQIIEEANQFKEDFHKKRELACENNKAANREKEKLYVETQEKFYAEASKNYWKAIAELVPKEVPTI

SEQ ID NO: 54621 - protein, 484 aa, Thermoplasma acidophilum DSM 1728
MLSFERVRIKKADPDERVKTFDIEPLDNYTDEEAIAEASRCLGCNMCSAACPASLDISGYIRSTAAGDPAQTVRIIMETLPFPAIIGRVCTHMCEDICVMYDGGGPIAIRHLKRYAADKFDDYGEILRPQKRKFIGKKVAVIGGGPAGLTVAYYLSLQGVKVTLFEERPALGGFMKTGIPRYRLPQSVLDKEIGYVVSRGVDVKLNTKVGRDISFDQIMKEYDAVFLGVGNHKPRMTGTPGSDAPNVMHATEFLERVSFGERIDVGDTVAVIGGGFTANDSARTSLRLGAKHVYIMYRRRDVDRPGYPSMNADEEMDEAEEEKVEYVWEVTPFEYVKENGRVVAMKYWMNEMVKEGKGRAKPVPIKDKVYTIKVDMVIEATGQETDYSFLGDYVKKLRLNPHGEPIVDQNGMTSIEGVFSGGDSTNPNRDLISAVRDGDIAVQGILKYLNVMDKVSYDDLPILDRFKPYSYTAAQEAYAVRGLI

SEQ ID NO: 54622 - protein, 271 aa, Zea mays
MRRQWALSVTSDYRAATPQSSFSYREGDPTGPTKWATLQKDWDVCDSGTEQSPIDVAKVEVSEDLDPLQQTYEPGDAVMHNRLHDFMLNWTGGNGGLTIEGKKYKLKQVHWHAPSEHTVNGTRFDAEMHMVHEDSTDAKSKAVVAVLFSAKAGKSSKLLRDLKPYFERLAGKQNGTEEVKGPVVDPAAWIDKASGYYGYEGSLTTPPCTQGVLWTIMSKVADASKEEIHSIESVKEANARPAQKINSRVVRYYKAAGATEAPAPAPAPEAT

SEQ ID NO: 54623 - protein, 515 aa, Prochlorococcus marinus str. MIT 9312
MYMNDYFEKILQAEVYEVAKKTPLEKAHNLSNKLNNEVFLKREDLQDVFSFKIRGAFNKMSKLTKSQLAQGVITSSAGNHAQGVALSALKLNCQATILMPLTTPLVKINAVKNLKAKVILYGDNYDETYREAIRISKERNLCFIHPFDDPEVIAGQGTIAIELEQQLKDKPYAIYIAVGGGGLISGISLYIKKVWPEVKIIGVEPQDADAMSKSLEESKIVELASVGQFADGVAVKKVGNNTFDIGRKYIDKMIRVNTDEICAAIKDVFEDTRSILEPAGALSIAGMKKDILNSNHSNKNMVAIACGANMNFERLRFVAERAELGECKEVMMAVEIPECAGSLIDFCKLLKNRNLTEFSYRMSNSINAQIFVGVEVNGIVDKKILLDEFRNSQYKFIDLSEDELSKNHLRHMVGGRLPKNLKEINNRSFVELLYRFEFPEKPGALINFLNNMKSNWSISVFHYRNYGADVGKIVIGVLIDKSEITEWNNFVKFLGYKYWDETKNDTYKLFLGAPE

SEQ ID NO: 54624 - protein, 161 aa, Treponema denticola ATCC 35405
MRTGLGYDLHRLVRGKKLMMGGVHIPFKKGEKAHSDGDVLLHAITDALLGACGMGDIGEFFPPSDKKWKDANSSELLSTVWERISEAGWKIQNIDCVIIIEEPKILPFREEIRKSIAGILKIEKEQIFIKAKTGEGIGIIGRGKAVAALASCLIFCRHTQE

SEQ ID NO: 54625 - protein, 476 aa, Yarrowia lipolytica CLIB122
MSHFKAAANDFIDFVNACPTPYHVVHDVRARLVKNGFKELKEKASWNIEPNGRYFVTRNESSIVAFTVGGKWKPGNPMAIVGAHTDSPTFRVKPVSKRSPSGNFLQIGVECYGGGIWHSWFDRDLSVAGRVFVKDPTTGKSQIRLVKVDKPILKIPTLAIHLDRSVMEKFEFNKEQHLTPVLGLLEKNLNKKKEEEPVESESDATPHQALEQCHDPALLGLLASELDVTPEQIDNFELYLFDTQKSCIGGLNDEFIFSPRLDNQVSSYCATEALIKSLDTVEKDESIRVIGLFDHEEVGSLSYQGADSNFLPAVLSRLAGAPGQNDGSDVSINYQSLASSFLLSADQAHAFHPNYPTSYESAHRPDMNRGPVIKINGNQRYTTDGVGMVLIQKIAEKANLPMQKFVVKNDSSCGSTIGPMLASKLGLRSIDIGNPQLSMHSVRETGGSKDIYYLEKLFIEFFNNFVETDKQIVYDE

SEQ ID NO: 54626 - protein, 178 aa, Prochlorococcus marinus subsp. marinus str. CCMP1375
MSDSQSPKNNEVPTLLVVDSKGDELLCFLEQIVPLSDVEYVLLTPVDTPVSLFRLREDNDPELIKTIEKKEPILEVADVVLQEYDLKLIRSAVTLTITGELDEPEPEELEEKDFDEDSELYELLVNFKVKDDEYGLYIPLDPFFIVGKIIDGNATVLEGEEFDKIQPLIEAELEKRDF

SEQ ID NO: 54627 - protein, 397 aa, Synechococcus sp. WH 7805
MLTSERLARLGSGVFDRNDRRKAHYCLGSRHPQQPLIDLSLGSTDLAPPAEVIAAMAGALQDPISSSYCLHAGTEAFRHAAAAWCERRFGVAVDAETEVLLLVGSQEGTAHLPMAVLDPGESALILDPSYPSHRGGLELADASIHTLPLRAETGWAPDFSSLTTEQWRQLRLMVLGFPHNPTACTGEQAWLDEAMEHCHRHDLVLAHDNPYVDLALEGEAPALLRCPQWKERGIEFFSLSKGWCLGGFRLAFAVGAAPLISALRQLKGVVDFNQCRALQQGAVLALDRFAHWPASLRPVYRDRRDRMLRSLERIGWSVPQPSMALYLWMPLPSWARSRGWSDEQLAAEVLEHCGVALTPGSGFGTAGAGWLRLALVRPSIELESAVDRLAPWWALQS

SEQ ID NO: 54628 - protein, 586 aa, Oryza sativa Indica Group
MPDARSAAENASRHHHHHHRAHAIADRSERGLPEEHSRGSVDERFVFPWMGILVNVPTEWKNGRQVGESGNRLKEGFARFCPHKVIPLWNHRGHTGNAIVEFAKDWTGFENALAFEVHFEQQGYGRRAWMGNKYRGSQMFGWVARADDHNSPGPIGVYLRKNGDLKTVADLENEGTRKTDKLVANLASQVEVKKRHVEELESQYNETTASLERVMEQREQQLQAYNEEIRKMQDLALRHSQRIMDENKKLRSDLESKMQLLDSRSKELDKLAVQSNSDRMNLEKEKEKNVNLAIGILGNADVIYVSFYFVRRFANDIKTKHLKMATLEQQKADESVLKLVEEHKREKQAALDKILKLEQQLNAKQKLELEIQQLQGKLEVMKHMPGKEDSEAKSKIHELSEELKDKYAEMESIESLNQALVIKERQSNDELQHARKVLIEGFQDIIVGRTNIGIKRMGVIDFKAFTNAYKQRSLEEDADVSAAELCSLWENEIKNSDWHPFRVVMVDGKEMEILSEDDGKLCELKEEHGEEICAMVTKALLELNEYNPSGRYPVPELWNFKENRKATLKEVVQYVLNQWKKNKRKR

SEQ ID NO: 54629 - protein, 395 aa, Hyphomonas neptunium ATCC 15444
MEDPRQHILPVYRPPEEVFVQGEGVYLFTEDGRRYLDFIAGIAVTALGHAHPAMVEALRDQAGKLWHTSNMFRVKGQEELADKICRDSFADRVFFTNSGTEAIECAIKAARKYHWAAGNADRLDIITFTGAFHGRSIGAINAGGNPKYLEGFGPKLPGFVHLEWGDHDALKAAVAASTAAAVLVEPVQGEGGVRAMPEQCLKGLRDLCNEHGVLLIYDEVQCGMGRTGQLWGYQWAAGADPDILCAAKGIGGGFPFGACLMTEAVGEPMQPGSHGSTYGGNPLAMAVGNVVWDIISSEEFLANVRRVSGTLQQGLKSLADSHPDKVEGVTGKGLLTGLRLKADPKNLQGICRDGGLLTGVAGNNVLRLAPPLIIDDAQVRDAIGMIDAALTEWTP

SEQ ID NO: 54630 - protein, 211 aa, Oryza sativa Japonica Group
LKSKWADEDVEEDDVKESWEEEEEEKPKPPPVEKTAPKPSGKGAAKKGKQQASTSSEVVQDEALDDPALEKLRQQRLVEEADFKSTTELFGKKDGSEKSLDTFIPKSESDFAEYAELIANKLRPYEKSFHYMGLLKNVMRLSMASLKGADAKDISSSIAAIANEKIKAEKEAAAGKKKQGAKKKQLHIENKDDDFIPGKGNFDDPDEYDFM

SEQ ID NO: 54631 - protein, 464 aa, Vibrio campbellii AND4
MPLHKKSALKGSLLDDVYSSKDLSIVMPKYRIPENEHAASHAYQVVHDELMLDGNSRQNLATFCQTWVEDEVHKLMDECIDKNMIDKDEYPQTAEIESRCVHMLADLWHAPHAENPMGCSTTGSSEAAMLGGMALKWAWREKMKRQGKPTDRPNLICGPVQVCWHKFARYWDIELREIPMQGDRLIMTPEEVIKRCDENTIGVVPTLGVTFTCQYEPVKEVHDALDRLQQETGLDIPIHVDGASGAFLAPFCDPDLVWDFRLPRVKSINASGHKFGLSPLGVGWVVWRDADALHDDLIFNVNYLGGNMPTFALNFSRSGGQIVAQYYNFLRLGREGYRKIHEACYDTARYLAQEIEKMGMFHIIYDGHGGIPALSWSIKEGANPGFNLYDLSDRIRSRGWQIAAYAMPAEREDLVIMRILVRHGFSRDLADLLLSDLQHCVNFFSKHPIVNGSDADESSNFNHG

SEQ ID NO: 54632 - protein, 370 aa, Hordeum vulgare
MAIGGVGAGGGAGGVEGQQGRSVLVTGGAGFIGTHTVLRLLEKGYAVTAVDNFHNSVPEALDRVRHIVGPALSARLQFIFGDLTIKDDLEKVFAAKRYDAVIHFAGLKAVAESVAHPEMYNRNNIVGTVNLYDVMKKHGCNKLVFSSSATVYGQPEKVPCVEDSPLKALNPYGRTKLYLEEMLRDYQHANPEWRTILLRYFNPIGAHQSGDIGEDPKGVPNNLLPYIQQVAVGRRPELNVYGHDYRTRDGTAVRDYIHVVDLADGHIAALEKLFATPDIGCVAYNLGTGRGTTVLEMVSAFEKAYGKKIPVKMCPRRPGDSEQVYASTAKAEQELGWRAKYGIEEMCRDQWNWARKNPYGYCGDAAENKD

SEQ ID NO: 54633 - protein, 600 aa, Oryza sativa
MKVTPTPHANGSKVAARLTRLLRCSPRDSNVIARSLQSAAAAVAVPVPTSSPARMLPPSAAATAGDGGGVPHFVGTMREERRKEKNEEMVAGQPLEMEEVEVAPPRAHEVRIKILCTSICHTDITFWRMEGNHPSIFGHEAVGVVESVGEHVQEVAVGDMVVPVFAAQCSECPDCLSDRSNLCSKLPNVAGLMPRDRTTRFSSVSTGEPIRHFLSVSSFAEYTVVDITHIVKLDVGFPPAMACLLSCGISTGVGAAWKVAAVEPGSSVAVFGLGAVGLAVAQGARMRGAKRIIGVDLNPDKFDVGKRLGMTDFINPNDTGGKTVSEVIKEMTGGGGADYCFECIGSTSVMAEAFQSTRNGWGKTILLGVSGNKAPISIPSHEILRGRSVIGSLFGGIKPKNDIPMLAQKYLDKELELEEFITHEMGFEEINRAFELLTQGKSIRCIIWMDGAKVIDNGEVFDSALASVAVVLESIRSEGQLWSLAGERGALSNVDYDHLLAPVKASPRPLSREGEEEEGDIAMVAAQSFVSTQDSASDTVVDYSGNEDKFHESNTTLVGWHWRHHWVYWLGPFIGAGLAGLLYEYLVIPSADATPHGGAH

SEQ ID NO: 54634 - protein, 164 aa, Yersinia pestis
SVGFEHFEQLLSGSHAMDKHFAETPAEKNLPVLLALIGIWYNNFFGAETEAILPYDQYMHRFPAYFQQGNMESNGKYVDRNGHPVDYQTGPIIWGEPGTNGQHAFYQLIHQGTKLIPCDFIAPAISHNPLSDHHAKLLSNFFAQTEALAFGKSLEDVEAEFAAA

SEQ ID NO: 54635 - protein, 361 aa, Bordetella petrii
MADSLQDRLKPLRERIDALDTQILELLSQRARAALEVGEAKHAAAADGPVLRPEREAEVIRRLQQLNPGPFPRDAVAFVWTEIISACRGLERGMTVAYLGPRGSFSEQAAFEHFGRSVQPLPCPSFDEVFRAVEAGQADVGMVPVENSTEGAVNRNLDLLLNTPLKILGERSLDIRHCLMTQSGSMDGVTAVAAHPQALAQCQAWLNRHYPGLERVAEASNSEAARVAAGNPAMAAIAGESAAPAWDLQIVAAGIQDDPNNRTRFLALGDIQPLPSGKDKTSLILAVPNRAGAVYDMLAPLAANGVSMTRFESRPARTGQWEYYFYVDVQGHRDDPQVARALADLQEQVAFIKVLGSYPAQ

SEQ ID NO: 54636 - protein, 403 aa, Cytophaga hutchinsonii ATCC 33406
MTTITNPQTLSTVVNSLSESETLAMTKKARELASQGNKVISLSVGEPDFKTPQHVMDAAKKAIDEGYHSYSPVAGFADLRAAIAEKLVKENNINVTAENIVVSTGAKQSLANVIQAIVDKGQEVIILAPYWVSYSEMVKLAEGKSVILTGTIENDFKVTAAEIAKAITPKTRAIMYSSPCNPSGSVYSEKELREIGELLKQNPQIVAIADEIYEYINFEGKNFSLGSIDEIKDQVVTVNGFSKGFAMTGWRLGYIAAPKYIAAATEKLQGQVTSGTCSITQRAGLAALQGDLSAPLKMKEAYLRRRDLIIDLLKEIPGLKINKPAGAFYIFPDVSAYLGKSVNGQVIKTSSDLSMFILNDAFVSTVGGDSFGSPNNIRISFAASDENIIEAIKRIKECLAKLK

SEQ ID NO: 54637 - protein, 178 aa, Triticum aestivum
  misc_feature (90)..(90): Xaa can be any naturally occurring amino acid
  misc_feature (109)..(109): Xaa can be any naturally occurring amino acid
  misc_feature (133)..(133): Xaa can be any naturally occurring amino acid
MASATLLKSSFLPKKAEWGATRQAAAPKPMTVSMVVRASAYADELVKTAKTIASPGRGILAMDESNATCGKRLASIGLENTEANRQAYRXTLLGHSNQGLGNYISGCYXLLRETLYQSTVDGKKIVDILVEQXSVPGIKVDKGLVPLVGSNDESWCQGLDGLASREASENMFVKNYSY

SEQ ID NO: 54638 - protein, 464 aa, Escherichia coli K12
MPDAKKQGRSNKAMTFFVCFLAALAGLLFGLDIGVIAGALPFIADEFQITSHTQEWVVSSMMFGAAVGAVGSGWLSFKLGRKKSLMIGAILFVAGSLFSAAAPNVEVLILSRVLLGLAVGVASYTAPLYLSEIAPEKIRGSMISMYQLMITIGILGAYLSDTAFSYTGAWRWMLGVIIIPAILLLIGVFFLPDSPRWFAAKRRFVDAERVLLRLRDTSAEAKRELDEIRESLQVKQSGWALFKENSNFRRAVFLGVLLQVMQQFTGMNVIMYYAPKIFELAGYTNTTEQMWGTVIVGLTNVLATFIAIGLVDRWGRKPTLTLGFLVMAAGMGVLGTMMHIGIHSPSAQYFAIAMLLMFIVGFAMSAGPLIWVLCSEIQPLKGRDFGITCSTATNWIANMIVGATFLTMLNTLGNANTFWVYAALNVLFILLTLWLVPETKHVSLEHIERNLMKGRKLREIGAHD

SEQ ID NO: 54639 - protein, 164 aa, Pectobacterium carotovorum subsp. carotovorum
SLGFENFEKLLSGAHAMDKHFASTPAEKNLPVLLALIGIWYNNFFGAETEAILPYDQYMHRFAAYFQQGNMESNGKSADRNGNPVDYQTGPIIWGEPGTNGQHAFYQLIHQGTKLVPCDFIAPATSHNPLSDHHSKLLSNFFAQTEALAFGKSRDVVEAEFAAA

SEQ ID NO: 54640 - protein, 378 aa, Coccidioides immitis RS
MFRTGIRRFSSTALRGSESLVAQAEAKNQYGIGVSRAQGVVKGLTGAIGNTPLIRLNRLSEETGCNILGKAEFQNPGGSVKDRAALFVVKDAEERGLLRPGGTVVEGTAGNTGIGLAHVCRSKGYKLVIYMPNTQSQGKIDLLRLLGAEVYPVPAVAFENPENYNHQARRHAESLDNAVWTNQFDNTANRRAHIETTGPEIWAQTKGKVDAFTCATGTGGTLAGVTRYLKEVSNGRVKCFLADPPGSVLYKYVSSGGKLIERGGSSITEGIGQGRVTDNLKPDIELMDGALQIADEKSIEMVYRCLDEEGLYIGASSALNVVAAKEVAEKLGKGHTIVTMICDGAYRYADRLFSDKWLRTKNLRDAIPKHLEKYIVLP

SEQ ID NO: 54641 - protein, 643 aa, Azoarcus sp. BH72
MISFRNLRLARGARTLIEGASLQIHPGWKVGLTGANGSGKSSLFAMLRDQLHPDQGDLDMPQGWVIAHVAQETPGLPQPAIDYVLDGDAELREVESALAKAEAEHDGSHIGELHARLHEIGGYAARARAAALLDGLGFLPADIERPVADFSGGWRMRLNLAQALMCRSDLLLLDEPTNHLDLDAVIWLEAWLRDYRGTLLLISHDREFLDACVTHVAHIEQQKLTLYTGGYSDFERQRGERLIQQQSMFERQQREIAHMEDYIRRFRAKATKARQAQSRIKALERMERIAAAHVDTPFSFSFRDCPAAPDPLLQIEDGAVGYGGRTVLDRIVLTLRPGERVGLLGRNGAGKSTLIKLLSGQLALSAGRRLEGKGLATGYFAQHQLETLRPEESALQHMTRLDPAAREQDLRDYLGGFDFRGDGVGGTSTPATTPCAPFSGGEKSRLALALLIWQRPNLLLLDEPTNHLDLEMRHALTLALQDYEGAMVLVSHDRALLRATCDRFLLVDDGRIQPFDGDLDDYRDWLAARRAEAAAAAQCPDQAADKAARKADRAQAAADRQARLAARRPLVKELDQLEKKLAGWNGEKKLLDARLADPTLYSGGDSAQLQTLLKRQAELAGWIDEAELRWLEISEALEALPAD

SEQ ID NO: 54642 - protein, 511 aa, Campylobacter coli RM2228
MKKADILVLDFGSQYTQLIARRLREQGVYAEILPFNVSLADIKAKEPKGIILSGGPASVYATDAYFCDKEVFNLGLPILGICYGMQLMAHHYKANVAPAGHKEYGKASIEIQKDSDLFKNLPKKQIVWMSHSDKVENLPQGFEVLATSENSPYCVFANEEKKFFALQFHPEVQHSEFGKSILKNFAKYACNCESIWNMGSFAKTQAEKIREEVGKDKVLCAVSGGVDSSVVAALLANAIKDQVIVVFVDNGLLRSDEKEQVEFMFKNTLGINLISIDASKIFLDRLAGVTDPEQKRKIIGNTFIEIFEEEAKKHKDVKFLAQGTLYTDIIESSVIGASKTIKSHHNVGGLPEKMNLKLVEPLKEIFKDEVRALGIELGLSKEIVYRHPFPGPGLAIRIMGEVNRPSLELLRKADVILLEELRSTGWYNKTWQAFCVLLNVKSVGVMGDNRTYDNTICVRVVDASDGMTATFSHIPYEILENISRRIINEVEGINRVVYDISSKPPATIEWE

SEQ ID NO: 54643 - protein, 411 aa, Bacillus halodurans C-125
MKIIIQKFGGTSVKTAEVREMAAKHVEKAVEGGYKVVVVVSAMGRSGDPYATDTLLQLVDTKTIAKREQDLLVSCGEIISSVVFTELLLKKGIQATAMTGAQAGFRTNEEFTNAKIVDMKVDRLKKTLVHQDVVVVAGFQGQSPTGETTTLGRGGSDTSATALGAALDAEWVDIFTDVEGIMTADPRIVSEARPLDTMTYNEVCNMAYQGAKVIHPRAVEIAMQAKIPIHIRSTYSDGKGTLVTSMLTEAGARDVQDRIITGIAHMSGVTQIKVHAKDGEFDLQEKVFRAMAAEKISVDFININLTGVVYTVMDEVADRAIEVLRELGFDPEVKRHCAKVSAVGAGMTGVPGVTAKIVAALSQENIRILQSADSHTTIWVLVSEDDLTKAVNALHRMFHLEQSEQTKQKQV

SEQ ID NO: 54644 - protein, 353 aa, Pseudomonas aeruginosa PAO1
MSTPPFRVALNGYGRIGRCVLRALHERPEQLGFEIVALNDLADQASVEYLTRFDSTHGRFPGEVKVDGDCLHINGDCVKVLRSPTPEAIDWQALRVDLVLECSGQYTNRAQAERFLRAGAPRVLFSQPMASEADIDATIVYGVNQQDLSGRETLVSNASCTTNCGVPLLKLLNEAIGLEYVSITTIHSAMNDQPVIDAYHHEDLRRTRSAFQSVIPVSTGLARGIERLLPELAGRIQAKAIRVPTVNVSALDITLQTSRDTSAAEINRVLREAAESGPLRGLLAYTELPHASCDFNHDPHSAIVDGSQTRVSGPRLVNLLAWFDNEWGFANRMLDVAGHYLRAAVPDQQVPKD

SEQ ID NO: 54645 - protein, 259 aa, Magnaporthe grisea 70-15
MDSNARLAGARKLWRAWRTIHQMLSDRGYELSEEECNISIERFLADFTDGNGNVDQSKLTFSARPSDAMLKLHARIPTPTDPDPAPDCGSIWVEFINEEKIGVGRTKQFVEVLLQSGFRDGILVTQGALSSGARRALSATGSGDNKVEAFMLEDLLVNITHHELVPKHVMLSRVEKKALLERYRLKETQLPRIQTKDPVARYLGLQRGNVVKIIRHSETAGRYASYRLTPSVLILQVAISSEKRTPPWLQGGQQSVRSL

SEQ ID NO: 54646 - protein, 387 aa, Pseudomonas aeruginosa PAO1
MTVLKMTDLDLKGKRVLIREDLNVPVKDGQVQSDARIKAALPTLKLALEKGAAVMVCSHLGRPTEGEFSAENSLKPVAEYLSKALGREVPLLADYLDGVEVKAGDLVLFENVRFNKGEKKNADELAQKYAALCDVFVMDAFGTAHRAEGSTHGVARFAKVAAAGPLLAAELDALGKALGNPARPMAAIVAGSKVSTKLDVLNSLAGICDQLIVGGGIANTFLAAAGHKVGKSLYEADLVETAKAIAAKVKVPLPVDVVVAKEFAESAVATVKAIAEVADDDMILDIGPQTAAQFAELLKTSKTILWNGPVGVFEFDQFGEGTRTLANAIADSAAFSIAGGGDTLAAIDKYGIAERISYISTGGGAFLEFVEGKVLPAVEILEQRAKG

SEQ ID NO: 54647 - protein, 362 aa, Kineococcus radiotolerans SRS30216
MPDVRGRASATLARMVDTLRLAVIPGDGIGQEVTVEALKVLTAVLGGGGRVATTEYDLGARLYHRTGETLPDSVLEELRGHDAILLGAVGDPSVPSGVLERGLLLKLRFALDHHVNLRPSKLHPGVPSPLGDPGEIDFVVVREGTEGPYVGNGGALRVGTPQEIATEVSVNTAFGVERVVRDAFARAAARPRRKLTLVHKHNVLVHAGHLWRRTVEAVGAEFPDVAVDYLHVDAATIFLVTDPARFDVIVTDNLFGDILTDLAAAVTGGIGLAASGNVNPDRTTPSMFEPVHGSAPDIAGQQIADPTAAVLSVSLLLAHLGRDDLAARVEAAVAADLARRATGEVGTRSTSAVGDALAAAVG

SEQ ID NO: 54648 - protein, 296 aa, Physcomitrella patens subsp. patens
MGLKHPHSPNDPFLAKLAAAASTEMGKAQLAGASGVSDGPPLLDILSNPVMMAAPAQVERSSGYNEHRPRRPPPDLPSLLLNSRIVYIGMPLVPAVTELVIAELLYLQYADPRQPIYVYINSTGTARADGETVGLETEGFAIYDTLMNVRNQIQTVAVGAAIGQACLLLASGDKGMRYMMPHATAMIQQPRLPSTGQMSAIDVHIRAKELINNRDTLVGLLAKHTGNPVEKVAKVMERPFYMNPKKAVDFGVADKILWRGQEAMAETMKAEDWDKGAGIRVVERPASYGAGDTGLG

SEQ ID NO: 54649 - protein, 413 aa, Bacillus halodurans C-125
MINTMTLDNGVRIITEKMSTVRSVSIGIWVGTGSRYESAEENGISHFLEHMFFKGTNTRSAQEIAEFFDSIGGQVNAFTSKEYTCYYAKVLDDHAGQAIDTLSDMFFHSTFQKEELEKERKVVFEEIKMVDDTPDDIVHDLLSSATYGKHSLGYPILGTVETLNSFNEGMLRHYMDRFYTGDYVVISVAGNVHDELIDKIKETFSQVKPTTYNYQGEKPMFLPNRIVRKKETEQAHLCLGYPGLPIGDKDVYALVLLNNVLGGSMSSRLFQDIREKRGLCYSVFSYHSSFRDSGMLTIYAGTGHDQLDDLVYSIQETTSALAEKGLTEKELENGKEQLKGSLMLSLESTNSRMSRNGKNELLLKKHRSLDEMIEQINAVQKQDVSRLAKILLSASPSISLINANGELPKALIH

SEQ ID NO: 54650 - protein, 369 aa, Olimarabidopsis pumila
MERSTIQVEPLDEEEDDFLLELAAIEAEAAAKRPRVHPIPEGPYMAALKGSKSEQWQLSPLNPASKSRGVAVTTAGGGGGVVGEQEFPEKSCPCGVGLCLILTSNTQKNPGRKFYKCPNREENGGCGFFQWCDAVQSSGTTHSYGNTNDSKFPDHQCPCGAGLCRVLTAKTGENVGRQFYRCPVFEGSCGFFKWCNDDAVSAPTSYSVTKNSNLGDSDTRGYQIAKTGTPCYKCGKEGHWARDCTLQSPIPPSEMGPVRSTSAAGECYKCGKQGHWARDCTAQSGNPTYEPGKVKSSSSSGECYKCGKQGHWARDCTGQSGNQQFQSGQAKSTSSAGDCYKCGKPGHWARDCTLAAQTTSTSGKRQRQY

SEQ ID NO: 54651 - protein, 602 aa, Oryza sativa Indica Group
MSHLSEAVILHRDAPTSQLRALDSRNPNLVLESELQIQAGAIRVKPGEKSLRKKMSPATAAAADLPAEEEGKGGRSSSRQEEANVLLAVDAAAEGGGAWSPVGWFRMLGRELHWSFVAAVVATYGVSQGLGGGIMRVASDYYWKDVQRVQPSAAQVYQGVTSIPWMVKPLWGLLTDVLPIAGYRRRPYFVIAGGFMGVVAMLVLSLHSKLHVLFALLALMAGSASVAIADVTIDACVAENSIVHPHLAADMISLNGFCASVGGLIGFSISGFLVHAIGSQINLVFLKGALGMLAIPSALVILAGMMIKDVHMPNFPYELAHMKFVEASRTMMATLKCPEVWRPCVYMYMSLALSVDIQEGMFYWYTDQNAGLSFSEGFIGFIFAVGSVGSLIGVILYQNILKDHSFRSVLCLSQLLLSLSGMLDLILVLRLNLKLGIPDYYFAVIDEGVSKMINRIKWMPLLVLSSKLCPAGIEGTFYALLMSIDNVGLLSGSWAGGLILHVLNITRTEFKNLWAAILIRNAMRLLPLALLFLVPRSDQNSNLLPADLLPEDDGAQYQVDNVELTSLTVDGKSSTGSLHQEFKNQDVVENDDDEASLLANSS

SEQ ID NO: 54652 - protein, 221 aa, Brassica napus
MEFLSTTTLLALALLLLVIPKIYKSCWILVWRPWMLSRKFMKQGISGPKYKILHGNLREIRTLKQEAKLTVLDLNSNDIFPRVLPHFHQWRSQYGETFLYWQGTEPRIFISDHELVKQILSNKFGFYVKPKTRPEVLKLAGNGLVFADGIDWVRHRRILNPAFSMDKLKLMTKLMVDCTLRMFEEWSKQMNDGEKEQVVMMNVEFKRLTADIIATAAFGSS

SEQ ID NO: 54653 - protein, 324 aa, Mesorhizobium loti
MNDMQTDSTLHDDAQARGASGRLPPEIWMQDGARRVEQALARLLCAEDDGETELMAAMRYATLHGGKRTRALLCLATGALADTPAPMLDDVGAAIEMMHACTLVHDDLPAMDDDVLRRGLPTVHVKFGEATAILVGDALQAHAFLTLASLDAPGDNRIALVRELAQAVSAEGAAGGQAMDLSLVGKHVELDRIVAMHRMKSGALVRASVRMGALCAIAEDAAHAALYCALDRYSACFGLALQVVDDILDATADTATLGKTPGKDAAAQKPTCASIMGLQAARQLALDLLRDAGEAIAPLGTRAERLAQMLQRANAYLFKHAPCA

SEQ ID NO: 54654 - protein, 557 aa, Thermoplasma acidophilum DSM 1728
MIEQDTFVKSTASDKRFRKELTTIDLLFLSLGGIIGSGWLFAAAGASMLAGPAAVLSWIIGGLIVLVIALVYAELGGMIPRSGAIVRYGQYSHGGLAGFLFGWAYFLSAVSVPAIEAEGVITYAGTYVKGLVTPTGVLTAVGILLAAILMLGFFFLNYFGIKVMGKTNTGMTWWKLIIPSATVALLLTVHFNIGNFFLKTGFVTYGWSSVFEAISVSGIVFSYLGFRQALDYGGEAKNPQRSVPIATILSVVIGIALYALLQVVFIGQVNWAAVGVAPGQWSALSGGVVTAPFATLASSAGLVFLSYFLFADAYVSPSGTLNVYLGTSQRTLYGLATLGYLGKSMSDVNRKHRVPILPLIASLVIGYIFFAPFPSWYKLVGFISSSTVFTYIVGGSALQVFRREASELKRPFRLKGASILSPIAFVGATLIVYWSGWPLVAYLVIAILIGLIVYAAFYLAGKSAINIFSGKHFKGGAWLLAYMGAITLLSYFGEKAYGGTGLIPFPWDFLVMILVAIGFYFWSVYSGFKTDEITEIIESGMQYLPSEEAAQAPAGKK

SEQ ID NO: 54655 - protein, 259 aa, Arabidopsis thaliana
MASQVRSVKVGNLSSGATEHDIKEFFSFSGEVESIDIQSNEHSAYVTFKETQGAETAVLLSGASIADQSVIIELAPNYSPPAAPHAETQSSGAESVVQKAEDVVSSMLAKGFILGKDAVGKAKAFDEKHGFTSTATAGVASLDQKIGLSQKLTAGTSLVNEKIKAVDQNFQVTERTKSVYAAAEQTVSSAGSAVMKNRYVLTGVSWAAGAFNRVAQAAGEVGQKTKEKVEAEQPSQPAQSQQQLPEGYSPIHTSEYSKN

SEQ ID NO: 54656 - protein, 522 aa, Triticum aestivum
MARGGGNGEVELSVGVGGGGAGAGGADAPAVDISLGRLILAGMVAGGVQYGWALQLSLLTPYVQTLGLSHALTSFMWLCGPIAGLVVQPCVGLYSDKCTSRWGRRRPFILTGCILICIAVVVVGFSADIGAALGDSKEECSLYHGPRWHAAIVYVLGFWLLDFSNNTVQGPARALMADLSAQHGPSAANSIFCSWMALGNILGYSSGSTNNWHKWFPFLRTRACCEACANLKGAFLVAVLFLAFCLVITVIFAKEIPYKAIAPLPTKANGQVEVEPTGPLAVFKGFKNLPPGMPSVLLVTGLTWLSWFPFILYDTDWMGREIYHGDPKGTPDEANAFQAGVRAGAFGLLLNSVVLGFSSFLIEPLCKRLGPRVVWVSSNFLVCLSMAAICIISWWATQDLHGYIQHAITASKEIKIVSLALFAFLGIPLAILYSVPFAVTAQLAANRGGGQGLCTGVLNIAIVIPQVIIAVGAGPWDELFGKGNIPAFGVASAFALIGGIVGIFLLPKISRRQFRAVSGGGH

SEQ ID NO: 54657 - protein, 336 aa, Triticum aestivum
MAPLGDAVAPASAAAPGLVVSFGEMLIDFVPDVAGVSLAESGGFVKAPGGAPANVACAISKLGGSSAFIGKFGDDEFGHMLVEILKQNGVNAEGCLFDQHARTALAFVTLKSNGEREFMFYRNPSADMLLTEAELNLDLIRRARIFHYGSISLITEPCRSAHVAAMRAAKSAGILCSYDPNVRLPLWPSAQAARDGIMSIWKEADFIKVSDDEVAFLTQGDATDEKNVLSLWFEGLKLLIVTDGEKGCRYFTKDFKGSVPGYSVNTVDTTGAGDAFVGSLLVSVSKDDSIFYNEAKLREVLQFSNACGAICTTKKGAIPALPTTATALELISKGSN

SEQ ID NO: 54658 - protein, 522 aa, Triticum aestivum
MARGGGNGEVELSVGVGGGGAGAGGADAPAVDISLGRLILAGMVAGGVQYGWALQLSLLTPYVQTLGLSHALTSFMWLCGPIAGLVVQPCVGLYSDKCTSRWGRRRPFILTGYILICIAVVVVGFSADIGAALGDSKEECSLYHGPRWHAAIVYVLGFWLLDFSNNTVQGPARALMADLSAQHGPSAANSIFCSWMALGNILGYSSGSTNNWHKWFPFLRTRACCEACANLKGAFLVAVLFLAFCLVITVIFAKEIPYKAIAPLPTKANGQVEVEPTGPLAVFKGFKNLPPGMPSVLLVTGLTWLSWFPFILYDTDWMGREIYHGDPKGTPDEANAFQAGVRAGAFGLLLNSVVLGFSSFLIEPLCKRLGPRVVWVSSNFLVCLSMAAICIISWWATQDMHGYIQHAITASKEIKIVSLALFAFLGVPLAILYSVPFAVTAQLAANRGGGQGLCTGVLNIAIVIPQVIIAVGAGPWDELFGKGNIPAFGMASAFALIGGIVGIFLLPKISRRQFRAVSGGGH

SEQ ID NO: 54659 - protein, 437 aa, Petunia x hybrida
MNTNRAVLVPHRGEVGGKQKNGQADGRNNRRVLGDIGNLVTGAPVIEGKPKAQISRPATRSFCAQLLANAQAEKNKVKPLAEVVNKVPAKKKASDKPAVQEAVIVISPDEEVKKKTIEKSPLSKRKAKKTGKTLTSTLTARSKAACGLSNRPKNEIDDIDAADAANHLAVVEYVEDIYNFYKLTEDESRVNNYMEFQPELNHKMRAILVDWLIEVHRKFELMPESLYLTINILDRFLSMKTVPRKELQLVGISAMLIACKYEEIWAPEVNDFMHISDNVYTRDHILQMEKAILGKLEWYLTVPTPYVFLVRYIKAAMPSDDQEIQNMAFFFAELGLMNYTTTISYCPSMLAASAVYAARGTLNKGPLWTPTLQHHTGYSEEQLMECTKQLVSYHKGAAESKLKAIYRKFSSPDRGAVALFPPARNLLPTTTTTTTSS

SEQ ID NO: 54660 - protein, 451 aa, Vibrio vulnificus YJ016
MATHFDYICIGGGSGGIASANRAAMYGAKVALIEAKDLGGTCVNVGCVPKKVMWHGAQIAEAMSLYAPDYGFDVEVKGFDWSKLVESRQAYIGRIHQSYDRVLGNNKVNVIKGFAKFVDEKTVEVNGEHYTADHILIAVGGRPTIPNIPGAEYGIDSNGFFDLAEQPKRVAVVGAGYIAVEIAGVLNALGTETHLFCRKESPLRSFDPMIIDTLVEVMAAEGPTLHTHSVPKEVVKEADGSLTLHLENGESQNVDQLIWAIGRHPATDAINLSATGVATNERGYIKVDEFQATNVAGIYCVGDIMEGGIELTPVAVKAGRQLSERLFNNKPNAKMDYDLVPTVVFSHPPIGTIGLSEPEAIAQYGKENVKVYTSGFTAMYTAVTQHRQPCKMKLVCAGEDEKVVGLHGIGFAVDEMIQGFGVAMKMGATKADFDSVVAIHPTGSEEFVTMR

SEQ ID NO: 54661 - protein, 328 aa, Vibrio campbellii AND4
MTKKIILDTDPGIDDAMAILFAEAHPDIELIGITTVYGNASLENATRNALYLKQKFGMKAKVAQGANKPLVRAPVGATVAVHGEAGFGDVKAPSSLNVKATDTPAYRYIIDRVRAEPGEITLVAIGPLTNLALALEADPEIVHLVKEVVVMGGAFGENGHRGNVTPIAEANIHDDPHAADKVFTASWPVVIIGLDVTEESFFTEQYLDQLRQEAGEVGQFIWDVSRYYLAFYAEKLGVGGCHVHDPSAIAYVINPQLFSLRLGAVRVVTDGPAEGMTIQKTDQRKYMHDAWSAFPAQKIGVGVQSDALLSLYRESMIAWFTSRGKLGY

SEQ ID NO: 54662 - protein, 344 aa, Silicibacter pomeroyi DSS-3
MRIARDLAEAVGHTPLIRLRRVSEETGCEIYGKAEFMNPGQSVKDRAALYIIRDAIARGELQPGGTIVEGTAGNTGIGLALVGASMGFKTVIVIPETQSEEKKDMLRLAGAELVQVPAAPYRNPNNFVRYSERLARELAKTEPNGAIWANQFDNTANRQAHVETTGPEIWEQTGGKVDGFVAAVGSGGTLAGVAEALQPKGVKIGLADPMGAALFSYYTTGELAMEGGSIAEGIGQVRITRNLEGFKPDFAYQVPDAEALPYIFDLLRQEGLVMGGSTAINIAGAVRMAREMGPGHTIVTVLCDYGTRYQSKLFNPDFLREKDLPVPEWMSRAPSSIPGVFEDV

SEQ ID NO: 54663 - protein, 393 aa, Methanosarcina acetivorans C2A
MYDVYAVREDFPVLKEVVYLDSTATTQTPIPAVEAMVEYFYKYAGNHGRGAHRLARETTNRYEDARETVARFLNSEPSKTVFTKNTTEGINFVANSYPWEAGDHIVTTLLEHHSNLLPWLRLQKKGVNVTVVSPDRKGIIDPQVIENALTDRTKLIAVTHISNVFGSVQDVIRITKLAHRNEVKVLIDGAQSAGHIPVDLKTLGCDFFATAGHKGLLGPQGTGVLYIKQPEVLESASVGGGTVSGVKGLAYTLEPSPACFEAGTPNIPGVIGLGRAVEYVEKIGVSEIKKHEEKLSREAAKRLSEFEHVEVYGPENRAGIVPFNVKGLHAHDVALILDQTKKICIRSGHHCAIPVTRFLEVESTARASFALYNTEEEVDIFVNAVDALKALVS

SEQ ID NO: 54664 - protein, 163 aa, Pectobacterium carotovorum subsp. carotovorum
SLGFDNFEKLLSGAHAMDKHFASTPAEKNLPVLLALIGIWYNNFFGAETEAILPYDQYMHRFAAYFQQGNMESNGKSADRNGNPVDYQTGPIIWGEPGTNGQHAFYQLIHQGTKLVPCDFIAPAVSHNPLSDHHSKLLSNFFAQTEALAFGKSRDVVEAEFPA

SEQ ID NO: 54665 - protein, 168 aa, Oryza sativa Japonica Group
KEVFWAPAPLTTKSWADVEDDDDDDYFATTAPPRPVWGTGHGDDGAKEEDEEDDDDAVHAALQEEVESEDEDLDDEVDDGAVDEPEHEVDDTSAEPAGKKAAVPVAPPKDTERQLSKKELKKKELAELDAVLAELGISGGSSNAAQDENNAEKKGSNQTGDGDAPAPS

SEQ ID NO: 54666 - protein, 416 aa, Carboxydothermus hydrogenoformans Z-2901
MKKFKVTNKFLQKSLYVLSIIGPGLITVNAGNDAGGIATYAAVGALYGYRMLWGLLLITFSLAVIQEMNARMAVVTGKGLSDLIRENFGVKVTFLAMVILFVANLGVCIGDFAGIAASLELFGVAKFVSVPLMAFFIWYVIIKGSYSRLEKILLLFTVVFFSYIITAFVVKPNWSEVFKATVIPSIIPRKDYILTFIGMIGTTITPYMQFYLQGSIADKGLSLKDYKYEKLDVYFGAFWGDLVSFFIIVTTAATLYKAGIKIETAQDAALALKPLAGQYASLLFGIGLLGASILAAIVIPLSTAYAVTEAFGFERGLDKSFGEAPVFYGIFTFMIFISALLILLPKISLVGIMLATQQLAGILSPIILILMVLLTSKKELMGELVNNRLQSIIVWVTVIFIIILTITLVMASFFNF

SEQ ID NO: 54667 - protein, 594 aa, Picea sitchensis
MGVEGEGSVETALLEEGSISSVQTGKASEDEYTGDGSVDFWGRPSVKENTGNWRACPFILGNECCERLAYYGINTNLVTYLTKRLHQGNAAAAKSVTTWAGTCYLTPLFGAVLADAYWGRYWTIAAFSTIYFIGMATLTLSASVSSLKPPSCIGSDCPTANLAQYGVFFLGLYLIALGTGGIKPCVSSFGADQFDDTDPKEKKKKGSFFNWFYFSINVGALVSSSVLVWVQDNVGWGWGFGIPTLFMGLAIGSFFSGTPLYRLQKPGGSPVTRMCQVVVASLRKLRKTVPLDHSHLYEVQDRNSAIQGSRKLEHTDEFKCLDKSAIITDDDVRKGGFSNPWRLCTVTQVEEMKILLRMFPIWATGIVFAAVYSQISTMFVEQGMTLDTSIGSRFHIPPASLSVFDVVSVMIWVPVYDRVIVPIVSKYTKRERGFTELQRMGIGLFISILAMVAAALVEIRRLNIVKTYDLVYDKGTPVPMSIFWQIPQYFLVGASEVFTFVGQLEFFYDQSPDAMRSLCSALSLLTTALGNYLSSLIVTIVMFATTKGGNIGWIPDNLNEGHLDYYFWVLASLSVLNLLVYVSCAHRYKYKKAS

SEQ ID NO: 54668 - protein, 743 aa, Hyphomonas neptunium ATCC 15444
MKLETFKFDIDADGIAHAIFDVPGRSMNTLTGKAVQDIIAITQEVASNEKITGLVISSGKESGFCAGADLGEMGNRAGAGGEQKKKSEDELKKEQFEAGFALNGTLRKLETCGKPVAVALNGLALGGGLEVALACHYRVAANDNPRIQFGLPEAKIGLLPGAGGTQRLPRLVGVQAALPLILQGESFNAEKAHSMGVVQELAPGAETVARAKAWVKANPKAKAPWDEKGYKVPGGVPHKSPGAGQVATMANMMLASKTYGNYPAQKNILSCIYEGIQVPIDAGLRIETRYFINTQQRPEAKAMIRSLFLSTQALSKGANRPSGFEKAELKKVGIIGAGLMGAGIAYEQARAGIRTVLVDVKQEAAEKGKQYAVRLVEKDISRGKSTKEKGDALLSLITPTTDYKLLEDCDLIVEAVYEDIDLKHKVLADAEAALGENAIVGSNTSTLPITQLSTPLKRKDKFIGIHFFSPVERMGLVEIIMGKETSQETLAKTIDYVLKIRKTPIVVNDSRGFYTSRCFGTYTQEGLEMLSEGIKPAIIENVGRQAGMPMGPLEVSDSVGLDTALKVGRATAKAVGFDYNEAPLGRMMAWIVEDKGRVGRKAGKGFYDYNDQGKPDRIWPDLNEQVEVKIDECPPALKKELTNRLLIRQAIEVSRCFEEGVIQDARDGDIGSILAWGFAPYTGGCVSYMDLIWGVPAFVAEADRLAEKYGERFRPGKLLREMAEKGQSFYERFPPAGEKKAAA

SEQ ID NO: 54669 - protein, 461 aa, Cytophaga hutchinsonii ATCC 33406
MRNYFILLCVIFSNLTLYAQPCWLQIEAGSSFVIAMKADSTLWSWGSNSSGQLGDNTTDNKSIPSQFNTAKGWLKISSGNSHCIGLKKDGSIWTWGWNSEGQLGNGSLTKMLVPTQIGVDNDWMAVSAGQYNTFAIKNNGTLWGCGRNFEGQLGKGTTGSNVKTFIQIGTATDWAYVSVGAFHTMAIKTDGSLWAWGSNNNGRLGIGTTTTKNAPTKVGTATNWKSVYAAGSNTFAIKTDGSLWAWGYNYAGVLGDGTTTDRLSPVQIGTDNNWKTISSDGNTSFALKSDGTLWVWGDNNSGQFGNGTTTNSTLPIQIGTDNQWQHISINYSFLLAIKTDGSLWTWGYNYSGQLGNGTTTNTNLPVLVDCNLSLKVHEAISSENIVVYPNPTAGELTIKIKNQAAQNIHITIMNSVGQILQQKYITDESQLLDLSSQPNGMYLLKIQTTDNQVSLQKIQKF

SEQ ID NO: 54670 - protein, 164 aa, Pectobacterium carotovorum subsp. carotovorum
SLGFENFEKLLSGAHAMDKHFASTPAEKNLPVLLALIGIWYNNFFGAETEAILPYDQYMHRFAAYFQQGNMESNGKSADRNGNPVDYQTGPIIWGEPGTNGQHAFYQLIHQGTKLIPCDFIAPAVSHNPLSDHHSKLLSNFFAQTEALAFGKSRDVVEAEFAAA

SEQ ID NO: 54671 - protein, 426 aa, Hyphomonas neptunium ATCC 15444
MSEIIDIHAREILDSRGNPTIEVDVTLDDGSTGRAAVPSGASTGAYEAHEQRDGDKARYNGKGVLKAVDAVNGEICNELAGMDATEQRLVDTLMIDLDGTENKSRLGANAILGVSLAVAKAAAESSALPLYRYLGGANARILPTPMMNIINGGAHADNPVDIQEFMIMPVSAESISEAVRMGAEVFHALKKTLHDAGHNTNVGDEGGFAPNLASADEAIGFIMKSIEKAGYRPGEDIALALDAASTEFYKNGKYELAGEGKSLSSEQFGQYLADLCGRYPILSIEDGMAEDDWDGWVALTELLGDRVQLVGDDLFVTNPDRLAIGLQKGAANSILVKVNQIGTLSETLDAVELAHLHGYTAVMSHRSGETEDSTIADLAVATNCGQIKTGSLSRSDRIAKYNQLIRIEEELGPIGMYAGLARINAG

SEQ ID NO: 54672 - protein, 372 aa, Gibberella zeae PH-1
MSSTPMDIDRSNTPNGASLNIHRTIGTTASVSNLSDVIGNFRPTKLFRRDDIKETRPQPHVLSLDYDDEGEFVMASASDETIQIYNVKEGRHDKSLVSKKYGVKLAKFTHTNSSIIYASTKQNGGAFVIMEQYPERAVTSLAVHPGSDNFISCSQDNTVLLWDTQTKNYHGKLFLRSPYLAAYDPSGTVFAVACVSSGTVLLYDARNYDKAPFATVDIVEQCRKVDSQCLNKGWTTLEFSNDGKSLLVGTRGNGHFLVDAFEGTLKAYLHKPNGGTRRLAVGEAAQAGGDTNHIESSGECCFAPDGRYVLSGSKKDVLVWDTMAAPDDNKVLKPSWTLPDKREAAVLAFNPRYNFFATADQELLFWLPDPLA

SEQ ID NO: 54673 - protein, 391 aa, Synechocystis sp. PCC 6803
MQFADRLNAFGGNVFADMDLAKAQARAQGQTIIDLSLGSSDLPTPAPILATIAKALEDPSTHGYLLHQGTLPLRQAIAVWYEKRFGLAVDAETEVLPLIGSQEGTAHLPLAVLNPGDVALLMDPGYPSHMGGVYLAGGEIYPMALRSENQFLPVFTAIPNSVLAKAKMTVLSYPHNPTTAIASLEFFQTAVQFCRDHDLVLVHDFPYMDLVFDGIAMPPSVLQADRQKSCAIEFFTFSKSYNMGGFRIGFAIGNIQLISALKKIKAVVDFNQYAGILQGAIAALESPPETVQQTVQIFAQRRATLIDALAKIGWAVPLPTATMYVWAPLPESWLGNSLEFCQKLVAKTGVALSPGSGFGAGGEGYVRFALVQEPDILATAAKKIGQFLDQN

SEQ ID NO: 54674 - protein, 348 aa, Escherichia coli K12
MEFFKKTALAALVMGFSGAALALPNITILATGGTIAGGGDSATKSNYTVGKVGVENLVNAVPQLKDIANVKGEQVVNIGSQDMNDNVWLTLAKKINTDCDKTDGFVITHGTDTMEETAYFLDLTVKCDKPVVMVGAMRPSTSMSADGPFNLYNAVVTAADKASANRGVLVVMNDTVLDGRDVTKTNTTDVATFKSVNYGPLGYIHNGKIDYQRTPARKHTSDTPFDVSKLNELPKVGIVYNYANASDLPAKALVDAGYDGIVSAGVGNGNLYKSVFDTLATAAKTGTAVVRSSRVPTGATTQDAEVDDAKYGFVASGTLNPQKARVLLQLALTQTKDPQQIQQIFNQY

SEQ ID NO: 54675 - protein, 387 aa, Gibberella zeae PH-1
MHPESESVSYCLGENPYLFGTLASGTSFFLTSVEWPIVEISSLARALRPFRDLIPSRLYILLLATDSRLLVPGELGAMSTTVGAFIAGGIAACGAVTATHPFETVKIRMQLQGELQNKGHQPHHYRGPIHGVSVIVRNEGVRKIYRGIGAAYIYQILLNGCRLGFYDPMRNALAKFIFKDGNAQNLGINMFCGAASGVIGAAAGSPFFLVKTRLQSFSKFRPVGTQHHYTGAWHGFKSIYSTEGIGGLYRGVQAAMIRTAFGSSVQLPTYFFAKRRLVRHFGMEEGPGLHLASSAISGFVVCCVMHPPDTVMSRMYNQNGNLYTSAADCFAKTIRSEGIFALYKGFFPHLARILPHTILTLSLAEQTNKLVRKIEGRILPSRMDMAT

SEQ ID NO: 54676 - protein, 193 aa, Enterococcus faecalis
DFQEFMIMPVGAPTFKEALRMGAEVYHALASILKGRGLATSVGDEGGFAPNLGSNEEGFEVIIEAIEKAGYVPGKDVVLAMDAASSEFYDKEKGGYVLADSGEGENTTVDMIAFYVVLVSIYPIISIEDGLDENDWDGFKILTEVLGDKVQLVGDDLFVTNTTKLAEGIEKGIANSILIKVNQIGTLTETFEA

SEQ ID NO: 54677 - protein, 378 aa, Oryza sativa Japonica Group
MDPYTSRAPASGGVAAGDDDEEAACLQAFELMCIFTVPMTLKAAIELGLLDALAAAGDGRALTADELAAARLPDAAPDKAEAASSVDRMLRLLASFDVVKCSTEAGPGGEPPRRRYSPAPVCRLFTAGGNSHRGSLAPSVLFGVDEDYLCTWRQLAAAVGGGGPSAFERAHGMRMFEYMGTNRRLNTLFNQAMAQQSMIVIDKLLDRFHGFDGVGVLVDVGGGTGATLEMITSRYKHITGVNFDLPHVISQAPSIPGVKHIAGNMFESISNIGDAIFLKMILHMQNDEDCIKILKNCHQALPDNGKVIAVEIVLPTIPDLAQTARYPFQMDMIMLSNSRGGKERTELEFAKLATDSGFSGALRTTYILANYWVLEFSK

SEQ ID NO: 54678 - protein, 473 aa, Gibberella zeae PH-1
MADAGAPSNPGQLPPPQAGAGAPGYEAGQNGQPMAPPPLHIPQNNNPIPTAITSPRSADNGGIMSPTSAGGFRRAAPEPNKRALYIGGLDQRVTEEVLRQIFETTGHVQNVKIIPDKNARGYNYGFVEYDDPGAAERAMQTLNGRRVHQSEIRVNWAYQSNTTNKEDTSNHFHIFVGDLSNEVNDEVLTQAFSAFGSVSEARVMWDMKTGRSRGYGFVAFRDRPEAEKALSSMDGEWLGSRAIRCNWANQKGQPSMAQQQAMQAMGMTPTTPYGHHQFPAHGVASYEVILTQTPSWQTTVYVGNLTPYTTPNDVVPLFQNFGFVVESRFQADRGFAFIKMDSHENAAMAICQMNGYNVNGRPLKCSWGKDKTPNAQGGFDPVQPFSPQSAQAPGFPGTPTGYYPQYGAQYGGQPGNYGGPQAGSPAGYAGSPMGYAAPQSAGGYGRGQQPPNAEWAQPRPGQNFNNGFGGYQA

SEQ ID NO: 54679 - protein, 574 aa, Prochlorococcus marinus str. MIT 9312
MKETSPKSNNGTILDINESFKIEFDPISDALAAIRNGECIIVVDDERRENEGDLICAAQFATPQQINFMATEGRGLICLAMQGEKLDSLDLPLMVDRNTDKNQTAFTISIDAGPENNVSTGISAEDRAKTIQVAINPNTKPDDLRRPGHIFPLRAKKGGVLKRAGHTEAAVDIAAMSGLYPAGVICEIQNPDGSMSRLPQLKEYAKQWGMKLISIADLISYRFQTERFVFRKSDAVLPSIFGNFKAYGYINELDGSEHVALVKQKSKKLSEPVLVRMHSECLTGDAFGSLRCDCRPQLEAALSRIEKEEEGVVVYLRQEGRGIGLINKLKAYSLQDGGLDTVEANEKLGFPADLRNYGVGAQILTDLGIKKLKLLTNNPRKIAGLGGYGIEVIERVPLMICPNDNNAEYLSVKRTKLGHMIDVDNSNFRNIDPFISIFLDGNYKSIHLVPIKNKVNKFCKDQNINIKLESTPRLLAFWNRPKLVWRIIHDRNRTNTNITDEEIKNIELLIEFLSKYEDSKKIGIIVSRNIEQALHPKNSIKLINTKFTINNEILYSSTRKFNLDKETFSIVFEG

SEQ ID NO: 54680 - protein, 72 aa, Thermoplasma acidophilum DSM 1728
MIIPVRCFSCGRVIASDYGRYIKRVNEIKAEGRDPSPEEIEKIFDDLGIERYCCRRMIVSHVDLISEIMPFS

SEQ ID NO: 54681 - protein, 527 aa, Prochlorococcus marinus str. MIT 9312
MNEELNSWDKFCNYLWFDKKLNIWLDISKIIFTNDDIVTLEEKFTDVLSSIKELENGAISNIDENRQVGHYWLRNPSISPSSNIGEEISADINEISEFGKQILNGNIKNKNNQKYTDVLWIGIGGSGLGPLLITESLQKCSKGLNFSYIDNVDPFLISEKLEELAEKLSTTLFVVVSKSGGTPEPRIAMEIIKSHCENNSLEWNSNAIAITMKDSKLFNKAISENWLKIFNLQDWVGGRTSITSSVGLLPLALINENIFEFIRGASLMDEATRTSDFKNNPAALLSSAWYLTGDGVGKRDMVVLPYRDRLQVFSKYLQQLVMESLGKKFNRNGEVVNQGISVFGNKGSTDQHAYVQQLRDGIDNFFCIFIELLDSPSTNIFDGKENPKEYLSGFLQGTRSALSSENRQSITITLEKLNCFSLGALIALFERSVSFYAELVNINAYDQPGVEAGKKAAANIIDYQQKVSNLLEKGGEYSINEITSLIDNSVSEPIFFILREMCFGNEDYLVKGDWSNPNSLVIQKRNS

SEQ ID NO: 54682 - protein, 406 aa, Oryza sativa
MAAAATTSSHLLLLSRQQAAASLQCGLSFRRQPGRLAGGSSAPSVRCMAAVDTASAPAATEASKKSSYEITTLTTWLLKQEQAGTIDGEMTIVLASISTACKQIASLVQRAPISNLTGVQGAVNVQGEDQKKLDVVSNEVFSNCLKSSGRTGVIASEEEDVPVAVEESYSGNYIVVFDPLDGSSNIDAAVSTGSIFGIYSPNDECLADIADDQNLDQVEQRCIVSVCQPGSNLLAAGYCMYSSSVIFVLTIGTGVYVFTLDPMYGEFVLTQEKVQIHKAGKIYAFNEGNYALWDDKLKSYMDSLKEPGPSGKPYSARYIGSLVGDFHRTLLYGGIYGYPRDQKSKNGKLRLLYECAPMSFIVEQAGGKGSDGHQRILDIMSTEIHQRVPLYIGNVEEVEKVEKFLA

SEQ ID NO: 54683 - protein, 165 aa, Triticum aestivum
  misc_feature (75)..(75): Xaa can be any naturally occurring amino acid
  misc_feature (85)..(85): Xaa can be any naturally occurring amino acid
  misc_feature (108)..(108): Xaa can be any naturally occurring amino acid
  misc_feature (115)..(115): Xaa can be any naturally occurring amino acid
  misc_feature (118)..(118): Xaa can be any naturally occurring amino acid
  misc_feature (132)..(132): Xaa can be any naturally occurring amino acid
  misc_feature (147)..(147): Xaa can be any naturally occurring amino acid
  misc_feature (151)..(151): Xaa can be any naturally occurring amino acid
  misc_feature (153)..(153): Xaa can be any naturally occurring amino acid
IDQNAQGLARYAIICQENGLVPIVEPEILVDGPHDIDRCAYVTEIVLAACYKALNDQHVLLEGTLLKPNMVTPGXSDSKKVAPGXVLLSYTVRTLQRTVPAAVPALSXLRVGQSXEEXTLNLNAMNNSKTKXPWELSFSLPAALQQXPQAXPXKTENEEKAKALP

SEQ ID NO: 54684 - protein, 331 aa, Vibrio campbellii AND4
MTIKVGINGFGRIGRFVFRAAQERNDIEVVGINDLIDVDYMAYMLKYDSTHGRFNGTVEVEGGNLIVNGKTVRVTAERNPEDLKWGEIGVDVVAEATGLFLTDETARKHITAGAKKVVLTGPSKDATPMFVMGVNDSTYAGQDIVSNASCTTNCLAPIAKVLNDKFGIASGLMTTVHATTATQKTVDGPSAKDWRGGRGASQNIIPSSTGAAKAVGVVLPELNGKLTGMAFRVPTANVSVVDLTVNLEKGASYEAICAAMKEASEGELKGVLGYTEDQVVSQDFIGEVQTSVFDAKAGIALTDNFVKVVSWYDNEIGYSNKVLDLIAHISK

SEQ ID NO: 54685 - protein, 732 aa, Oryza sativa Japonica Group
MAFLGWAVDIARDSGASSSVVLTCDGYGSALYFSPWDSVPLPATASPDDGFLLPRFPDVCVQRSQFTNHLAPANGTGGGGSRTGVKEEASEVLSWPPTSKQSVRRLEVAEHWYRLYKTDNQRLSPDSQQVSVLAESHCDLASGNWKEISIHHKKMPSSTTTKTTTPSRDAWIVSARSDPFHLLLEAQAPLGIKADALSQIAAVHQSHRNTSHIRELSLAMDNAYIIAILSVAILFLLHYYLLGRGNGGAARLPPGPPAVPILGHLHLVKKPMHATMSRLAERYGPVFSLRLGSRRAVVVSSPGCARECFTEHDVTFANRPRFESQLLVSFNGAALATASYGAHWRNLRRIVAVQLLSAHRVGLMSGLIAGEVRAMVRRMYRAAAASPAGAARIQLKRRLFEVSLSVLMETIAHTKATRPETDPDTDMSVEAQEFKQVVDEIIPHIGAANLWDYLPALRWFDVFGVRRKILAAVSRRDAFLRRLIDAERRRLDDGDEGEKKSMIAVLLTLQKTEPEVYTDNMITALTANLFGAGTETTSTTSEWAMSLLLNHPDTLKKAQAEIDASVGNSRLITADDVTRLGYLQCIVRETLRLYPAAPMLLPHESSADCKVGGYNIPRGSMLLINAYAIHRDPAVWEEPEKFMPERFEDGGCDGNLLMPFGMGRRRCPGETLALRTVGLVLGTLIQCFDWERVDGVEVDMTEGGGLTIPKVVPLEAMCRPRDAMGGVLRELV

SEQ ID NO: 54686 - protein, 207 aa, Clostridium thermocellum ATCC 27405
MKLKLNLNLNNARFEITAVRPEQYPKNDLPEITFVGRSNVGKSSLINTMLNRKNLAKVAATPGRTRVINFYNIDDKLYFVDLPGYGFAKVPKTMKTGWKDIIETYLIERKQLKKVIMLVDIRHSPTSDDVLMHEWLKAMRKSYVVVATKLDKIPRTKIKERISDIRSILKLEDDVKIIPFSSETRQGRDELWDEILDESYFVESYFS

SEQ ID NO: 54687 - protein, 260 aa, Bordetella pertussis Tohama I
MHPMLNTAIKAARRAGTIINRASLDLERLTVARKGPRDYVTEVDRASEEVIVEVLRTAYPDHAVLGEEFGLQGPEQAEFQWIIDPLDGTTNYIHGLPNYAVSIALLHRRQVTQAVVYDPSRNELFTASRGSGTFLNDRRVRVSGRIRYHDALLGAHWPHSTDPDQGSGRFRAMAEGSASVRRLGSTVLDLAYVACGRLDGFCGVGLKPWDVAAGSLLVLEAGGLLADFDGEQGWLDTGNVLAGTPKVFTHMLTALQPRTA

SEQ ID NO: 54688 - protein, 275 aa, Larix gmelinii var. principis-rupprechtii
WLTSVICEIWFAFSWVLDQFPKWNPVNRETYIERLSARYEREGEPSQLAGVDFFVSTVDPLKEPPLITANTVLSILAVDYPVDKVSCYVSDDGAAMLSFESLVETAEFARKWVPFCKKYSIEPRAPEFYFSQKIDYLKDKVQPSFVKERRAMKRDYEEYKVRVNALVAKAQKTPEEGWTMQDGTPWPGNNTRDHPGMIQVFLGNTGARDIEGNELPRLVYVSREKRPGYQHHKKAGAENALVRVSAVLTNAPYILNVDCDHYVNNSKAVREAMCI

SEQ ID NO: 54689 - protein, 360 aa, Glycine max
MANFTSFSSSLTHIPPISAPSSSAAFDDSSEDSCSICLEPFSVHDPSTVTCCKHEYHLHCIIEWSQRSKECPICWQSLALKDPASQELLAAVEDEKCMRSRNIANSRAPLGQLNESHDDSCSDDSDFDDQIMKRLVSAARRAHFVQRQERKRSPSAGPSEALGVNSSMHVSGLQTTLTTSSSGGSSPASGVPSTVSIQPPALNTNPDSARRPNTSDMFSFPKSFKSKFSSASARYKESISKGTRDLKEKLLAHNVSVKELSKGVQREMNAGIAGVVRMIERLDLSSKRSSSPLIAVHSGATSDFPSSRKPVEENGIGGSPSKESGGAVHDVSSDVLPLVTNMQSFQTETPPFVQSGHGKL

SEQ ID NO: 54690 - protein, 311 aa, Colwellia psychrerythraea 34H
MAKSPQQPVIQSILDDAYHKFENDTSGKNADYIPALAKVDSAYFGLAVVTPHGKIYTKGDVSQPFSIQSISKVFTLALAMEQKGPQTIVDKIGVNATGLAFNSVTAIELNKARSVNPLVNAGAIATVSLLDGKNEKAKWSALSAWYDKFANRKLSVLEDVYKSESDTNGHNRAIAELLTSYDRFYGDVDLNLAIYTRQCSVAVTTKDLAVMASVFANNGVHPLTDKRLMSSDNVSRVLAVMTTAGLYENSGQWAYQVGLPAKSGVGGGIIAVSPGKFAVAVFSPRLDSAGNSIRAQKAIDYIAEKLHANIF

SEQ ID NO: 54691 - protein, 520 aa, Coccidioides posadasii
MGLLANVLTGVSKACSGQSLWTLVLLGICAFFTLSVFVNVLKQVFFKNPNEPPVVFHWFPIIGSTISYGIDPYKFFFSCQKKYGDIFTFILLGKKTTVFLGTKGNDFILNGKLKDVCAEEVYSPLTTPVFGRHVVYDCPNAKLMEQKKFVKFGLTSEALRSYVTLITREVESYLENSPAFQGDSGVFNVAKSVAEITIYTASRSLQGKEVRDKFDSSFAELYADLDMGFAAINFMFPWAPLPHNRKRDRAQQKMTQVYTDIIRERRKAGGKKDSEDMVWNLMSSVYKDGTPVPDVEVAHMMIALLMAGQHSSASTGSWIVLRLASRPDILEELYQEQLRVLGPDLPPLTYESLQRLELHSNVIKETLRLHAPIHSILRAVKSPMPVDGTKYVVPTSHNLLAAPGVPSRMADYFPEPMLWDPHRWEKGGGVNATGVQDEAAEEKVDYGYGLVSKGANSPYLPFGSGRHRCIGEQFAYVQLGTITAALVRALKLRKLDGDKEVPDTDYSVSLTLLFSSARSH

SEQ ID NO: 54692 - protein, 181 aa, Gossypium hirsutum
MGLSFAKLFSRLFAKKEMRILMVGLDAAGKTTILYKLKLGEIVTTIPTIGFNVETVEYKNISFTVWDVGGQDRIRPLWRHYFQNTQGLIFVVDSNDRDRVVEARDELHRMLNKDELRDAVLLVFANKQDLPNAMNAAEITDKLGLHSLRQRHWYIQSTCATSGEGLYEGLDWLSNNIANKG

SEQ ID NO: 54693 - protein, 270 aa, Polaromonas sp. JS666
MKTIVITGASDGIGAEMARQLAQTHRTGVALVLAARNEALLAEVAAQCAAHGAQTLVVKTDVSVEAQCRQLIAAAVARFGRIDALVNNAGRSAQALFEDVKAEDLAWYEQLMRINLWGSVWCTHAALPHLKQSRGAIVAVSSLAGLIGVPGRTAYSATKFAMTGFFEALRAELKGAGVSVTTVYPGVVATQTRYRGFNAAGAPADASGLKEDQAMSVEECAGLILQGMARRDREVVMTAKGRLGRWLKLVAPARVESMALAALKDEVKPH

SEQ ID NO: 54694 - protein, 413 aa, Azoarcus sp. BH72
MASHIMLTSHNRGRSGRAPAVEWGATSARARGPLIASLGEPGLRNVIGTHAGAYSVYRALAVASGQLQRDHRPDLTDTAPAVAIGPHPQWSDPGAIVSLDPWGHRVAEEFAHLIAAGMDIRPTIAVTTAHINMPELQAAIAAGRLRADGTVLAANGDVRVTKAAIDPVWYLPGIAERFGIRETALRRALFEQTAGMFPELVTRPDLKVFLPPIGGMTLYFFGDVAKLGRPETKVACRVHDECNGSDVFGSDICTCRPYLAHGIEVCVEMAQQGGVGLVVYNRKEGRALGEVTKFLVYNARKRQRGGDRAETYFERTECVAGVQDMRFQQLMPDVFHWLGIRRIDRWASMSNMKHGALAAAGIEVVERVAIPDALIPPDARVEMDAKVAAGYFSVEAPPAEAELALAKGRGLHE

SEQ ID NO: 54695 - protein, 527 aa, Ajellomyces capsulatus
MGHLADVVARVCAHCSTLSLWALLLAGSATFIVLSVIINLLHQLLWKNPNEPPVVFHWFPIIGSTISYGIDPYKFFLDCREKYGDIFTFVLLGKKTTVFLGTKGNDFILNGKLKDVCAEEVYSPLTTPVFGRHVVYDCPNSKLMEQKKFVKYGLTSESLRSYVTLITDEFNRYIKTSPAFQGDKGVLDVCKSVSEITIYTASRSLQGKEVRSKFDSSFAQLYHDLDMGFTPINFMFPWAPLPHNRKRDAAQQKMSKIYTDIIRQRREAGVKKDSEDMVWNLMSCVYKDGTPLPDIEIAHMMIALLMAGQHSSSATLSWIILRLASCPHIIEELYEEQKRVLGEDLPPLTYETLQNLNLNSHVIRETLRIHAPIHSILRAVKSPMPVDGTRYTIPTTHNLLAAPGVTSRLPEHFPNPMTWDPHRWENPAMAQVEDQSDEKLDYGYGLVSKGANSPYLPFGSGRHRCIGEQFAYVQLGTLLVAIVRQLKLKKLDGETGVPETDYSVRPPRDPFFWPDVSCFLTFGRLRC

SEQ ID NO: 54696 - protein, 237 aa, Hyphomonas neptunium ATCC 15444
MTKLALIRHGQSAWNLENRFTGWWDADLTAQGEAEARHSGKLLAEVDADFRAGFTSVQTRAIRTMWLALTEMKRVWLPIEKDWHLNERHYGGLTGLNKAETAAKHGEDQVHVWRRSYDIPPPPLEVGSTFDLSTDPRYRGIDIPNTESLKTTLDRVLPYWQQKIAPGLIAGTDTMIAAHGNSLRALVKHLFNVPDETITGLEIPTGNPLLIELDPNLKPVSVRYLDAERAHSLPDLP

SEQ ID NO: 54697 - protein, 531 aa, Coprinopsis cinerea
MGLDLVKLGFFLAVVPVATILLNVLRQLLFPTRAPNPPEVFHWIPIVGSALQYGNDPINFFFKCREKYGDVFTFILLGRRITVALGPKGNNFILGGKSTVFNAEDAYTHLITPVFGKDVVYDVPNEKFMQQKRFIKAGISTENLRAYVGMIEEEVEDFLEKDPSFATYQQRNPANEWGRFNAVKTMQEITILTASRTLQGREVRSSLTKEFAQTYNDLDGGLTPLNFLFPNLPLESYRRRDRAQKKMSDFYIDIIKKRKLAQVEEVEHDMIASLSEQRYRSGAPLPDHEIAHIMIALLMAGQHTSSATSSWALLHLAHNVEVAYVSEALYNEQVEHFSNPDGSFRPLTYDELRALPILDSVIRETLRMHPPIHSIMRYVRDDVVVPGSLAAASEDKTYVIPKGNYVLASPVVSQMDPRIWRNPEKWEPARWSDPNGVAAQAYSTYVDGNGEKIDYGFGAVSKGTESPYQPFGAGKHRCIGEQFAYLQLGTLIATIIRKLELRVDKVPEHNYHVGSSVFCCHTPGNAHMARY

SEQ ID NO: 54698 - protein, 491 aa, Bacteroides fragilis NCTC 9343
MATQNKTDIGLIGLAVMGENLALNMESRGWSVSVYNRTVPGVEEGVVERFINGRAKGKHIEGFTDIEAFVESIALPRKIMMMVRAGSPVDELMEQLFPYLSPGDILIDGGNSNYEDTNRRVKLAESKGFLFVGAGVSGGEEGALNGASIMPGGSEKAWEEVKPILQSIAAQAPDGTPCCQWVGPAGSGHFVKMIHNGIEYGDMQLIAEAYWVMKELLDMTNEEMASVFTRWNEGKLRSYLIEITGNILRHKDKTGAYLIDKILDAAGQKGTGKWSVINAMELGMPLGLIATAVFERSLSARKELREAAARQYQCRHSMAVYNKQDTEKEIFSALYASKLVSYAQGFAVLQRASDTFGWNLDLASIARMWRGGCIIRSVFLNDIAAAFEAKEKPKHLLLAPYFEEEIKGLLSGWKNLVAQAMREELPVPAFSSALNYFYSLVSADLPANLVQAQRDYFGAHTFERKDELRGVFFHENWTGHGGDTKSGTYNV

SEQ ID NO: 54699 - protein, 515 aa, Zea mays
MDGLVAPSPSHSGATSGGGASHRKRKLPPSSLSDATGDEDDDTTAPSSPSTAPSSPSRPSSPSSSHSDDDDDDSLHTFNAARLDGAPSGGSASGRPPKPDSSSVSAAAAAAAAAVGGGPKPEPGSANAGDGKEDTKGLFTDNLQTSGAYSAREEGLKREEDSGRLKFLCYSNDGVDEHMIWLVGLKNIFARQLPNMPKEYIVRLVMDRTHKSMMVIRNNIVVGGITYRPYASQRFGEIAFCAITADEQVKGYGTRLMNHLKQHARDADGLTHFLTYADNNAVGYFVKQGFTKEITLDKERWQGYIKDYDGGILMECKIDPKLPYVDVATMIRRQRQAIDEKIRELSNCHIVYSGIDFQKKEAGIPRRLIKPEDIPGLREAGWTPDQLGHSKSRSSFSPDYNTYRQQLTTLMQTALKNLNEHPDAWPFKEPVDSRDVPDYYDIIKDPIDLRTMLRRVDSEQYYVTLEMFVADMKRMFSNARTYNSPDTIYYKCATRLENFFSGRITVLLAQLSTKS

SEQ ID NO: 54700 - protein, 679 aa, Glycine max
MTSGSCIGISTMKPCCRILCNYKSPSIFGFSPTKLSDSAIMGMLSRSCRHNSTHRHRYNTCNTQNVGYINGIHPNRRDFSVSGSNWGLARNFSTSFCVNIGSFRPRVVSLIPHVASDFRNHSTSVDSNANDTSFEKIFIQSSLNVKPLIIERIETDQSKLEEVAEERCDESNVNIDNLKDLSENKVQREVSEIEKEAWKLLQDAVVTYCGNPVGTVAANDPADKQPLNYDQVFIRDFVPSALAFLLNGEGEIVKNFLLHTLQLQSWEKTVDCYSPGQGLMPASFKVRTVPLDGSNEAFEEVLDPDFGESAIGRVAPVDSGLWWIILLRVYGKLTGDYALQERVDVQTGIRLILKLCLTDGFDMFPSLLVTDGSCMIDRRMGIHGHPLEIQALFYSALRCSREMLIVNDATKSLVAAVSNRLSALCFHMREYYWVDMKKINEIYRYKTEEYSTDAVNKFNIYPEQIPSWLVDWISEEGGYFIGNLQPAHMDFRFFSLGNLWAIVSSLGTTRQNQGILNLIEAKWDDIVAQMPLKICYPALEGEEWRITTGCDPKNTPWSYHNGGSWPTLLWQFTLACIKMGRPDLAQKAVDSAEKRLSADRWPEYYDTRNGRFIGKQSRLMQTWTIAGFVTSKMLLENPEKASLLFWEEDFELLQNCVCKLSKSGRRKCSRFAARSQFIV

SEQ ID NO: 54701 - protein, 353 aa, Alkaliphilus metalliredigens QYMF
MWEGIISKYSSYFGVADGEKVITLNEGNTPLIAAENIGEMLGGIKLYLKYEGLNPTGSFKDRGMTMAVSKAVEAGSKAIICASTGNTSAAAAAYAAKAGIQCFVLIPNKKIALGKLSQAVIYGAKIIPVEGNFDDALRIVQEIAAEGRVTLVNSVNPYRLIGQRSGAYEVCEQLEGEIDYLSIPVGNAGNISAYWAGFKDYFEAGKLKKLPVMLGFQAEGAAPIVENRIFENPETVATAIRIGNPASWEKAVAARDDSKGLIDKVTDEEILSAQRLLASKEGIFVEPASAASVAGVIQLSKKGYFKKGQKVVCVLTGNGLKDPSVVDVEKELKVYGVHTEEIKILINECLGGE

SEQ ID NO: 54702 - protein, 463 aa, Zea mays
LRSSGAHLGNSRTRSLLQIGDRNEDGLFHLPHTRAPPAPAPESAPAPSPSMSPPDSSPSPSPHGSHPMPRQSTSHRHPSITPPHLVRPGPRQDGNDPLVYTPAHSRHKHFWTTYGLVAAGIAVFLLVSAASILCFRAKKMGTVRPWATGLSGQLQKAFVTGVPSLKRSELETACEDFSNIIGSTSTCMLYKGTLSSGVEIAVASSLVTSAKDWSKENESQYRKKITNLSKVSHKNFMNLLGYCEEEHPFTRVMVFEYAPNGTLFEHLHVREAEKLDWMARLRISMGIAYCLEHMHQLQTPAALRNFDSTTVYLTDDFAAKVSDLEFWNDAKGHNSTTNNELAFSPDTEDIVRKYGMVLLEILTGRVPSSEDDGPLENWVSRYFEGGMRLEELIDPSIGFFPEDTARALCEVVRSCIDRDPKKRPQMKEVAARMREITALGPDGATPKVSPLWWAELEIMTSES

SEQ ID NO: 54703 - protein, 368 aa, Oryza sativa Japonica Group
MATSPRSPPGAPPPPEFEISRQSRLLAALSKKVIDLDELRMLAAQGVPDGAAVRPTVWKLLLGYLPSDRALWEQELAKKRSQYAAFKEEFLSNPMEIARQRELEGQGSENAGSIYNGLLHRSEVTQEEHPLSLGKTTAWNQFFEYSEIIEQIDRDVKRTHPDMHFFCGDSSFAKSNQESLKNILIIFAKLNAGIRYVQGMNEILAPLFFVFRNDPDDKNANFAEADSFFCFMELLSGFRDNFCQKLDNSAVGIQGTLSKLSQLVAKYDGELQRYLEITTEINPQFYAFRWITLLLTQEFNFADTIHIWDTLLSDPDGPQETLLRICCAMLILVRKRLLAGDFTSNLKLLQNYPPTNISHLLYVANKLH

SEQ ID NO: 54704 - protein, 264 aa, Staphylococcus aureus subsp. aureus COL
MQLYYLGPKGTFSYLACRQYFSENEATFQPKSNFFEVIKAVADDDTSIGVVPIENSIEGTINIVADALAQQDVFAHGEIRLDINFALYGNGTDSISDIKKVYSIAPAISQTTNYIHQHQFDYDYVDSTIQSLTKIENGVAAIAPLGSGEAYGFTPIDTHIEDYPHNVTRFLVIKNQQQFDQNATSLMFLITPMHDKPGLLASVLNTFALFNINLSWIESRPLKTQLGMYRFFVQADSAITTDIKKVIAILETLDFKVEMIGAFN

SEQ ID NO: 54705 - protein, 764 aa, Colwellia psychrerythraea 34H
MNNEVNSTAENSITKAYGNDAAEAKVTDEKVSEHNDPVEPTGSAFTIVRHDNGIAHLVIDVIGENVNTLKAEFTEQVNAVLAEIKVDKAITGIVLCSGKKGSFVAGADINMLDACQSRDEVVALSRQGQRIFSLLEQLPIPIVAAIDGACLGGGLELAMACHARVCSDNSKTALGLPEVQLGLLPGSGGTQRLPQLVGLQKALDMMLTGKQLRAKQALKSGLVDDVVPSSVLLTVAEDLAISLRQRGKKTVKRKQGLMDKLLENNAVGRKVVYQQAQKTVLAKTQGNYPAPAKIIDCIRTGIESSPEKGYRVEAEHFADLVMSDESAQLRQLFFATTAMKKEQGVADVMPEKMTKAGVLGGGLMGGGIAFVTATKANMPVRVKDISHKGIGQALKYSYQILNKKVKRRFLLNSEMQKQLAMITGSVEYTGFKALDIVVEAVFEDLTLKQNMVAEVEAQGHDKTIFASNTSSLPIGKIATNAKRPENVIGLHYFSPVDKMPLVEIIPHDKTSDQTISNTVAFAKKQGKTPIVVKDKAGFYVNRILAPYMNEAAILLLAGEPIDKIDKALVKFGFPVGPMQLLDEVGVDVGAKIGPILQADLGERFAAPAAFDKLLADGRLGKKVKKGFYQYEKPTFTKNLQNTFKGIKSGHKQVDETIYSLLNIKPMGSLSAVEISKRCTYMMLNEAARCVDEGIVRNARDGDIGAIFGIGFPPFLGGPLRYIDKIGAKSVVAQLSQWAEQHGERYTPCEALITMAENDAVYYPK

SEQ ID NO: 54706 - protein, 512 aa, Escherichia coli W3110
MTNNPPSAQIKPGEYGFPLKLKARYDNFIGGEWVAPADGEYYQNLTPVTGQLLCEVASSGKRDIDLALDAAHKVKDKWAHTSVQDRAAILFKIADRMEQNLELLATAETWDNGKPIRETSAADVPLAIDHFRYFASCIRAQEGGISEVDSETVAYHFHEPLGVVGQIIPWNFPLLMASWKMAPALAAGNCVVLKPARLTPLSVLLLMEIVGDLLPPGVVNVVNGAGGVIGEYLATSKRIAKVAFTGSTEVGQQIMQYATQNIIPVTLELGGKSPNIFFADVMDEEDAFFDKALEGFALFAFNQGEVCTCPSRALVQESIYERFMERAIRRVESIRSGNPLDSVTQMGAQVSHGQLETILNYIDIGKKEGADVLTGGRRKLLEGELKDGYYLEPTILFGQNNMRVFQEEIFGPVLAVTTFKTMEEALELANDTQYGLGAGVWSRNGNLAYKMGRGIQAGRVWTNCYHAYPAHAAFGGYKQSGIGRETHKMMLEHYQQTKCLLVSYSDKPLGLF

SEQ ID NO: 54707 - protein, 627 aa, Ostreococcus tauri
  misc_feature (421)..(427): Xaa can be any naturally occurring amino acid
MALVRRRGLDLVTLVGRCASGASIGSVGGANGGRFRTTLTSAGVAGVAGRADGRDDARRETRSSGVTPYSSVRTFAKNTAGDTAKAGEGKDKNVLDNLLRTHDVILLHEELEASARQRDTMGLDELRELVRNSASPPRSPAETAEKLQLLQDSGMILVLEDLVYLRPREVTSAVLRALPGVPSKVYGMKQNELEEMQQEFEALRNNYDQARRRAESRSRMIISSGLVLLCCQLAMFIRLTYYEFSWDVMEPISYFVGLSNAIMAYSYYLWNRRDFTFESWQRQLEGKYSEDILRSRGFNLERYIILARRLPIAQPSSPHSPSRARHRARDAPDERARRTARAPPHERANAPCAPSPHARTRREYPAKMPQVPLVCHGHSRPIVNLEYSRVTPDGVFLISSSKDGQPMLRCGDSGDWVGTFXXXXXXXIVKSVCFSENGERLLTGGAEKLLRIYDLNKPEADPYAMAGHASSIKTASFIHNDELILSSCAEDKGIRVWDVRTNTVVTTLSTESPVMSIEVSADGKHMTTADGKDVTFWDLQNFSKIQKWTMEYEVESASVSLKHRKFVAGGPDMWVHLHDMETGAEEQTNKGHHGPVHNVRFAPDQNSYCSGSEDGTIRIWQTVEPKD

SEQ ID NO: 54708 - protein, 533 aa, Lentinula edodes
MLPFVSLLAAELVCLVYGAEVIRDTTTYGQTVSENLFIVNKQLAPDGFQRSTVLAGLTPSTGSFPGPLISGNKGVRFNLNVTDQLTDPSMVRSTTVHWHGLFQKTTNYADGVAFVSQCPIAANHSFLYDFQVPDQAGTFWYHSHISVQYCDGLRGPLVIYDPQDPQAYLYDVDDETTVLTIADWFHNTSTELIAAAVAPPADATLINGKGRYLGGPAVPLAVINVQQGKRYRFRMISIACDAYHNFSIDGHRLTVIEVDGENHEPATVDNIQIFPGQRYSFVLTATQPVDNYWVRALSSSGVGFSGFTGGLNSGILRYQGAPDADPTTTNSTGVVLTESMLHPLENPGAPGLPFPGGADEVLNLTLGFNLPATFFMNDTQYIPPTVPVLLQILSGAQSPQDLLPPGSVYTLPINKTIEINFFGNATPGGPHPFHLHGHSFDVVRSADNTTYNYKNPVRRDVTAVAIGNQTTIRFVTDNPGPWFLHCHIDLHLEFGLAVVMAEAPSLVKATDVTTPAWDELCPIYDSLTPAQLP

SEQ ID NO: 54709 - protein, 548 aa, Lentinula edodes
MFLINVVFGFWLLCVPTSLRLVSGVEIVKSHPRDKIWHEKIDHHDQLFIVNKDIAPDGFQRSTVLAGRTPQDASFPGPLITGRKGDRFTINVTDLLTDPTMDRSTSIHWHGLFQKTTNYADGVAFVSQCPIATNHSFLYDFGVPDQAGTFWYHSHLSVQYGDGLRGPIVIYDPEDPHQDLYDVDDESTIITIADWFHLTSLQLLAALVVPNADATLINGNGRYVGGPDTPLTVINVEHGKRYRFRLIDMSFDAFHGFSIDNHNLTIIEVDGINTLPHTVNFIEIYPAQRYSFVLNANRPISNYRIRALSNTGVGAHNFTNGVNSAILRYVGAPEEEPQTSQPLSSNVMIFREGDLHPLENPGAPGNPYPGGADLVLNFTLGFDAEMVLFSMNGVVFESPTVPVLLQILSGAHHAQDLLPKGGVHTLPPNKVIEINFFGGDAPAGPHPFHLHGHAFDVVRTSDSSEYNFKNPVRRDTTLVAMKNQTTIRFVTDNAGPWFLHCHIDLHLSLGLAVVLAEDTRDTKKDDMIPADWKGLCPIYNSLTPSQLP

SEQ ID NO: 54710 - protein, 324 aa, Burkholderia pseudomallei K96243
MTAAVERAAGGASPARAGRVMVVGSLNMDLVVRSARLPRPGETLAGRSFAQAAGGKGGNQAVAAARLGAQVAMLGRVGADAHGAALRAGLVAEGIDCVALSVSATATTGVALIVVDDASQNAIVIVAGSNGEVTPESIAGHEAAIAAADVLICQLETPAAAVRAALAAGRRLGKTVVLNPAPAAGPLPADWLPLVDYLIPNEIEAAALTGLPVRDPASAETAARALAAAGARNVIVTLGGQGVLALTADGDARHYPAPRVAPVDTTAAGDTFIGGFAARLAARDAPHDAIRFAQRAAALSVTRAGAQPSIPTLAELDAFAPGPA

SEQ ID NO: 54711 - protein, 421 aa, Bordetella pertussis Tohama I
MSLIVQKYGGTSMGSVERIKNVARRVAKWHAAGHKVVVVPSAMAGETNRLLSLAREISPQPDGRELDMIAATGEQASSGMLAIALQAEGVPARSYAGWQVPVRTDSSYTKARIKSIDDKRVLADLDAGRVVIVTGFQGVDDDGHITTLGRGGSDTSAVAVAAAIKADECLIFTDVDGVYTTDPRVVPEARRMAVVSFEEMLEMASLGSKVLQIRSVEFAGKYHVPTRVLSSLTDPLIPLEEEMRSGTLITFEEDEKMEAAVVSGIAFSRDEAKITLLAVPDKPGIAYSILGPVAAANIDVDMIVQNQSVAGTTDFSFTVNRNEYQRTLDLLKREVIPAVSARELVTDEKVAKVSIVGIGMRSHVGVASLMFQTLSQEGINIQMISTSEIKTSVIIDDKYMELAVRSLHKAFGLDQVPGDQV

SEQ ID NO: 54712 - protein, 115 aa, Triticum aestivum
  misc_feature (56)..(56): Xaa can be any naturally occurring amino acid
  misc_feature (99)..(99): Xaa can be any naturally occurring amino acid
MASSSDPWMKEYNEASRLADDISSMIADRGSLPQSGPEIMRHTSAIRRKITILGYXDWDSLGVIVWARIPPKSITDKEMHKRQDMLSSLKSKAKQMATXFNMSNFANKEVLLGQS

SEQ ID NO: 54713 - protein, 174 aa, Oryza sativa Indica Group
MDSSNNNNNKRARDAEDEADEAKRLRAEDLLDMLDDDTDAGGAAGDLASVMRSFEEEIVAGDVAGDVAPTTQPELGFLLEASDDELGLPPATASSSEEEAGAGEPEDAIGFGGQIWGFEDEIGGGGYAGFALTSPEAVAAAAAAAEWDDDGFDAGLFGFGDEVSALRHETMPAV

SEQ ID NO: 54714 - protein, 334 aa, Synechocystis sp. PCC 6803
MTKIFADSSINPLSVAPMMDHTDRHFRYFLRQLTRHTLLYTEMITAQAILHGDRQRLLNFSPEEKPVALQLGGDDPQLLAECARIGQDWGYDEINLNVGCPSDRVQSGNFGACLMAQPDLVAQCVSAMQKAVEIPVTVKHRIGIDHRDSYEDLVHFVEIVANAGCQRFTVHARKAWLQGLSPKENRTIPPLRYEDVYQLKKDFPQLLIEINGGITQTEQIQQHLSHVDAVMVGRAAYENPYLFATVDRDIYHKTNLVPSRAEIIERMLPYVEERLRHGDRLNQITRHLLSLFNGQPRAKFWRRTLSDSTLLASAGPELLQTALQAQKFPGVLVA

SEQ ID NO: 54715 - protein, 517 aa, Agaricus bisporus
GLIGGILSLRSFQEYLGINTKNAVKKAILDGNIISVLQAGCFFGALGTGYLSSRFGRRPCLIASGIVYITGGLLQCTVGLGPSQAAALHVFYIGRFISGIGVGMVSTLVPLYISECVPRTIRGRCTGTLQFATNSGLMLGFWVNYSVSKNVPFGEMQWRIPLIIQMIPSLLFIIAMFFQPESPRWLVEHGKHKEAATVLARTGGKDVDHPSVVQTLEEIKQEFVASKQPSFLKQIRLVGESRAVALRCFIPPLVMFFQQWTGTNAINLYSPEVFRHLGIHGTSGALFATGVYGVVKVVSVALALTFAVERFGRKRGLIFGGIGQALMMFWLGGYSATHQDGTVSPASHVSIVALYLYGAFFSMGWGPLPWVVAGEVAPNHVRSFALSIAVGTHWLFGFVISKVTPIMLDRIKYGTFLLFGFCCMIVATWAYFCLPETSGFALEDIKYLFERDVIIRSLQDAPGGKIFLGGRRVESVASLKERRVGVAGEQGEKITGLNSELEDVSSKKSTLKETSSV

SEQ ID NO: 54716 - protein, 689 aa, Nocardioides sp. JS614
MPRTELPLVVNVSLAGRERDYDETVTFLHRRFRIRRIGTDGDLAAAEELVRAMAPRATAIAVSGLREAKASGLYDGELTAIERVVRATDAVPVTDGHALLGVLQEWAVRRVQTELPGYFDNARTVVLGGQNHERTTRILREYTANLEFADPLLRLDLPARLDANPLLAVAADLGRSSLGLLPGLVRAQLQAPGQVVSHALARRAARDCDVVVGTYEELAGFGLEDLAGKTLISRSISAERLTELGDRGVDMVIDVTPQPFGVTVSAAVLEALMLATVHASGRLTNDDLLEMIAAAGFEPRVLYPNGFKRKSRFAFVIHPLSQQYFNNVEPLRTLSKIAPGVVMDAVEKAVAYAPPFTYSHVTGIVSPTGAEAEGWLISVGGTPKELMAHSPEFTYGRLLAAAETARRLGAQIMGLGAFTKVVGDAGVTVAKKAPLPITTGNSYSAAGALWAAHEALLQLGLAPVDDQGHLKGKAMVVGATGAIGSVCARLLALASAELWLVSPESAKLLALKQEIQRENPRAKVHVAATPDDHLAAMDLIVTATSGAGKRVLDIMAVKPGCVITDVARPLDLSAEDVARRPDVLVVESGEIELPGDVRMKNIGLPKNVAYACLAETVVLALEGRYETFTVGRNIEWPKVKEIYKLGLKHGMRLATISGVNGIYTAEHIAGIRERALAARAAAGASRTGS

SEQ ID NO: 54717 - protein, 547 aa, Aspergillus fumigatus
MSSYGGGYQRESRGDSYRGGHDTGYQNGNGYSGGYSGGGGYGGGYGGGYGRGGGAAGGDRMSNLGAGLKKQDWDLDSLPKFEKSFYKEHPDVAARSEREVEEFRKKHEMTVQGRNVPRPVENFDEAGFPQYVLSEVKAQGFERPTAIQSQGWPMALSGRDVVGIAETGSGKTLTYCLPAIVHINAQPLLAPGDGPIVLILAPTRELAVQIQAEISKFGKSSRIRNTCVYGGVPKGPQIRDLSRGVEVCIATPGRLIDMLEAGRTNLRRVTYLVLDEADRMLDMGFEPQIRKIVSQIRPDRQTCMWSATWPKEVRQLATDFLNDYIQVNIGSMDLSANHRITQIVEVVSDFEKRDKMIKHLEKIMENRSNKCLIFTGTKRIADEITRFLRQDGWPALSIHGDKQQQERDWVLNEFKTGKSPIMVATDVASRGIDVRDITHVLNYDYPNNSEDYIHRIGRTGRAGAKGTAITFFTTENSKQARDLVTILTEAKQQIDPRLAEMARYSGGGGGHGGYGRWGGRGGRGGGRGRGGTYTASNAAPLGNARRW

SEQ ID NO: 54718 - protein, 562 aa, Candida albicans
MSYNNGGYNNRNGGSYGGGYGGGGSRGGRDGYSGGGRGGGYGGGDRDQGGYRGGRFSGGGRGGGRFNDAPRQELTAPQWDLEQLPKFEKNFYSEHPDVAARSDRDIEQFRKENEMTVKGHDIPHPITTFDEAGFPDYVLQEVKDQGFPKPTPIQCQGWPMALSGRDMIGIAATGSGKTLSYCLPSIVHINAQPQLQYGDGPIVLVLAPTRELAVQIQTECSKFGKSSRIRNTCVYGGAPKGPQIRDLARGVEICIATPGRLIDMLEAGKTNLKRVTYLVLDEADRMLDMGFEPQIRKIVDQIRPDRQTLMWSATWPKEVQQLTRDYLNDPIQVTIGSLELAASHTITQLVEVIDEFSKRDRLVKHLESALNEKDNKILVFASTKRTCDEITTYLRSDGWPALAIHGDKEQNERDWVLDEFRKGKTSIMVATDVAARGIDVKGITHVINYDMPGNIEDYVHRIGRTGRGGASGTAISFFTEGNSKLGGDLCKIMREANQTVPPELQRFDRRSYGSHMRFGQGRGGRGGRGGRGGRGGRGGYGGGGGYRSTGGNSAPLGGNRRF

SEQ ID NO: 54719 - protein, 589 aa, Dunaliella salina
MGSRRITLLGALFAVLAVAIEGRTLLTHNLKAEAAETVDAVSSVVAGSAGRQLLVSEPHDYNYEKVGFDWTGGVCVNTGTSKQSPINIETDSLAEESERLGTADDTSRLALKGLLSSSYQLTSEVAINLEQDMQFSFNAPDEDLPQLTIGGVVHTFKPVQIHFHHFASEHAIDGQLYPLEAHMVMASQNDGSDQLAVIGIMYKYGEEDPFLKRLQETAQSNGEAADKNVELNSFSINVARDLLPESDLTYYGYDGSLTTPGCDERVKWHVFKEARTVSVAQLKVFSEVTLAAHPEATVTNNRVIQPLNGRKVYEYKGEPNDKYNYVQHGFDWRDNGLDSCAGDVQSPIDIVTSTLQAGSSRSDVSSVNLNDLNTDAFTLTGNTVNIGQGMQINFGDPPAGDLPVIRIGTRDVTFRPLQVHWHFFLSEHTVDGVHYPLEAHIVMKDNDNLGDSAGQLAVIGIMYKYGDADPFITDMQKRVSDKIASGAITYGQSGVSLNNPDDPFNVNIKNNFLPSELGYAGYDGSLTTPPCSEIVKWHVFLEPRTVSVEQMEVFADVTLNSNPGATVTTNRMIQPLEGRTVYGYNGAAA

SEQ ID NO: 54720 - protein, 192 aa, Staphylococcus aureus subsp. aureus Mu50 [sequence omitted]

SEQ ID NO: 54721 - protein, 487 aa, Salmonella enterica subsp. arizonae serovar 62:z4,z23:--
MSLSKDNIWKLLAPLVVMGVMFLIPVPDGMPPQAWHYFAVFVAMIVGMILEPIPATAISFIAVTICVIGSNYLLFDASELADPAFKASKQALKWGLAGFSSTTVWLVFGAFIFALGYEVTGLGRRIALFLVKFMGKRTLTLGYAIVIIDILLAPFTPSNTARTGGTVFPVIKNLPPLFKSFPNDPSARRIGGYLMWMMVISTSLSSSMFVTGAAPNVLGLEFVSKIAGVQISWLQWFLSFLPVGIILLIVAPWLSYVLYKPEVTHSAEVAAWAGDELKSMGRLSRKEWTLIGLVLLSLGLWVFGGKIINATAVGLLAVSLMLALHVVPWKDITRYNSAWNTLVNLATLVVMANGLTRSGFIDWFANTMSTHLEGFSPDATVIVLVLVFYFAHYLFASLSAHTATMLPVILAVGKGIPGVPMEQLCILLVLSIGIMGCLTPYATGPGVIIYGCGYVKSRDYWRLGAIFGVIYIAMLLLVGWPILAMWN

SEQ ID NO: 54722 - protein, 569 aa, Clarkia gracilis
MSTPALISETEAWKDLKAHLEDIKRTHLRELMGDTERCQSMMVEFDNIFLNYSRQQASPDTINKLYKLADAAHLNQKIDRMYNGDHINSTENRSVLHVALRAPRNSAICSDGKNVVPDVWNVLDKIKDFSERVRNGSWVGATGKELKDVIAVGIGGSFLGPLFVHTALQTDPEASKNARGRELRFLANVDPIDAARNISGLNPETTLVVVVSKTFTTAETMLNARTLREWISSALGVSAVAKHMVAVSTNLPLVEKFGIDPNNAFAFWDWVGGRYSVCSAVGVLPLSLQYGFAVVEKFLQGAHSIDQHFSSAPFEKNIPVILGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLILHKIFTGNRPSLSILLPTLDAYRIGQLLAIYEHRVAVQGFVWGINSFDQWGVELGKSLATQVRKQLHASRVKGEAVEEGFNFSTKTLLTRYLEATSDVPADPSTLLPKI

SEQ ID NO: 54723 - protein, 221 aa, Vitis vinifera
MADTSQTRPSAGVNRRPPSRLQRRAPSSLQISPAADWKVAIPLLSPLATSPSSPKLIDRTAEVKPKEEPRQMKEGEKPVFKKWQHPAAPFCYEPASFVRSFVPDFEHIMQTYSIILGRNSNKSIVDVDLSSLGSGMNISYSNNVHVLQTNSHDLHQNWKQENLFSIDDKKHCQWYKQKRVSLPRNGLSICCLHLSLIFQVRFQWRVGLGEKKRECENKRRG

SEQ ID NO: 54724 - protein, 312 aa, Picea sitchensis
MAEHLASIFGTEKDRVNCPFYFKIGACRHGDRCSRLHTRPTISPTILLSNMYQRPDMVTPGMDIQGHAMDPRKIQEHFEDFYEDLFEELGKYGELESLNVCDNLADHMVGNVYVQFREEEQAANALRSLQGRFYAGRPIIVDFSPVTDFREATCRQYEENTCNRGGYCNFMHLKKISRELRRRLFGRYRRYSHSRSRSRSASPHKDHEKHRHHDDRPRHGGRGYDRRYDVDDRDGHRGRRTRSRSPGGHRRGRSRSHSPRRNRSPIREGSAERRAKIEQWNREKEAQASSTIANHPMQNGGAYSNPQGYYDR

SEQ ID NO: 54725 - protein, 203 aa, Clarkia lassenensis
KFLLGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLTKENVSEHLIPHKTFTGNRPSISILLPTLDGYRIGQLLAIYEHRVAVQG

SEQ ID NO: 54726 - protein, 280 aa, Ostreococcus tauri
  misc_feature (1)..(1): Xaa can be any naturally occurring amino acid
XPAQDVPSTSGGALYDDVMQTAPPWGSLGRQAVLGVVALTGKAILDAANTTVVSGRERFERMISDRDRTSGEGLVTVCNHASTFDDPGVLSSLIPWSFFMGESAHAGVRWTLCADEICAKNSLREAFFLCGKALPIKRGGGVEQPAMRTAANLLARGDWVHVFPEGRVSKNGELGGMRRGLAKLLCDVEMSGGKRPIILPFFHSGMEHVKPYGKWQINVGNRVHVTVGEPLDLSDLTRQCARCEKNAKARDHLHTEIMRRIEKSLKDLERQNARERASPT

SEQ ID NO: 54727 - protein, 350 aa, Salmonella enterica subsp. arizonae serovar 62:z4,z23:--
MGEVVETGHDVKNIQKGDRVVIPFVIACGDCFFCRLQQYSACENTNDGHGAAMNKKQIPPPAALFGYSHLYGGVPGGQAEYVRVPKGNVGPFKVPPLLSDDKALFLSDILPTAWQAAKNAQIQQGSSVAVFGAGPVGLLTIACARLLGAEQIFVVDHHPWRLRFAEERYGAIPINFDDENDPAEKIIEQTAGHRGVDAVIDAVGFEAKGSMTETVLTNLKLEGSSGKALRQCIAAVRRGGVVSVPGVYAGFIHGFLFGDAFDKGLTFKMGQTHVHAWLGELLPLIEKGLLKPEEIVTHYMPFEEAARGYEIFEKREEECRKVILVPGATSAQAAQKQATGVINPMPGGVV

SEQ ID NO: 54728 - protein, 170 aa, Zea mays
  misc_feature (67)..(67): Xaa can be any naturally occurring amino acid
  misc_feature (76)..(76): Xaa can be any naturally occurring amino acid
  misc_feature (127)..(127): Xaa can be any naturally occurring amino acid
  misc_feature (143)..(143): Xaa can be any naturally occurring amino acid
SPGCFFPPTPRASIIPVYCGKYTDELIKNAVYIGTPGKGILAADEGTGTMGKLLSTINVHNGEENRXRALRELLLXCPGALHDIRTVILYEETLYQKTNDRLPIVAVHEDGRVLPGINVDKGPMDAXATDYETTTLSADYLGXRCPKYYEAGARIAKWGADLKTGPYEPS

SEQ ID NO: 54729 - protein, 256 aa, Clarkia gracilis
KFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVMKSQQPVYLKGEVVNNHDELMSNFFAQPDALAYGKTPEQLKKENVSEHLIPHKTFTGNRPSLSILLPTLDAYRIGQLLAIYEHRVAVQGFVWGINSFDQWGVELGKSLATQVRKQLHASRVKGETVEGFNFSTKTLLTRYLE

SEQ ID NO: 54730 - protein, 501 aa, Mycobacterium smegmatis str. MC2 155
MGFMTTTLASTHPVETVHGHRVPTGLFIGGDWRTTDSTFTVLDPATTGHIADVSDAGAAEALAALDAAHAVRDEWRRVTPRARAGLFGEAYRLLRSRAEAFAAVMTAESGKPLAESRAEFNLSAEFFLWYTEQIAHLHGTYAPASHGGYRVVTTHQPVGPALLITPWNFPMLMIARKAGAALAAGCPVIVKSAKETPLTCALFVETLREAGFPAGVVNLVHTTSSSAVSAALMADPRLRKISFTGSTGVGSTLLAQAAPGILNASMELGGDGPFIVLEDADVELAAKQAVVCKFRNAGQACVAANRIIVHRAVAEEFTKRFVALTEQLRVGNGFDDGVDVGPIISARQLDGVSELVDTLRGLDSELLTGGNALPGDGFFFAPTVFRVNGRPTELCSRELFAPVATIYQVESTSEAIEFANDTRYGLAAYVFTRDLSRAVAVGERLDFGMVGINRGIMADPAAAFGGVKASGLGREGGHDAIYDYLEPKYLALTVDEEAGLA

SEQ ID NO: 54731 - protein, 203 aa, Gossypium anomalum
  misc_feature (67)..(67): Xaa can be any naturally occurring amino acid
GYTPLFPRILGHEASGIVESVGEGVNDLKPGDHVLPIFTGECKECRHCLSEESNNMCELLRINCDRXVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVE

SEQ ID NO: 54732 - protein, 537 aa, Oryza sativa Indica Group
MAIVDASTGPAVIVAVAVVVVVVSTLLWTAMAQLVWRPYAVGRALGQQGVRGPAYRLLVGNIGEANEMRAAASGGVLDRRCHDVVPRVLPHYRAWMSRYGKVFVSWTGPFPALCVGDYAMAKEILADRTGLYAKPDPGASILALFGNGLAFVNGDDWARHRRVVHPAFAMDKLKMMAKTMAECARKVIQAWGARAAAAADGERMVQVEVGEQFQELTADVISHTAFGSSYRQGKEVFVAQRELQYIAMSALNSVRIPGSQYIPTKANIRRRQLAKKVRGTLMAIIRERQATAAAAKEDRGYGNDLLGLMLEANAAAGGGEKSMTMDEIVDECKTFFFAGHDTTSHLLTWAMFLLGTHPEWQQRLREEVLRECCGGGGGDTEALPNGDALNKLKLMTMVLYETLRLYGPVSMLVRTATADAELGGVRVPKGTMTMMPVAILHRDADVWGADAGEFDPLRFRGGVNKAAAHAGALLAFSLGQRSCIGQDFAMMEAKTTLAMILRRFAFEVSPEYVHAPLDLLTLQPKCGLPMVLKLLDQ

SEQ ID NO: 54733 - protein, 532 aa, Oryza sativa Indica Group
MATVESSTAPGVAVAAAVVLVVLTWLWTALVQLVWRPYAVARAFGRQRIRGPAYRLFVGSDGEANAMRAATRGDVLDRRCHDIVPRVMPHYRAWMSRYGKVFVSWSGATPALCVGDYAMVKQILSDRTGLYGKPEPGPSILALIGNGLIFIGGDDWARHRRVVHPAFAMDKLKMMAKTMADCAREVIREWEARATADGERRVQVEVGGQLQELTADVISHTAFGSSYREGKEVFVAQRELQSIAFSAINSTRFPGSQYIPTKTNLRRRHLAKKVRGTLMAIIRERQAAAAKEDSGHGNDLLGLMLEANATDACGSGGENSMTMDEIVDECKTFFFAGHDTTSHLLTWAMFLLGTHPEWQHRLREEVLRECGGGGDTEALPNGDALNKLKLMTMVLYETLRLYGPVSLMARTATADAELGGVRVPKGTMTMIPMAILHRDADVWGAGAGEFDPLRFRGGVNKAAAHAGALLAFSLGQRSCIGQDFAMMEAKTTLAMILRRFAFEVSPEYVHAPLDYLTLQPQCGLPIILKLLD

SEQ ID NO: 54734 - protein, 203 aa, Gossypium somalense
GYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVE

SEQ ID NO: 54735 - protein, 525 aa, Bacillus subtilis
MNRSVIGTKQMVVSPHYLASQAGNRILDKGGNAFDAAVAVSACLAVVYPHMTGLGGDSFWLTFHQETKAVKVYNGSGRSGKNVTRDVYKGKSAIPLRGIDSAITVPGMVDSWDAVLKEYGRLSLADVLEPARDYAQNGFPVSADQCRHTEKNIELLASTPYTADIFTRRGKAPVPGERFLQKELADSLNVIAEKGRSAFYEGDLAQRIVSHLQNNGSYMTIDDFKAHRGEWAAPVSSDYRGYSVYQAPPNSQGFTGLLTLNILENYDFTQIEHGSFEYYHVLVEALKKSFVDRNAFLTDPAFADIPLERLLDKNYAKRLAGEIGYLAEPAESRPVGSDTAYAAVIDADGNAVSFIQSLYFEFGSAVTAGDTGILLQNRGSFFSLDENHVNTLEPRKRTFHTLMPAMVCKGGKPKILYGTQGGEGQPQTQTAIITRMLDYGMHPQQAISEPRWVWGRTWGEEYEGLRVEGRFTDKTIQKLKDSGHLVEVVGDYDPLMGQAAAIKVDEEGFLQAGADPRGDGAAVGI

SEQ ID NO: 54736 - protein, 243 aa, Prochlorococcus marinus subsp. marinus str. CCMP1375
MRKTVIAGNWKMHMTCSSAKEYIDKFIPFSKEFPSDRHVVIAPPFTAISTLASLLQGTNIQLSSQNVHWEDTGAFTAEISPSMLLEHDVRYAIVGHSEPRKYFSESDEQINLRARSAQSNGLIPIVCVGESIEQRERGEAERVIRRQVEQGLEQTDLTKLVIAYEPIWAIGTGKTCESNEANRICGLIREWAGFSDLIIQYGGSVKPANIDEIMSMSDIDGVLVGGASLDPENFARIANYQSI

SEQ ID NO: 54737 - protein, 203 aa, Gossypium longicalyx
GYTPLFPRILGHEASGIVESVGEGVDDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVE

SEQ ID NO: 54738 - protein, 393 aa, Ostreococcus tauri
MAFILMFSAPFCFAMSMVETFEGFLICRLGIGLGLATFVCTQFWMSNMFNRKCVGLANATSAGWGNLGGGVTQFLMPGIYAICFAGCSKKAFLAWRWAYIVPGLAHVLTAFLTLAYGQDMPDGNYKLLTTSGAMEKKNALMVNLLGMKNYRMWAMVLTYGACFGVELTMNNIVAGYLFDQFGVSLQVAGVLASCYGLMNIFARSVGGIVSDWSSEKFGMRGRLWTLWIMQTLEGVLCIFMGLSKNNLGATIAFMVAFSICVQASEGASYGIVPFISRRALGVVSGFIGAGGNAGSTIVTALFFTKDSIETHEGLVYLGYYVIAVTALVIPIHFPMWGSMLFPASKDATEEDYYMSEFSPEEVKAGVAAPVQKFCENARAERPKWKRAETAVSP

SEQ ID NO: 54739 - protein, 933 aa, Oryza sativa
MEERSRWESECGREMWALRYGVRRENRYIWPKSTRFGASSIFGGLNAVSVGGPFSSRICHISDGGPDEGSPGDALRRVRGFWWWWGQCGGRWMGIPEVVVPPRAAGPRRYKGLVPWRFQPGFVRPPPVKPPAAAAAVAGGGVAGTPGGKGRGLGASGEGVGSSGGRGDPQSRRCTHSASAKGSGDARSVEEGGPRVAGDDGGSGKSGVAAEGSGFEGLRNGRGGGVGTAAAEDCGLEKSNPDGIVGDADVHLESGSDARDGECVSEGLKKPCVNNSNGSSAADCAPKVKKGNDSGNGGADECNAAAKSSNLACPGNNGDETNRKGRKVVLPWRFQVGFKRSFSKAFCSDSESSGPSGTQFYRAQDSSTPCTPATRSSVRCYASAHSGVRVSAMRDFSVKGEKETSTPYKKSKTGMDGPSQGMPKNGVVLARENIMGSLQNFRLIYRDLLDEEEEKSTEAVIRPDLQAYRIFRERFITDCDEKKYIGNVPGIKVGDIFHLRVELCVVGLHRPHRVGVDHIKQEDGTCIAVSIVSYAQSSDIKNNLDVLVYSGAMTAIANQKIEGTNLALKKSMDTNTPVRVIHGFVTHLNGNCQRKKIPTYIYGGLYIVEKYWREKEGNDRYVYMFRLRRMAGQKHIDIQDILNSGQAESYGGIIIKDISRGLEKIPVSVVNSISDEYPMPYRYIAHLQYPRNYQPAPPAGCGCVGGCSDSKRCACAVKNGGEIPFNDKGRILEAKPLVYECGPSCKCPPTCHNRVGQHGLRFRLQVFKTKLMGWGVRTLDFIPSGSFVCEYIGEVLEDEEAQKRSTDEYLFAIGHNYYDEALWEGLSRSIPSLQKGPDKDEEAGFAVDASKMGNFAKFINHSCTPNLYAQNVLYDHDDKSVPHIMFFACEDIPPRQELSYHYNYTIDQVHDANGNIKKKKCLCGSIECDGWLY

SEQ ID NO: 54740 - protein, 631 aa, Psychrobacter arcticus 273-4
MTQQYQVLARKYRPKNFHELIGQTHVSQALINAIDYNRLHHAYLFTGTRGVGKTTIARILSKCLNCDTGITSTPCGVCDNCVAIDQGRFIDLIEIDAASRTKVEDTRELLDNVPYAPSQGRYKVYLIDEVHMLSTHSFNALLKTLEEPPEHVKFLLATTDPQKLPITIISRCLQFVLRPLSQSLLSEHLANVLTQEQVGYTQPALWQLASAAKGSVRDALSLTDQAIAFGQGALDDVTVNSMLGLIDAADLVSLITDIYHHDKPAVAAHIEQMRAQMVDASSMFDGLAELLHQLALCQLLPEVALNVNEAQAQHINQLAQHMSPDVLQLYYEIVVQAREGVKLASTPMQALEMCILRLLAFRPLPVDEILVKVPDSTVTAIEHYSPTISSTTSATTTEPVPSSLESQAQADNIIYDNADISVSEKNRVGADNIVNQNEQYHSNDPASESSQYNDYSVHNSLELSSNQLEPVVEPVINDSQLFSQPEDPRALLRCPPQELIGEWTAEKWDYWLQTAREAGSLAQDELALARQGMMTGSCNAEAVFVTAVDSKHLQATFEQLATKMQLQFPAAAISLRIDSSIMQADDKTPERRQQKRLVQAKTVAESRLFNTPVMQYLTERGEGKMGKVQLY

SEQ ID NO: 54741 - protein, 457 aa, Oryza sativa
MAHGGGEEEEERVLSHGDVVLLRCDLTILRGPHFLNDRIIAFYLAHLAADHHADDDLLLLPPSVPYLLSNLPDPASVAAVADPLRLASRRLVLLPVNDNPDVSHAEGGSHWTLLVLDNSNAVSGPRFVHHDSLPPTNLPSARRLAAVLRPLLPASAIPLIEGPTPRQTNGYDCGVFVLAVARAICNWWPTRARHSNSDSDWLEAVKREVNADSVKAMRTQLLQLIHTLIQNNTTTNQHSPSTQLPSHPSIASTSLPVTAQDFGTWLEDSGTHTAYDQKKADTGKGACWDNLTVSQSVRKPNVSAKNSLSYDGYSWRKYGQKQVKGSEFPRSYYKCTHPTCPVKRKVEMTPDGRIAEIVYNGEHNHPKPHPPRKPTLSTSVETLVATNDAGLENKLEGCDQAIGSDAVVEALRGGCHCLDGFRNGNEISDCKKRYAYAVIFIQNLLMFFCAKNVQVVA

SEQ ID NO: 54742 - protein, 562 aa, Neurospora crassa
MSGSYGGGGYGGRGGGGGGYSNGYDRNGGGYSNNYSSHGGSNGYGGGGGGYGGGGGGYGGGGYGGGGGGDRMSALGAGLQKQNWDMSALPKFEKSFYQEHPSVANRSPAEVDKFRADHSIAVFGNNVPKPVETFDEAGFPRYVMDEVKAQGFPAPTAIQSQGWPMALSGRDVVGIAETGSGKTLTYCLPAIVHINAQPLLAPGDGPIVLILAPTRELAVQIQQEISKFGKSSRIRNTCVYGGVPKGPQIRDLSRGVEVCIATPGRLIDMLESGKTNLRRVTYLVLDEADRMLDMGFEPQIRKIIGQIRPDRQTLMWSATWPKEVRNLAADFLTDFIQVNIGSMDLAANHRITQIVEVVSESEKRDRMIKHLEKIMEGRENQNKILIFTGTKRVADDITRFLRQDGWPALSIHGDKQQNERDWVLDQFKTGKSPIMVATDVASRGIDVRNITHVLNYDYPNNSEDYIHRIGRTGRAGAKGTAITFFTTDNSKQARELVGVLQEAKQQIDPRLAEMARYSGGGGGRFGGYRGRGGGGWRGGRGGGGGGGSVGGANALPLNNRRW

SEQ ID NO: 54743 - protein, 515 aa, Arabidopsis thaliana
MEAVISFDFQNCFIFILIFLLTFLCFFFFFKKPKDSRVNFDLPPSPPSLPIIGHVHLLLSTLTHKSLQKLSSRYGPLLYLRIFNVPIILVSSASVAYEIFRTQDVNISSRGVTAVDESLVFGSSSFVTAPYGDYWKFMKKLTVMKLLGPQAQEQSRDIRADDIKRFCRNLLDKARKKESVEIGKEAMNLMNNILCKMSMGRSFSEENGETEKLRGLVTESIGLMKKMFLAVLLRRQLQKLGISLFKKDIMGVSNKFDVLLEKVLVEHREKPEKDQGTVMLDVLLAAYGDENAEYKITKNHIKAFFVDLFIGATDTSVQTIQWTMAEIMNNTHILERMREEIDSVVGKSRLIQETDLPNLPYLHAVIKEALRLHPPGPLLPREFQQGCKIGGFYIPEKTTLLINAYVVMRDPNVWEDPEEFKPERFLASSRSGQEDERREQALKFLPFGSGRRGCPGSNLAYMIVGSAIGMMVQCFDWRIEGEKVNMKEAVKGTILTMAHPLKLTPVTRQPPLTWI

SEQ ID NO: 54744 - protein, 393 aa, Psychrobacter arcticus 273-4
MSATYLMPTYLRQPISFTRGSGSWLYTRDETPYLDALTGIAVCGLGHCHPQVTDAIQQQAATLVHTSNLFGIDWQERAGEALCNAAQMDSVFFANSGAEANEAALKLARLYAHQQGFKRPKVIVMEQSFHGRTLLSLSATANPKAREGFYTLDDDFIRVPFGDIAAIEQAAHDYEDICAVFVEPIQGEGGLNTASNGFSYLEQIQAVCNTHNWLFMLDEVQTGNGRTGKYFAYQHSSARPDVLTTAKGLGNGFPVGACMVRGRANGLFGAGSHGSTYGGTPLASRVVHSVYDVLANSDIMKNAVTEGQFIRDGMVDAFGEYGVSSRGAGMMIGIALPEDMDCSNLVDRARDEQKLIINVTGAHVIRLLPPLNMSRDESSQVVERLVNLLKPSF

SEQ ID NO: 54745 - protein, 552 aa, Ustilago maydis
MSYGGYSGGSGRGGSYGGGRGGYGGGSSSYGNGGSSYGGGSSYGGGSSYGNGGGGYGGGYGGGYGGGDRMSNLGSNLGAVDWNSVNLVPFEKNFYVEDPRVSNRSDSEVQQYRASKQMTIQGQNVPKPVTSFDEAGFPDYILSEIKKMGFSEPSAIQSQAWPMALSGRDLVAIAETGSGKTIGFALPAMVHINAQPLLKPGDGPIALILAPTRELANQIQVECNRFGGSSRLRTCAVYGGVPKGPQIRDLQRGAEICIATPGRLIDMVDAGKTNLRRVTYLVMDEADRMLDMGFEPQIRKILQQIRPDRQTLMFSATWPKEVQRLAGDFLNNYAQVNIGSTELAANHNVKQIIEVCTEFEKKGKLIGHLETISAENGKVIIFTSTKRVADDLTKFLRQDGWPALAIHGDKQQQERDWVLAEFKSGRSPIMVATAVASRGLDVKDISYVINYDFPTNTEDYVHQIGRTGRAGRTGTAYTYFTPENSKSARELIGILREAKQEIPREIEEMGRFGGGGGGRGFRGGRGRGRGRGGYGGGGRTGANSFAVGNSRW

SEQ ID NO: 54746 - protein, 498 aa, Aspergillus oryzae
MTKRDLHNEGGDENKPRKKQKSEKQKKEKSAKSKSSAEQSLSYVQSPALGDVPQSEIEKFLTENSIKITDTSSENVMRPIISFSHLPPCKDDLYAPLSSFKSPTSIQSATWPLLFAGRDVIGIAETGSGKTLAFGLPCLKKIQDSAMTKQKPYRPLAVIISPTRELAMQIYDQLLKFSGSVGVRVACVFGGVRKEEQREALKTAGVVVATPGRLKDLQNDGSVDLGKVKYLVLDEADRMLDKGFEQDIKDIIRPMPVSKRQTIMFTATWPPSVRDLASTFMSSPVTVTIGGDPSADPRANTRIKQVVEVVKPHEKESRLVQLLNRSQRGVPEPEKVLAFCLYKKEAMRIERLLRTKGFKVAGIHGDLSQQERFRSLDAFKTGAATVLVATDVAARGLDIPSVKQVINVTFPLTVEDYVHRIGRTGRAGAEGHAVTLFTETDKAQSGALINVLRAAKQDIPEDLLKFGTTVKKKQHDAYGAFFKNVDTDKTATKIVFDD

SEQ ID NO: 54747 - protein, 281 aa, Ustilago maydis 521
MGRYAVLVSGPAGSGKSTFCSALIAHAQSLGRNVHLFNLDPAAERFEYQPSIDIKELISLEDVMEEMNLGPNGGLIYCFEYLLDNLDWLDDELGQFNDDYIIIDCPGQIELYTHFPIMSRLVNILSSQYHFRICATYLLESQFIDDKTKYFAGVLSAMSAMINLEVPHINLLSKMDLVEKGEIGSEAKRGRKREMERYLDPDPLLLMDEVNSRTNPKFHSLNQALVQLIDDFSMVSFMPLDSTDEDSVGTILSHIDNAVQYGEDEEPKEPKDMDEGDFTAQ

SEQ ID NO: 54748 - protein, 531 aa, Glycine max
MDQSSGLNLEDLKWDHSFVRELPGDPRRDSFPREVLHACYTQVSPSVQVHNPQLVAFSQPVADLLDLDHKELPYAQCYGGHQFGMWAGQLGDGRAMTLGEILNSNSERWELQLKGAGKTPYSRFADGLAVLRSSVREFLCSEAMHHLGIPTTRALSLVTTGNLVTRDMFYDGNPKEEPGAIVCRVAQSFLRFGSYQIHASRSDEDLGLVRVLADYAIRHHFPHIQNMSKSDSLSFCTGDEDHSVVDLTSNKYAAWVVEIAERTASLIARWQGVGFTHGVLNTDNMSILGLTIDYGPFGFLDAFDPKFTPNTTDLPGRRYCFANQPDIGLWNIAQFTTTLQAAHLINEKEANYAMERYGTRFMDDYQVTMTKKLGLPKYNKQMINKLLSNMAVDKVDYTNFFRTLSNVKADINIPDDELLVPLKSVLLDIGKERKEAWTSWLKAYIHEVATSGIPDDERKISMDSVNPKYILRNYLCQTAIDAAEIGDFGEVRRLLKLVEHPYDEQPGMEKYARLPPAWAYRPGVCMLSCSS

SEQ ID NO: 54749 - protein, 725 aa, Hyphomonas neptunium ATCC 15444
MTWYALALGAGILSVLYGWVQIQSIMKAPAGNARMLEIAAAIQEGANAYLKRQYRTIGIVGVVVAIVLVILLGWKAALGFVIGAVLSGAAGYIGMLVSVRANVRTTEASRHGLNEGLKMAFKSGAVTGMLVVGLALIGIVGYYGLLTGPLGLSLGDEDQKREIIDALVSLGFGASLISIFARLGGGIFTKGADVGGDMVGKVEAGIPEDDPRNPATIADNVGDNVGDCAGMAADLFETYAVTLVATMVLGGIYFAATPYIAEIMMLPLAIGAVCIVTSIIGSFFATLSKGSTNVMGALYKALNVTGVLSIGGLAIAIHTVLPGGLGGTLEGAGALLGLVDPATGQAADITGWHLFACGVVGLFVTLLIVVITAYYTETKYRPVRSIAKASESGHGTNVIQGLAVSLEATALPALTIIGGILLTYNLAGLYGIAIATTTMLALAGMIVALDAFGPVTDNAGGIAEMAELPSEVRTTTDALDAVGNTTKAVTKGYAIGSAGLGALVLFAAYAEDLSYFTARATEGSFFYNITVDFSIANPYVVVGLLFGGLLPFLFGGMSMMAVGRAAQAVVEEVRRQFREMPGIMKGEVKPDYGRAVDMLTQAAIKEMIIPSLLPVLSPIILFGVILVIGGPGEALASVGAMLLGVIVTGLFVAISMTSGGGAWDNAKKYIEDGHHGGKGSEAHKAAVTGDTVGDPYKDTAGPAVNPMIKITNIVALLMLAVLAGH

SEQ ID NO: 54750 - protein, 502 aa, Oryza sativa
  misc_feature (191)..(191): Xaa can be any naturally occurring amino acid
MELLLLCTPCVILLLSSLYLLRLFVDARRNLPPGPRPQPLIGNILDLGSQPHRSLARLAGRYGPLMTLRLGTVTTVVASSPGAARDILQRHDAAFSARSVPDAARACGHDGFSMGMLPPSSALWRALRRVCAAELFAPRSLDAHQRLRRDKVRQLVSHVARLARDGAAVDVGRAAFTASLNLLSSTIFSAXDLADFGDARAESSVGDLRDLISEFTIVVGVPNVSDFFPAVAPLDPQRLRRRVARVFERLQAVFDGHIERRLRDRAAGEPPKNDFLDALLDYRSPEDGRGFDRPTLQFLFTDLFSAGSDTSAVTVEWAMAQLLQNPPAMAKAREELARVIGSKQEIEESDISQLKYLEAVVKETLRLHPPAPFLLPHQAETTTQVGGYTVPKGTRVLVNVWAIGRDSKVWSDPDKFMPERFLQSEVDLRGRDFELIPFGSGRRICPGLPLAVRMVYLMLASLLHRFEWRLLPEVEKNGVDMAEKFGMILELATPLRAVAIPV

SEQ ID NO: 54751 - protein, 347 aa, Cytophaga hutchinsonii ATCC 33406
MNKNTPAQQGYSFPAEWAKHKATWLSWPHKEASWPGKLDSIFPQYAQFIKLIAEGEEVRINVANAAMEAFARGYIEKAGADMHNVFFHHFPTNDAWCRDHGPAFLVNPAAEQKKVIVDWGYNAWGGKYPPYDLDDVIPTKIAQMYNIPVFHPGIVMEGGSVEFNGRGTLLTSTSCLLNPNRNPSKSREQIEEYLEDYYGVEHILWLGEGIVGDDTDGHIDDITRFVNEDTVVTVVEENKSDDNYFLLKDNLKDLHKMRLENGKQLNVIELPMPSAVIYDDQRLPASYANFYISNNHVVVPTFRDKNDEVALEILQQLFTDRKVTGLDSTDIIWGLGSFHCLSQQEPA

SEQ ID NO: 54752 - protein, 427 aa, Polaromonas sp. JS666
MSAIVDIVGREILDSRGNPTVECDVLLESGVMGRAAVPSGASTGSREAIELRDGDKSRYLGKGVLKAVEHINTEISEAVLGLDASEQAFLDRTLIDLDGTDNKSRLGANATLAVSMAVARAAAEEAGLPLYRYFGGSGAMQMPVPMMNVVNGGAHANNNLDLQELMIIPIGAPSFREAVRYGAEVFHALKKILHDKGMSVAVGDEGGFAPNVPSHEAAIQMILEAIDKAGYVAGEQIALGLDCAASEFYKDGKYVLAGEGLSLDATEWTNILATWVDKYPIISIEDGMAEGDWDGWKILTERLGKQVQLVGDDLFVTNTKILKEGIDKHIANSILIKINQIGTLTETFAAIEMAKRAGYTAVISHRSGETEDSTIADIAVGTNAGQIKTGSLSRSDRMAKYNQLLRIEEDLGDIATYPGRAAFYNLR

SEQ ID NO: 54753 - protein, 576 aa, Azoarcus sp. BH72
MPFTLHGLPVSQGIAIGHVHLVSHALLEVNHYHVAQRHLADETARLDDAVATVQGELIGLKAAATGGQAHSEVGAFVDLQLMMLADPMLIDAARALIESRGCNAEWALVQQMELVVAQFRQIEDPYLRERQADVVQVVERLVKVLLGHPGHLPPRRRDGLGTIVVAHDLSPADTIGFRDHNIAGFVTDVGGPTSHTAIVARSLAIPAVVGLHHIRDLVEDDELLIVDGTRGVIIVAPDDSIIEEYRLRRAELELERSKLKRLRDTPATTLDGETIHLLANIEGPKDVAQVKASNADGVGLYRTEFLFIGRDTLPDEDEQYEAYRTVLKAVPGKPVTIRTFDVGADKALNGAHSRFEPNPALGLRAVRYSLAEPKMFLTQLRALLRASVHGRLQIMVPMLAHAHEIDQTLTLIDKAKAELRAERIKFDEQVPIGGMIEVPAAALALGMFIRRLSFLSIGTNDLIQYTLAIDRSDEAVVHLYDPLHPAVLKLIGATIQAGARYGLPVSVCGEMAGDPAYTLLLLGMGLRNFSMHPGHILEIKQQVLRADLGELAPRVQRILKMDEQARVREAVERLAG

SEQ ID NO: 54754 - protein, 400 aa, Campylobacter coli RM2228
MLIVQKYGGTSVGTLERIDAVAERVIKSAKEGHQLVVVVSAMSGVTNTLIEQAEYFSKNPNGKDMDMLLSSGERVTSALLSIALNERGYPSLAFSGRKAGIITDSVSTKARISYIDTQAITKALNEGKIVVVAGFQGVDKEGDVTTLGRGGSDLSAVAVAGALKADLCEIYTDVDGVYTTDPRIEPKAKKLDKISYEEMLELASLGAKVLQNRSVELAKKLNVKLVTRSSFNDNEGTMITKEDGMEQALVSGIALDRNQARVTLRNIEDKPGIAAEIFSVLADENINVDMIIQNVGVDGATNLGFTVPQNELDLAKNAMQKILGSKTTIESDSAVVKVSIVGVGMKSHSGVASKAFKALADEGINIGMISTSEIKISMIVHEKYGELAVRALHECYGLDK

SEQ ID NO: 54755 - protein, 703 aa, Ostreococcus tauri
  misc_feature (379)..(385): Xaa can be any naturally occurring amino acid
MTTATAARATATPTSRADGDDGGRTGWTTSLAGAIAGATARACVAPLDVIKIRMQVQLEEASTGKYRGLAHAVRTIVREEGARGMWAGTAPALMLWVPYTAIQFATLGVFNDAAAARERRRGETEATRSPLVGFVGGAVAGTVATVLTYPFDVMRTLLASQGHPKVYENVLDAARGVVRARGARRGLYAGLSVTLAEIIPASAVQFGSYAALKTRFPDVFGENDFACGFVAGTAARLVVHPLDVVKKRFQIAGFTRSLAYGARVDAAGYVNFAAAVRTIAKTEGVRGFYKGLTPSLIKSAPASAITFAVFEARPAHGGARTSSRASSSLHRCPTPPNSRSLGSKTNTRCSSNVRTRSRRRISANTPWRLRDERRTPPEXXXXXXXAVPREHCSSLSCARFRREYVRRDVPVVITGLRDVLTEDGADGERCAWLTRRAGNKKVAVTRDHGHRNSTASCASTDVVDLREYFDEVTKDASPGSYLYDVSVPLKLPTLTESIFLPKYFAHDYVQRTMRLTAFSRSWPSLFVAAKDTRSTLHVDQWQGHFFMAMIRGTKRWTVFHRDATPFLRPSWLRGTLDPAMPALEEQCASGLSEHAARWDVDLGPGEVLFVPGGAPHAVHNLDSTVAFAGNFVDDANLERALVDLKLMGLNQGERMMESFIALDEIDFDDATDLDDDDADADADAPLDPRDLVVAIDAHLARRP

SEQ ID NO: 54756 - protein, 259 aa, Zea mays
MASTVGQTITCKAAVAWGAGEPLSVEDVEVAPPKAHEVRIQVLHTGVCHTDAYTLSGKDPEGAFPVVLGHEGAGIVESVGEGVTSVKPGDYVVALYTPECRECKFCKSGKTNLCGKIRATQGKGVMPDGTSRFKARGKDLLHFMGTSTFSQYTVVADISVVAVTPKIPTDRSCLLGCGITTGYGAAVVTAKVEEGSNIAVFGAGCVGLSVIQGAVKNKAGRIIVVDVNDGKEAWARKFGATDFVNPTKLGGKTIQEQLI

SEQ ID NO: 54757 - protein, 409 aa, Picea sitchensis
MGSIRTILKHPEDVPALVRMKIAQTHALKQIPSEPDLAFCFTMLQRVSRSFAFVIQQLGPDLRNAVCIFYLVLRGLDTVEDDTSIPLDTKLPILEAFYKHIYDPSWHFSCGVKDYKELMEKFHHVSTTFLRLGRGYQEAIEEITKRMGAGMAKFICSEVESVEDYDEYCHYVAGLVGYGLSRLFHAAQLEDLQPDSLSNSMGLFLQKTNIIRDYLEDINEIPAPRMFWPREIWAKYVSKLEDLKEEEWSKEAVQCLNEMVTNALKHANDCLKYLSDLRDPAIFRFCAIPQIMAIGTLERCYNNIEVFRGVVKIRRGLTAKIMERTNTMADVYGAFFDFSRSLASKVPEDDPNAKETLNCIDEIQRTCKASGLLARRTTFSIDSKRGHQACLAIVVLILAIILAIITFKL

SEQ ID NO: 54758 - protein, 439 aa, Oryza sativa Japonica Group
MAASPAAGAAAATVSSFVSPSSFSSVNFRFEAFKTKVPRNANMAKLQAGYLFPEIARRRAAHLLKFPDAKIISLGIGDTTEPIPDVITNAMAKRAHALSTVDGYSGYGAEQGEKKLRAAIAATYYADLGIEETDIFVSDGAKCDISRLQVLFGSNVKIAVQDPSYPAYVDSSVIMGQTGLYQEDVQKYGNIEYMKCSPENGFFPDLSSVPRTDIIFFCSPNNPTGAAASRDQLTKLVKFAKDNGSIIVYDSAYAMYISDDSPKSIFEIPGAKEVAIETASFSKYAGFTGVRLGWTVVPKELLFSDGHPVAKDFNRIVCTCFNGASNISQAGGLGCLSPEGLKAMSDVVGFYKENTKIIVDTFTSLGFNVYGAKNAPYVWVHFPGRNSWDVFAEILEKAHVVTTPGSGFGPGGEGFVRVSAFGHRENIIEAARRLKQLYK

SEQ ID NO: 54759 - protein, 643 aa, Ostreococcus tauri
MGTRERARVGADGASRARTRWSRRVVSPARAWEGTGGVETLGTVTTRRGDRANGTRAATGKDADGGKTLEERIASGEFTVQAKTGPYRVVADAIRGAIPENSGTFGRGAMSKMPVATGDIREIAGQPVFVPLYKLFLAYGEMFVLAIGPKKFVVVSDNAVAKEMLLTQAKSFSKGLLSEILDFVMGQGLIPANGEVWKIRRKVIVPSLHKKYVTSMVGMFGDCGLKGMAQLARAEKMGESVEMENFYSRFALDIIGKAVFNYDFDSLTTDDPVIKAVYTVLREAEYRSVTFIPYWKVPPLRWLVPRQRQCQEALKVVNDTLDELIDRCKKIVEEEDEEFVEEYMNTDDPSILHFLIASGDDVTSKQLRDDLMTLLIAGHETTAAVLTWTTFLLAKHPDIKQKVFEEVDRVVGDRNPTVADMRELVYTTRVINESMRLYPQPPVLIRRALEPVTLGGYNIDAGTDFFISVWNLHRNPRIWPEPDAFKPERFPIEGPMPNEYTEDYAYLPFGGGQRKCVGDQFAIFESIVSLAMLMRRFDFELDESKHPDGECGMTTGATIHTTNGLHVRLKRREGRGGAEMSGAVRGKALTELDDVDVVRGSIDAPTASADEVDVLIAEDIDAGTVEKIQRATKIIEEEEARAR

SEQ ID NO: 54760 - protein, 174 aa, Polaromonas sp. JS666
MAIYQLGDSAPTIHESAWVAENAQVIGRVTLGEGSSAWFGVVIRGDTESVTIGRGTNVQDNSVLHADPGVPLTIGNDVSIGHQVMLHGCTVGDGTLIGIQAVVLNGAKIGKNCLVGAGSLVTEGKEFPDGSLILGSPAKVVRQMSPEQIEGLKAIAQHYVDNARRYKAGLKKLA

SEQ ID NO: 54761 - protein, 120 aa, Glycine max
GNKIGKPPPVPCKGTGKCGAVTVRKGPAPKGSGNVAAKGPQKGLQFAGNEEGFTSSRGSPQTLGKFVKGTFECLKKTYGFLAPEIWKETRFSKFPFPKDPDLLAKPTGKALILEEEKGEA

SEQ ID NO: 54762 - protein, 102 aa, Glycine max
PTRPPTRPPTRPGAQMLRDLGVRSMKLMTNNPAKYIGLKGYGLTVSGRIPLLTLITSENKRYLETKRVKMGHIYAMEFNGQLSTHDSGRQALPKMFILILET

SEQ ID NO: 54763 - protein, 339 aa, Picea sitchensis
MVQSLDLEVIADSDNCPVSLPVQRTKLIIDTDPGIDDAITILMAFQLPEFEVIGLTTIFGNVLTKDATRNALHLCEVAGFPDIPVAEGCPEPLKRGPPFIADFIHGSDGLGNTLPPPPKNKKIDKNACEFLVDKVSEYPGEVTILALGPLTNIALAVKKDRSFASKVKKIVILGGSFFASGNINPAAEANVYGDPEAADIVFTCGAEIVIVGLNVTTQVLMTDQDLCELRDSGGRYGRYIYNISQFYRDWHVKSDGINGIYLHDPTCFVALLKPHLFEFKKGAVRVETQGICTGHTLMDLGLKNWNSNNPWTGVRPVSVAWTVDAAAVINLIKELLKKA

SEQ ID NO: 54764 - protein, 200 aa, Nocardioides sp. JS614
MTAAVRTELMVPLRLADGWSTLARLYTFDGLTDPGEHLALRLGSPGDVPLVRVHSECLTGDVFGSQRCDCGPQLHEAFRRVDAVGGYVLYLRQEGRGIGLYPKLDAYALQDAGLDTYEANVALGYGEDERDYSVAAQMLTALGVSRVALLSNNPDKAEQLALDGITVAARVPTAVHRSEANARYLAAKAQHADHTLDLGA

SEQ ID NO: 54765 - protein, 154 aa, Campylobacter coli RM2228
MRRVLSVIVLNEHGVLSRIVGLFSGRGYNIDSLTVAPLLGGEFSRINIVTFGDERVFEQIVKQLHKLIPTYKVIERDEFIEKEMALVKIPLSENLGGLDAVLKAYNGTIANSNENFLFLLVADDTNRIENFLKTIKKYNPSDIVRSGSVLMELK

SEQ ID NO: 54766 - protein, 189 aa, Glycine max
MAEYERSIQHQSKETAFQALNTIIQLHFEKTLEKKRAIDLQKKELYKLFQIFFIFLGLVFLVLAQSPRLQCRHCWIPITLLSIAHLIFYVSVAQTLRCINAFKYQRRCHKLTLGLATEKLRDIKIRIAAASAADADYDSVVADDEFEIHYQEPPETYFGKFKRNWALHFGFLILIYAFMISSSVVLLCF

SEQ ID NO: 54767 - protein, 386 aa, Salmonella enterica subsp. arizonae serovar 62:z4,z23:--
MRNNPLIPQSKLPSLGTTIFTQMSVLAQKYQAINLSQGFPDFDCPRYLQERLAYYVAQGANQYAPMMGAQALREAIADKTAELYGYRPDDACDIIVTAGATEALYAAITALVRKGDEVICFDPSYDSYAPAVELSGGVLKRIMLAPPHFSVDWQAFSELLSERTRLVILNTPHNPTATVWRQADIEALWQAIGEREIYVLSDEVYEHICFAAEGHASVLAHPQLRERAVVVSSFGKTFHMTGWKIGYCVAPAAISAEIRKIHQYLTFCVNTPAQLALADMLRAAPEHYRALPDFYRKKRDVLVNALAQSRLKVLPCEGTYFLLIDYSAVSTLNDVEFCQWLTKDVGVAAIPLSVFCAAPFPHQLIRLCFAKQELTLLAAADRLCKL

SEQ ID NO: 54768 - protein, 346 aa, Alkaliphilus metalliredigens QYMF
MKNRAVFMQGTDNMVTKDVPMPKIKEKDVLIKVDIVGICGSDVHYYKHGKIGDFVVEGEFILGHEAAGEVVEVGEQVKGLTVGDRVTMEPGKTCGKCEFCKGGKYNLCPDVEFFATPPYHGVLTNYVSHPEDMCFKLPKNVSNVEGALVEPLAVGLHASDQGGVKLGDTVVIFGTGCIGLMTIISCKAKGAAKIIVVDILENRLEVAKKVGATDTINAKEVNVLKKIQELTDGKGAEVVIDAAGAAITVKQTVDAVKPGGTIVLVGMTPKDEVEFNFMKLMGKEAEVKTVFRYRNLYPIAINAIASGAINIKDIVSHEFDFEQTKEAFDFVAEHASDVVKAVIKIK

SEQ ID NO: 54769 - protein, 327 aa, Alkaliphilus metalliredigens QYMF
MTIPKSLKLANLPTKIEKLERLSKSLGDINIYIKRDDQTGTEVSGNKVRKLEFAVQEALDQGCDYLITCGGIQSNHARATAAVAAKLDINSYLVLRSNGDDPVEGNYFLNKILGAEICLITPEEYRDNRMKVMEEIQRELAGQGHKAYILPEGASNGIGTFGYYQAMEEILEQEAELDVKFDAIVTAVGSGGTYAGLFYANKLRKNEAKIYGINVCDDADHFKNRVQELVHESIQYTKRPIHFKKEDIHMIDGYVGEGYAQSRQEELTFILDFAKLEGIILDPVYTGKAMYGLVEEIKKGSFNGFKNILFIHTGGLYGLFPKGNQLF

SEQ ID NO: 54770 - protein, 421 aa, Rubrobacter xylanophilus DSM 9941
MRRAGEDPVGLAARSALEGGRRGLGRVWPFLGPAFVAAVAYVDPGNFAADMEGGARYGYLLLWVVACADLVAVLVQSMSARLGIATGRNLAELCREAFPWPVVALLWLQAEAVAMATDLAEFVGAALALRLLFGLALLPAALLTGAAVFGLLALQRRGVRPLEAAVSAMVGVIVLAFALQVFLSGPEWGRAVAGLLEPGFAGPGSVLLAAGILGATVMPHAIYLHSALVQRRVVGRTAEERRRIYRFELLDVAVAMGLAGLVNASMLVVAAALFHPGGAAGLEGVFYGISALEGRWAALLFGLALLASGLSSSSVGTMSGQVVMQGFVSRSIPLFARRALTMAPALAVIAAGVDPARALVLSQVVLSFGIPFALVPLILFCRDRALMGSLAAGRPLTAAAAAAAAAVISLNVLLLCQTLRP

SEQ ID NO: 54771 - protein, 309 aa, Salmonella enterica subsp. enterica serovar Typhi str. CT18
MSKKIAVIGECMIELSQKGADVQRGFGGDTLNTSVYIARQVDSAALAVHYVTALGTDSFSQQMLEAWQHENVDTSLTQRMENRLPGLYYIETDDTGERTFYYWRNEAAAKFWLESEQSAAICETLATFDYLYLSGISLAILSPTSRDKLLSLLRECRANGGKVIFDNNYRPRLWTSREETQQVYQKMLECTDIAFLTLDDEDALWGKQPVEEVIARTHAAGVQEVVVKRGADSCLVSIQGEALIDVPAVKLPKEKVIDTTAAGDSFSAGYLAVRLTGGSATDAAKRGHLTASTVIQYRGAIIPHDAMPQ

SEQ ID NO: 54772 - protein, 217 aa, Wolbachia endosymbiont of Drosophila melanogaster
MVQATYASMSLPGISSVEDVLEDARSGKLFILVDDESRENEGDLVVLAEKVKPEHMAFMVRYGTGIVFLAMTKLHMSKLNLEFMRKSNVDEKLTPHTAFTTSIDARYGITTGVSAHDRTHTILTAIDEKSTKDDIITPGHVFPIIANEGGVLARNGHTEASVEIAKLVGLNHAAVGCELVNDDCSMMRLPQLLKFAEQHKIKLTTIDKLISYVKKLN

SEQ ID NO: 54773 - protein, 441 aa, Salmonella enterica subsp. enterica serovar Paratyphi B str.
MYHGQLKNILLLSLRFIMDKLSYASDSSTSAWNTYLQQIERVAPYLGELSPWVDTLRHPKRALIVDIPVQMDDGTIRHFEGYRVQHNLSRGPGKGGVRYHPDVDLNEVMALSAWMTIKCAALNLPYGGAKGGIRVDPFSLSEGELERLTRRYTSEIGIIIGPQKDIPAPDVGTNGKVMAWMMDTYSMNHGTTITGVVTGKPIHLGGSLGREKATGRGVFVSGLEAARRANIAVEGARVAVQGFGNVGSEAARLFAGAGARVVAIQDHTATLFNATGIDMKALTAWQTEHKQIAGFPGAETIASDAFWRLEMDILIPAALEGQITRQRAEALTCKLVLEGANGPTYPDADDVLASRGILVVPDVVCNAGGVTVSYFEWVQDMASFFWSEEEINARMDKIMTDAIVHVWEKATEKSCSLRTAAYIVACERILLARKDRGIYPG

SEQ ID NO: 54774 - protein, 425 aa, Vibrio campbellii AND4
MDLAFDRQHIWHPYTSTLTPLTCYPVASANGVHIKLEDGTELVDGMSSWWSTIHGYNHPHLNQAAHRQIDQVSHVMFGGITHQPAITLCKKLLSLAPSNLEHVFLADSGSVAVEVSLKMALQYWHAKGERRPKFLTLRHGYHGDTFAAMSVTDPDNSMHSLYKGFLPEHIFAQSPTCGYWAEWDPEDLTDFEHKIETYHQELAAVILEPIVQGAGGMRIYHPEFLKGVRRLCDKYGLLLIADEIATGFGRTGKLFACEHADIQPDILCVGKALTGGYMTLSATLASKNVADTVCGGDAGCFMHGPTFMGNPLACAVATASLELIEQGDWQQQTRQIETLFSELLPTLEEYDLVKNTRWLGAIGVVETHRPVNMETIQALFVEHGVWIRPFGKLIYMMPPFISKPEDIEKLVNAVKAALQCQACFT

SEQ ID NO: 54775 - protein, 333 aa, Vibrio vulnificus YJ016
MTIKVGINGFGRIGRLAMRAAFDWPELEFVLINDVAGDATTLGHLLEFDSVQGRWHHEVTVQGQQLHINGHVIETTQQRDISAVDWSGCDVVIEATGVHRKSRFLNQYLEQGVKRVVVSAPVKEEGIANIVVGVNDEIFNPEQHRIVTAASCTTNCIAPVVKVIHEKLGIEQASFTTIHDLTNTQTILDAPHKDLRRARACGMSLIPTTTGSATAIVEIFPELKDRINGHAVRVPLANASLTDIIFDVKRDTTAEEVNALLKEASQGELNGILGFEERPLVSIDYRGDQRSTIVDALSTMVVGTRMVKIYAWYDNEMGYATRTAELVRKVGAA

SEQ ID NO: 54776 - protein, 379 aa, Ustilago maydis 521
MSKQAYNVVVLPGDGIGPEVVEQATRVLELISSKSTTFSIKLKSYDFGGCAIDSTGKPLPDDTLAACKEADAILMGSVGGPKWGVGKVRPEQGLLALRKELDLYANIRPCLFPSESLLSHSPLKPEVAKGVSFIVVRELVKGLYFGERQEANLDDPNSDGAAFDTMVYNKHDVERITKLASHLALQSNPPAPLHSIDKANVLATSRLWRKVVQDTVDSEFASQGITVDHQLVDSASMVMVSNPRKLNGVVLTENMFGDILSDESSVIPGALGLLPSASLSGLPDGNGKCNGLYEPIHGSAPDIAGKGIANPVGTILSAAMLLRYSLNQPDLADKVEAAVRKVLDAKQIGGLELRTADLGGKHGSKDVGDQVVAVLETLL

SEQ ID NO: 54777 - protein, 339 aa, Burkholderia pseudomallei K96243
MSASPALSPRRVSVAPMMDWTDRHCRSFHRTISRHAWLYTEMVTTGALIHGDVARHLAFTPDEAPVALQLGGSEPADLAHSAKLGERWGYDEINLNCGCPSERVQRGAFGACLMNEPQLVADCVKAMRDAVSIPVTVKHRIGVDAVEDYAFVRDFVGTVAAAGCDVFVVHARNAILKGLSPKENREIPPLKYDYAYRLKRDFPQIEIVINGGVTTLDEVEQHLRHVDGVMLGREAYHNPYVLAGIDARFYGASAPAPTREEVEAKLVEYCAAELARGTYLGAIVRHALGLYRGVAGARGWRRVLSDNKRLGRGDLSIFDEARTHLTHPEEFFEKKALQS

SEQ ID NO: 54778 - protein, 319 aa, Cytophaga hutchinsonii ATCC 33406
MKRILITGGAGFIGSNLTEALLNRSDVELVRVLDNFSTGYQHNIHEFLTHPKYEFVEGDIRNYEDVVKAVEGIEVISHQAALGSVPRSLKDPMTSNNANVLGSMNVFHAAKESGADRVVYASSSSVYGDDPGSPKEEDRLGNVLSPYAASKRSIELYAKAFSNVYPFRFIAMRYFNVFGPRQNAQGAYAAVIPQFITALLNGQQATIFGDGSQTRDFTFIDNVLQMNIKALSTDNADAFNRYYNVACGSTTSLNRVYAILAGCAGSDIKPHYTDPRQGDIKDSLANISLAQKHIGYKPEIQIEEGLIKTFDWFKKNQGE

SEQ ID NO: 54779 - protein, 131 aa, Glycine max
MTSKGAILLCLNVLFFTVVSSTYVPCNPPPKTPKHPPVPKPPSPKQVSCPKDTVKFGVCADVLGLINVQLGKPPKTPCCSLIHGLADLEAAVCLCTALKANVLGINLNVPVNLSLLLNYCGKGVPKGFVCY

SEQ ID NO: 54780 - protein, 185 aa, Methanosarcina acetivorans C2A
MESTITIENVVASTALATEFDLVKIMDSGLEGAEYNKTKFPGLVYRIDNPKAAFLIFTSGKVVCTGAKTINNAHKAITNLANKLKDIGCDKINLEPEIHVQNIVASADLKTTLNLNTIAIAFGLENVEYEPEVFPGLIYRVEAPKVVVLVFSSGKLVITGGKCEEDCNGGLRIVRKEFDNLGLLC

SEQ ID NO: 54781 - protein, 339 aa, Campylobacter coli RM2228
MKFVSIEQAIKDLQEGKMLVMVDAEDRENEGDLIFPAQFSTKEKVNFMIKEARGVVCVALAEELARKFELPLMVPKNTSNHETAFTITVDAKDATTGVSAYERDMTIKIFADDNAKASDFVRPGHINPLIAKKGGVLERTGHTEGTVDLCHLAGLKQACVICEIVKDDGDMARRSDLEEFCTKHNLNMIAVSDIIEYRLKNESLIKLQEKSDAILAGFKAQKFIFTDHNNAQHIAFAFKEIQKCENVKFHISGSDFELLTSDKFSKLLDQIRFLSENGGVIVFMQGEKSSVTQFKNYGIGAQILRYFGIEEIKLMSQSCDKDYIGLKGFGLNLKICNFN

SEQ ID NO: 54782 - protein, 526 aa, Hyphomonas neptunium ATCC 15444
MTQQADSVLKAHERVLIVDFGSQVTQLIARRLRESGVYCEIHPFNKVDGAFLAAFGPQALILSGGPASVTWKDAPLADQAIFDSGLPILGICYGQQVMMHQLGGKVESGTSREFGRAFIEQVEADPILEGLFEGDNSEQVWMSHGDHVAEMAPGFGVIARSPGAPYAVIADPERKFYGTQFHPEVVHTTHGARLLRNFTHGVAGLKGDWTMAAYRAEAIQKIRNQVGKGRVICGLSGGVDSSVAAVLIHEAIGDQLTCVYVDHGLMRAGESEQVVSLFREHYNIPLVHVDASELFLGQLDGVTDPEKKRKIIGGLFIDVFDAEANKIGGADFLAQGTLYPDVIESVSAIGGPSVTIKSHHNVGGLPARMKMKLVEPLRELFKDEVRALGRELGLPEAFVGRHPFPGPGLAIRIPGAITREKADTLRKADAIYIDEIRKAGLYDEIWQAFSVLLPVNTVGVMGDERTYEAVLALRAVTSTDGMTADYYPFEHAFLGRVATRIINEVKGVNRVVYDVTSKPPGTIEWE

SEQ ID NO: 54783 - protein, 362 aa, Oryza sativa Japonica Group
MALRRLLQGSVLPRMAGRAAAAPFSTASGETVRATLFPGDGIGPEIAESVKQVFNVAGVPIEWEEHYVGTEVDPRTESFLTWESLESVRRNKVGLKGPMATPIGKGHRSLNLTLRKELGLYANVRPCNSLPGYKTRYDDVNLVTIRENTEGEYSGLEHQVVRGVVESLKIITRQASLRVAEYAFHYAKTNGRERVSAIHKANIMRKTDGLFLKCCREVAEKYPEIVYEEVIIDNCCMTLVKNPGLFDVLVMPNLYGDIISDLCAGLIGGLGLTPSCNIGEGGICLAEAVHGSAPDIAGKNLANPTALMLSAVMMLRHLQFNNQADRIHNAILQTISEGKFRTADLGGKASTSDFTKAVCDHI

SEQ ID NO: 54784 - protein, 573 aa, Staphylococcus aureus subsp. aureus Mu50
MWDKSLVFTFFRRRFGMALSTFKREHIKKNLRNDEYDLVIIGGGITGAGIALDASERGMKVALVEMQDFAQGTSSRSTKLVHGGLRYLKQFQIGVVAETGKERAIVYENGPHVTTPEWMLLPMHKGGTFGKFSTSIGLGMYDRLAGVKKSERKKMLSKKETLAKEPLVKKEGLKGGGYYVEYRTDDARLTIEVMKRAAEKGAEIINYTKSEHFTYDKNQQVNGVKVIDKLTNENYTIKAKKVVNAAGPWVDDVRSGDYARNNKKLRLTKGVHVVIDQSKFPLGQAVYFDTEKDGRMIFAIPREGKAYVGTTDTFYDNIKSSPLTTQEDRDYLIDAINYMFPSVNVTDEDIESTWAGIRPLIYEEGKDPSEISRKDEIWEGKSGLLTIAGGKLTGYRHMAQDIVDLVSKRLKKDYGLTFSPCNTKGLAISGGDVGGSKNFDAFVEQKVDVAKGFGIDEDVARRLASKYGSNVDELFNIAQTSQYHDSKLPLEIYVELVYSIQQEMVYKPNDFLVRRSGKMYFNIKDVLDYKDAVIDIMADMLDYSPAQIEAYTEEVEQAIKEAQHGNNQPAVKE

SEQ ID NO: 54785 - protein, 514 aa, Oryza sativa Japonica Group
MVVSVAATDSDTAQPVQYSTFFASRYVRDPLPRFRMPEQSIPREAAYQIINDELMLDGNPRLNLASFVTTWMEPECDKLIMDSVNKNYVDMDEYPVTTELQNRCVNMIAHLFNAPIKEDETAIGVGTVGSSEAIMLAGLAFKRKWQNKRKEQGKPCDKPNIVTGANVQVCWEKFARYFEVELKEVKLSEGYYVMDPVKAVEMVDENTICVAAILGSTLTGEFEDVKLLNNLLTEKNKETGLSLEVDRYDQENWWDVPIHVDAASGGFIAPFLYPELEWDFRLPLVKSINVSGHKYGLVYPGVGWVIWRSKEDLPEELIFHINYLGTDQPTFTLNFSKGSSQIIAQYYQLIRLGFEGYKNIMQNCMENTAILREGIEATGRFEILSKEAGVPLVAFSLKDSGRYTVFDISEHLRRFGWIVPAYTMPANAEHVAVLRVVIREDFSRSLAERLVSDIVKILHELDAHSAQVLKISSAIAKQQSGDDGVVTKKSVLETEREIFAYWRDQVKKKQTGIC

SEQ ID NO: 54786 - protein, 354 aa, Picea sitchensis
MQIDLMGDWQCTGPPPPMGGSSADIVVNSKRQRRPSVRLGEIGDQSAAFAYSSQDLIRRKKQKQWNQPPTGFFRNASDFPGGSGKLSKTRPLLNISSDEQVILDEPISHCGFPSDEAGKMQLDPICVSKKLRHGRTRRRGVGLVGKMTRTMRVSPESNNNGQDKGSGDDNGFGASYDVDTPECFKDSDLDTSGSPVKETSTIHLDSPDSRPVNLGSSECHHTVGEVSGNEREEETWAHDNKESTEYGNGSGLNFPSDSNTRSKQDAMRDRNGDDDKKLVSISAAHYLGMVKDVRAWLNGLGLGRYAELFEMHEVEKDVLPLLTLDDLKEMGINAVGARRKIYSAIQKLGKRFAV

SEQ ID NO: 54787 - protein, 411 aa, Campylobacter coli RM2228
MNLKEEALRYHLGGKIDIKPSKPMNSSHDLSLAYSPGVAEPCIEIASNNELAYTYTNKANLVAIVSDGSAVLGLGNIGAQASKPVMEGKACLFKKFADVNAYDLEIEAHSIEEIVAFCKAIAPTFGGINLEDISAPKCFEIEAALQDLGIPVMHDDQHGTAIISTAGLMNAMEISGKKFEEIKVVVSGAGAAGIASARMYRNLGVKNIILVDSKGVVNKKRTDLNQYKLEFVSDTQADTLKEAMKDADVFLGLSAPKILDDEMILSMAKDPVIFALENPIPEVMPEDVARLRKDAIVGTGRSDYPNQINNVLGFPFIFRGALDVRATKITENMKVAAAKALADLAKLPVSDAVKNAYKISHLEFGKDYVIPKPFDERVKAVVSTAVAAAAVKDGVALLKEFDEKTYFESLK

SEQ ID NO: 54788 - protein, 363 aa, Picea sitchensis
MAMENWAFTRVQTLADSGIQTVPPEYVRRVEKTHHDPNRFQVPIIDLQLGFSSQQHDHFCKDQYDRIAAQISRAAENWGFFQIINHGIPDSLIARVQEASKAFFQLPTKEAYANEAQNPIGYGSKIGYSPDSEAKLEWGDYYYNAIWPPDMRDMSKWPIQLSDFTESMDEYSRELSKLFELLMEVLSRDLDLESENSLNESVGGERKGLHIRINYYPPCPQPDLVVGLAPHSDPNVLTILLHDQTPGLQIRKDGAWIDVQCIPGALVVNIADQMEILSNGKYKSIEHRGVVHKDRSRISWAVFCSPPQDMVVSPKRELIDEQHPPLYQGAPYREYLTKFFKKGLDGKGHIHNAKQQDSLVSNS

SEQ ID NO: 54789 - protein, 313 aa, Ashbya gossypii ATCC 10895
MSTKATLKASTDTVTLNTGAKIPLFGLGTWQSTDDDASSAVAAALKHGYKHIDTASFYKNEELVGKAVKESGIPREELFITTKVWNDQQRDPAGALDLSLKKLGTEYVDLLLMHWPVPFKEPENSTLDAYKVPRGPDGKVTRDEEWDFVKTWHLMQKLLGTGKVKAIGVSNFSINNLEELLNAEGTTVVPAVNQVELHIRLPQLELVEYCQKKGIVVEAYSPLGSSSAPLLKDATVNKVAEKYGVTPAHVLLNYVANRGIVVLPKSVKESRIISNFEYFKMDEEDIKLLNDIHKKEGVQRFVDPDFSPFPLFQ

SEQ ID NO: 54790 - protein, 438 aa, Pseudomonas sp. QDA
MRISIFGLGYVGAVCAGCLTARGHEVIGVDVSSTKIDLINQGKSPIVEPGLEALLQQGIANGRLRGTTDFAEAIRASDVSMICVGTPSKKNGDLGLEYIESVCREIGYVLRDTTRRHTIVVRSTVLPGTVKNVVIPILEDCSGKQAGVDFGVAVNPEFLRESTAIKDYDQPPMTVIGELDSASGDILQALYEELDAPVIRKPIEVAEMIKYTCNVWHATKVTFANEIGNIAKAVGVDGREVMDVVCQDTVLNLSQYYMRPGFAFGGSCLPKDVRALTYRAASLDVRAPLLDSLMRSNESQVQNAFELIEAHDKRKVALLGLSFKAGTDDLRESPLVELAERLIGKGYQLDIFDENVQYARMHGANKDYIESKIPHVSSLLNADLQQVIDNADIIVLGNRDEQFRTLAQQAPAGKQVIDLVGFMSKPSSTTSRTEGICW

SEQ ID NO: 54791 - protein, 156 aa, Physcomitrella patens subsp. patens
QEEGAILRQWKRENMQRLQEKERVEKEKLQQIMDDADEYKEKHKAKRESNREAKMKENREKEMVYHADQEHFHKTADKQYWKAVTELVPKELPASLEPKSRQMKEKKEKKSTFVALPGPKPGRATDLGRFRQVLLKLKHNPPAHMIPPPPPPAKAE

SEQ ID NO: 54792 - protein, 526 aa, Arabidopsis thaliana
  misc_feature (453)..(453): Xaa can be any naturally occurring amino acid
MNPEEQKMESASDLGKLFIGGISWDTDEERLQEYFGKYGDLVEAVIMRDRTTGRARGFGFIVFADPSVAERVIMDKHIIDGRTVEAKKAVPRDDQQVLKRHASPMHLISPSHGGNGGGARTKKIFVGGLPSSITEAEFKNYFDQFGTIADVVVMYDHNTQRPRGFGFITFDSEESVDMVLHKTFHELNGKMVEVKRAVPKELSSTTPNRSPLIGYGNNYGVVPNRSSANSYFNSFPPGYNNNNLGSAGRFSPIGSGRNAFSSFGLGLNQELNLNSNFDGNTLGYSRIPGNQYFNSASPNRYNSPIGYNRGDSAYNPSNRDLWGNRSDSSGPGWNLGVSVGNNRGNWGLSSVVSDNNGYGRSYGAGSGLSGLSFAGNTNGFDGSIGELYRGSSVYSDSTWQQSMPHHQSSNELDGLSRSYGFGIDNVGSDPSANASEGYSGNYNVGNRQTHRGXKHRKKSTKRSENCRSRRTAISVAEFEELLFRYQVEKETNFLHHSEFLVLFFSSLASQTQKREVYFYFKNSYIR

SEQ ID NO: 54793 - protein, 1452 aa, Aspergillus fumigatus
MNESHEAGKNSSTNVEEREEEVLRLARQFTEQSSYSTAGQTPFAAEAGSALDPNGERFNARAWCKAMLQMHIGDKEAHPLRTLGVAFSNLNVHGFGSDTDYQKSVGNVWLKTLSLARIAFGQKQRKVDILQNLEGLVEAGEMLVVLGPPGSGCSTFLKTIAGETYGFHVDKNSNINFQGIAKQMAHEFRGEAIYTAEVDVHFPKLTVGDTLYFAARARTPRHIPGGVNATQYAGHMRDVIMAMFGISHTKNTIVGNDFIRGVSGGERKRVSIAEACLSNAPLQCWDNSTRGLDSANAIEFCKTLRMQADINGTTACVSLYQAPQAAYDYFDKVLVLYEGREIYFGPTSMAKHYFLQMGFVCPDRQTDADFLTSMTSHLERVVQPGYEDRVPRTPDEFAARWKASPQRAQLMQHIKSYNAKFALDGEYLDKFKQSRRAQQAKAQRVSSPYTLSYVQQVKLCLWRGYQRLKADPSVTISSLFGNTIISLVIASIFYNLKADTSTFFQRGALLFFAVLMNALGCGLEMLTLYAQRGIIEKHSRYALYHPSAEAFSSMIMDLPYKILNAITSNIVLYFMTNLRRAPGAFFFFVFTSFILTLTMSMFFRSMASLSRSLVQVLPFSAVLLLGLSMYTGFAIPTGYMLGWARWIAYINPISYGFESLMINEFHNRDFPCMDYVPSGPGYTDVGLNNRVCSTVRSVPGQAFVNGNAYIESAYSYTASHKWRNIGVIFAYMFLLGAVYLVATDFITEKKPKGEILVFPRGHKALKKGKSDEDLEGGGGRSATVEKIGSDGLAMIERQTAIFQWKDVCFDIKIGKENCRILDHVDGWVKPGILTALMGVSGAGKTTLLDVLATRTTMGIISGEMLVDGQPRDESFQRKTGYAQQQDLHLSTATVREALEFSALLRQSAHVPRQEKIDYVTEVIKLLDMTEYADAVIGVPGEGLNVEQRKRLTIGVELAARPQLLLFLDEPTSGLDSQTSWAILDLLDKLKKNGQAILCTIHQPSAMLFQRFDRLLFLQAGGRTVYFGEIGQNSQILIDYFVRNGAPPCPPDANPAEWMLDVIGAAPGSHTSINWFETWRRSPEYARVQEHLAELKHERRHQTNLFRTTSGQKREDKDSYREFAAPFWAQLYQVQVRVFQQIWRSPTYINSKTALCVLSALFVGFSLFHTPNTIQGLQNQMFGIFMLLTLFGQLIQQIMPHFVAQRALYEVRDRPAKTYSWKAFLIANIVVELPWNSLMSVLMFLCWYYPIGLYRNAEPTDAVHLRGTQMWLMIWTFLLFSSTFAHFMIAAFDAAENAGNLGNLLFLLCLLFCGVLATPDQLPRFWIFMYRVSPFTYLVSGMLSVGISNTNVTCADNEYLRFDPVNGTCGEYMGSYMSNLGGYLADEMATANCSFCPIKETNVFLGRVSSSYSDIWRNFGLMWVFIVFNIFAACSLYWWVRVPRDKKPVAKAE

SEQ ID NO: 54794 - protein, 615 aa, Legionella pneumophila str. Lens
MKSTDPIKIAVLPGDGIGIEVTEATLPVFEVLDVPATLSYGDIGWEFWKKEGTAIPSRTWQLISASDTVLLGAITSKPQREAKQELSKALRKSNPYYVSPVIQLRQGLDLFANVRPCFSIDDQSKPFNFCIIRENSEGLYCGFDYFPLPKAIHNLLAESQHWQTIPADEASCALRLQSKPGLTRLFDFAFNHAMQTGMPRVTLADKPNVLRESGEFARKIFESTAQKYPKIQADILNVDAVALWLIKSPEKFGVIVAENMFGDILSDIGAGVMGGLGLAPSANIGDKGSYFEPVHGSGPRMKKNCANPSAMFLTISMLLNHFGYPDRAKKIVNAVMQVIKEKRFITYDLGGHSTTIDMANAVIESCARLEASCLSTDFSSVPKENLIESDTMSNLLQQLMHCNSAEISDALDACGIEGGLLNIKPLSQGMKMVGPAYTIQYLPREKKETAFHNAANYIDKVPKHSVIVIDNNGQTDCTVWGDLLTHTALRNNIMGTVVHGAVRDVESIRSTNYPVFCTGIYMCSGKNRVYKANEQCPLFINGVTINPGDIVFADDNGVLVIPNELLHEVVNKTIAIRLTEKRIKAAVASGSTLEQAREDYYYEQPWLGINKKREQ

SEQ ID NO: 54795 - protein, 594 aa, Prochlorococcus marinus subsp. marinus str. CCMP1375
MTTIDLKRRTKIVATIGPATESPEKITELIKAGATTFRLNFSHGDHEEHAKRIKTIRSVASDLGVNIGILQDLQGPKIRLGRFKEGPVNLKTGDVFALTSENKDCNQEIANVTYENLVNEVEKGKRILLDDGRVEMIVENVDKKNKSLICKVTVGGILSNNKGVNFPDVQLSINALTEKDKIDLSFGLKQGVDWVALSFVRNPADIQEIKELIRRHGYTTPIVAKIEKFEAIDQIDSILSLCDGVMVARGDLGVEMDAEEVPLLQKELIKKANSLGIPIITATQMLDSMASSPRPTRAEVSDVANAILDGTDAVMLSNETAVGDYPIEAVETMAKIARRIERDYPQRALESHLPSTIPNAISAAVSTIARQLNAAAILPLTKSGATAHNVSKFRPATPILAITSEISVARRLQLVWGVSPLLIDAQKSTSKTFGIAMEQAMDMKLLKPGDQVVETAGTLTGISGSTDLIKVGIVSKIVASGKTKPIVKEGTISGKLRVINKATDLSDLKSGEILVLAENVQYNLDTKTHISAMIFEGEYSLINTNNQIEDNNIIPAIYNVEGACTKFKNGEIVTLDLKDGNIIKGLAQDLKTYN

SEQ ID NO: 54796 - protein, 380 aa, Picea abies
NNVNPIKEVQDSPKEPNPITEQISVHADCKQTVEKPNENEIVVSANKAAVASLKQQSTLQSPRISRQPKTSLNQGNPVPLAKLHEDAGRSSSLDFVNIDSEYKDPQMCTAYVTDIYANMRVVELKRRPLPNFMETIQRDINANMRSVLIDWLVEVSEEYKLVPDTLYLTISYIDRFLSANVVNRQRLQLLGVSCMLVASKYEEICAPPVEEFCYITDNTYKKEEVLDMEINVLNRLQYDLTNTKPLRPFSGVSFEQLKHPVRFQACIWEFMGNYLAELTLVEYDFLKYLPSLIAAAAVFLARMTLDPMVHPWNSTLQHYTGYKVSDMRDCICAIHDLQLNRKGCTLAAIRDKYNQPKFKCVANLFPPPVISPQFFIDNEV

SEQ ID NO: 54797 - protein, 412 aa, Streptococcus pneumoniae
MKIAVTGTGYVGLSIAVLLAQHHQVIAVDIIPEKVELINQRKSPIQDDYIEKYLAEKDLNLVATLDAKEAYKDADFVVIAAPTNYDPKKNFFDTSAVESVIETVLKYNPDAIMVIKSTVPVGYTESARKKFQTENILFSPEFLRESKALYDNLYPSRIILGTDKNNERLVSVAETFAGLLQEGALKEDIDTLYMGFTEAEAVKLFANTYLALRVSYFNELDTYSEMKGLDTQAIIDGVGLDPRIGSHYNNPSFGYGGYCLPKDTKQLLANYEDVPEELIGAIVRSNSTRKDFIADQVLKMVDYYDYSAHNVFNERVEKDIIIGIYRLTMKSNSDNFRQSSIQGIMKRIKAKGVRVVIYEPTLESGSTFFGSSIINDLEEFKRLSNAIVANRYDNSLEDVKEKVYTRDIFERD

SEQ ID NO: 54798 - protein, 513 aa, Prochlorococcus marinus subsp. marinus str. CCMP1375
MVDYLHKILTARVYDVARETPLEKAFNLSKRVQNDIWLKREDLQPVFSFKLRGAYNRMSNLTQKELEKGVVASSAGNHAQGVALSAQHLKCRAVIVMPITTPPVKIQAVKSLKAKVILHGDTYDEAYLEAIRLSKEEELVFIHPFDDPLVIAGQGTIGVEILRQIDQPPYAIYVAVGGGGLIAGVGAYIKNLWPEVKIIGVEPEDASAMTSSLKANKRIELSNVGLFADGVAVKQVGEETFKLAKKYVDEMITVNTDQICAAIKDFFEDTRGILEPAGALAIAGLKAHIQKNDLKDKHLVAITCGANMNFERLRFVAERALLGESKEAMMAIEIEEKAGSLKMLCKVIDNRNLTEFSYRISQTKTANIFMAVEVANKEDRISLFNKIKSHGFKIIDLSDDELSKIHLRHMIGGRFPNVIRNQKKSYKELLYRFEFPERPGALMNFLEAMNPEWSISIFNYRNHGADIGRIVIGVLVHDKDLVAWRNFLNELGYKYWEETENAAYKLFLGAQHE

SEQ ID NO: 54799 - protein, 643 aa, Prochlorococcus marinus subsp. marinus str. CCMP1375
MRLSDVSHPNQLHGLTTAQLEDVACQIRERHLQVVSTSGGHLGPGLGVVELTLALYQTLDLDHDKVVWDVGHQAYPHKLLTGRYGDFDSLRQQNGVAGYLKRSESSFDHFGAGHASTSISAALGMALARDRQGKDYKCVAVIGDGALTGGMALEAINHAGHLPSTPFLVVLNDNDMSISPPVGALSTHLNRMRHSAPIQFISDSVQEGVRNIPFIGKEIPQEIKSLTGSVKRLAVPKVGAVFEELGFTYMGPVDGHDIAQMTRTFQAAHRIGGPVLVHVATTKGKGYPYAEADQVGYHAQSAFDLTTGKSIPSKTPKPPSYSKVFGQTLVKICEQNSKVVGITAAMATGTGLDLLQKAIPDQYIDVGIAEQHAVTLAAGMACDGLRPVCAIYSTFLQRAFDQLIHDVGIQNLPVTFVMDRAGIVGADGPTHQGQYDISYLRSIPNFTVMAPKDEAELQRMLVTCLSHDGPTALRIPRGPGEGVTLMEEGWDPLKIGRGEILSEGSDLLIIAYGSMVAPAQKTALCLKESGISATVINARFLRPLDQGLIHPLARRIGKVVTMEEGTLLGGFGSAIVESFADQDIAVSTYRIGIPDKLVHHASPQQSKEELGLTPTAMADNIKKRFGWDNSDSLFVKNSNTSTI

SEQ ID NO: 54800 - protein, 492 aa, Xanthomonas campestris pv. campestris str. ATCC 33913
MKAKPTLSFWQIWNMCFGFLGIQFGFALQNANASRIFQTLGAQVDDVPGLWIAAPLTGLIVQPIIGYLSDRTWTGWGRRRPYFMIGAVFTTLALLVMPNAPVLWIAAGTLWVLDASINISMEPFRALVGDQLPAEQRPSGYAMQSFFIGVGAIVASFLPWLLTRWGVDNTAPAGELPDSVRYAFYLGAAVLFLSISWTVLRTREYSPAELAAFEPAPAPAAAQLAATDQPSLQASVLWCLGGLLLAAAIAWQHGDRMLYVLAGLCIAYGVLLALARVLPRGGMLVAIMHDLRHMPQTMRRLAWVQFFSWFALFAMWIYTTAAVPQVHFGARDTVSAAYNDGANWVGVLFGAYNGFAALAATVIPLMVRAIGLRWSHLCNLWLGAAGLLSMLFIRDPYWLLLSMLGVGFAWASILSLPYALLSDSVPAAKMGVYMGIFNFFIVIPQLVAASALGFVLRVWLGGQPIYALAIGGLSLIVAGVCVVRVPSAQGGQ

SEQ ID NO: 54801 - protein, 143 aa, Nocardioides sp. JS614
MRIGDVLKAKPSHEVITIGPDAGVRELIAKLAEHNVGALIVSSDGTSVDGIVSERDVVRHLHSDGTVINNTVQAIMTTVVQTCDQETQVDELMKTMTERRVRHVPVVEGGRLVGIISIGDVVKHRIDQLEFERDQLDSYVHQT

SEQ ID NO: 54802 - protein, 344 aa, Polaromonas sp. JS666
MENPLVMENPDKPLQVATAGEALIDLILQPDGRYEPCIGGAVFNLTRALARQDIGTLYLNPLSGDRFGRQLAAALVSDGVQLAHSQPVMQSTSLALVGVDDKGHPDYAFYRDGVADRAITAERLIRSCRQAPALQMVCTGALALAPEDAPHYLPWLRAQREAGTLVVVDANLRPSVMPDLEAYRRNVQAVMQQADVLKVSDEDLEHLATPGGDALARAQHLLDATSARLLVLTLGAQGACLLTREGRQWRAREAMPLKVVDTVGAGDCFLAGFLAALLTHDGAGHGLTGAAAAAVRAPLDDAAGRRLLAHALASASLCVMRRGCVPPTRVQVQARVEQAPCAFG

SEQ ID NO: 54803 - protein, 512 aa, Cunninghamella elegans
MAIVSQISRFITFTIISMGYSVLAVGVALTIHILSQLIVPKNPNEPPNVFSLIPVLGNAVQFGMNPVAFLQECQKKYGDVFTFTMVGKRVTVCLGADGNQFVFNSKQNLSSAAEAYNHMTKYVFGPDVVYDAPHAVFMEQKKFIKAGLNSDCFRQHVPMIVQETEEFFKKFNKPTGFIEAYETFGSLIIYTASRCLMGKEIRASLDGNVAKLYYDLDQGFKPINFIFPNLPLPSYRRRDVACKKMADLYSSIIQRRKDEKDNNNADLLQALMDATYKDGTHIPDHHIAGMMIAVLFGGQHTSATTSAWTILELANRPDIIKALREEQIEKLGSLKADLTFDNLKDLPLLEAAIRETLRLHPPIFQMMRRVVADKIVYEKNGMEIPKGNFICAAPGVTQVDPTYFNEPTTYNPYRWIEKTDPVHQLEQGDDANIDYGFGAVGISSKSPFLPFGAGRHRCIGEQFGYLQLKTVISTFIRTFDFDLDGKSVPKSDYTSMVVVPEHTAKVRYTWRE

SEQ ID NO: 54804 - protein, 446 aa, Brassica napus
MKGVIPHYHHSYTFFFVILVLFPHAFSTNTLSSNEALTISSNKTLVSPGDVFELGFFKTATKNSQDGSTDRWYLGIWYKTTSDKRTYVWVANRDNPLHNSIGTLKISHASLVLLDQSDTTVWSTNLTGVAHLPVTAELLANGNFVLRDSKTNDLDRFMWQSFDYPVDTLLPEMKIGRKHKSSEKEKILTSWKSPTDPSSGDYSLILETEGFLHEFYLFKNEFKVYRTGPWNGVRFNGIPKKMQNWSYIDNSFIDNNEEVAYTFKVHNNNNMIHSRFRMSSTGYLQVITWTKTVPQRNMFWSFPEDTCDLYKVCGPYAYCDMHTSPTCNCIKGFVPKNAGRWDLRDMSGGCVRSSKLSCGEGDGFLRMSQMKLPETSEALVEKRIGLKECREKCVRDCNCTGYANMDIMDGGSGCVTWTGELVDMRKYDAGGQDLYVKVAEASLVPS

SEQ ID NO: 54805 - protein, 214 aa, Mycobacterium smegmatis str. MC2 155
MAEQAGAGSAQDNRGGRGRRDDRGGRGRDGGDKSNYIERVVSINRVSKVVKGGRRFSFTALVIVGDGKGMVGVGYGKAKEVPAAIAKGVEEARKNFFRVPLIGSTITHPVQGEAAAGVVMLRPASPGTGVIAGGAARAVLECAGVHDILAKSLGSDNAINVVHATVAALKLLQRPEEVAARRGLPIEDVAPAGMLKARRESEALAAAAAREGSA

SEQ ID NO: 54806 - protein, 307 aa, Mycobacterium smegmatis str. MC2 155
MSADTKWTEADVPDQSGRVAIVTGSNTGLGYETARALAAKGAHVVIAVRNLDKGRDAVDRIMASTPKADLKLQKLDVGSLDSVRTAADELKGAYPHIDLLINNAGVMYPPKQTTVDGFELQFGTNHLGPFALTGLLIDHLLPVEGSRVVAVASVAHRIRAKIHFEDLQWERRYNRVEAYGQSKLANLLFAYELQRRLAAAGKPTISVAAHPGLSNTELMRHIPGTGLPGYHQIASLFSNSPLMGALATLRAATDPGVKGGQYYGPDGFREVRGHPELVKSSSQSRDPELQRRLWAVSEELTGVSYPV

SEQ ID NO: 54807 - protein, 368 aa, Vitis vinifera
MAKEGSKLSSIYRRFKPHLLMALAQFGYTFLYFITEASFNHGMNPHVYITYRHIVGGLVTFPFAYFLERKVRPKLTLALFVELFILSLLGVGLSLNMYFASLRYTSPTFIASVVNTIASLTFIIAVVLRMEVLDFRNPRGIAKVLGTLVSLAGVMTMTLYKGPIMKSLWDPLIHIQGNTTIHENWLKGSILTVASCVTWSIWYIMQAITLKRYPAQLSLTTWMSFIGAAQSAVFTVCVEHSRAAWTIGFNIDLWSTVYAGVVCSGLIIFVQLWCTEEKGPVFVTMFNPLSTVLVAVLAYFVLGEKLYMGSILGGAIVIVGLYLLLWGKEGDQEAQVKSQEESYSARDLQGGHKTQIITSAEELQRAEP

SEQ ID NO: 54808 - protein, 379 aa, Oryza sativa Indica Group
MATAGKVIKCKAAVAWEAGKPLSIEEVEVAPPQAMEVRVKILYTALCHTDVYFWEAKGQTPVFPRILGHEAGGIVESVGEGVTELAPGDHVLPVFTGECKECDHCKSEESNMCDLLRINVDRGVMIGDGKSRFTIKGKPIFHFVGTSTFSEYTVIHVGCLAKINPEAPLDKVCILSCGFSTGFGATVNVAKPKKGQTVAIFGLGAVGLAAMEGARLSGASRIIGVDLNPAKFEQAKKFGCTDFVNPKDHSKPVHEVLIEMTNGGLDRAVECTGNINAMISCFECVHDGWGVAVLVGVPTKDDVFKTHPMNFLNEKTLKGTFFGNYKPRTDLPNVVELYMKKELELEKFITHSVPFSEINTAFDLMLKGESLRCVMRMDE

SEQ ID NO: 54809 - protein, 386 aa, Physcomitrella patens subsp. patens
MEEFAEAYSVRLLAHTGRYLWADPDLKSVSQKKGKDTKGVIWRVELVPERGAIRLKSVHDLYLHASDYAFLLGATGKKVTQSYASKADSSLEWVPEKYTPYVKLKARSNKYLRANRGVPPYRNSVTHDLPVLQGNQHVVLWTVEVAPHFTPARGSTSRHKLKPTEIPPSAEPSSSSESLSPVSIRRTRAVRVDADSSPPPRWNPPVREDGSPLPPRRRTPPARQDDSPPLPHIRTPLAREDGDSPRPRSPNPRFLEANNTSFKTAEPKSANARRINYEVAEDDGEVLALEDGTFGTFMFEGSTVDELIEELRRKTKIDDIILCMRNNQKGTLFKMRLALPSNKAPLPVVVVRQNSSCTFLSLHLLQFIKVAGLGTQQIHIRNFVCC

SEQ ID NO: 54810 - protein, 352 aa, Vitis vinifera
MDLVSTDSSIHGSQAFSPIKSQASSVLPSPSHSSDTSFPIIAIAVIGILATAFLLVSYYIFVIKCCLNWHRIDLLRRFSFSRSRHPEDPLMVYSPAIESRGLDESVIRSIPIFQFRKGGGREFGERSHCECAVCLNEFQEEEKLRIIPNCSHIFHIDCIDVWLQSNANCPLCRTSISTTPRFPVHQIIAPSSSPQDPSPYANNYIGGDEDFVVIELGNDSSADSSLLRPPERLNSRELSAPSISPSPRKLEQRIVPKKARKFHHVASMGDECIDTRGKDDQFSIQPIRRSFSMDSSNDRQLYLAIQEILQQNRPVSDFSPSEGCSSRFRRSFFSFGHGRGSRSAVLPIPMDP

SEQ ID NO: 54811 - protein, 413 aa, Kineococcus radiotolerans SRS30216
MSTGLDRGASAPPPGAPPPPPDPRVVARMRRFGPTVFAEMSALAARTGAVNLGQGFPDADGPASLLEDAVAAIRSGRNQYPPGTGVPALLEAVAEHQHRFYGLTLDPGTEVLVTAGATEAIAASLLALCGPGDEVVVLEPAYDSYAAVIALSGAVQRSVPLVPGPDGSTLDAQDLRAAFSARTRVVLLNTPHNPTGTVLSPAQVAAVAALAVEHDAVVLTDEVYEHLVFDEHRHVPVATLPGMAERTLTVSSAGKTFSVTGWKVGWVSGPAPLVAAVRMVKQFLTYVNAGPFQPAVAGALALPDDFYLGLAADLQRRRDLLVEGLLSAGFGVSVPAGTYFVVADPRPLGHDDGTALCRELPGLAGVVGVPVSAFCEPGSPAAAAVRPLVRFTFCKSDAVLEEACRRLQALRPR

SEQ ID NO: 54812 - protein, 348 aa, Kluyveromyces wickerhamii
MSIPKTQKAVVFYKHGGALEYKEIPVPTPKANEILINVKYSGVCHTDLHAWQGDWPLDTKLPLVGGHEGAGVVVALGANVKGWKIGDFAGIKWLNGSCMACEYCELSNEPNCPEADLSGYTHDGSFQEYATADAVQAARIPAGTDLAAVAPILCAGVTVYKALKSAHLKAGDWVAISGACGGLGSLAIQYANAMGYRVIGIDAGEEKAALFKELGGEYFVDFIKSKDVIKEINDVTKGGAHGVINVSVSENAIEDSTKYVRSNGTVVLVGLPKGAQAKSDVFSQVVKSISIVGSYVGNRADTREALDFFSRGLVHAPIKIVGLSELASIYDKMSKSQVVGRYVVDTSK

SEQ ID NO: 54813 - protein, 371 aa, Kluyveromyces wickerhamii
MLRLTQTKTISPLRAAIGSIRTMASVPETQKGVIFYENGGKLEYKDIPVPVPKPNEILINVKYSGVCHTDLHAWKGDWPLATKLPLVGGHEGAGVVVGMGSNVKGWKIGDLAGIKWLNGSCMSCELCEQGFESNCAHADLSGYTHDGSFQQYATADAVQAAQIPKGTDLAEVSPILCAGVTVYKALKSANLKAGDWVAISGAAGGLGSLAVQYAKAMGYRVLGIDGGADKGKLVKELGGEVFIDFTKSKDMVADIQEATNGGPHGVINVSVSEGAINASTQYVRPTGTVVLVGLPAGAVIKSEVFSHVVKSINIKGSYVGNRADTREAIDFFVNGKVKSPIHVVGLSELPSVYELMEQGKILGRYVVDTSK

SEQ ID NO: 54814 - protein, 158 aa, Lactococcus lactis
MRRMIIAKLHNVTGIMNRFTAVLNRRQVNILSITAGVTESQDLTHTTFVIEVDHLDEVEQIIKQLNRLIDVIEVADITDFPHVEREVVLIKVSAPPTIRAEIFTMIEPFRVNVVDVNLENVTIQLTGDSAKIEALIEVVSPYGILNMARTGSAGFERG

SEQ ID NO: 54815 - protein, 495 aa, Coccidioides immitis
MTDFKEKALDFCSFVNASPTPFHAVASARTRLVDAGFKEIKEKDAWSSICKPGGKYYLTRNGSTIIAFAVGRKWKPGNSIAMLGAHTDSPCLRVKPVSKKRAEGFIQIGVETYGGGLWHTWFDRDLGIAGRVMARNNDGSISARLLRIDRPILRIPTLAIHFERQETFSFNKETQLFPIAGLVEAELSRVGGDHASTEPSKSEDKTDDAPTAPLKVITERHHPYLIELMASELALKPDDIVDFEILLYDTQKACLGGLLDEFIFSARLDNLNMSYCATMGFIESLSKSSALDNETSIRLVALFDHEEIGSKTAQGADSNALPAILRRLAVLPSSGKEDTSTAYEQSLSTSFLLSADMSHSVNPNYAFKYEPDHKPEMNKGPVIKINANARYATNSPGIVLVQEAARLAKSGGDTANTVGVPLQLFVVRNDSLCGSTIGPMLSAALGTRTVDLGNAQLSMHSIRETGGTKDVGYAVRLFKSFFENFSQLSQRIFVD

SEQ ID NO: 54816 - protein, 178 aa, Triticum aestivum
  misc_feature (71)..(71): Xaa can be any naturally occurring amino acid
  misc_feature (140)..(140): Xaa can be any naturally occurring amino acid
  misc_feature (146)..(146): Xaa can be any naturally occurring amino acid
  misc_feature (163)..(163): Xaa can be any naturally occurring amino acid
MAPTVMASSATSVAPFQGLKSTAGLPVSRRSNGASLGSVSNGGRIRCMQVWPIEGIKKFETLSYLPPLSTXEALLKQVDYLIRSKWVPCLEFSKVGFIFREHNASPGYYDGRYWTMWKLPMFGCTDATQVINEVEEVKKXYPDAYXRIIGFDNMRQVQCVSFXIAFKPTGCEGVPEGP

SEQ ID NO: 54817 - protein, 220 aa, Zea mays
  misc_feature (198)..(198): Xaa can be any naturally occurring amino acid
  misc_feature (202)..(202): Xaa can be any naturally occurring amino acid
MVKICCIGAGYVGGPTMAVIAVKCPAIEVVVVDISKPRIDAWNSDKLPIYEPGLDEVVKACRGKNLFFSTDVEKHVAEADIIFVSVNTPTKTRGLGAGKAADLTYWESAARMIADVSKSDKIVVEKSTVPVKTAEAIEKILTHNSKGINYQILSNPEFLAEGTAIEDLFKPDRVLIGGRKTPEGRKAVQALKECTPTXFPEXNIITTNLWSAELSKLAAH

SEQ ID NO: 54818 - protein, 561 aa, Salmonella enterica subsp. enterica serovar Paratyphi B str.
MNKLFSSHVMPFRALIDACWKEKYTASRFTRDVIAGITVGIIAIPLAMALAIGSGVAPQYGLYTSAVAGIVIALTGGSRFSVSGPTAAFVVILYPVSQQFGLAGLLVATLMSGFFLILFGLARLGRLIEYIPVSVTLGFTSGIGITIGTMQIKDFLGLQMAHVPEHYLQKVGALFMALPTVNIGDAAIGVVTLGTLIFWPRLGIRLPGHLPALLAGCAVMGIVNLLGGNVATIGSQFHYVLADGTQGNGIPQLLPQLMLPWSLPGSDFTLSWDSLRALLPAAFSMAMLGAIESLLCAVVLDGMTGTKHKANSELIGQGLGNMVAPFFGGITATAAIARSAANVRAGATSPISAVIHAILVILALLVLAPLLSWLPLSAMAALLLMVAWNMSEAHKVVDLLRHAPKDDIIVMLLCMSLTVLFDMVIAISVGIVLASLLFMRRIARMTRLAPVNVDVPEDVLVLRVIGPLFFAAAEGLFTDLESRIKGKRIVVLKWDAVPVLDAGGLDAFQRFVKRLPEGCELRISNLEFQPLRTMARAGIKPIPGRLTFFPNRTEALADLLS

SEQ ID NO: 54819 - protein, 509 aa, Medicago sativa
MTMAGPGQLNVIESPSRGSRSVDCFEKLEQIGEGTYGMVYMAREIETGEIVALKKIRMDNEREGFPITAIREIKILKKLHHENVIKLKEIVTSPGPEKDDQGRPDGNKYKGGIYMVFEYMDHDLTGLADRPGMRFTVPQIKCYMRQLLTGLHYCHVNQVLHRDIKGSNLLIDNEGNLKLADFGLARSFSNEHNANLTNRVITLWYRPPELLLGTTRYGPAVDMWSVGCIFAELLHGKPIFPGKDEPEQLNKIFELCGAPDEVNWPGVTKTPWYNQFKPSRPMKRRLREVFRHFDRHALELLEKMLTLDPAQRIPAKDALDAEYFWTDPLPCDPKSLPKYESSHEFQTKKKRQQQRQNEENAKRLKMQNPQQHTRLPPIQQGGHAQMRQGPNHLIHGSQPAGAAGPSHHYGKPRGPSGGPGRYPPGGNPSGGYNHPNRGGQGGGAGYGSGPYPPQGRGAPYGSSGMPAGTGGGPRGGGGFGAPNYPQGGPPYGGSAAGRGNRNQQYGWQQ

SEQ ID NO: 54820 - protein, 567 aa, Psychrobacter arcticus 273-4
MTDILSAIAAENGIIESTDTPNTTANTDTNNEAATTDATDENKVTFTDLNIAKPILSALERSGYTHPTPIQAEAIPFALQGRDLLLSAQTGSGKTAAFVIPVLDRLSRATSFDKLTKALILTPTRELAQQVHDSVRTYSKDMRGLFCVPLVGGAPYNGQITALKKGVQVIVATPGRLLDHINAGRVDLSSLEILVLDEADRMLDMGFADDISDILRAAPIDRQTIMCSATWDGPVGKIAASFTKNPERVSIKVESAHIEEKVYYCDDFDHKNRLLDKIVCHKDMEQIIIFAATKRSTEKLAKQLQEAGHKASFLHGDLPQSKRNRIVQDLRNGKCKILVATDVAARGLDVPALSHVINYDLPRQTEDYVHRIGRCGRAGRTGVAISLCSMDDRPQLNAINRYLDRKMEASVIEGMEPKKTYVPSENKGNGRGRGRGRSNGGGNGNGQGRGRSAGGYAGSGASKPSGQGRGRPSGDSSNATGQRASNDSGYQGKPRDSSGKPNERSGGKPYQGKRTGAPSRGDSTGVPRGERAATGRGRPSGSQGRPAARSDSRGQGRPTGGNRGNNS

SEQ ID NO: 54821 - protein, 311 aa, Medicago sativa
MEKYEKLEKVGEGTYGKVYKAKELSTGQIVALKKTRLEMDEEGVPPTALREVSLLQMLSQSLYIVRLLNVEHIDKPPKNATHTPSKPLLYLVFEYLDTDLKKFIDTFRKGTNPRPLPNTLVQSFLFQLCKGVAHCHSHGVLHRDLKPQNLLLDQAKGILKIADLGLGRAFTVPLKSYTHEIVTLWYRAPEVLLGSSTYSTGVDIWSVGCIFAEMVRRQALFPGDSEFQQLLNIFKLLGTPTEQQWPGVSSLRDWHVYPRWEPQNLARAVPSLSPDGVDLLTKMLKYNPAERISAKAALDHPYFDSLDKSQY

SEQ ID NO: 54822 - protein, 231 aa, Burkholderia pseudomallei K96243
MTQDELKRLVGEAAARYVTENVPQGAVIGVGTGSTANCFIDALAAVKDRYRGAVSSSVATTERLKSHGIKVFDLNEIESLQVYVDGADEIDGSGAMIKGGGGALTREKIVASVAETFVCIADASKRVAVLGQFPLPVEVVPMARTAIGRRLAALGGVPVLRVKQDGAPYVTDNGNEILDVKGLRIDDPRALEAAINGWPGVVTVGLFAQRGADLCLLGTERGVETLRYAAH

SEQ ID NO: 54823 - protein, 383 aa, Bordetella pertussis Tohama I
MQGKPRIAVIGAGLGGTAGAALMARAGFNVRLYEQAPAFSLLGAGIHLGPNVMKIMRRIGIEDELNRQGSHPDYWYSRDWQTGAELARIPLGDYAVSHYGATYLTVHRGDFHALMTAALPAGLLQFNKRLTRVDEDDDVVRLHFADGSVEEAEIVIGADGVNSRLREHLLGAELPKYTGYVAHRAVFPTPLDSGSLPFDMCVKWWSDDRHMMVYFVTGKRDEIYYVTGVPEQQWDMGKSWVPSSKEEMRAAFAGWHPTVQALIEATPEVSKWPLLERDPLPLWSRGRIVLLGDACHPMKPHMAQGAAMAIEDAAMLTRIFEQTGLQDHAAAFRLYEDNRAERASRVQRVSHDNTWLRTNENPDWCFGYDVYAEPLVEGRRAAA

SEQ ID NO: 54824 - protein, 316 aa, Medicago sativa
MEKPGETIAVVLSAKEAFEKLEKVGEGTYGKVYRAREKATGKIVALKKTRLHEDDEGVPPTTLREVSILRMLSRDPHVVRLLDVKQGQNKEGKTVLYLVFEYMDTDLKKFIRSFRQTGQNIPPPTIKGLMYQLCKGVAFCHGHGILHRDLKPHNLLMDRKTMMLKIADLGLARAFTVPLKKYTHEILTLWYRAPEVLLGATHYSMAVDMWSVACIFAELVTKTALFPGDSELQQLLHIFRLLGTPNEDVWPGVSKLMNWHEYPQWGPQSLSKAVPGLEEAGVDLLSQMLQYEPSKRLSAKKAMEHPYFDDLDKTHL

SEQ ID NO: 54825 - protein, 283 aa, Candida albicans SC5314
MIRKQARERREYLYRKALQLQESSLTEKRQQLKAALASGKSLSKELAEDEKLQRDFIYDESEQIEIDDEYSRLSGISDPKVVITTSRDPSVKLLQFSKEIKLMFPNSLKLNRGNYIISDLVSTCNRVQVSDMILLHEHRGVPSSLTVSHFPHGPTAIFTLHNVKLRHDLPNLGNVSESYPHLIFENFQSDLGKRVVKILQHLFPPGVKKDSSRVITFVNNDDYISVRHHVYVKTKDSVELSEIGPRFEMRLYEIRLGLPDNKDADVEWQMRRFIRTANRKNYL

SEQ ID NO: 54826 - protein, 384 aa, Zea mays
MAHGGGAGRAKVTPNLAVDGEGTRTLNRTVLQRLDPAVEDILITAAHVTLYDFDTDVNQWSRKDVEGSLFVVKRNAQPRFQFIVMNRRNTDNLVEDLLGDFEYQLQAPYIMYRNAAQEVIGIWFYHSQECQQVANLFSRILNAFSKVPPKPKIPPVQSEFEEVEAAPVLVDGPLEPQTSNIMSTTTHIQEDPLSAFFSAAANVGGNSAVAVARQPIQPFGATPVATHAATSITTTQSPGLHYLLPSQASSVSGRPADAHGGTGSIGRSTSLVYPSLFSPLTSSQTKMVHTNSAVPTAPPQHPRIAQQPQSAPLLQPFPLPTASSPPYGTPLLQPFPPPNPSPSLASAPVLSPALTRDKVRDALLRLVENDEFVDLVYREIMNRQ

SEQ ID NO: 54827 - protein, 286 aa, Oryza sativa
LIGQNVRTLTVQIPEDLHFVLRMRHMFESLGYQSGFFLSQLFSSSRGTSPSPSSFPLKQQQPPPPQLFNWPGHAPPQLPPGASPLFPPGPAAFHPSSRPMPPFPGGGKDESHLFHLPPAAAAKQPQHMDEHHHHQQQPMAAPQQHGGEAPEGDLKWPNGLSFFTALTGRTEDAKFLFGGGGGGGADDGSKTAAAAQDAGHGGAENVEEYLSLESHSNKARRMESAQSTKFKRSFTLPARMSSSTTSTSPSVSASTAPAPPQQQQGMEYRGPHEGGVYSDLMETFLE

SEQ ID NO: 54828 - protein, 262 aa, Vitis vinifera
  misc_feature (129)..(129): Xaa can be any naturally occurring amino acid
  misc_feature (153)..(153): Xaa can be any naturally occurring amino acid
MDVPEGTVVGFDGDBDRDGFVLVKIRGKHNPLRVHVSTLERVTSGLVVTDWVRLKEPNRKHSTVGILHSVQRDGSVAVGFLGLETLWRGHSSELQMAETYYVGQFVRLKTNVFTPRFDWPHKKGGAWVXGRIAQVLPNGCLVVRFPGRFVFGXESNSFLADPAEVELVSFDKCHGVVEKYHHIEDFHWAVRPLVIAFGVFTTLKLGVFVGGNVCVRMRKSPRNLTPNDGQCQDGQAGGNPAWIPPTVANILFREGPPTATAR

SEQ ID NO: 54829 - protein, 535 aa, Zea mays
ANANATRLSLTSMMDLAAYIAILSLVFLFLLRRVHGLARRDGKSRSMRRPPPSPPGAVPFLGHLHLIKKPFHATLSGLAQRHGPVFTLRLGSRDAAVVTSPACARECFTEHDVTFANRSLLPSQRLVTFDGAALGTASYGPRWRDLRRVAVVQLLSAHRVGCMSGVICGEVRAMVRRLHRAAAAAAGAGARVELKRRLFELSLSVLMEAIAETKAARRDPEPEPDADGTTDMSPEAQEFKRVIDEVFPYVSSVLWDYLPVLRWFDVAGVRSRILAAVSRRDAFLRRLIDAERRRMADGVCGEKKSLIAVLLALQKLEPEVYTDTVITAFCSNLFGAGTETTSTTVEWAMSLLLNNPGTLEKAREEIDAAVGHSRLLNAGDLPRLGYLRCIIAETLRLYPAAPLLLPHESSADCKVGGYDVPRGTALLVNVYAIHRDPAVWEEPGRFVPERFEGGKAEGLFVAPFGMGRRKCPGERLALQTVGVALGSLIQCFHWSRVDGVEVDMSEGSGLTMPKAVPLEALCTTREAMYDVLQKL

SEQ ID NO: 54830 - protein, 100 aa, Glycine max
  misc_feature (71)..(71): Xaa can be any naturally occurring amino acid
  misc_feature (82)..(82): Xaa can be any naturally occurring amino acid
CWLLASEGSFACCNGNICWAELESAPGTFAGRCLPYYGMYLIGNSCPGRNCLAPWLSYTSTTAIRSMAIYXGRCETLNRSCXCCGSILEDEVQSEQCQST

SEQ ID NO: 54831 - protein, 374 aa, Kluyveromyces wickerhamii
MFRLARAQSSIANKSVARHFLRLNSTYAIPETQKGVIFYENGGELHYKDLPVPVPKPNEILINVKYSGVCHTDLHAWKGDWPLAVKLPLVGGHEGAGIVVAKGENVTNFEIGDLAGIKWLNGSCMSCELCEQGYESNCLKADLSGYTHDGSFQQYATADAVQAAQIPKGTDLAEIAPILCAGVTVYKALKTADLKPGQWVAISGAAGGLGSLAVQYAKAMGLRVLGIDGGDGKEELFKKCGGEVFIDFRKSKNMVADIQEATNGGPHGVINVSVSEAAISMSTEYVRPTGTVVLVGLPANAYVKSEVFSHVVKSISIKGSYVGNRADTREAIDFFTRGLVKSPIKVIGLSELPEAYELMEQGKILGRFVVDTYK

SEQ ID NO: 54832 - protein, 281 aa, Pyrus communis
MAKDVEVAEHGEFAAKDYHDPPPTPLFDAEELTKWSFYRALIAEFIATLLFLYITVLTVIGYKSQSEADQCGGVGILGIAWAFGGMIFVLVYCTAGISGGHINPAVTFGLFLARKVSLIRAVLYIIAQCLGAICGVGLVKAFQKSYYVKYGGGANELSAGYNKGTGLGAEIIGTFVLVYTVFSATDPKRNARDSHVPVLAPLPIGFAVFIVHLATIPITGTGINPARSLGAAVIYNKDKAWDDQWIFWLGPFIGAAIAAFYHQYILRAGAIKALGSFRSNA

SEQ ID NO: 54833 - protein, 219 aa, Carboxydothermus hydrogenoformans Z-2901
MLVNIAPSILNADFSNLELVLKQLETGGAKYLHLDIMDGHFVPNLTFGPPVVKSLRAKTNLIFDVHLMVEKPESLIEPFIEAGADMITIHWESTRHPHRLLQKIKDSGKKAGIALNPATLPENLEYLLDLIDLILIMSVNPGFGGQSFINNQLTKIRKVKSMVCKAPQEILLGVDGGINLQTAPLVIEAGANFLVTGSFLFKGDVIKNLKDLIEVCQKS

SEQ ID NO: 54834 - protein, 348 aa, Saccharomyces bayanus
MSIPKTQKGVIFYESHGKLEYKDIPVPTPKANELLINVKYSGVCHTDLHAWHGDWPLPVKLPLVGGHEGAGVVVAMGENVKGWNIGDYAGIKWLNGSCMACEYCELGNESNCPHADLSGYTHDGSFQQYATADSVQAAHIPKGTDLAECAPVLCAGITVYKALKSANLSAGQWVAISGAAGGLGSLAVQYAKAMGYRVVGIDGGEGKEELFRSIGGEVFIDFTTEKDIVGAVIKATDGGAHGIINVSVSEAAIEASTRYCRANGTTVLVGMPAGAKCCSDVFNQVVKSISIVGSYVGNRADTREALDFFARGLVKSPIKVVGLSTLPEIYEKMEKGQIVGRYVVDTSK

SEQ ID NO: 54835 - protein, 416 aa, Lactococcus lactis
MISAKEVEDAYDLLKAVVTKTPLQLDPYLSNKYQANIYLKEENLQKVRSFKLRGAYYSISKLSDEQRSKGVVCASAGNHAQGVAFAANQLNISATIFMPVTTPNQKISQVKFFGESHVTIRLIGDTFDESARAAKAFSQDNDKPFIDPFDDENVIAGQGTVALEIFAQAKKQGISLDKIFVQIGGGGLIAGITAYSKERYPQTEIIGVEAKGATSMKAAYSAGQPVTLEHIDKFADGIAVATVGQKTYQLINDKVKQLLAVDEGLISQTILELYSKLGIVAEPAGATSVAALELIKDEIKGKNIVCIISGGNNDISRMQEIEERALVYEGLKHYFVINFPQRPGSLRTFVSDILGPNDDITRFEYIKRADKGKGPCLVGILLSDASDYDSLINRIERFDNRYVNLRGNDSLYELLV

SEQ ID NO: 54836 - protein, 440 aa, Mycobacterium smegmatis str. MC2 155
MRFSNIMDSNSYTGDQSIDPGTEQLISARTRLLGPAYRLFYERPVHLVRGRGSHMFDADGVRYLDAYNNVVSVGHCHPHVVAQVTRQLETLNTHTRYLHDGIVAYSERLLATMPDEVDQVMYACTGSEANDLALRVAQMYTGARGVIVTRDAYHGNTEAVTAISPSIGGETVTGPHVRTVPAPDSYRAGDDVAARFRADVEAAIADLQRCGHGVSALIVDTFFSSDGIYPDTSVLAPAVEAVRAAGGVFIADEVQPGFGRTGDDMWGFARHNVVPDLVTMGKPMANGLPVAAMAARSAVLEPFAVGVPYFNTFGGNPVSMAAAAAVLDVIENEELVTSAATVGAALRHELTRITADHPHIGDVRGAGLYVGVELVEDRDAATPDRTRAHDLVNEMRDRHVLISVCGTYGNVLKIRPPLVFSMADVDWFCTEFAGALAHLP

SEQ ID NO: 54837 - protein, 244 aa, Carboxydothermus hydrogenoformans Z-2901
MNDSRQTSKEELVYNIFSAIAHRYDLLNTVLSFNRDKAWRRFAVKVSGLSAGGRGLDVACGTGMFAIELARVVGPTGEVVGLDFNENMLEVARKNIARYSMEKIIKLVHGNALALPFPDNSFDVATIGFALRNVPDIEKTILEMKRVVKPGGRVVNLELAHPTFPVFKQLYWFYFEKLVPLLGKLGVGVDGPYSYLPNSVKNFPHQQVIKKMFEDLGLVDVKCYELTGGIVAVHVGTKPFEKTT

SEQ ID NO: 54838 - protein, 348 aa, Saccharomyces bayanus
MSIPKTQKGVIFYESNGKLEHKDIPVPTPKPNELLINVKYSGVCHTDLHAWHGDWPLATKLPLVGGHEGAGVVVAMGENVRGWKVGDLAGIKWLNSSCMACEYCELGNESNCPHADLSGYTHDGSFQQYATADAVQAVHIPEGTDLAEVAPILCAGITVYKALKSANLRAGHWVAISGAAGGLGSLAVQYAKAMGYRVVGIDGGPGKEELFTSLGGEVFIDFTKEKDIVGAVIKATDGGAHGIVNVSVSEAAIEASTRYCRANGTVVLVGLPAGAKCTSDVFNHVVKSISIVGSYVGNRADTREALDFFARGLVKSPIKVVGLSHLPEIYEKMEKGQIAGRYVVDTYK

SEQ ID NO: 54839 - protein, 460 aa, Kineococcus radiotolerans SRS30216
MTTLSSPDATSAPAVGGPALPQEIRLRTEVPGPLSRELAARRVAAVSAAVGSSMPFYAAVAGGGVVVDVDGNSYADLGSGIAVTTVGNADPAVVAAVGEQVGRFTHTCFMITPYDSYVAVAERLNALTPGDFPKRTALFSTGAEAVENAVKVARAFTGRQAVVVFDHAYHGRTNLTMAMTAKNMPYKNGFGPFAPEVYRAPLSYPFRDGLDGPTAAARAIATIEKQVGAANLAAVVVEPVQGEGGFIVPAPGFLPAIAAWARENGVVFVADEVQTGIARTGAVFASHLEGIEPDLVTIAKGVAGGLPLAAVTGRAEILDAPVVGGLGGTYGGNPAACAAALATLDAVEHEDLPARARQLEGVLLRRLHALAAVDPRVGDVRGRGAMVAVELVRPGTTEPDAALAKRVAADAARRGVIVLTCGTDGNVLRFLPPLSIPDALLEEAFDVLDDVFATDRPTAR

SEQ ID NO: 54840 - protein, 488 aa, Kineococcus radiotolerans SRS30216
MSTTQHEQDLVRAVPTGLFVGGGWREAEGGRTVDVEDPATGQVLVAVSDASVADGTAALDAAVAAAPAWARTPTRQRAEVLRRAFELITARADDFALLMTLEMGKPLAEARGEVAYGAEFFRWFSEEAPRIAGRYAQNPAGGSRLLTLKQPVGPVLAILPWNFPLAMGTRKIAPALAAGCTIVVKPATQTPLTTLLLAQVLAEAGVPDGVVNVVTTTSTAEVVEPLVRDPRLRKLTFTGSTPVGKKLVAQSAERLLRVSMELGGNAPFLVFDDADLDAAVEGAVAAKMRNTGEACTAANRFYVQRPVAEEFSRRLGERLGAMVVGRGTEDGVQVGPLIDARARDGVARRVSEAVDAGAQVLVGGSPVGERGYFYAPTVLTGVPAGSRLLTEETFGPVAPVVVFDEEAEGVALANDTEYGLVGYAFTRGLDRGFRVAEALETGMVGLNAGVISNAAAPFGGVKASGFGREGGAEGIEEYLETKYVGFPL

SEQ ID NO: 54841 - protein, 375 aa, Saccharomyces bayanus
MLRTSTLFTRRVQPSLFARNILRLQSTIAIPQTQKGVIFYENNGKLHYKDIPVPEPKPNEILINVKYSGVCHTDLHAWHGDWPLPVKLPLVGGHEGAGVVVKLGSNVKGWKVGDLAGIKWLNGSCMTCEFCESGHESNCPDADLSGYTHDGSFQQFATADAIQAAKIQQGTDLAEVAPILCAGVTVYKALKEANLKAGDWVAISGAAGGLGSLAVQYATAMGYRVLGIDAGAEKEKLFKQLGGEVFIDFTKTKDMVSDIQEATKGGPQGVINVSVSEAAISLSTEYVRPTGTVVLVGLPANAYVKSEVFSHVIKSINIKGSYVGNRADTREALDFFSRGLIKSPIKIVGLSELPMVYDLMEKGKILGRYVVDTSK

SEQ ID NO: 54842 - protein, 401 aa, Sulfolobus solfataricus P2
MITIGIIGKTNVGKSTFFAAATLKDVEIANRPFVTINPNEGIGYVKVKCAHTEFNVKCNPKNSICIEDYRFIPVKLVDVAGLIPGAHEGRGLGNKFLDDLRQADALIHVIDASGSTNEEGVPVEPGSRDPEEDIKFIESELDEWFYSIINKDWAKFARTSDLSGKDLVDALLSKLSGVSVNRSHIIETLKVTKLENLKLMQWTEQDLRVFAKTLRSVSKPMIIAANKSDLPQARNNIRRLKEKYKWAIPTSAASEMALRKAAKAGIISYIPGDSDFTILKPLNEKQKSALEYIRTSVLQVYGSTGVQQAINTAIFDALNMIVTYPVEDERKLTDKNGNVLPDAILLKKGSTPKDLANAIHTELAKGFLYAIDVKRKMRVGENYQLQNNDVIKIVSSTARPS

SEQ ID NO: 54843 - protein, 232 aa, Triticum aestivum
DGGVTDIGLTILAHGCKRLVKLELVGCEGSYDGIAAVGRCCAMLEELTIAEHRMDGGWLAALAFCGNLKTLRLQGCARIDDDPGPAEHLGACLTLESLQLHRCQLRDRHALHALFLVCEGARELLVQNCWGLEDDMFALAGLCRRVKLLSLEGCSLLTTRGVESVVTSWNDLQSLQVVACNKIKDEEMTGALSELFSNLKELKWRPDNKSLLAASLVGTGMGKKGRVFFKRV

SEQ ID NO: 54844 - protein, 351 aa, Saccharomyces bayanus
MSSQAIPESQKAIVFYETNGKLEYKDIAVPEPKANEILVHVKYSGVCHSDLHAWRGDWPFQLKFPLIGGHEGAGVVVKLGSNVKGWKVGDLAGIKWLNGTCMSCEYCEVGNESQCPHLDGTGFTHDGTFQEYATADAVQAAHLPENVDLAEVAPILCAGVTVYKALKRANLIPGQWVTISGACGGLGSLAIQYATAMGYRVIGIDEGETKKQLFEGLGGEVFIDFTKEKDIVGAVIKATDGGSHGVINVSVSEAAIEASTRYCRPNGTVVLVGMPAHAYCKSDVFNQVVKSISIVGSCVGNRADTREALDFFARGLIKSPIHLASLSDVPEIFEKMEKGEIVGRYVIDTSK

SEQ ID NO: 54845 - protein, 666 aa, Physcomitrella patens subsp. patens
MTIIGCECVLPRPNVLQHTPPEIVKTMFHEAAQGKNYMNALDFATFLEKVQGQKGLDEHQVASLVTQTVLSAIAGFHFSISVQSVQLDLLGFSNYLVNAKLNPPISDTDIMYIDSLKINHIFQPTHDMTRPLSHYYIYASHNSYLTGNQLTSSSSIVPIIEALRNGCRVIELDCWEKQGQQCWSGSTNNDIVVLHGNTLTSAIPFKDCVIAIKENAFIASQYPVIITIENHMGAEMQKKAALVLREILGESLFYPSREQRPPLQFESPEVLKGFIIVSDQPPSDTIEDQLAVDPNAAQVLATDELDDAHASTSDHTRHAQRLKKHIKRAHKKAVLRVANTAAKVLRKSLLVEKIEVPETVEFQELIYLYCAKPSEMKKAKHEEGPLVGGDRAIMANLSEPQLQHFIARHPGSLIEYSKMNLGRVYPFGLRFNSSNADPMLAWSHGFQIAALNLQGRDRPVWLAKGFFQVNGHTGYVKKPDIFLPGFSLSHEDILNLPIKMILRVTVLLGTNWHRNFDFFKNPDFYVKVAVHGVKNDASKRQTQVIYNCIEPHWEHEHFEFPLRVPEIAVLRLECWEWDMGNHDFVGQACLPVRELRYGIRSVALRSKSGASRSSKLLCHFQSFAVSSLAPPSELPHPHPGPPSSPPPLPPPVAPEEPQPPPPSSCT

SEQ ID NO: 54846 - protein, 279 aa, Triticum aestivum
MADRGGERGVGERGGDRGGFGRGFGRGGRGDRGGRRGGRRGPRQEEEKWVPVTKLGRLVKEGRFTKMEEIYLHSLPVKEHQIVETLCPGLKDEVMKITPVQKQTRAGQRTRFKAFVVVGDSNGHVGLGVKCAKEVATAIRGAIILAKLSIVPVRRGYWGNKIGQPHTVPCKVTGKCGSVTVRMVPAPRGSGIVAARVPKKVLQFAGIDDVFTSSRGSTKTLGNFVKATFDCLMKTYGFLTPDFWRETTFTKAPYQEFTDILAKPTKALMLDAPAEKIEA

SEQ ID NO: 54847 - protein, 546 aa, Prochlorococcus marinus subsp. marinus str. CCMP1375
MTATNSLNIAFDQIADALAAIRNGECVVVVDDESRENEGDLICAAQFATPQQINFMATEARGLICLAMDGERLDQLDLPLMVDRNTDSNQTAFTVSIDAGPEYGVSTGISAEDRARTIQVAINPQTKPNRLRRPGHVFPLRANKGGVLKRAGHTEAAVDLSLLSGLSAAGVICEIQNADGSMARLPELTKYAKTWGLKIISIADLIRFRLENERFVYRKAKTRLPSIFGDFQAIGYTNELDGTEHIALVKGNINELKEPVLVRMHSECLTGDAFGSLRCDCRPQLEAALNLISEEGEGVVVYLRQEGRGIGLINKLKAYSLQDGGLDTVEANLKLGFAADLRNYGVGAQILTDLGINRLRLLTNNPRKIAGLGGYGLRVESREPLVINPTDYNANYLAIKRTKLGHYIGNDDDSGKYYVIYWKGIVSSNMLSAYKNKAEQIASDNKVELNPESSSRLLALLQRPQFVWRVQNCIDFESIINLLKEIIKWDGTKSIGIFITNSKEQAIHPSQDVETILENISNLKDTNYKNIANINDKDLPFIMTWQ

SEQ ID NO: 54848 - protein, 533 aa, Prochlorococcus marinus subsp. marinus str. CCMP1375
MNFPDFNNNNKDDQWERFSQLLFYDEEIGFWLDISRMKFSSEDIGSLQDNFKEACKSMKALEKGSIANIDESRQVGHYWLRNASLAPSKQTSNSIRNEINDIKTFGENILNGKITTAQGKPFTDVLWIGIGGSGLGPLLIVNSLQDNNKGLNFSFLDNVDPNGINKTLNSFRDKLSTTLFVVVSKSGGTPEPQIAMDQTRFFLDKNGLDWSSRAVAITMEGSSLDQIAENEKWLKRFDLPDWVGGRTSITASVGLLPLVLIGEDIDSFLDGASQMDQITRRIDIYKNPSALLAASWYFSGAGKGKRDMVVLPYQDRLQVFSKYLQQLVMESLGKEEDRNANKVNQGLAVYGNKGSTDQHAYVQQLRDGIDNFFVTFVEILEDCTEIPKINKKSPGDYLSGFLQGTRLALSENDRQSITITIKKFNSYTLGSLIALFERAVGIYAELIDINAYHQPGVEAGKKAASNILKLQSEIELLLEDGKLYSIEGIMNTIPGSSQESIYIILRHLSNNDHTYKFVGNLSDPRELQIKKAV

SEQ ID NO: 54849 - protein, 399 aa, Wolbachia endosymbiont of Drosophila melanogaster
MQDAVLILQDGKCFWGKSVGKKGKCIGEVCFTTGMTGYQHTITDPSFADQIITFTFPHIGNIGINHKDNEGKKIFASGVVMRELSSMSHPSSYISLNDWLEKNNVIGISGVDTRALTRHLREHGSQNGMICSSSKAHALDKLKEYKPVNGIEITNKVSLNNSFENNRLAEHFVIQVADYSDPAKNIWIPVSRTGMTSDRAIDLNAKYRIVIVDFGVKISIVSRLIELGCTVELIRPSTGFAQKVLSMNPDGIVLSNGPGDPQEIGESVVSEIDIIIKSKIPIFGICMGHQLLAITLGAKTIKMDIGHRGSNHPVYDVISGKVEITSQNHGFVVDSASLPSNVEITHISLFDNSVEGIMMKDYLVFSVQYHPEEAPGTHDSHYLFRRFIGNIVLYKMKSA

SEQ ID NO: 54850 - protein, 570 aa, Burkholderia pseudomallei K96243
MDLRSKHIDAPPQHAAHFAPLDEPPAPRARRTALDALAGLSIAGLLIPEAVAYAGLANLPPQAGLIALVVGLVVYAIAGSSRFAIVSATSSSAVVLAATVMSEAGPGAAAQLMLAAALVATTGILFILAGAARLGGMSDFIARPVLRGFTFGLALTIVIKQLPKMLDVPIHHGDTLRVALDLLLGIAGCNVRSAGLGATALAILFALGRRTRVPATLVVIVLGIAAGYWIDWHRYGIAVVGTIDLQNLAFGMPVLGRSGWMQTAEFGFALMLILYAESYGSIRNFALKHGDTVSPNRDLVALGCANLVSGLLHGMPVGAGYSATSANEAAGAQTRMAGLFAAAVIALIAWLLLPQLARIPEPVLAAIVIFAVSHSLHPEVFRPYWTWHRDRIVVIAALAAVIVLGVLHGLLAAIGVSLLLTLRQLSEPNVSVLGRLRGSHDFVDVSMHEDAKPIPGVLIVRPEAQLFFANAERVLTMARRLARDAQPPVHTVMLSLEESPDVDGTTIEALKTFGAECDARGWRLALVRLKPNVLRVLQRAADGGLRADALSELSVDESLQSLTAGELPRA

SEQ ID NO: 54851 - protein, 255 aa, Streptococcus thermophilus LMG 18311
MENKLVFAKEIIKEAGAFIKKSLSKTITVEEKSAFDDLVTNIDKETQDLLVARIKSAFPTDNILAEENDMVHNIKDGNVWVLDPIDGTVNFIVQQDNFCVMIAYYEKGQGKFGLIYNVMADQLFYGGGQFDVYCNDKLLSPYKRRPLDRCLVGSNAAMYAKNYHGIKGFIDKTLGVRVYGGAGLSMSKVLSGQILAYFSVIYPWDYAAASIMGKKLDYQLETITGELLDYSSRQAVMLVPKDRLEEIRDILNSEN

SEQ ID NO: 54852 - protein, 912 aa, Wolbachia endosymbiont of Drosophila melanogaster
MMGEKLIHYFSQGKCEGNAEMKNLLGGKGANLAEMCNVGIPVPPGFTISTSACKVYYQDNRSSVIQVADYSDPEKNVVTHWNDICSGIKNYMAMLENDIGCKFGDLNNPLLVSIRSGSVSSMPGMLDTILNVGLNDETVVGLAKKSGERFAYDSYCRFIMMYSNVVLQLDHHLFQDVVDNKQQKSGAKSLADLDVDVLKEIVNNFKRIVHEKTGKHFPQNVEEQLLSSVNAVFASWKNDRAVSYRKIHNIPENFGTAVNVQAMVFGNLNDNSATGVIFTRNPSTGEKKYFGEFLINAQGEDVVSGVYTPMPIDGEQKNTMEKLLPSVYRELCVVCEKLERHYKDMQDIEFTVQDGKLWILQTRSGKRTAEAAIRIIVDMVNEGTITKEEGILRIDPKTFDNLLHPVLDVKSDQKVIGKGLPASPGVASGYVVFSASDAEKAAEQGKKVILVRSETSPEDINGMNAASGIVTARGGMTSHAAVVTRGMGKPCICSVSGLYIDKDGTFFSVGDTKVNKGEPITINGGTGEVMLGILPTISPELSQEFKTVINWIDEIKTVKVRANADTPKDAKIAKEFGAEGIGLCRTEHMFFASDRIEFIQKLIIADDENERANALIKLEEMQKSDFKEIFSIMEGREVTIRLLDPPLHEFLPNDQSTIEKIAKSLSKSVESVKNKIAQLSEKNPMLGHRGCRLAISHPEIYSMQIRAILSAASELKKEKKIEVEPEIMIPFIMSEKEFILICELAKKESSVISAGIQTQIPASRAGMTSDKAYSIGTMIELPRAALIADKLAKHAEFFSFGTNDLTQTTMGLSRDDSVNFLDSYKESNIFENDPFEVLDIEGVGELIKMAIERGKKTRKEIKLGICGEHGADPKSIEFLIESGVDYVSCSPYRVPIAKLVAAQFSVRSKFAR

SEQ ID NO: 54853 - protein, 381 aa, Clostridium thermocellum ATCC 27405
MIYLDNAATSYPKPDRVYDEMLLCMKEYCANPGRSGHELAIKTGRAVYETREIVSRFFNIENPMRVVFTKNATEALNLAINGVLKEGEHVITTSMEHNSVLRPLKTLERNNIIELTIVWGNYFGEIDVADIERSIKKNTKMIICSLSSNVNGIIMPVKEIGKITRERGILFLVDASQGAGSIKLDVQEINADLFAVPGHKDLLGPQGVGALYVNENVEITPIMQGGTGSRSESFYQPEIFPDMLESGTLNAPGIVGLGFGIKFIESFGVDNIRIYKHMLIKRLYEGIENLNGIKLYSLKDMDKNSGIISFNFIGVDSTKVSFMLDRIYGIASRSGLHCAPLAHETIGTKATGTVRLSVGCFNTIEEIDTTIEALREISQGL

SEQ ID NO: 54854 - protein, 343 aa, Acinetobacter sp. ADP1
MGSLMKAAVVTAFNQPLEIKDVEIPKVTSGKVLVKMIATGVCHTDLHAMHGDWPIKPSLPFIPGHEGVGEVVEIGEGITHLKIGDTVGVPWLYSACGHCDHCYAGWETLCKQQQNSGYSVNGSFAEYCLADGEYVGVIPEGVDLLEIAPILCAGVTVYKGLKMTEAKTGDWVAISGIGGLGHVAVQYAKTMGFNVVAIDVDDSKLELAKQLGADVGINALKVDVKEEVLKATGEGCHGVLVTAVSPKAFEQAVSVVRRGGTMVLNGLPPGKFDLSIFDMVLDGITVRGSIVGTRLDLKEALDIAARGKVKAHISVEPLENINDIFERMEQGKIDGRIVIDLKL

SEQ ID NO: 54855 - protein, 449 aa, Burkholderia thailandensis E264
MSYNDSRFWHPMLHPNDMKRREPIRIVRGDGCHVYDERGRQLVDGVAGLWNVNVGHNRAEVKEAIVRQLDELEYFQLFDGITHPRAEELSTKLIDMMEPEGMRRVLYSSGGSDSVETALKIARQYWKVRGQADRTKFISLKQGYHGTHFGGASVNGNTVFRRNYEPNLPGCFHVETPWLYRNPFTQDPEALGRICAELLEREILFQSPDTVAAFIAEPVQGAGGVIVPPANYWPLVREVCDRYGVLLIADEVVTGFGRSGSLFGSRGWGVKPDIMCLAKGISSGYVPLGATAVNARIEDAFASNADFGGAIMHGYTYSGHPVACAAALASLDIVLRENLPANAAKQGAHLIEALQPFVERFDAVGEVRGKGLMVALDLVADKATRAPIDPMSGYANAVAEVARENGVLVRPVGTKIILSPPLVIQREQIDRIVAGLEAGFRATPFSGGR

SEQ ID NO: 54856 - protein, 504 aa, Burkholderia thailandensis E264
MNATLAADARSACTAGTRVAVQPVVLAGGSGTRLWPMSRERHPKQLINLLGDESLLQSTARRLDGLSGAHPVSERMIIVCGEEHRFTTAEQLRLAGKDATLLLEPLGRDTAPALTIAALRAVADGDDAVLTVMPADHAVADIARFQQAVAAGVRCAEQGMIATLGIVPARAETGYGYIRVGAAASASDAELGVAVRKLDRFVEKPHLELARQYVASGEYWWNSGIFIVRASVWLKAIRHFQPAIHEACARAVELGSVDGPFFRVDRDSFAASPSNSIDYAVMEPLSNLPAVCEGVVVPLDAGWSDVGSWDALWQISDKDDEGNVARGRVCFEQASSTFAHSEGRLIACVGTQNLVVVETPDAILVADRAHVQDVKKIVGRLKAESGTEASEHRKVHRPWGHYDSVDSGERFQVKRIVVKPGARLSLQMHHHRAEHWIVVRGTARITRGDETFLLSENESTYIPLGVSHRLENPGKMPLELIEVQSGSYLGEDDIVRFEDNYGRH

SEQ ID NO: 54857 - protein, 289 aa, Pyrus communis
MEGKEEDVRLGANKFSERQPIGTSAQTQDEGKDYKEPPPAPLFEPGELTSWSFYRAGIAEFIATFLFLYITILTVMGVVKSKSKCTTVGIQGIAWAFGGTIFALVYSTAGISGGHINPAVTFGLFLARKLSLTRAVFYMVMQTLGAIAGAAVVKGFEKSSTFEMLGGGANSVAHGYTKGQGLGAEIIGTFVLVYTVFSATDAKRSARDSHVPILAPLPIGFAVFLVHLATIPVTGTGINPARSLGAAIIYNKQHAWDDHWVFWVGPFIGAALAALYHVVVIRAIPFKSK

SEQ ID NO: 54858 - protein, 523 aa, Saccharomyces cerevisiae YJM789
MSYKQTTYYPSRGNLVRNDSSPYTNTISSETNNSSTSVSSLQGASNVSLGTTGNQLYMGDLDPTWDKNTVRQIWASLGEANINVRMMWNNTLNNGSRSSMGPKNNQGYCFVDFPSSTHAANALLKNGMLIPNFPNKKLKLNWATSSYSNSNNSLNNVKSGNNCSIFVGDLAANVTESQLFELFINRYASTSHAKIVHDQVTGMSKGYGFVKFTNSDEQQLALSEMQGVFLNGRAIKVGPTSGQQQHVSGNNDYNRSSSSLNNENVDSRFLSKGQSFLSNGNNNMGFKRNHMSQFIYPVQQQPSLNHFTDPNNTTVFIGGLSSLVTEDELRAYFQPFGTIVYVKIPVGKGCGFVQYVDRLSAEAAIAGMQGFPIANSRVRLSWGRSAKQTALLQQAMLSNSLQVQQQQPGLQQPNYGYIPSSTCEAPVLPDNNVSSTMLPGCQILNYSNPYANANGLGSNNFSFYSNNNATNTQATSLLADTSSMDLSGTGGQQVIMQGSEAVVNSTNAMLNRLEQGSNGFMFA

SEQ ID NO: 54859 - protein, 287 aa, Pyrus communis
MAKDMEVAERGSFSAKDYHDPPPAPLIDAAELTKWSFYRALIAEFVATLLFLYVTVLTVIGYKSQTDPAVNADACGGVGILGIAWAFGGMIFVLVYCTAGISGGHINPAVTFGLFLARKVSLVRAVLYMVAQSLGAIAGVALVKAFQKSYYIKYGGGANSLSDGYSTGVGLAAEIIGTFVLVYTVFSATDPKRSARDSHVPVLAPLPIGFAVFIVHLATIPITGTGINPARSLGAAVIYNKDKAWDDQWIFWVGPFIGAAIAAFYHQFILRAGAVKALGSFRSNPHV

SEQ ID NO: 54860 - protein, 411 aa, Nicotiana plumbaginifolia
MNALAATNRNFRQAARILGLDSKLEKSLLIPFREIKVECTIPKDDGTLVSYVGFRVQHDNARGPMKGGIRYHPEVDLDEVNALAQLMTWKTAVADIPYGGAKGGIGCKPKDLSKSELERLTRVFTQKIHDLIGINTDVPAPDMGTNAQTMAWILDEYSKFHGHSPAIVTGKPIDLGGSLGREAATGRGVVYATEALLAEYGKNIKDLTFAIQGFGNVGAWAAKLIHERGGKVIAVSDITGAVKNPNGLDIPALLNHKEATGKLIDFSGGDVMNSDEVLTHECDVLIPCALGGVLNRENADNVKAKFIIEAANHPTDPEADEILCKKGIVILPDIYANAGGVTVSYFEWVQNIQGFMWDEEKVNRELRKYMTKAFHNLKNMCQSHNCSLRMGAFTLGVNRVARATTLRGWEA

SEQ ID NO: 54861 - protein, 330 aa, Candida albicans SC5314
MWSKEEKKQKREKKMYVQPQQRTYYLLLMFRLFARRNYSIHWRFKDVCPSPRYDTGCTYCQPEFPTNLAIDFDKNLNKTGAIPTKHVMVLTNPINQISELPSKTEFIPNSIPSEITKYRTMIQTDDQRVTISVIHLNNNRHQQILDQYNIKPGSSQQLVFLYPSMKIIRFDLSVSDQFVKKYLYSKPTAPVYNPFVQTKPSAPNNDLFDSIIVDESNFIEDELDKDLLVICGHAKRDLRCGIIAPQLESEFNQVLVRHNLQDTIYTGQVSHVGGHAYAGNVLYYPKDCQTSKDFIWYGRVFPKDVQGIVESTIINKEIIKDLFRGDIEAY

SEQ ID NO: 54862 - protein, 525 aa, Zea mays
MVSESNRGGADRTTAAGEERGQLLFDVPEIRFTKLFINGSFVDAVSGRTFETRDPRTGGVIASVAEADKEDVDLAVRAARAAFDHGEWPRMSGSERGRIMARLADLVEERADELAALESLDAGKHPAVTRAVDVGNAAGSLRYFAGAADKIHGETLKMPGQFQGHTLREPLGVAGVIIPWNFPSTMFAVKVAPALAAGCALVVKPAEQTPLSALYLAQLAKQAGVPDGVINVVPGFGPTAGAALASHMDVDMASNYRQISSHYTTGLAFVGRLIMKASAESNLKPVYLELGGKSPLIVFDDADLDMAVELAVGASFFNKGEACVAASRVYVQERVYDRFEERLAERMRSWVVGDPFSDPSADQGPQVDKAQYERVLSYIDHGKREGATLLTGGRPCGPEGKGYYIEPTVFTNVKEDMIIAKEEIFGPVMCLMKFKTVEEAIARANDTRYGLGAGVVTRDLDVANRVVRSVRAGVVWVNCYFAMGSDCPFGGRKMSGFGKDEGMHALDKYLAVKSVVTPLRASPWI

SEQ ID NO: 54863 - protein, 473 aa, Acinetobacter sp. ADP1
MAERLNNDFQFLDVARQDPEKKDIDVRKSEFVEIYKPFTAEVAANQTHRCLGCGNPYCEWKCPVHNYIPNWLKLIAEGRIFQAAELCHQTNTLPEVCGRVCPQDRLCEGACTLNDGFGAVTIGNAEKYINDTAFALGWRPDMSSVKWTNKKVAIIGAGPAGLGCADILVRNGVKPVVFDKRPEIGGLLTFGIPEFKMEKDVMKRRREIFTGMGVEFRLNVEIGKDVTIEQLLEDYDAVFMGMGTYTYMKGGFPGEDLDGVYDALDFLIANVNRTQGWEQNPSDYISVEGKKVIVLGGGDTAMDCNRTSIRQGAEEVTCAYRRDEANMPGSRREVQNAREEGVNFLFNRQPIEIVGENGQVTGVKVVTTQLGAPDSRGRRSPEPIPGSEEVLAADAVLLAFGFRPSPADWFASSSINLDGSGRVVAAEQQQYKFQTSNPKIFAGGDMVRGSDLVVTAIWEGREAAEGILDYLDV

SEQ ID NO: 54864 - protein, 351 aa, Lachancea kluyveri
MSAPQIPETQKAVIFYENGGELQYKDIPVPKPKSNEILINIKYSGVCHTDLHAWKGDWPLPTKLPLVGGHEGAGIVVGMGENVKGWKIGDYAGIKWLNGSCMSCEYCELSNESNCPDADLSGYTHDGSFQQYATADAVQAARIAPGTDLAEVAPVLCAGITVYKALKSANLRAGEWVAISGACGGLGSLAIQYAKAMGYRVLGIDGGDEKAALFKELGGEVFIDFTKTKDVVKAVVDATNGGAHGVINVSVSEAAIEASTVYCRANGTVVLVGLPGGAKCKSDVFNQVVKSISIVGSYVGNRADTREALDFFSRGLVKSPIMIVGLSELPSIYEKMEKGAIVGRYVVDTSK

SEQ ID NO: 54865 - protein, 464 aa, Salmonella enterica subsp. arizonae serovar 62:z4,z23:--
MKNASTASGASVSDAASKNEPTLQRGLQNRHIQLIALGGAIGTGLFLGIGPAIQMAGPAVLLGYGVAGIIAFLIMRQLGEMVVEEPVSGSFAHFAWKYWGPFAGFLSGWNYWVMFVLVGMAELTAAGIYMQYWLPDVPTWIWAAAFFIIINAVNLVNVRLYGETEFWFALIKVLAIIGMIGFGLWLLFSGHGGEHASIDNLWRYNGFFATGWHGLLLSLAVIMFSFGGLELIGITAAEARDPQKSIPKAVNQVVYRILLFYIGSLVVLLALYPWVEVKSNSSPFVMIFHNLDSNVVASALNFVILVASLSVYNSGVYSNSRMLFGLSIQGNAPKFLTRVSHRGVPVNSLMLSGAITSLVVLINYLLPQKAFSLLMALVVATLLLNWIMICLAHLRFRAAMRRQGRETQFKALLYPAGNYLCIAFLALILVLMCTIDDMRLSAILLPVWVVFLFIAFNVLRRKAP

SEQ ID NO: 54866 - protein, 283 aa, Ashbya gossypii ATCC 10895
MLRRQARERREYLYRKAQELQESQLQQKRDLIKQALAQGKPLPKEVADDTKLQRDYQYDESAQESIDDEYSALSGIVDPKVIVTTSRDPSTRLSQFAKEVKLLFPTSVRLNRGNYIMKNLVDACQKSGTTDLVVLHEHRGVPTALTISHFPHGPTASFSLHNVVLRHDILNAGNQSEVHPHLIFDNFTTPLGQRVVKILKHMFPPGVKRDSPRVITFANRGDFISVRQHVYVKTRDGVELAEVGPRFEMKLYELTLGTLENKDADVEWQLRRFVRTANRKDYL

SEQ ID NO: 54867 - protein, 450 aa, Physcomitrella patens subsp. patens
MADAEFFTEYGEANRYRILEVIGKGSYGVVCSAVDTLTGEKVAIKKINDIFEHVSDATRILREIKLLRLLRHPDIVEVKHIMLPPSRRDFKDIYVVFELMESDLHQVIKANDDLTPEHYQFFLYQLLRALKYIHTANVFHRDLKPKNVLANADCKLKICDFGLARVAFSDAPTAIFWTDYVATRWYRAPELCGSFFSKYTPAIDIWSIGCIFAEVLTGKPLFPGKNVVHQLDLMTDMLGSPSSETVQRVRNEKARRYLSTMRKKLPMPFGQKFPNADPLAIRLLERMLAFDPRDRPTAEEALADPYFKGLAKVDREPSAQPITKMEFEFERRRINKEDVRELIYREILEYHPQMLKEYLNGSDNATFLYPSAVDQFKRQFAHLEEHYGKVGNNPPLERQHASLPRYLFCTPASEFTKCESKFFISTICRVMVRVSQDRNEVYYSFDSRCI

SEQ ID NO: 54868 - protein, 565 aa, Bradyrhizobium japonicum USDA 110
MRHGSFSGERRQVRSSYNMAFARPCTSRHGRSSFLAAFTPFRHRCILSRPTIPPRSNPINHLTGSAAMAVSQAIPITRHPFANGSYKQMLIDGKWVDAASGKRFETHNPATGELLATVAEGDKEDIDRAVAAARRAFEGPWSKVKPFERQNLLLRLADLVEKNFDELSQLDTLDMGAPLSRTRAYRLRAVGMLRYYAGQTTAIHGETIENSLPGEIFSYTLKEPIGVVGAIIPWNGPLTATIWKIGPAIATGCTVVLKPAEEAPLTSLRIAELAMEAGIPPGVVNVVPGYGETAGAALAAHPDVDKVAFTGSHVTGQSIIRASAGNLKRVSLELGGKSPDIVFADADLDAAVPGAAMAVFANSGQICSAGTRLFVEQSIYEEFVGRVAEFGKKLQVGNGLDPNVQIGPLVSEQQLERVTGYLDIGQKEGARALAGGGRVTEGALSKGFFVSPTVFAGVQDNMRIAQEEIFGPVISAIAFKDMDELVKRANNTTFGLGSGLWTRDVSKAHAVAKSLRAGSVWVNCYQAMDPAVPFGGYKMSGYGRESGKQHVEEYLNVKAVWIKTA

SEQ ID NO: 54869 - protein, 441 aa, Salmonella enterica subsp. arizonae serovar 62:z4,z23:--
MTQYQALIIGFGKAGKTLAATLAKTGWRVAIIEQSASMFGGTCINIGCIPTKTLVHDAEREGDFSAAMQRKAAVVGFLRDKNFHNLADLDNVDVIEGRAEFVDNQTLRVFQADGERVLRGEKIFINTGAESVIPAITGLTTTAGVFDSTGLLSMSQRPARLGILGGGYIGLEFASMFANFGTKVTIFEAAPQFLPREDRDIAQAIARILQEKGVELMLNASVQAVSSQEGVVQVETPEGAHLVDALLVASGRKPATAGLQLQNAGVAVNERGGIIVDDYLRTTAENIWAMGDVTGGLQFTYISLDDFRIVRDGLLGEGKRSTRDRQNVPYSVFMTPPLSRIGLTEEQARASGATVQVATLPVAAIPRARVMDDTRGVLKAVVDVNTQRILGVSLLCVDSHETINIVKTVMDADLPYTVLRDQIFTHPTMSESLNDLFSLIK

SEQ ID NO: 54870 - protein, 191 aa, Brassica napus
VGGPHIPLKTGRRDGRKSRTDMLESYLPDHNESISVVLEKFKSIGIDTPGLVALLGSHSVGRTHCVKLVHRLYPEVDPSLNPDHVPHMLHKCPDSIPDPKAVQYVRNDRGTPMVLDNNYYRNILDNKGLLLVDHQLAHDKRTRPIVKKMAKDQAYFFKEFTRAIQILSENNPLTGSKGEIRKQCNLANKIH

SEQ ID NO: 54871 - protein, 368 aa, Linum album
MDAATAVELLNAQPQVWHHFLGYINSMTLQCALELEIADVIHRHGQPIPLNRLAAAVKIPQAKAPFLSRLMRMLVHLGYFTQVKHQQKPEAEEDVPCYWLAPLSRLLLKENPFNARSLTFCSVHEHLVDPWRQMSAWLRTSNEDGKDTANVFAFAHEGKKVYEVCSEDANFSQLFSEGMAGDSWLFSRALVSKCRDAFEGLSSLVDVGGGTGNTSKVIAEAFPNIHCTVFDLPHVVSGPKQTHPNLDYESGNMFTDDIPHADAVLFKWVLCDWPDEPVLKMLKQCKKALTKNGVKGKVMIADHVLGHESCNDSSSMGTSLILDLLFMSFLEGSLRTEKQWAKLFSEAGFADYKITPVGGLRVLIEVYP

SEQ ID NO: 54872 - protein, 211 aa, Triticum aestivum
TLLFEPYGLQVTPITTFLLVILAMTPCLVKAFANPQPKHIIRWVAYACSCGFMFGWHVHEKASLHFTIPLALIAMDSLDDIRHYFLLSIVSCYSLFPLLFEDQEYPIKVLLLLTYSALMWVGFSTHFAANPAPGGKKLDASDSIVEKKFTGWISLGYLLGMFAIEFWSRLFHHHVFGDRLPFLPLMMVSVYCGVGMMYSWIWQLSWIIRHT

SEQ ID NO: 54873 - protein, 233 aa, Triticum aestivum
MARIKPKQLLIQSKTKKGPSRISYSSIITWNLIVVLVVLSLYATYRHWHHRPAFEAEMDLPRAENVERSEDSTKISTPSYVIMDTLKGSITIEISKDASAGVVDRFINLCKSDYFKGMPFRHVIKNSVIYGGDFDLNGAAHEWILKAKASGENALSPKHEAFMIGTTRSPNSKGFDLFITTAPIPDLNGKIVLFGRVIKGEDIVQEIEEIDTDEHYQPKTPIGIINISLIQEL

SEQ ID NO: 54874 - protein, 309 aa, Escherichia coli W3110
MSKKIAVIGECMIELSEKGADVKRGFGGDTLNTSVYIARQVDPAALTVHYVTALGTDSFSQQMLDAWHGENVDTSLTQRMENRLPGLYYIETDSTGERTFYYWRNEAAAKFWLESEQSAAICEELANFDYLYLSGISLAILSPTSREKLLSLLRECRANGGKVIFDNNYRPRLWASKEETQQVYQQMLECTDIAFLTLDDEDALWGQQPVEDVIARTHNAGVKEVVVKRGADSCLVSIAGEGLVDVPAVKLPKEKVIDTTAAGDSFSAGYLAVRLTGGSAEDAAKRGHLTASTVIQYRGAIIPREAMPA

SEQ ID NO: 54875 - protein, 302 aa, Heterosigma akashiwo
RIGRLVARAALANPETSLVAINDPFMSIDYMVYLFKYDSVHGRYPGTVEVGENAIVVDGVSISVFAERDPTQIPWGAASATYVCESTGVFTTTEKASAHIQGGCSKVIISAPSADAPMFVMGVNADGYSKDMTVVSNASCTTNCLAPLVKVINDAYGIEEGLMTTVHAMTATQLTVDGPSKGGKDWRGGRCASANIIPSSTGAAKAVGKVIPEMNGKLTGMAFRVPTADVSVVDLTCRLVNGASMDEIKATVKAAAEGPMAGVLGYTDEDVVSQDFVDDKRSSIFDANACIGLTNNFVKLVS

SEQ ID NO: 54876 - protein, 302 aa, Heterosigma akashiwo
RIGRLVARSLIANPETDLKVINSGASNDYMAYQLKYDSVHGRYPGTVEIADDGLIIDGSLVPTMHTRDPGAVGWGKFGADYICESTGAFLTAEKCAPHLADGAKKIIFSAPAKDDSPTVVMGVNQDTYTTDMQFVSCASCTTNGLGPLVKCIDDAFGIEMGLMTTVHAMTATQLVVDGSSKGGKDWRGGRCASSNIIPSSTGAAKALTKVMPNLKGKLTGMAFRVPTPDVSVVDLTAVLQKEASYEDICAAVKARSEGDMAGILGYCDEPCVSQDFVSDPRSSIFDAEAGISLNPKFCKVVS

SEQ ID NO: 54877 - protein, 626 aa, Bacillus cereus ATCC 10987
MTICSVNNVTKSFGGNIIFENISLEIKNGERVGLVGRNGSGKTTIFQLLTGMESLDAGAIHMKKGTRIGHVAQIPKFDESMTVYEVLSSAFKIEKELEREMRTLEKHMAEEQESSVLQKLMERYGIIQEKFAFLGGYEIEANIMKVANGLQVTELFHRSFLELSGGEQTKVSLAYMLLQKPDLLLLDEPTNHLDLFAVEWLEQFLKEYNGTVMVISHDRYFLDEVVTKIFDLEDGEIHVYHTNYSQFVEEKEERLLQEFQAYQEQQKKIKKMKEAIKRLREWANQANPPNEGLHKRARSMERALERMEKLKKPILERKQIGLQFEGQERSGKDVVVMKEVSKRFAEHLLFNEANLHVRFQERAAIVGRNGTGKTTLLKLLLEEIEPDAGEIRIGSSVKIGYLSQHAYGNMKSNVLEAFRECVAVTEGEARHILAKFLFYGPAVFKKVTQLSGGEKMRLRLAQLMYQDINFLILDEPTNHLDIESREVLEEALEQYNGTILAVSHDRYFLNKLFEKTYWIDECKLFEFAGNYAWARQKWEEKIETQVIKQRRQGRKSMETVPVKKKEVRNIEEIETELMHVEEDIYTLECKMEQVVDVEMLEQLYEEKTKKELLRAELYNELENIVE

SEQ ID NO: 54878 - protein, 566 aa, uncultured bacterium
MKTLFVVWIVFFVLGCSGQVLAADQSNEYAQVSPDGRGAVATVNPYATQIAMKVIAQGGNAIDAAIAAAFTLGVVDGHNSGIGGGCFILVRTADGRILAIDGREMAPAAASRDMFVVDGKADPELSRTGALAVGIPGSVAALDKLQKLGGKLKFRDVILPAADLAEKGFPISPALAERLAATAVNLAKFPASAAIYLDKNNKPLPAFSPLQQKDLAATYRAIAKQGPRYFYSGDFAKKTGRWMAANGGLITRKDFANYQVKMRKPIVSEFAGYTLYGFPPPSSGGVHVAQILNILEQFDLDKLAPAERYHLIAEAMKFAFADRAHWLGDGDFTKVPLSLADKRYAQTIAQKISLEKTTINIAHGNPDVDIQHLMNKHTTHIATADLDGNWVAITATVNTSFGSKVVIPGTGVVLNNQMDDFSAQVGVANAFGLVGSDANAIAARKRPLSSMSPTLVFKNGEPVMALGAAGGPTIISQVVQTLLYSLNDSMPVEKAMAQARIHQQWNPNVLFVEAAMPIEIQQALQKKGHELKIWPTMGASQAIQLRDGKLVPVAEPRVILQNQQTN

SEQ ID NO: 54879 - protein, 1143 aa, Oryza sativa
MANHRAVIAAVLVFCLCFVQVARCDVVAAAVSPSSPEQAQELQMLRAKVASLEDEISGRKEETLQLENVVREKSAQIAALVSELEVLQVPNVADDESVLKANAHNEMLEKQVLRLGSDLEDQVKKGESLEARASEAEKSLLELTQKLDHAEKINMEQKKKIEELNHSLRQVQDKLFEVEREAKLKAEELMKVHGMWLPHWVMARFVYCQDLASDKWQLHGKPVLDALAQKKSVPAAKAHLNSLKKSTDVYASAIATRSTQAYRVCRDTIQPSMAKAQEFADHYWQESKKFTTPYITKVVAASEPRLSRVCAVLEPYTRPVISAWRKLVMSASVPHRQVQKGIKHFVNDNGLLKSDSADRFAWFTASALVALPMFYTYKMLSAAICFLFLEKNIDKKELGNIDKKELGIKDAYGRMGYIFSRIFYKRLNESRKHYTSPMRDWLPAEPVRELTDQERASQVVFKQILSTPPVKSKRSKVAFMFLTPGTLPFERLWEKFFEGHEGRYTIYVHASREKPEHASPLFIDRDIRSEKVVWGKISMVDAERRLLANALEDVDNQHFVLLSDSCVPLHNFDYVYNYLIGTNISFIDSFYDPGPHGNFRYSKHMLPEVRESDFRKGSQWFSVKRQHALMIIADSLYYTKFKLHCKPGMEDGRNCYADEHYLPTLFHMIDPNGIANWSVTHVDWSEGKWHPKAYRANDVTYELLKNITSIDMSYHITSDSKVKGTDRGVLLPKDGHQEVADVALQLAKYCIDDPVKSPLIFGEWEVVYCSVPTSPGGLYRTPLGRLIFKTDEMAQVVQAPDVVKNKVSFSVFGFDGAVSLKGKLNVLDGKWIQVIFEPPEVKTNEHGYGFLVNPAMKLLLLVYTVFARRFQHFCRQLLVTEHFWIYEHRQISIKRSRLFQTSKCISIADMPPPACSNVLYGDRTCTVEKSPLEKENAFLEKPSCSSPHPRRGGVPSSSRVSRLLDGGVAVELPLWDKRSKYSAQSVRAMPMRVLTVGKKRSRGAQLIVEEYKEKLGYYCDIEDTLIKSNPKLTSDVKVQVEAEDMAMMLQLKPEDFVVVLDENGKDVTSEQVADLVGDAGNTGSSRLTFCIGGPYGFGLQVRERADATIRLSSMVLNHQVALIVLMEQLYRAWTIIKGQKYHH

SEQ ID NO: 54880 - protein, 489 aa, Burkholderia thailandensis E264
MTTAHETLALKDPALLRERAFVAGEWQAADGGATLEVRNPATGALIGTVPAMGAAETRRAIDAANAAWPAWRKKTAKERAAILRKWHDLMIAHADDLALILTTEQGKPLAEAKGEIGYAASFLEWFAEEGKRVYGDTIPSPANDKRIVVTKEPVGVCAAITPWNFPAAMITRKVGPALAAGCPIVVKPAEATPFSALAMAVLAERAGVPAGVFSVVTGEPKAIGGELTSNPIVRKLSFTGSTPVGRLLMAQCAATVKKVSLELGGNAPFIVFDDADLDAAVEGAIASKYRNSGQTCVCTNRFYVHEKVYDAFAEKLTAAVAKLKVGLGTEAGVVQGPLINGAAVQKVESHIADALDKGARVTTGGKRHALGHGFFEPTVLTGVTPDMKVAKEETFGPLAPLFKFSTEEEAIRYANDTEFGLAAYFYSRDIGRVWRVAEALEYGMVGINAGIISNEVAPFGGVKQSGLGREGSHYGIDDYVVIKYMCVAV

SEQ ID NO: 54881 - protein, 396 aa, Nocardioides sp. JS614
MAEAESASPHPYAGDPVFDLHVGGKMAVRSSVALDGPDDLSKAYTPGVARVCEAIAEDPSLTQHYTWVPNTVAVVTDGTAVLGLGDIGPAAAMPVMEGKAVLFKQFAGVDAVPICLDTTDAEEIIETVARLAPSFGGINLEDISAPRCFEIEDRLKERLDIPVFHDDQHGTAVVTLAALTNALKLTGRNPESTRVVISGAGAAGVAVAKILLEAGIKDLAVTDRKGVLNSERGDLTPVKRSLAVLTADRSGRTGSLADVLAGADVYIGVSGGTVPEEWVAAMAPDAIIFGLANPTPEVHPEVAHRHARVVATGRSDFPNQINNVLAFPGIFRGAFDVHATAITEGMKVAAAQALADLVGDALAEDMVIPSPFDPRVGPAVAAAVADAARRDGVARR

SEQ ID NO: 54882 - protein, 594 aa, Picea sitchensis
MASAALAASSTVGIRAPHISAVQLNHHHHRSPPLSSIALAAAPARPFLQCRDSISRPHAAAGRNSLVSLWWGRQQKIQEQKRPLFAPLEGLRRRRPVKAPPTASPRASSAAVTPPPPAPPAQPWQGAALKPLAASIATGVIMWLVPAPAGVTKNAWQLLAIFLATIVGIITQPLPLGAVALMGLGAAVLTKTLTFAAAFSAFGDQIPWLIALAFFFARGFIKTGLGNRVAYQFVALFGSSSLGLGYSLVFSEALLAPAIPSVSARAGGIFLPLVKSLCVACGSNVGDGTEGRLGSWLMLTCFQTSVISSAMFLTAMAANPLSVNLAASAIGQTIGWTDWAVAALVPGLVSLIVVPLLLYVIYPPSVKSSPDAPKLAREKLQKMGPMTKNEIIMSGTLLVTVGLWIFGGMLKVDAVTAAILGLSVLLCTGVVTWKECLAESVAWDTLTWFAALIAMAGYLNKYGLISWFSQTVVKVVGGLGLSWQLSFGILVLLYFYSHYFFASGAAHIGAMFTAFLSVASALGTPPLFGAMVLSFLSNLMGGLTHYGIGSAPVFYGANYVPLAQWWGYGFLISVVNIVIWLGLGGVWWKVLGLW

SEQ ID NO: 54883 - protein, 438 aa, Polaromonas sp. JS666
MSQAPIPSASAAAGTHPLPSYLQADKLGPWGNYLQQVDRVIPHLGSLGRWAETLKRPKRILVVDVPINMDDGTIAHFEGYRVQHNVSRGPGKGGVRFHQDVTLSEVMALSAWMSIKNAAVNVPFGGAKGGIRVDPKTVSQGELERITRRYTSEIGIIIGPTKDIPAPDVNTNEQVMAWMMDTYSMNTGSTSTGVVTGKPVDLGGSLGRRDATGRGVFTVGVEAARHIDLDISTSRVAVQGFGNVGGVAGRLFHETGARIVAVQDHGGTIYREAGLDVPALIRHVAETGSVGGFPNAEVIANELFWEVDCDIMIPAALEEQINAANAGRIKARMIIEGANGPTTPEADDILQERNVLVLPDVIANAGGVTVSYFEWVQDFSSFFWDEAEINARLVRIMKEAFAGVWQVAQDHKVTLRTATFIVACKRILHTRQLRGLYP

SEQ ID NO: 54884 - protein, 421 aa, Triticum aestivum
  misc_feature (101)..(101): Xaa can be any naturally occurring amino acid
  misc_feature (247)..(247): Xaa can be any naturally occurring amino acid
MEPNADKLRGLCITSLDDEDDDETELPNQPLPASTVTVAAAASGYDDEDEDEEAEVMLGFLEKPKHPGLLLRHLFPSKAGGIPAWLDPVNLPTGNSSCCGXFCGEPLHFVLQIYAPIESNAAAFHRTLFMFMCPSMACLHRDQHKQWTRNQGNPRRSVRVFRCQLPRTNVFYSSEPPSRNNSDKPLCAGAALCHWCGTWKGDKICGGCKKSRYCSEKHQALHWRSGHKNDCLQIINSSEASSSVLPXAVGKVPARTSWPEYQIAIDDEVDLDSDGCDENSSKSLVMQKHGKPDDTMQSWMDQFEADADNQCWAYFQERISRAPEQVLRYCRDPNVKPLWALSAGRPSNPDIPSCSYCKGPLCYEFQIMPQLLYYFGVRNEPDSLDWATIVVYTCKGSCDQSTSYKEEFAWVQLYPTSISRP

SEQ ID NO: 54885 - protein, 436 aa, Xanthomonas axonopodis pv. citri str. 306
MLMFISTRGGAPAASLSQAIAAGLAPDGGLYVPQTLPPARTLVAGAGLADTATALLQPFFEGDALAAELPAICAEAFDFPAPLVALGTPGDYALELFHGPTAAFKDFGARFLAACLTRLRRAEDRPLTILVATSGDTGAAVAAAFHRQPGLRVVVLYPDGRVSPRQAHQLGCFGDNIQALRVAGSFDDCQAMVKQALNDAALQTQVPLSSANSISLGRLLPQMSYYAHAALQHHAASGSVLNLVIPTGNLGNALAAIIARALGVPLGRIALASNANHVLPDYFAGDAYAPQPSVSTLANAMDVGAPSNFERLRWLYNGDDAALREEFRALSVDDAAIRNTVQQRFARYGEVHCPHTATAVHVLEQLRAEGAEGGTGDWAVAATAHPAKFEGVVEPLIGRSVEVPPALAALLQRPAHAEALAPDYAALRQRLLADAT

SEQ ID NO: 54886 - protein, 409 aa, Spiroplasma citri
MIDYRKIKKQFPFFKNNSEQIYFDSAATTLKPQVVINAINDYYTNYGTNPHNTDSDLGYKTNVQYELVRQKLQHFINAKKKLEIIFVPGATYGLNQIAYGLSSKITTGDEILITKQEHGANILPWYRLAQEKKAIVKFLPEINFQIDLKQLATVITAKTKIVSFANVPNILGYENDPTSIVAMIKKINPAIIVVIDCAQGVIHMPTDVQKWNADFITFSAHKIFGPNGIGILWGKEELLLQLQPLIVGGGMNAQIDSNSLDYSLKKLPDRLEAGSANIADIFGFGAAIDFVNSLTLTEIIKYNHQLKQYAIQQFHKKLKDKAIIYNAYSKGPTLVFNIKNVFCQDVTMHLGSRNNITVRSGDHCARLIGTVIPEKNTIRVSFSIYNSYEDIDLLVSALANEKDFLGRLV

SEQ ID NO: 54887 - protein, 259 aa, Deinococcus radiodurans R1
MLGSDVMSRIPLKSAREIETMRRAGGLVAETFRVLEPYVQPGVTLKELDRRAEEFIRGKGAKPAYLGYGPRNNPFPGTICASVNEVICHGIPDDRELRDGDILGMDIGVLLDGYYGDACTTYTVGQVSDEVRALVDTTRACLQAGLDEVRPGAKTGDIGHAIQSLAESRGYGVVREYTGHGIGKRLHEDPTIYHWGVHHTGLKLQPGMVFTIEPMINLGTPETRLLADGWTVITADKKPSAQFEHTLVVTPKGYDILTL

SEQ ID NO: 54888 - protein, 445 aa, Nocardia farcinica IFM 10152
MNRRDDVMTAVVDQTCAAFARVSGDDLRVPLVQGGTTTYANFDLAASAPALATVADRIQHLLPYYASVHRGAGYASRISTECYEAARGSVARFLDAGDDQVVVFTRNTTDSLNLLAGCVPGETVVLDIEHHANFLPWTTHGRRVVRAADTIEETLRRLVAELCARPAALLAVTGASNVTGEVLPLRRLAEIAHQCGARLLVDAAQLAPHRRISLRDTGIDYLACSGHKLYAPFGAGVLVGRRDWLDAAEPYLAGGGAVREVGVSDVAWAPAPQRHEGGSPNVLGAAAIAAACDALGAVDAEALVAHERQLTERLRAGLAAVPGCRVLRVFADSSDCVGIVAFTLDGYEPGHVAAYLSAEHGIGVRDGRFCAHPLLARLGVAAALRASVGVSTTSEQVDRLVGAVARLVERGTAWNYACTGGLWSPSPETRPLGGDSAGGAAPCLR

SEQ ID NO: 54889 - protein, 487 aa, Brucella suis 1330
MADIYDVIVIGSGPGGYVTAIRAAQLGLKTAIVEREHLGGICLNWGCIPTKALLRSAEILHFGEHAKDYGLKLDGTITPDVKAVVQRSRGVSARLNGGVAFLMKKNKIDVIWGEAKLVKAASGSNPAEISVGKTSKQPMQPQNPVPKGVLGEGSYKAKHIIVATGARPRALPGIEPDGKLIWTYFEAMVPQALPKSMLVMGSGAIGIEFASFYHDMGVDVTVVEVMSQIMPVEDAEISAIARKQLEKRGLKIITDAKVAKVEKGANSVTAHVETKDGKTQTLTVDRMISAVGVQGNIENLGLEALGVKTDRGCIVIDGYGKTNVAGIYAIGDVAGPPMLAHKAEHEGVICVEKIAGLPNVHPLDKGKIPGCTYCNPQVASVGLTEAKAKEQGYDIRVGRYSFSANGKAIALGEDQGLVKTIFDRKTGQLLGAHMVGAEVTELIQGFVIAMNLETTEEELMHSVFPHPTLSETMKESVLDAYGRVLNA

SEQ ID NO: 54890 - protein, 378 aa, Wolbachia endosymbiont of Drosophila melanogaster
MSPFSLENSGCVYADYNATAPISENVKKSIFEVLLKQTLNPSSLHKRGQEARKILQDARDNVRGAIGVSSDKEIVFTSGATEANNLVMRGIAGYLHIISAIEHPSILNSACNPYIIPVNQEGIVDFLELEKILSELKGNKAIVSVMMANNETGVIQPIEEIAEIAHKFGAICHTDTAQSVGKIKVNMEDLGVDLLTLSAHKFGGVAGSGVLIFNKELAIEPIIIGGGQEKGFRGGTENIVAIAGLSAALQNIPDLLSKMDEVKELRDQLECELLNLASDIRIFGKNSKRLPNTSFIYMPGVKSDVQLMHFDLNHIAVSNGSACSSGKVEPSHVLLAMGATKEQAECSIRISIGPETKPQDIKKIVDCWYNIYKQNTLV

SEQ ID NO: 54891 - protein, 163 aa, Nocardia farcinica IFM 10152
MEFDVTIEIPKGSRNKYEVDHETGRVRLDRFLYTSMVYPADYGFIENTLGEDGDPLDALVLLPDSVFPGVIVEARPVAMYKMEDEAGGDAKVLCVPAGDPRWDHIQDLADVPEFELAAIKHFFERYKDLEPGKYVKGSEWVGRAEAEAEVEASFKRLQDKGGH

SEQ ID NO: 54892 - protein, 774 aa, Bifidobacterium longum NCC2705
MSHIAQRTNHPFTEMLGALLRHVDLGQCRALAFNFGKTSEGRFEGMRSASGNGFDSSDSFAVSGAAEGTARLHDIPPSITPSHGDDSHLLSRIASPADVKALAPNELAELCREIRATLLAYGHQHGGHIGSNLGMVEATVALHRVFDSPRDRIVFDVSHQSYVHKMLTGRAAAYLDPDRFSEVTGFTNPGESKHDQFVLGHTGTSISLACGLAKTRDMEGPNNSIGNVIAVIGDGSLSSGVAFEGLNNAAEQGGNLIIVFNDNEMSIAGDFGGMYGPLARLRASGGTAQPNLFNAFGLDYRYVEAGNDVSALVAAFEEVRDIDHPVVVHIHTLKGAGYDGEETHADRQTASASPVSFDSPTGVHPTDNVNHSEPWHSDHCNLSDHEPHEGQCEASHWQNPDAAIGKPDDPRKHYGKMAMAALEPRFAAEPGLVVISPATPGSNGITHEFRERAGAHYVDTGITESHAVAYAAGIARAGGTPVVATTASFFQRAYDQFFQEMSLNRSRVTVLDFLGGLSGSDNTHSGAYDVTMFSNIPGVTMLVPTSARDYLADLAWATAPAGSADAPAGPAVIRVPGEAILAAERDATLLPVTGGQIADRPQSASLPASASSASGGISAATVHGTVSVTAQHAGARHMLDWRVNQTGSQVAIIGLGNAYPLAEQTAAALSDDYGITATVIDPRQCTSLDSDVLESLRDGHQQVITLEDGQLEGGWGEKVTAYYANHHVSDGSRNPRVLNFGAAKEFTDRVSLGELNERYGLTVEQVTEAITRCF

SEQ ID NO: 54893 - protein, 271 aa, Clostridium thermocellum ATCC 27405
MSNRIGFIGAGNMGGAMITSIAQSGIIPAENILVFDVDRDKLSVLREKTGITITDSALETVRKSDIIILAVKPNMVKAVLNDIKPAVDNNKILVSVAVGIPIKFYKEMLGENIKFIRTMPNTPALVGEGMTLMCCDKNVDEKEAEQVKKIFECFGKVEFLEEKLMSEVTAVTSSSPAYVFMFIEAMADAAVLSGIPRNLAYKLSAQAVLGAAKMVLETGKHPGELKDQVCSPAGTTIEAVRSLEKNRFRYAIIEAMSECTKKALEIGKMYD

SEQ ID NO: 54894 - protein, 225 aa, Wolbachia endosymbiont of Drosophila melanogaster
MSIKIAPSILSADFAKLGEEVRKISDLGVDYIHIDVMDGNFVPNITIGPSVVSAIRKYSNLPFDVHLMVKSPGKHIESFINAGADIITVHAEVETHLERLIRKIKSYKNVNDEKKPIQVGVSIVPSTSPSVLEYIIHELDIVLIMTVNPGFGGQEFIHSQLNKISTIKKMIQERNLKTQISVDGGINFFNAADIIKAGADILVAGSAIFKAEDIKKAINYLKNPS

SEQ ID NO: 54895 - protein, 302 aa, Salmonella enterica subsp. enterica serovar Paratyphi B str.
MAALNSKVKKAVIPVAGLGTRMLPATKAIPKEMLPLVDKPLIQYVVNECIAAGITEIVLVTHSSKNSIENHFDTSFELEAMLEKRVKRQLLEEVQSICPPHVTIMQVRQGLAKGLGHAVLCAHPVVGNEPVAVILPDVILDEYESDLSQDNLAEMIRRFDETGNSQIMVEPVEDVTAYGVVDCKGVELAPGESVPMVGVVEKPKADVAPSNLAIVGRYVLSSDIWALLAKTPPGAGDEIQLTDAIDMLIEKETVEAYHMKGKSHDCGNKLGYMQAFVEYGIRHNSLGAEFKAWLEEEMGIKK

SEQ ID NO: 54896 - protein, 218 aa, Streptomyces coelicolor
MRAASQGRYTGPQAESRYVIPRFVERTSQGVREYDPYAKLFEERVIFLGVQIDDASANDVMAQLLCLESMDPDRDISVYINSPGGSFTALTAIYDTMQYVKPDVQTVCMGQAASAAAVLLAAGTPGKRMALPNARVLIHQPYSETGRGQVSDLEIAANEILRMRSQLEEMLAKHSTTPVEKIREDIERDKILTAEDALSYGLIDQIITTRKMDNSSLR

SEQ ID NO: 54897 - protein, 179 aa, Zea mays
  misc_feature (150)..(150): Xaa can be any naturally occurring amino acid
  misc_feature (160)..(160): Xaa can be any naturally occurring amino acid
MDAEKERQHDGDGGAVEADIERLPVDLLAHILSLLSPFRDLSMAGGVSRRWRWAVERSLASRRRLSFAGQRTGDDTAARLVRAAVNLRDLDISRSCWGCRITDDGLIKISSADCVGNLTSISLWGLAGITDKGVVRLVSRAYSLLHLNIXGGTFITDESXLYAVANSCANLKSIIPVEL

SEQ ID NO: 54898 - protein, 433 aa, Picea sitchensis
MAMAASSMMRSSLQAGSFVENHRTSVAADAKIQSKITSTDGTVRLSFGSFGSNFFGSTAQFCQGSALQSQSARTLQPVRATATETPPRVQKSSGKERSKIGINGFGRIGRLVLRVALSREDIEVVAINDPFIDAKYMAYMFKYDSTHGVYKGSLKIVDDKTLEIDGHRIIVNSKRDPAEIPWGDYGAEYVVESSGVFTTIDKASTHLKGGAKKVVISAPSADAPMFVVGVNEGSYKPEMSIVSNASCTTNCLAPLAKVVNEEFGIAEGLMTTVHATTATQKTVDGPSMKDWRGGRGAGQNIIPSSTGAAKAVGKVLPELNGKLTGMAFRVPTPNVSVVDLTCRLVKPASYDDVKAAIKAASEGSLKGILGYTDEDVVSNDFIGDERSSIFDSKAGIALNTGFVKLVSWYDNEWGYSNRVVDLISHMALVDSRK

SEQ ID NO: 54899 - protein, 1137 aa, Puccinellia tenuiflora
MEEAGSSPDDAVLLFGVSLVLGIGSRHLLRGTRVPYTVALLVLGVALGSLEYGTKHGLGKLGAGIRIWAAINPDLLLAVFLPALLFESSFSMEVHQIKKCMAQMVLLAIPGVVLSTVLLGSAVKLTFPYNWSWKTSFLFGGLLSATDPVAVVALLKDLGASKKLSTIIEGESLMNDGTAIVVCQLFYRMVLGTTFDAGSIIKFLTQVSLGAVALGLAFGIASVLWLGFIFNDTIIEISLTLAVSYIAFFTAQDAFEASGVLAVMTLGMFYAAFAKTAFKGDSQESLHHFWEMVAYIANTLIFILSGVVIADGVLQDNIHFERHGASWGFPLLLYVFVLTGRAVVVTVLYPLLRHFGYGMDVKEATVLVWSGLRGAVALSLSLSVKRASDADQPNLKSEVGTMFVFFTGGIVFLTLIVNGSTTQFLLHLLGLGKLSATKLRVLKYTRYEMLNKAKEAFGDLRDDEELGPADWITVKKYITCLNNLEDEQAHPHDAPDKDESVHTMNLRDTRVRLLNGVQAAYWGMLEEGRITQATANILMRSVDEAMDLVSTQSLCDWKGLRSNVHLPKYYRFLQMSRLPRRVVTYFTVERLELGCYICAAFLRAHRIARRQLHDFLGDSEIARIVIDESTAAGEEAKKFLEDVRLTFPQVLLALKTRQVTYAVLTHLSEYIQDLGKTGLLEEKEMVHLDDALQTDLRKLKRNPPLVKMPRASEILNTHPLVGALPAAVRDPLLSNTEETIKVHGTILYSEGSRPTGIWLVSTGIVKWTSQRLSTRHSLDPILSHGSTLGLYEALVGKPYICDIITESVVHCFFIEAETIEQLRQSDPSIEDFLWQESALVIARIFLPQIFEKMAMREMRVLISERSTMNIYIKGEDIELGPNYVCILLEGFLQMNQTLITPPAVLLPSNTDLNVFGLQSSAMNHIDYCYTAPSYQVTARARAILFDIRRPEAESDLQRSASLLSPNLGPPRTQSKEHIGLLRWPQSFHHRSRGPGNPSLAEIGKQPGSFSASALQVSMYGTMMDDEMHTAQPRPRPDRVEANQKHSASYPKVPSRSLSNTRPLLSVRSEGSNMMKRKSAPAPAHAPALDPFPPLAGGRHHRAITEGDLSSDESAGEEVIVRVDSPSMLAFQPRPQGN

SEQ ID NO: 54900 - protein, 286 aa, Oryza sativa Japonica Group
MGKEVDVSTLEAGGARDYIDPPPAPLVDVDELGKWSLYRALIAEFVATLLFLYVTVATVIGYKHQTDAAVNGADAACGGVGVLGIAWAFGGMIFILVYCTAGVSGGHINPAVTLGLFLARKVSLVRALLYMAAQCLGAICGVALVKGFQSSLYDRYGGGANELAAGYSTGTGLAAEIIGTFVLVYTVFSATDPKRNARDSHVPVLAPLPIGFAVFMVHLATIPITGTGINPARSLGVAVVYNNNKAWSDQWIFWVGPFIGAAIAALYHQVILRASARGYGSFRSNA

SEQ ID NO: 54901 - protein, 506 aa, Picea sitchensis
MQDTRGSAEELHDERDEEQVDLDGDEEPEEIMDEEAEDEGDVEEEEKNHGQEGLDLDLVEDEGSGSQDEQEAEQDVNVPNVDHEKLSEDDGNIDTVEDALPAEGNGEKADKDKEECNDDELLARPPHGTEVFVGNLPRNITKEDLTSLCEQHGEVFDVIIKREASKLEYAFVTFTTKESAKKAIETLNGFEFKDKKLRVSESQPKNRLFLGNIPSNLKEEELTKIVSEQGPGYQHLELIKDPKDTTRNRGFAFVEYYNKGCAEKAMKNMTHSKFQLDDKLITVKWATSQRSSSEEVKSVYVRNLPENVTEEQLRELFGRHGEVTKVVLLEQKPGQPKRDFGFVHYADHSSAMKAIEKTEKYTLEDRELSVSLARPLSDKKPQNMGNPTSFQRPLFSNFQPQAGYGYNPNMYGFGSMGYTQPVIYGRGPTPEGMTMVPMILPDGRVGYVLQQPGNAVGGSAPYRSEGSASYGGGSASYRSSRTSSGSGRQGGGRNSGSGGSRRYRPY

SEQ ID NO: 54902 - protein, 520 aa, Deinococcus radiodurans R1
MTQPGIELQELIATMEQRRRKVEEGGGPERQQKQREGGKLTARERIERLLDPGSFLESSTFVEHGRNRLMDGIEAPGEGVVTGSGTIDGRQVFVFSQDFTVLGGSLGKMNASKVTKIMDLAAKTGCPVIGLNDSAGARIQEGVDSLSGYGEIFYRNAVYSGSVPQISAILGPCAGGAVYSPAITDFILMSRGSSYMFITGPEVIKSVTREEVTFDQLGGADVHTRKSGVAHLAYEGDEAVIDGIKDLLGYLPQNAREKAPVKPTSDPADRRNEKLLDIVTPDQRRPYAMQDVIRELVDDGTFLEIQPDWAKNIIVGFARLNGQSVGIVANNPKALSGSLNIDASDKAARFIRTCDCYNVPILTLVDVSGFLPGVQQEYGGIIRHGAKMLYAYAEATVPKVTLITRKSYGGAYLAMNSRDMGADVVYAWPTATVAVMGAEGAANIVYRKDIKDSENPAATRAEKIAEYKEAFDNPYVAAAKGYIDDVIPMEETRERLIRTFEMLANKEETRPFKKHGNIPL

SEQ ID NO: 54903 - protein, 354 aa, Picea sitchensis
MNSNGATTSGANGGGDSAAPRRQSKQPKYSRFTQQELPACKPLLTPGWVITTFMLVGALFIPIGVISLVASHRVVEIVHQYETDCLPPQYRINKAAKVTYIKSDMPKSCTQTLKVPKHMKRPIYVYYQLDNFYQNHRRYVKSRNDQQLMKAGSENETDSCKPEATTGSLPIVPCGLIAWSLFNDTYSFYKGNKPLIVNKKDISWKSDREHKFGKDVYPKNFQSGGLIGGAKLNASIPLSEQEDLIVWMRTAALPTFRKLYGRIEEDLQENDTIKVTLLNNYNTYTFNGKKKVVLSTTSFLGGKNNFLGIAYLTVGGLCFFLAMVFFLVHIIKPRPLGDPAYLSWNRNSPEVRSS

SEQ ID NO: 54904 - protein, 470 aa, Salmonella typhimurium
MKKTKIVCTIGPKTESEEMLSKMLDAGMNVMRLNFSHGDYAEHGQRIQNLRNVMSKTGKKAAILLDTKGPEIRTIKLEGGNDVSLKAGQTFTFTTDKSVVGNNEIVAVTYEGFTSDLSVGNTVLVDDGLIGMEVTAIEGNKCICKVLNNGDLGENKGVNLPGVSIALPALAEKDKQDLIFGCEQGVDFVAASFIRKRSDVVEIREHLKAHGGENIQIISKIENQEGLNNFDEILEASDGIMVARGDLGVEIPVEEVIFAQKMMIEKCIRARKVVITATQMLDSMIKNPRPTRAEAGDVANAILDGTDAVMLSGESAKGKYPLEAVSIMATICERTDRVMNSRLDYNNDSRKLRITEAVCRGAVETAEKLEAPLIVVATQGGKSARAVRKYFPDATILALTTNEVTARQLVLSKGVVSQLVKEINSTDDFYRLGKDVALQSGLAQKGDVVVMVSGALVPSGTTNTASVHVL

SEQ ID NO: 54905 - protein, 378 aa, Thermus thermophilus
MNLHEYQAKEILARYGVPVPPGKVAYTPEEAKRIAEEFGKRVVIKAQVHVGGRGKAGGVKLADTPQEAYEKAQAILGMNIKGLTVKKVLVAEAVDIAKEYYAGLILDRAKKRVVLMLSKEGGVDIEEVAAERPEAIHKFWIDPHKGFRPFEAREMVKRAGLEGNLNKLAQVLVALYRAYEGVDASIAEINPLVVTTDGGIVAADAKIVLDDNALFRHPDLAELREVEAEHPLEVEASNYGFAYVKLDGNIGIIGNGAGLVMYTLDLVNRVGGKPANFLDIGGGAKADVVYNALKVVLKDPDVKGVFINIFGGITRADEVAKGVIRALEEGLLTKPVVMRVAGTAEEEAKKLLEGKPVYMYPTSIEAAKAIVAMVGGAA

SEQ ID NO: 54906 - protein, 478 aa, Actinobacillus pleuropneumoniae serovar 1 str. 4074
MNLTSPGSFRQVVLKVPLKETALVRREYVFNAGVPVLGICYGMQTMAMQLGGLTETSDHREFGYASVDLQATDALFAKLNDNLTASEPKLDVWMSHGDKVTRLPQGFQVTGITPTCPIAAMSDESRRFYGVQFHPEVTHTKSGLELLTNFVVGICGCECKWTAENIIEDAVARIKEQVGDDEVILGLSGGVDSSVTALLLHRAIGKNLHCVFVDNGLLRLNEGDQVMEMFGDKFGLNIIRVNAEDRFLDALKGIDEPEAKRKTIGKVFVDVFDDESKKLTSVKWLAQGTIYPDVIESAASKTGKAHVIKSHHNVGGLPDYMKLGLVEPLRELFKDEVRKIGLALGLPAEMLNRHPFPGPGLGVRVLGEIKKEYCDLLRKADAIFIEELYKADWYYKVSQAFTVFLPVKSVGVMGDGRKYDWVVSLRAVETIDFMTAHWAHLPYDLLGKISNRIINEVNGISRVVYDVSGKPPATIEWE

SEQ ID NO: 54907 - protein, 275 aa, Alkaliphilus metalliredigens QYMF
MKIGYLGPEGSYSYTAAKCYAPQGTLISMRGFREIIQGVENGTIEEGILPIENSTEGAVTQTMDALMETVDSKIKGELVLQIRHNLLSLGESIGEINYVASHPQALEQCREFLATHYPHAVLIPSESSSAACQMIKEKDQASAYAAIANSWAGENNGLKTLCKDIQDNKNNQTRFIIIGIEDTITTGNDKTSIAFSFHEDYPGSLYGILREFAQEKINLTRVESRPAKAELGKYIFYIDFNGHGEDQKCKSVLERIRKEVNKFKIFGSYPIGRVY

SEQ ID NO: 54908 - protein, 151 aa, Triticum aestivum
  misc_feature (58)..(58): Xaa can be any naturally occurring amino acid
  misc_feature (70)..(70): Xaa can be any naturally occurring amino acid
SINVSGHKYGLVYAGIGWCIRRSKEDLPDELIFHINYLGADQPTFALNFSKGSTRVIXAQYYQLIRVGCXGYRKGVFFCRENAMVLKEGLELTGRCNIESDDEGVPVVGHSLSGQRPARAACALRGPAPIRPDRARLTLGARAPPRKTPGD

SEQ ID NO: 54909 - protein, 629 aa, Cocos nucifera
MAVLERDVMVPWFLWLILVFHPLARVLANSEGDALHSLRTNLIDPSNVLQSWDPTLVNPCTWFHVTCNNDNSVIRVDLGNAQLSGTLVPQLGLLKNLQYLELYSNNISGTIPSDLGNLTNLVSLDLYLNSFTGGIPDTLGKLTKLRFLRLNNNSLSGSIPQSLTNITALQVLDLSNNNLSGEVPSTGSFSLFTPISFANNPQLCGPGTTKACPGAPPLSPPPPFISPAPPSSQGSSASSTGAIAGGVAAGAALLFAAPAIGFAWWRRRKPQEHFFDVPAEEDPEVHLGQLKRFSLRELQVATDNFSTKNILGRGGFGKVYKGRLADGSLVAVKRLKEERTPGGELQFQTEVEMISMAVHRNLLRLRGFCMTPTERLLVYPYMANGSVASCLRERPPSEPPLDWTTRRRIALGSARGLSYLHDHCDPKIIHRDVKAANILLDEEFEAVVGDFGLAKLMDYKDTHVTTAVRGTIGHIAPEYLSTGKSSEKTDVFGYGIMLLELITGQRAFDLARLANDDDVMLLDWVKGLLKEKKLDMLVDPDLQDDYVEAEVESLIQVTLLCTQGSPMERPKMSEVVRMLEGDGLAERWEEWQKVEVVRLDVEMAPPNGNNEWIIDSTDNLHAVELSGPR

SEQ ID NO: 54910 - protein, 144 aa, Triticum aestivum
  misc_feature (66)..(66): Xaa can be any naturally occurring amino acid
  misc_feature (77)..(77): Xaa can be any naturally occurring amino acid
  misc_feature (80)..(80): Xaa can be any naturally occurring amino acid
  misc_feature (85)..(86): Xaa can be any naturally occurring amino acid
  misc_feature (100)..(100): Xaa can be any naturally occurring amino acid
  misc_feature (119)..(119): Xaa can be any naturally occurring amino acid
MGMAEKSSATRKAGLITKTLDRCWSTPMRNKPAEGCFSVYVGAGRQRFVVRTVCVNHPLFRALLEXAEEVFGYAAAXPLXLPCNXXMFAGVLEQIEEEKXMAGRRKCGLARGNSYRLLXTGRAVIIDRDIILMIPDNSNFVNNG

SEQ ID NO: 54911 - protein, 425 aa, Brucella suis 1330 [sequence omitted]

SEQ ID NO: 54912 - protein, 254 aa, Brucella suis 1330
MTPGIRPLVAGNWKMNGKGESLTELRAIAAGLSSDLGRKLDAVICVPATLLSRAAETLEGETVGLGGQDAHFKTSGAHTGDISPEMLKEAGATHVILGHSERRTDHHESNKLICAKTEAAWAAGLVAIVCVGETASERKAERALDVIGDQLSGSLPDGVTAENTIIAYEPVWAIGTGLTPTVQDVRAAHAFMREQLIERFGAKGAHLRLLYGGSVKPSNAAELLGVADVDGALVGGASLKAADFLAICETYRNL

SEQ ID NO: 54913 - protein, 309 aa, Glycine max
MTTTNSLFFSLDWHNEFYPTYHDFYLLPLFALFFPSLRFFLDRFIFEKVARRLIFGKGHAALDYHSDERRKKIRKFKESAWKCVYYLSAEILALSVTYDEPWFTNTRNFWVGPGTQVWPDQKIKLKLKAVYMYAAGFYSYSIFALIFWETRRSDFGVSMSHHVATVILIVLSYIFRFARVGSVVLALHDASDVFLEIGKMSKYSGAETMASFAFILFVLSWIILRLIYYPFWILWSTSYEVLLTLDKEKHQVDGPIYYYVFNSLLYCLLVMHIYWWVLIFRMLVKQIQARGKVSEDVRSDSEDEDEHED

SEQ ID NO: 54914 - protein, 471 aa, Bacillus cereus ATCC 10987
  misc_feature (25)..(25): Xaa can be any naturally occurring amino acid
MKQIFQKKPIAKLMQESKQKTLARXLGALDLTMLGIGAIVGTGIFVLTGVVAAKHSGPAIILSFAIAALACAFAAFCYAEFASSVPVSGSVYTYTYATMGEVFAFLIGWDLMLEYLLATSAVANGWSAYFQSLLKGFGIHIPTILSSAPGTGKGGIIDLPAVLIILVMTVLLSRGVRESARVNNIMVFIKLAVVLIFIFAGFNYVKPENWTPFMPFGLDGVMAGAATVFFAFIGFDAVSTAAEEVKRPQRDLPIGIIASLLICTALYIIVSLILTGIVPYGQLNISDPVAFALQFIGQDSLAGVISVGAITGITTVMLVMMYGQVRVSYAMSRDGLLPKRLAKVHPKFKTPFLNTWTTGIIAALISGLIDLNVLAHLVNMGTLSAFALVAVAVIVMRRTHPDLPRAFKAPLVPFLPALTVIFCLYLMLQLSGTAWISFGVWMIIGIAVYFLYSRKHSALNNSKEEDDAANL

SEQ ID NO: 54915 - protein, 641 aa, Triticum aestivum
MSKLLVIALLLLPLINQGIYLATAWDDQDFFKYCPPSQCSQDGPEVRFPFCLESSNTSAAAAASCGCAGRSIRKLACSGRDTILFHPVLGPYNVSAIDYGRSSMKLIPLVDPCFVLQQKPVISRSSSSPQADVINDEKRSLQFFEWTSTALVRCSREFAPGAADGIAGPVSCLSNTTHFFYLVHGYEDMSLLPLDCKVVPLSDGVGGGLIPMYMFYNPMSDTLRVSFKESIERILSFAEMTVYWFNGYTCRQCERSGGRCAFSSQSVGPFCMPGPHGSRIKVIAATSSVAAFVVLLLTVATVLYLSLKTRYNAEIHMKVEMFLKTYGTSKPTRYTFSEVKKMARRFKEKVGQGGFGSVYKGELPNGVPVAVKMLENSTGEGESFINEVATIGLIHHANIVRLLGFFSEGMRRALIYEFMPNESLEKYIFSDDSNIFQNLLVPEKLLDIALGIARGMEYLHQGCNQRILHFDIKPHNILLDYNFNPKISDFGLAKLCARDQSIVTLTAARGTMGYIAPELYSRNFGGVSYKSDVYSFGMLVLEMVSGRRNADPRIGSQDDVYLPEWIYEKVINGEELALTLETTQEEKDKVRQLAMVALWCIQWNPRNRPSMTKVVNMLTGRLQSLQMPPKPFVSYENEPMP

SEQ ID NO: 54916 - protein, 452 aa, Oryza sativa
  misc_feature (43)..(43): Xaa can be any naturally occurring amino acid
MAAKAAALSSSPFVSSRRLSSPAASLRARTPRCVMGSEQVRVXVVEEEGKTKKRMGVAEPRSAPPAVWTPRAPAQEARLAALRTDGRDSRLKIFSGTANRPLAQEIASYLGVDLGKVLIKRFADGEIYVQLQESVRGCDVFLVQPTCSPVNENLMELFVMIDACRRASARSITVVIPYFGYARADRKAQGREAITAKLSANLLTEAGSDRVIVCDIHSTQALGYFDIPVDHIHGQPVILDYLASKTISKDLVVVSPDVGGVVRARAFAKKLSDAPLAIVDKRRQGHNMSEVMHLIGDVKGKVAIMVDDMIDTAGTITSAAALLKQEGAEAVYACSTHAVFSPPAIERLSGGIFEEVIVTNSILLPEHKCFPQLTVLSMANLVAETIWHVHRDGSSSISTSETHSLPLTKEASDALPGYNQPRGHMTLLPTTKEASDAPTYGGVVILASEAQL

SEQ ID NO: 54917 - protein, 596 aa, Bacillus cereus E33L
MVESLLLSIVIIITLGIASQWTAWRFQLPAIVVMAVAGLLIGPVFGIINPKEVLGDVFSPLVSLSVAIILFEGSLSLDIRELRGLSKPVFRIVTFGAFIAWIAGSLAAHYVAGLDWAVAFIIGGLFIVTGPTVIIPLLRQARLKPRTAAILKWEGIIVDPFGALLAVFAFQIVNFLTKENVQLHTLLYFFAGSLFAMVLGYVFSIFMSYMILKGKVPEYLKAPILLVTVLLCFGIADEVMHETGMLAVTVMGITLARMKKYISSIGDIRHFNENISVLLTSTVFIILTASLPRTTIMEIFSWPIISFVLMMLFVVRPLSIWISTIGTELTKAERALVGWIAPRGIVALTVSSYFATELLQEGYKDASILTALTFALVITTVCAHGFSIGFLAKRLGLANTEPPGILISGASTFSSALALHCKEMGVPSLIVDVSEEHLQCAKVKGLNTYNGQVLSEQLQFEVDMNQYEYLIAVTDTDSYNVLVANTYVPQFGHHNTFLLPIHDVEKIEQERISLSKKAHLLFGQNEIYEELNRKIEDGYTFKTIQVAEEQKINKEEIDSEDLILFIRHRDGSLTFSTLYKYIAVMPGDELVVLAKQ

SEQ ID NO: 54918 - protein, 135 aa, Oryza sativa Japonica Group
TQTLATPKHFRFLLSSVRRANQASEIIGTFVLVYTVFSATDPKRNARDSHVPVLAPLPIGFAVFMVHLATIPVTGTGINPARSLGAAVVYNNSKAWSDQWIFWVGPFIGAAIAALYHQIVLRASARGYGSFRSNA

SEQ ID NO: 54919 - protein, 249 aa, Pseudoalteromonas tunicata D2
MKLRKQMVAGNWKMNGSVELVNQIANAISAVELDKVDVVVFPPYPLLNNALQNELVVGAQSVSEHEAGAYTGEIDAQLLAELGCKYTLVGHSERRSIYGESDEVVASKFQRAQCQGLIPVLCVGESEQEREQNLTESVVSRQIDAVINKLGVVSLVKSVIAYEPVWAIGTGKTATPEQAQQVHKFIRDKIASLDDAVSQSLILLYGGSVNEKNSELLFAQPDIDGGLVGGASLNPDSFVNICKSAQGNV

SEQ ID NO: 54920 - protein, 341 aa, Burkholderia thailandensis E264
MTQVQAEQPPHVAILQMVTGKWHAQALYVAAELGIADLLARQERTADELAAATHTHPEALYRVLRALGSLGVFVESDGRRFRNSPLGDTLRCDATGSMRGFVRLAGMDAGWRAWGQLMYSVKTGRSAFEQVVGGPGFAYIDSHPEIAAIVNDAMTSVSELESPAVARAYDFSQARTIVDVGGGHGFLLATLLLANPNANGVLFELPHACEGARRLFAKHGLTERVKVIAGDASKSIDARGDVFVMKHVVCDWDDEQATRIMTNCAEAMRAGGKLLLVEAVLTPPGEPHFAKLHDLEMLIMSSGGHGRTAEGYERLYAAAGLQMTAVHPTEGAHSVIEGVKP

SEQ ID NO: 54921 - protein, 365 aa, Nocardioides sp. JS614
MNPTGFTPTHQWRGVIEEYRQLLQIPEDTVAVTLREGGTPLVFSEWLSGRTGADVWLKVEGGNPTGSFKDRGMTAAISVAKHEGAEAVVCASTGNTSASMAAYAAKAGLKPLVLVPEGKIAAGKMAQAILHGAQVIMVRGNFDDCLGLAKGLAWDYPVALVNSVNPVRLEGQKTAAFEIVDFLGDAPDFHLLPVGNAGNISAYWLGYTQYADWGRATKRPVMRGFQAEGAAPLVTGEPFPDPETRATAIRIGNPASWKLAAAARDESGGRFAAVSDGQILAAQRELASRDGVFVEPASAAGIAGLLEELAAGEDYRGSTVVVTVTGHGLKDTATALEGFTESGNSIVDTVIDAEVTAAAQAAGLA

SEQ ID NO: 54922 - protein, 399 aa, Bacillus cereus E33L
MRSEVTVKIKPKFIKEIKSGYPLILKDAIQNLNDVQEEGTIIKVVDEKNHFVGKGYYGKQNKGYGWILTRKESEQINQSFFESKIKSALHKRKQFYKSSDTTAFRALNGEGDGLGGLIIDYYDGYYVLSWYSEGIYTFRDEIIAALQKVANFKGIYEKKRFDTKGKYIEGDDFVAGERGEFPLIVKENGVNFAVYLNDGAMVGVFLDQRNVRKQIRDKYAKGRTVLNMFSYTGAFSVFAALGGASKTTSVDLANRSLSKTIEQFSVNEVDYEAQDIIVEDVFLYFKYAAKKKMKFDMVVLDPPSFARSKKYTFSAAKDYKNLLKETIAITENNGIIVASTNCSAFDMKKFKGFIDTAFKEMNGKYKILEEHSLPEDFRTIDQFKEGDYLKVVFIEKIKG

SEQ ID NO: 54923 - protein, 254 aa, Triticum aestivum
  misc_feature (217)..(217): Xaa can be any naturally occurring amino acid
MGRKFFVGGNWKCNGTVEQVESIVNTLNAGQIASTDVVEVVVSPPYVFLPTVKAKLRPEIQVAAQNCWVKKGGAFTGEVSAEMLVNLGVPWVILGHSERRSLMGESSEFVGEKVAYALAQGLKVIACVGETLEQREAGSTMAVVAEQTKAIADKIKDWTNVVVAYEPVWAIGTGKVATPAQAQEVHANLRDWLKTNVSPEVAESTRIIYGGSVTGAXSCKELAAQPDVDGFLVGGASLKPEFIDIINAATVKSA

SEQ ID NO: 54924 - protein, 488 aa, Oryza sativa Indica Group
MSRRALGSAFAGFTRTPAMTPTATLPSSCASPARLLRWRRSAGVGARRFASGRNARISMSLRAGIVGLPNVGKSTLFNAIVRNLPSASSEEFRAVMNSFLAGSNSRRKKAILIICAFEEFFSIHGLVLVEDEVENGKAQAANFPFCTINPNVGVVAIPDARLHVLSKLSKSKETIPTSIELVDIAGLVKGASKGEGLGNQFLSNIREVDSILQVVRCFEDDDIVHVSGKVDPKSDIDVINLELIFSDLDQIEKRLDKLKKSKTKDQQVKVKIPTVLTTQEQAERTGLEKIQTVLMDGKPARSVDLADHEKEAIQHLCLLTMKPVIYVANVTESDLAEPGNNPHVKEVAKLATDLESGMVTISAQVEAELAELPLEERVEYLKSLGVTESGLGNLVKATYDLLGLRTYFTTGDKETKAWTILAGMTAPQAAGVIHSDFQKGFIRAETVSYDDFVAAGSLGVAREKGLLRLEGKDYIVQEGDVMLFRFNV

SEQ ID NO: 54925 - protein, 1080 aa, Saccharomyces cerevisiae YJM789
MSNYYRRAHASSGSYRQPQEQPQYSRSGHYQYSNGHSHQQYSSQYNQRRRYNHNDGTWRRYNDDRPHSSNNASTRQYYATNNSQSGPYVNNKSDISSRRGMSQSRYSNSNVHNTLASSSGSLPTESALLLQQRPPSVLRYNTDNLKSKFHYFDPIKGEFFNKDKMISWKATDKEFSETGYYVVKELQDGQFKFKIKHRHPEIKASDPRNENGIMTSGKVATHRKCRNSLILLPRISYDRYSLGPPPSCEIVVYPAQDSTTTNIQDISIKNYFKKYGEISHFEAFNDPNSALPLHVYLIKYASSDGKINDAAKAAFSAVRKHESSGCFIMGFKFEVILNKHSILNNIISKFVEINVKKLQKLQENLKKAKEKEAENEKAKELQGKDITLPKEPKVDTLSHSSGSEKRIPYDLLGVVNNRPVLHVSKIFVAKHRFCVEDFKYKLRGYRCAKFIDHPTGIYIIFNDIAHAQTCSNAESGNLTIMSRSRRIPILIKFHLILPRFQNRTRFNKSSSSSNSTNVPIKYESKEEFIEATAKQILKDLEKTLHVDIKKRLIGPTVFDALDHANFPELLAKRELKEKEKRQQIASKIAEDELKRKEEAKRDFDLFGLYGGYAKSNKRNLKRHNSLALDHTSLKRKKLSNGIKPMAHLLNEETDSKETTPLNDEGIPRVSKEHDEEDENMTSSSSEEEEEEAPDKKFKSESEPTTPESDHLHGIKPLLPDQNGSSDVLDASSMYKPTATEIPEPVYPPEEYDLKYSQTLSSLDLQNAIKDEEDMLILKQLLSTYTPTVTPETSAALEYKIWQSRRKTLEEEKASDWQIELNGTLFDSELQPGSSFKAEGFRKITDKLKINYLPHRRRVHQPLNTVNIHNERNEYTPELCQREESSNKEPSDSVPQEVSSSRDNRASNRRFQQDIEAQKAAIGTESELLSLNQLNKRKKPVMFARSAIHNWGLYALDSIAAKEMIIEYVGERIRQPVAEMREKRYLKNGIGSSYLFRVDENTVIDATKKGGIARFINHCCDPNCTAKIIKVGGRRRIVIYALRDIAASEELTYDYKFEREKDDEERLPCLCGAPNCKGFLN

SEQ ID NO: 54926 - protein, 450 aa, Yarrowia lipolytica CLIB122
MKAKQYVPPWKQPYIIAVAGSSGSGKTSVAQLIIKQLNVPWTVLLSMDNFYKTLTPEESAAAHRNEHDFDTPTAYDTDDLVKCLRDIKAGHRVNIPTYSFVEHARTDKTVSIYGANIVILEGIYVLYDHPGLLDLIDMKIFVDTDLDTCLARRLTRDMLHRGREMSGIINQWRKTVKPNFERYVRPTMANADVLIPRGRDNVVAIDMVAQHITKILTDKSERHLADLCSLIDDDELAAEEATWNKQIHELKQSPQLIGIHTILCSDDTKRADFVFYFDRIATLLVENALQHSKFENINVETPTGNTFEGVRRLGIDNTCAVAIIRAGECFDRSVKRTIPSVRMGKLLIQSDISTGEPKLHHLNLPSRISEPDAFVLLCDAQLSSGAAAIMATTVLVDHGVKEENIVFVCYLASKRGLQRYLNAYPNVHTVVGKILDGSHGRFIDTKYYGT

SEQ ID NO: 54927 - protein, 321 aa, Prochlorococcus marinus str. NATL1A
MFKTTRFSWIKRKQIFSFLVVSTIIFSSLFTNPNTATAASGGRIGGGSFQAPSSPRRQNYGGYGGNNFRGYGSGYRGGGIGFPFLMPIFGFGGGGIFGFLILMSIVGVIVNSFKSSSNFSSASNNSIVSQSTNPSKVSLIQFQIGLLASAKEIQVDLRDLAASSNTSTSSGLQRVLQDTTLSLLRKPELWVYSNIETGSVPYASAESTFNRISITERSKLKAELTSNYSGQISSSTDKQSNPGDSDSTNEYIAITILVATKKDLSLQNSANTEVITEALRILGSISSNDLIALEVIWQPDGEGETLREEELIIQYPNLKHL

SEQ ID NO: 54928 - protein, 293 aa, Oryza sativa Indica Group
MDAVAGASVSSSSARLRPCPRPRRIGNVAPATVRRRSRRRAVTCAAAADADVVGLFDAAKLTVDRFVESGMVVGLGSGPASGLAIQYLGTRLRRGSLTGILGIPSSTISASEAVKAGIQVSSYEEGTQIDFAFTDADIIEEDTMTAVIGRRKTESGEPSFMVEKGIVKSADKLAFIIGHEKYVKGIEGSIPVLVKSVWRRPSIGTAGPLGGDFPLVTKEGHHVLDVIFTTPIPDLGKDQYRFDRFSDPQVAHEDRQFIEFLDRMLDAIRNPQSLARIQREKLPKDLKILDDDI

SEQ ID NO: 54929 - protein, 231 aa, Saccharomyces cerevisiae YJM789
MSEFLNENPDILEENQLPTRKEDSTKDLLLGGFSNEATLERRSLLLKIDHSLKSQVLQDIEVLDKLLSIRIPPELTSDEDSLPAESEDESVAGGGKEEEEPDLIDAQEIYDLIAHISDPEHPLSLGQLSVVNLEDIEVHDSGNQNEMAEVVIKITPTITHCSLATLIGLGIRVRLERSLPPRFRITILLKKGTHDSENQVNKQLNDKERVAAACENEQLLGVVSKMLVTCK

SEQ ID NO: 54930 - protein, 408 aa, Prochlorococcus marinus str. NATL1A
MTKLRFDVVSLFPEAFKNFFNHGLIKKAFEEKIASIHIHNPRDHAMDNYRKVDDEPYGGGAGMVLKPEPYFSVFDQIPKLNKKRILLMTPQGRKISQPDFSRWSKEDQLILICGSYEGFDERIRSLADEEISIGDFVLTGGEIPAITLINGVVRLLPGTLGSAESLEEESHNEFLLEHPQYTRPAEFRGVKVPDVLLSGNHKLIREWRQKQREIRTKSRRPDLFELWKLDQLSFIKRSSLLKTEVNLRIGNGYDMHRLVSGRPLILGGVELNHPEGLGLDGHSDADVLTHAIMDAILGALSLGDIGKYFPPDDPKWKNADSLILLGHVMELIEKKGWQIQNIDSVIVAERPKLKPYIDLMKEKISKKIGLNIDDVGVKATTNEKLGAEGREEGICCHAVVLMKRNENS

SEQ ID NO: 54931 - protein, 165 aa, Oryza sativa Japonica Group
MSSVFSGDETAPFFGFLGAASALVFSCMGAAYGTAKSGVGVASMGVMRPELVMKSIVPVVMAGVLGIYGLIIAVIISTGINPKAKPYYLFDGYAHLSSGLACGLAGLAAGMAIGIVGDAGVRANAQQPKLFVGMILILIFAEALALYGLIVGIILSSRAGQSRAD

SEQ ID NO: 54932 - protein, 325 aa, Campylobacter lari RM2100
MRKSIAEWQKQELLLLSLPHENSDWKPYLEEILQSYEEFVKAVANFQKVLLIAPSEKDFQRFKHIKNVDFFKCDTNDTWIRDFGAIDVCEDDKLIGLDFTFNAWGDKFQSTLDNAVNSKLFSQKLSGKLEKIDFILEGGSIDFNGQGVMLTTSACLLNENRNSHLNKEQIEAKLKEIFGLKEIIWLENGFIKGDDTDSHVDTLARFINEKTIAYCVCKDENDEHYAPLKAMEEELKKTGFDLLELPLPKPLYFEGKRLGATYANFVFVNGGLIVPTYNDENDALVLENLQKACKDRKVVGVDARVFLRENGSLHCSCQNRYEGQR

SEQ ID NO: 54933 - protein, 245 aa, Pseudomonas brassicacearum
WGNKPRKLEYLIPEAIEQGCDTLVSIGGIQSNQTRQVAAVAAHLGMKCVLVQENWVNYSDAVYDRVGNIEMSRIMGADVRLDAAGFDIGIRPSWEKAMSDVVEQGGKPFPIPAGCSEHPYGGLGFVGFAEEVRQQEKELGFKFDYIVVCSVTGSTQAGMVVGFAADGRSKNVIGIDASAKPEQTKAQILRIARHTDELVELGREITEEAVVLDTRFAYPEYGLPNEGTLEAIRLCGSLEGVLTDP

SEQ ID NO: 54934 - protein, 514 aa, Solibacter usitatus Ellin6076
MLDLMPNENPFQDPLRFERQVPECVIVIFGANGDLTKRKLLPALYRLAYDRRLAAGFAVVGISRTPLSDDQFRAKMRESVEQFSEDTKLDEEVWGAFARGLYYVAGDVADAGLYQRVSEKVGQIETERHTGGNVLFYLSTQPSQYAEIAHGIGVAGMGKGNGWRRLVVEKPFGHDLASARELSNRLHEVFDESDVYRIDHYLGKETVQNILAFRFGNGIFEPLWNRRYVNHVQITGAESIGVEGRGAYYQEAGALDDMIQNHLLQVMATVAMEPSASFRANSVRDERSKLLRSIRPMTRDEVLQNAVAGQYGPARIGGEDVPGFRQEQGVDPNSQTNTYAAVTFFVDNWRWAGVPFYVRTGKRLAKRVSEIAIQFNSAPLHLFNQDSGGPSGDPGVNLLILRIQPEEGISLKFLSKRPGQGMTLRPVSMDFNYGSSFGERSPSAYETLLLDAIIGDPTLYTRQDMVEASWSVVEPIQNTWRETKFDFPNYPAGSWGPQAADVMLARRGHVWRKP

SEQ ID NO: 54935 - protein, 308 aa, Deinococcus radiodurans R1
MGTEEPARKFYTAPMTRYAEVAAFTTVPGQGNRAGVVLDAGELTGEQMQRLAAFLEAPETVFVTRLSDGLGRVRYFTPTQEVDFCGHATVALGRVLAQAGRWRGEALELETLAGRIPLRLVLDAGGGECRVWMHQPAFGTRAVGRGWHRELAEALGLSDRLLHRGLPLAAASTGLWSVFLPLLDASLLEGLEPDLPRIAELSRELGVVSVYAYAPVGVNRFAARDFAPLVGIPEDPVTGSAGGALLALLASEGRLPLRGNRASGLIYQGHALGTPGEIEVEVEVRGTRVEAVQVGGCAAVEREGVWPG

SEQ ID NO: 54936 - protein, 619 aa, Actinobacillus pleuropneumoniae serovar 1 str. 4074
MTTNSLTFADLGLPQSILDAVNDMGFVTPSPIQQETIPHLLAGRDVLGMAQTGSGKTAAFSLPLLAQIDPTKRHPQMLVMAPTRELAIQVADACEQFTKNMKGVNVVTVYGGQRYDIQLRALKQGSQVVVGTPGRILDHIRRGTLDLSALQSIVLDEADEMLRMGFIDDVETVMAELPENHQTALFSATMPEPIRRITRRFMQDPQEVKIQATQRSAPDITQSYWLVNGFRKNDALLRFLEVEEFDAAIIFTRTKTGTIDITELCERNGYRTAALNGDMTQQAREQTLDKLKSGRLDILVATDVAARGIDIERISLVVNFDIPLDAESYVHRIGRTGRAGRSGRALLFVEPRERRLLRNIEHLMKKPIDEVAIPNHEILMAKRREKFKARVSKQLEHHDLEKYRELLEDLFTADQDHEELAAAMMMMLQEKQKLILPPDPEIRAARGERGRRDRDDRRGGRDERRGGREHRENNGVAMDLYRIELGREDGVEVRHIVGAIANEGDISSRYIGHIKLHDTYSTIELPQGMPNHIVQHFAQKARVLNKQMQMSLLGPAGGVNSQPFEERRGGGRRNDRNDRNDRRSDRGGRSDRREGGFNDRKKGGFKEKRFNDKGRGRRD

SEQ ID NO: 54937 - protein, 408 aa, Mycobacterium smegmatis str. MC2 155
MSVKTLDDLLAEGVQGRGVLVRSDLNVPLDDDGNITDPGRVIASVPTLQALAEAGAKVIVTAHLGRPKGEPDPKLSLAPVAAALGEKLGRHVQLAGDVVGTDALARAEGLTDGDVLLLENIRFDARETSKDDSERLSLAKALAALVEGPDGSPGVFVSDGFGVVHRKQASVYDVATLLPHYAGTLVAAEVKVLQQLTSSTDRPYAVVLGGSKVSDKLAVIENLATKADSLIIGGGMCFTFLAAQGFSVGSSLLQEEMVDTCRRLLDEYADVIHLPVDIVVADKFAADAEAETVAADRIPDGKMGLDIGPGSVERFTALLSNAKTVFWNGPMGVFEFPAFAAGTKGVAEAIIGATGKGAFSVVGGGDSAAAVRRLGLPEDGFSHISTGGGASLEYLEGKELPGIQVLES

SEQ ID NO: 54938 - protein, 142 aa, Nocardia farcinica IFM 10152
MTEQTAPAARSGEPADHSRAELDRIELRGLRVFGRHGVFEHERRDGQEFVVDLTVWVDFTVAAASDDLAATVDYGALAERAVRIVAGPPRNLIETVVSEIADDVMADPRIQRAEVVVHKPAAPIPHTFADVRVVTTRTREPR

SEQ ID NO: 54939 - protein, 381 aa, Desulfitobacterium hafniense Y51
MGTALNALIERGAALMCWADPFFPDPVIPEHVKKATLEAIDVGMGSHYTMPIGNGELKKEIAKKLKEYNKMEVDPDRNIIITPGSDSGLLFAMMPFICPGDEVMVHEPSYPSNFLNPKLLGGVTIPVPLRAENNYQIDIEEFEKRLTPRTKMVLLTNPNNPTTTVFRRECLEKLAKFVVDNDLILVVDQAFEDSVFDDIEFVSAATLPGMWERTVSVFSISKGMSLSGYRVGYVVADDKIMDVMYGCAVNILGATNTASQMGAIAAISDRSFVKEYNKIFDKRRKVAYEVFNSIPGVSMAMPESSFLSWVNISKLGTSAEISKYIIEHANVVVNEGTPYGASGEGYLRVVHGCYKDDNVLYDALARIKKALTKLAEEKGVQ

SEQ ID NO: 54940 - protein, 395 aa, Cryptococcus neoformans var. neoformans JEC21
MVYEATASAPVNIACIKYWGKRDTRLILPTNSSLSVTLDQDHLRSTTTSRADASFEAGDKLWLNGKEEVIKEGGRLAVCIKELRGWRKEMESKDKDLPKLSEWPLRIASYNNFPTAAGLASSASGLAALVASLASLYSLPQSPSQLSLVARQGSGSACRSLFGGFVAWREGTDPAGSDSLAEEVAPREHWPEMHALICVVSDAKKGTSSTSGMQKTVETSTLLQERLRIVPKRMDAISQAIKARDFSEFAKLTMADSNSFHAVCLDTAPPIFYLNDVSRAIIAVVEELNRAAGEIIAAYTFDAGPNAVIYTLEKNMPVVLGAIKRFFPTGEEFEDPFQTGVRDLPEGFNTGVVREGGWEKGAVKGLIHTRVGDGPRVLKKEESLLGENGVPKVLA

SEQ ID NO: 54941 - protein, 556 aa, Legionella pneumophila str. Lens
MSYLALARKWRPRTFSQLVGQEHINKALINALNQQRLHHAYLFTGTRGVGKTSVARILAKALNCEKGITSEPCLHCDTCIAIEQGRYIDLIEIDGASKTRVEDTRDLLDNIQYAPTNGRFKIYLIDEVHMLSQHSFNALLKTLEEPPSHVKFILATTDPQKLPVTVLSRCLQFNLKHLPAELINQQLQLILQEERLDFEIQALDILARAARGSMRDALSLLDQAITSCETKLLANDVKMLLGHTQQDYALLLLQALAKQEAPIMLALSQQIVAEGGNFQYVLDEILNYLHQITVYQCLGDNNPLISPKTEIKELAKQFSAEDTQLFYQIGIKGREEMHLAPTLTIGFNMTMLRMYTFKPASHVTTPPLAFEQNNKTCSLIVDDNTPAQNPIGIEPIPVTKATDSTLAYHQTPSLSTDDKKSANAGESMSRDWNDIIPQLKLSGLALNAIENAEFLGKKEREITLGVQKGHQSLFTPTTINRIETALAGYYKSPVKIILNSQDAVHASPAQQKEKATQERQEQAEAALHADPVFQQLKQEFSAELVKNSIVLLKDDL

SEQ ID NO: 54942 - protein, 440 aa, Zea mays
MPKPWRPVLASATKCCAAEDAAVAPDGLARCRPQQSELSRRLASFRRLSSLANSPVSATATTVADKDGGSVKQAACGEMAGPLQLHSFGLGELRGVTHDFSSNFLLGEGGFGAVYKGFVDAGMRPGLDAQPVAVKQLNAAGFQGHREWLAEVILLGQFRHPHLVRLLGYCCEDEERLLVYEFMPRGSLENHLFRSRISTTTLPWGTRLKVAIGAAKGLAFLHAANTPVIYRDFKASNILLDSDFTAKLSDFGLAKMGPEGEDTHVTTRVMGTHGYAAPEYVQTGHLNVKSDVYSFGVVLLELLTGRRAMEHVRARSAHAEQQVKLVDWTRPYLSGGSRRLRCIVDQRLAGHYSVKGARAVAQLAVQCTAQQPRDRPRMAAVVEALEKLQGLKDMAVAVGLWPAGAATATGAGNRSAKVVRAEVKGAGAASRRRSSSSKLA

SEQ ID NO: 54943 - protein, 174 aa, marine gamma proteobacterium HTCC2080
MAYNDQKGRGGDQRTEGDLQEKLVQVNRVAKTVKGGRIMSFTALTVVGDGKGRVGYGRGKAREVPVAIQKAMEAARRNMVKVELVDGTLQYPVKANHGASKVYMQPASEGTGVIAGGAMRAVLELAGVHNVLAKCYGSTNPVNVVRATYKGLRDMQSPDAVAARRGKSVEEILS

SEQ ID NO: 54944 - protein, 327 aa, Wolbachia endosymbiont of Drosophila melanogaster
MAISILGAGAWGTAIAISLGSKKDVILWTHNETTFESINGKRESDKLPGCRISDNVSVKLAIEDIINASVTILAVPTQSLRKVCQQLHNCNLKKDVAIILACKGIEKSTLKLPSEIVNEILPNNPIAIFSGPSFAVEVARKLPYSMVLACQNNTLGSKLVSELQQENVKLEFSNDIIGVQICAALKNVFAIACGIVLGSKLGFNAHAALITKSMSEIKALYSAKIGDGSVDINTLLGPACLGDLIMTCTSLNSRNLSFGFKIGNSDNGFNVQQILSEGKSVIEGFSTAESIFNLAGKLKIKMPICEAVYRLLYESASIEDTLSVLIS

SEQ ID NO: 54945 - protein, 584 aa, Streptococcus thermophilus LMG 18311
MAFEIIMPKLGVDMQEGEIIEWKKQEGDVVNEGDILLEIMSDKTNMELEAEDSGILLKITRQAGETVPVTEVIGYIGAEGEVVADNSTSAPAAEATAQLEAAGLEVPKAPSQPSPATAEKAALADNEYDIVVVGGGPAGYYAAIRGAQLGGKVAIVEKSEFGGTCLNKGCIPTKTYLKNAEILDGLKIAAGRGINLASTNYTIDMDKTVDFKNSVVKTLTGGVQGLLKANKVTIFNGLGQVNPDKTVTIGSETIKGRNIILATGSKVSRIDIPGIDSQLVMTSDDILDLRELPKSLAVMGGGVVGIELGLVYASYGVDVTVVEMADRIIPAMDKEVSLELQKILSKKGMKIMTSVGVSEIVEGNNQLTLKLNNGEEIVAERALLSIGRVPQLNGLENLNLELDRGRIKVNEYQETSIPGIYAPGDVNGTKMLAHAAYRMGEVAAENAMHGNVRKAHLDYTPAAVYTHPEVAMCGLTEEDARAKYGDVLIGKSSFAGNGRAIASNEAHGFVKVVADAKYHEILGVHIIGPAAAELINEAATIMENELTVDELLQSIHGHPTFSENMYEAFADVLGEAVHNPPKRK

SEQ ID NO: 54946 - protein, 190 aa, Picea abies
MARECKVSLKSSDDELFDVNEAVAFESQTIKNMIEDTGTASAIPLPNVSSKILSKVIEYCKYHVEAQKPADEKSAISEDEIKTWDQEFVKVDQATLFDLILAANYLNIKNLLDLTCQTVADMIKGKTPEEIRKTFNIKNDFTPEKGGGRSGVKISGRLNDTRGSVVQKQYIYFCAIVFCFVLVAQNLFRN

SEQ ID NO: 54947 - protein, 462 aa, Streptococcus thermophilus LMG 18311
MAFEIIMPKLGVDMQEGEIIEWKKQEGDVVNEGDILLEIMSDKTNMELEAEDSGVLLKITRQAGEIVPVTEVIGYIGAEGEVVADNAAIAPAAEAAPQVEKVADVETPAAKPQPQVAIVHEGGKIRATPKARKVAREMGIDLAQVLGTGAKGRIHADDVENFKGAQPKATPLARKIAADLGIDLATVSGTGFGGKITKEDILAISAPAQVKVAAAAPAVEAKPEKVLPEGVEVIPMSAMRKAISKGMTHSYLTAPTFTLNYDVDMTNLIALRKQVLDPIMNKTGMKVTFTDLIGLAVVRTLMKEEHRYLNASLINDAQNIELHKFVNLGIAVGLDDGLVVPVIHGADKMSLSDFVVASKDVIKKAQAGKLKAAEMSGSTFSITNLGMFGTKSFNPIINQPNSAILGVSATIQTPVVVDGEVVVRPIMGLCLTIDHRIVDGMNGAKFMVDLKHLLENPMELLI

SEQ ID NO: 54948 - protein, 309 aa, Leptospira interrogans serovar Copenhageni str. Fiocruz L1-130
MKAKNILETIGNTPHVKINRLFNTKSEVYAKLERSNPGGSIKDRIALSMIEDAEKTGKLTKDSIIVEPTSGNTGIGLALVAAVKGYKLLLVMPESMSIERRRIMAAYGAEFELTPREKGMPGAIEKAKQIVAENPKAWMPQQFENEANIKIHVETTAQEIAKDFPDGLDYVITGVGTGGHITGVAQVLKQKFPKLKVFAVEPEASPVISGGKPGPHPIQGIGAGFIPKNLHTNLLDGTIQISKDEAFEYAQRAAKEEGLFIGVSSGAALAAVAKKLPEIPEGSRILTFSYDTGERYLSIEGLFPVPSNA

SEQ ID NO: 54949 - protein, 732 aa, Acinetobacter sp. ADP1
MNGYFMTIFQVRNKFHIKDALSGLVVFLVALPLCLGIALASGAPILSGIIAGIVGGIVVGILSGSHISVAGPAAGLTAVILVQLEQLGGNYAAFLLCIILAGFLQILFGLFKLGFFANFIPNNVILGLLAAIGVILMMTQIPYLMGLSDFSWSQLWSGQLDQVMSQIDLGAMLIGFLSLLLILAWDSSPLKKWVLPSALIAVVAAALLNYLLVYFQSPWAIQPNNLIQLPKILDAPESVMIYPDFSALSNPLIYTGAITLAVVASLETLLNLEAADKLDPQKRSSPPNRELWAQGTGNIVSGFIGGMPITSVIVRSSVNANTGARSKCSTIIHGVLLLLAVLFFVPLMNMIPLSALAAILILTGFKLTHPKMFKKLYQQGWKQFIPFIITLVAILLTDLLIGILIGLATSIAFILYGNLHKGVRVYKEKHLHGVITRIELPSQVTFLNRAALISALDRVHRNEKLVIDATQSDSIDSDIYQVIQDYQTETAIKRGIDVKLIGFKQHYAELDDAILDIDISTRDLQCQLSPADVLRLLKEGNERFVKNERLQRDIYRQIRVTADEGQHPIAAVLGCMDSRAPTEMLFDVGIGDLFSLRIAGNIAGQKVLGSLEFACQAKGSKVILVLGHTDCGAVTSACQLRLQHKQISDIQEMPHIQYVLGPLMHSVGSVFDIMQPRELSKAFIDQVTAMNVHYNIQYIIQHSSVLKDMLDRKEIDIVGAIYDVKTGKVNFL

SEQ ID NO: 54950 - protein, 251 aa, Xanthomonas campestris pv. campestris str. ATCC 33913
MRRKIVAGNWKLHGTRAFATELVAQVAAHMPLAGVDVVILPPLPYLGDLIEDFEAHHLAFGAQDVSSNEKGAYTGEVSASMLVDVGAEYGLVGHSERRQYHQESSELVARKFAAAMHAGLIPVLCVGESLEQREAGQTEAILRAQLEPVLSLVGSAGFARAVVAYEPIWAIGTGRTATPDQAQAVHAFIRGEVAKADARIADSLPILYGGSVKPDNASELFSQPDVDGGLVGGASLVAEDFLAIARAAAAC

SEQ ID NO: 54951 - protein, 504 aa, Arabidopsis thaliana
MVSLLSFFLLLLVPIFFLLIFTKKIKESKQNLPPGPAKLPIIGNLHQLQGLLHKCLHDLSKKHGPVMHLRLGFAPMVVISSSEAAEEALKTHDLECCSRPITMASRVFSRNGKDIGFGVYGDEWRELRKLSVREFFSVKKVQSFKYIREEENDLMIKKLKELASKQSPVDLSKILFGLTASIIFRTAFGQSFFDNKHVDQESIKELMFESLSNMTFRFSDFFPTAGLKWFIGFVSGQHKRLYNVFNRVDTFFNHIVDDHHSKKATQDRPDMVDAILDMIDNEQQYASFKLTVDHLKGVLSNIYHAGIDTSAITLIWAMAELVRNPRVMKKAQDEIRTCIGIKQEGRIMEEDLDKLQYLKLVVKETLRLHPAAPLLLPRETMADIKIQGYDIPQKRALLVNAWSIGRDPESWKNPEEFNPERFIDCPVDYKGHSFELLPFGSGRRICPGIAMAIATIELGLLNLLYFFDWNMPEKKKDMDMEEAGDLTVDKKVPLELLPVIRISL

SEQ ID NO: 54952 - protein, 243 aa, Acinetobacter sp. ADP1
MKDLFSTDSQRYQQARPTYPPSLLQSLLQYIPERELAWDCGAGSGQLTHMLASYFDQVVGTDISQTQLSHAEYYDNISYQLQPAENTTFPDHCFDLITVAQAIHWFDFEAFYAEVRRTIKPSGILAVVGYGLIHVDDLEINAKVQHLYHQTLNGFWDAERHYVDELYQTIPFPFDEIEMPAFQIEAQWTLQQLLQYLNTWSAVQHYILEKNLDPVQQLLSKGRDLQDQVSIQFPVLLRVGRCS

SEQ ID NO: 54953 - protein, 396 aa, Leptospira interrogans serovar Copenhageni str. Fiocruz L1-130
MELPRLENVDLSGKRVFLRVDFNVPVENGKVTDKTRIEKTLPTIELLIKKGARIIIASHLGRPKGQVNPEFSLAPVVETFQSLVKSKVYFSKTVIGEDAIKLSKELKNGEILVIENVRFHKEEEENDPGFSKKLAALADIYVNDAFGAAHRAHSSTEGIARLLPAYAGLLMHKEILELSALLHKPARPFVAIIGGSKVSTKIKVLTNLFDKVNHLLIGGGMAYTFLKSRAIPIGNSLVEKEFEVQAFQLIEKAGVAGIDLQLPVDHIIGDQFNEKAKTKSVDKMGILDGWMGMDIGSKTVSNYEKIIKNAGTIFWNGPMGVFEMDKFASGTMAIAKAVAKSKAKTVVGGGDSIAAINKARVADKITHISTGGGASLEFMEGRKLPGVEALKKKTSE

SEQ ID NO: 54954 - protein, 453 aa, Oryza sativa Japonica Group
MSVSTAAVPTANTNGNHALSMDSHSSQDVRRRTVVVARKKASPELLADGGFNGTSSVDKITDKKDLSHTIRGESVLGKSKYPLEARKDAIASAAAADRQKKSGAKQEKAKWEIALSVLMKLCLLISAVAWMGQLFWRWQNGDLSFTTLDMESRLSKVEGFKKTTKMLQVQLDILDKKLGNEIDKTRRDITKQFEDKGNKLEIKMKALEGKTDKLDKSLAELRDMGFVSKKEFDEIVEQLKKKKGLDGTVGDISLDDIRLFAKEIVEMEIERHAADGLGMVDYALASGGGKVVKHSEAFRKAKSFMPSRNSLLEQAKKMLEPSFGQPGECFALQGSSGYVEIKLRTGIIPEAVSLEHVDKSVAYDRSSAPKDFQVSGWYEGPEDDSDKESRVVTNLGEFSYDLEKNNAQTFQLERTADSRVINMVRLDFCSNHGNSELTCIYRFRVHGREPGSP

SEQ ID NO: 54955 - protein, 369 aa, Oryza sativa
MDHAAEAQRTDLMTITRHVLNEQGRHPESRGDFTILLSHIVLGCKFVASAVNKAGLAKLIGLAGDTNVQASNPISDPLYSTLLFLHTNPCDGGWPPRGEEQKKLDVLSNEVFVKALVSSGRTCVLVSEENEEAIIVDAPLRGKYCVCFDPLDGSSNIDCGVSIGTIFGIYMIKDKDNVTLDDVLQPGTDMLAAGYCMYGSSCTLVLSTGNGVNGFTLDPSLGEFILTHPNIKIPNRGKIYSVNEGNAKNWDAPTAKFVEKCKFPQDGSPSKSLRYIGSMVADVHRTLLYGGIFLYPADQKSPNGKLRVLYEVFPMSFLMEQAGGQAFTGKQRALELVPRKIHDRSPIFLGSYDDVEDIKALYASESIIG

SEQ ID NO: 54956 - protein, 171 aa, Bradyrhizobium japonicum USDA 110
MTDLTKLPSWADDDNIFAVVETPRGSSCKLDFDPKLGVFALAKPLMAGLTYPYDWGFIPSTKAEDGDPLDVLILHDAQTYPGVVLRCRPVGILEVEQKSKGKKERNDRVFAVPDRSPLETDIKDVRKLPSRARDDLEQFFRATNALENKELEFLGWHGPRRAAKAIRRLAR

SEQ ID NO: 54957 - protein, 244 aa, Deinococcus radiodurans R1
MQTLLALNWKMNKTPTEARSWAEELTTKYAPAEGVDLAVLAPALDLSALAANLPAGIAFGGQDVSAHESGAYTGEISAAMLKDAGASCVVVGHSERREYHDESDABVAAKARQAQANGLLPIVCVGENLDVRERGEHVPQTLAQLRGSLEGVGADVVVAYEPVWAIGTGKTATADDAEELAAAIRGALREQYGARAEGIRVLYGGSVKPENIAEICGKPNVNGALVGGASLKVPDVLGMLDALR

SEQ ID NO: 54958 - protein, 119 aa, Zea mays
  misc_feature (25)..(25): Xaa can be any naturally occurring amino acid
  misc_feature (61)..(61): Xaa can be any naturally occurring amino acid
SWTAALDLRQHALGPVLTYQRADFXSIFHTLYALPDTMRLLDPTLHQFLPQGNIDYIVTEXSAETVANHEDTLARIDKLSKVNPTLGIRDCRLGISCPASTKTQTPSIFEAAIAMTNQS

SEQ ID NO: 54959 - protein, 404 aa, Shewanella sp. MR-7
MRPIIKSNKLDTVCYDIRGPVHKEARRLEDEGHRILKLNIGNPAPFGFEAPEEIVRDVILNLPSAQGYCESKGLFSARKAIVQHYQAQGIFGVDIEDIYIGNGVSELIMMAMQGLLNTDDEILIPSPDYPLWTAAANLAGGKAVHYRCDEDADWFPDLDDIKSKISSRTRGIVLINPNNPTGAVYSKELLLQVVELCREHNLILFADEIYDKILYDEAKHIPAASLSDDILTVTFNGLSKAYRAAGFRVGWMMLSGNLKAAKSYIEGLEMLSSMRLCANVPNQHAIQTALGGYQSINELILPSGRLTVQRDTCYELLNQIPGVSVKKPKGALYAFPKLDMKKFNLRDDERLVLDLLREKKILLVHGSAFNWPEPDHLRVVFLPYKEDLTKALTEFGHFLETYKQ

SEQ ID NO: 54960 - protein, 333 aa, Schizosaccharomyces pombe
MDVQETQKGALKEIQAFIRSRTSYDVLPTSFRLIVFDVTLFVKTSLSLLTLNNIVSAPLWDSEANKFAGLLTMADFVNVIKYYYQSSSFPEAIAEIDKFRLLGLREVERKIGAIPPETIYVHPMHSLMDACLAMSKSRARRIPLIDVDGETGSEMIVSVLTQYRILKFISMNCKETAMLRVPLNQMTIGTWSNLATASMETKVYDVIKMLAEKNISAVPIVNSEGTLLNVYESVDVMHLIQDGDYSNLDLSVGEALLKRPANFDGVHTCRATDRLDGIFDAIKHSRVHRLFVVDENLKLEGILSLADILNYIIYDKTTTPGVPEQTDNFESAV

SEQ ID NO: 54961 - protein, 411 aa, Deinococcus radiodurans R1
MTGLCPLHQPSPLDHPHSGGTPMQNLSQLDVKGKRVLVRVDYNVPVGDGVVQDDTRITASVPTIKKLLDGGASVVLMSHFGRPKNGPEDKYSLKPVAEAVSRALGQDVKFIPSLPGSDETLQAVQALRPGEVALLENVRFEAGEEKNDAALNDKLAKLGDAFVLDAFGSAHRAHSSVSGVAGKLPHAAGGLLQSEVDALGKLLHAPEHPYVVIIGGAKVSDKIKVIENLLPKVDRMLIGGGMMFTFIKARGGQIGNSLVEDDQLDLAKGLLEKYGDKLLLPTDAVAADKFAADAQSKVVPADQIPDGWMGLDIGPDTQRAYADALQGAKTVFWNGPMGVFEFDQFAAGTNAVAAAVGSLKDQAYTVVGGGDSVSAINKSGKADQIDHISTGGGASLELLEGKELPGVVAMA

SEQ ID NO: 54962 - protein, 249 aa, Glycine max
FTLFSFYLQLAPSPSQSCNSISSTIMLRKLVSGPRKNKPGTVPVHLNVYDLTPINGYAYWLGLGVYHSGVQVHGLEYGFGAHEHDTTGIFEVQPKHCPGFTFRKSIFIGTTDLGPKDVRAFMEKLAQDYSGNTYHLISKNCNHFCNDVCLKLTGKSIPRWVNRLARLGLLCNCVLPPGLNDTKVSQAASDRVQEGEKRKIRSQSCRYEGSSNPSSSQRSAIKSSSSQRHCHPPSSSLINAASASTLTVK

SEQ ID NO: 54963 - protein, 423 aa, Wolbachia endosymbiont of Drosophila melanogaster
MNIPRVTKLDNGLRIITEQVRDIDSVALSIRVGVGSRAESAKQNGISHFLEHMAFKGTKTRTAFEIAKAFDDIGGVFNASTGRESTTYYAKVLKKDIKTGIDILIDILMNSTFPEDELEREKGVVIQEIFQTNDSPSDIIFDKYFEAAYKDQPFGRSILGTQNTVKSFTRGDLDNYINEHYFGENMLFAVAGNVEHEEVVALTKDFLSKIHSKKLKKSQNASCTGGEYLEHRKLDQVHLLIGLPSVSRHDDKYHTFQVLDSILGSGMSSRLFQEVREKQGLAYSVYSFNSSYTNTGMFSIFAGTDSSNLDKLLKSITTELKKLSTDDLKEEEVNRVKERVKSQILMSRESVSSRAETLGHYYGNYNRYISKNELIEKISAVTTANVKKAAEELLSQHEKTTLAAIGEIESLPSYDKVVSMLKA

SEQ ID NO: 54964 - protein, 178 aa, Legionella pneumophila str. Lens
MSLMEIPSGRDVPNEVNVIIEIPMHGEPVKYEVDKRTGALFVDRFMTTAMFYPTNYGYIPNTLSEDGDPVDVLVITPVPLISGAVISCRAVGMLKMTDESGVDAKILAVPTTKLSKMYQSMQTYQDIPQHLLLSIEHFFKHYKDLEEGKWVKVEGWVGPDAAREEITSSINRYNHIKK

SEQ ID NO: 54965 - protein, 662 aa, Bacillus cereus ATCC 10987
MIEKYKHGKVKKLFEVKTLILLQVNALSKLYGAETILANIKLEVQTKDRIALVGRNGAGKSTLLKIIAGELSHDDGEIIKPKDVSIGYLAQNTGLETSLTIWDEMLTVFTHLQQMETKLRRLEQEMGKEENFSNEATYERLLADYDQLQLDYKDQGGYQYEADIRSILSGLGFPVETHQTTISTLSGGQKTRLALGKLLLTKPDLLILDEPTNHLDIETLTWLEQYLQGYPGAILIVSHDRYFLDKLVTQVYEISNKESRRFVGNYSKYLDLKSALYEQEMKRYEKQQDEIAKLEDFVQKNIARASTTKRAQSRRKQLDRMELLTRPLGDSKSASFHFDIEKQSGNDVLQVKDATIGYDKDPIIEHVTMRLTRGDSVALVGPNGIGKSTLLKSIVNKLPLLHGDVSFGSNVSVGYYDQEQANLTSSKRVLNELWDEYPLQPEKEIRTILGNFLFTGDDVLKPVSSLSGGQKARLALAKLMMQKSNLLILDEPTNHLDLNSKEILENALIDYPGTLLFVSHDRYFINRVTTTVVELSTEGAQEYLGDYDYYVEKKNEMIERAEFEQQEQQENQTPVQKTVAPEKLNYLEEKERKKLERQRTRKIEELEQNIVQFEEEIATLEDQLCLPEIYADYEKASEITTKKQTLQEQLDACMAEWEELHL

SEQ ID NO: 54966 - protein, 433 aa, Cucumis melo
LEEGKKEPFHYDEEINLLLSDWWHESVLKQEVGLSSSPMRWIGEPQSILINGRGQSNCSIGAKYMKNMEQCKLSGSEECAPFILFVKPNKTYRIRIISTTSLSALNFAIGNHKLLVVEADGNYVQPFLTSDIDIYSGESYSVLINTDQNPSQNYWVSLGVRGREPKTPPGLTLLNYLPNSFSKLPISPPPETPKWNDYDRSKNFTYRILAAMGSPKPPVKSTRRIFLLNTQNKMNGGYTKWAINNVSLTLPSTPYLGAIKIGINDTFDQNPPPETYPENYDIHKPPPNGNTITGNGVYRFQLGEIVDVVLQNANTLNDKHSEIHPWHLHGHDFWVLGYGEGKFSAAVDETKLNLKDPPLRNTVVIFPFGWTVLRFVADNPGVWAFHCHIEPHLHMGMGVVFAEGVDKVGRIPTHAMACGGTAKALIQNPTQKP

SEQ ID NO: 54967 - protein, 219 aa, Bifidobacterium longum NCC2705
MNTMDENTMDKQSSPKSSLFDGWNAPPNLVTYSRIVLVVFFLTLDILAGAWGENNLTMRWVAAVLFIIAASTDKIDGWMARKYNQVTEMGKLMDPIADKLLTCGAMIVCSAFGELGWWVTILFLIREIGITVMRFFVMERPGGKVIAAAWPGKLKTVFQCVGLSMLLLPFWSLGNGQATPFWMTAYYFLTYAIIYVALVLCLYSGAVYLYNTFVAPKRK

SEQ ID NO: 54968 - protein, 377 aa, Clostridium acetobutylicum ATCC 824
MKAITFEGMNNVKVKNVNDPNIIKNDDAIIKITSTTICGSDLHLLRGTMPKVPHGFIIGHEAMGIVEETGKEVTNLKKGDRVIVPFPVSCGHCWYCTHGLSSQCDNSNEHGEVGAIYGYGDLMGGYDGGQAEYLRVPYANFGPKLVPENLTDEQVLFLTDILPTSYWGTIVNGGVKQGDTVVVLGCGPVGLLAQKWAAYAGASRIIAVDNIDYRLEHAKKYNSAEILNFNDYDNTGEYIKEITHGGADVVIDCVGMDGERSPIENVETLLKIQGGSKSAIEISTQAVRRGGTVSVVGVYGARYNNFPFGDFFSRNITIKTGQCPAHSYVDVILDLIKQNKFDATDIITHTMSLSDGEKAYNLFNNKLDNCIKVILKP

SEQ ID NO: 54969 - protein, 416 aa, Thiobacillus denitrificans ATCC 25259
MQLLTLGVNHHTAPLAIREQVAFGPDKLVQALHELTLSKRASEAAILSTCNRTELYVNTVSPDALSQWFADFHHLDVRELAPYLYTLPREKAAQHAFRVAAGLDSMVLGETQILGQMKQAVAAAEEAGTLGLLLHKLFQRTFSVAKEVRSSTEIGANSVSMAAAAVRLAERIFPSVKEQACLFIGAGEMIELCMTHFAAQHPRRMTVANRTTERARPLAERFNAGVIPLTALPDEVAAYDIIITSTASPLPILGKGMLERAIRQRRHRPIFIVDLAVPRDVEAEVADMNDVFLYSVDDLGQVVREGMDNRVAQVAQAEAIIETSVASFIHWMEGRELVPVIRGLRDAAERHRRHELDKAHKALARGDDPHAVLDAMSHGLANKFLHAPTHGLSHATPEERAELVRLISQLYGLHPE

SEQ ID NO: 54970 - protein, 538 aa, Saccharomyces cerevisiae YJM789
MSMPIASTTLAVNNLTNINGNANFNVQANKQLHHQAVDSPARSSMTATTAANSNSNSSRDDSTIVGLHYKIGKKIGEGSFGVLFEGTNMINGVPVAIKFEPRKTEAPQLRDEYKTYKILNGTPNIPYAYYFGQEGLHNILVIDLLGPSLEDLFDWCGRKFSVKTVVQVAVQMITLIEDLHAHDLIYRDIKPDNFLIGRPGQPDANNIHLIDFGMAKQYRDPKTKQHIPYREKKSLSGTARYMSINTHLGREQSRRDDMEALGHVFFYFLRGHLPWQGLKAPNNKQKYEKIGEKKRSTNVYDLAQGLPVQFGRYLEIVRSLSFEECPDYEGYRKLLLSVLDDLGETADGQYDWMKLNDGRGWDLNINKKPNLHGYGHPNPPNEKSRKHRNKQLQMQQLQQQQLQQQQQQQQYAQKTEADMRNSQYKPKLDPTSYEAYQHQTQQKYLQEQQKRQQQQKLQEQQLQEQQLQQQQQQQQQLRATGQPPSQPQAQTQSQQFGARYQPQQQPSAALRTPEQHPNDDNSSLAASHKGFFQKLGCC

SEQ ID NO: 54971 - protein, 558 aa, Nostoc punctiforme PCC 73102
MATFTVGDYLLLRLEQIGIKHIFGVAGDYNMEFLDYIVNHNGIELIPTCNELNASYAADGYGRLNGIAALITTFGVGELSAINGVAGAYAEHVPVVAITGAPATKIQALGSLVHHTLGTGDFSMFARMYEQVTVAQAYLTNENATTEIDGVLGICLLKKLPVYISIPMDVALTEVSAPSDSFIPPVFQSDGATLAEIVDVCVNILEKASQPVILADIGVARYHLHEQLRKLLTATGYPYATMNMGKGLLEETHPQFIGIYNGAASEESVRKRIEQADCVLTIGALMTDFNTGKFSAKLDPSQTIEVHGQYVKVKHALYNNVAMADVLSALSQRLQRRDPQTLNFKSATENLDAGFITPIEGGSSAPITQQYFWHRFAHFLQEDDIIVAETGTCLFGASIVPLPKGATFVGQVLWGAIGYSVASLLGCALAKPTAGIAASQRRSILLVGDGSFQMTAQELSTILRYNLKPIIFLINNDGYTIERDIHGERMPYNDIQPWNYHQLPKVFGGNGWGIKVSTESQLDKALQTAQQNHDQLAFIEVVMDKMDSPEVLLKMLQQ

SEQ ID NO: 54972 - protein, 112 aa, Zea mays
MATAPRRLLPALLKALAPAGARGLSTEKAVGAAAVAVVGSHTAKWMQDTSKKSPMELINEVPPIKVDGRIAVCEGAAEGVGLGHPIEYICLDLEAPNVCKYCGLRYVQIHHH

SEQ ID NO: 54973 - protein, 326 aa, Escherichia coli
MSSDADAHKVGLIPVTLMVSGNIMGSGVFLLPANLASTGGIAIYGWLVTIIGALGLSMVYAKMSFLDPSPGGSYAYARRCFGPFLGYQTNVLYWLACWIGNIAMVVIGVGYLSYFFPILKDPLVLTITCVVVLWIFVLLNIVGPKMITRVQAVATVLALIPIVGIAVFGWFWFRGETYMAAWNVSGLGTFGAIQSTLNVTLWSFIGVESASVAAGVVKNPKRNVPIATIGGVLIAAVCYVLSTTAIMGMIPNAALRVSASPFGDAARMALGDTAGAIVSFCAAAGCLGSLGGWTLLAGQTAKAAADDGLFPPIFARVNKAGSQWRG

SEQ ID NO: 54974 - protein, 250 aa, Leptospira interrogans serovar Copenhageni str. Fiocruz L1-130
MRKTIIAGNWKMNLSLKEAVFLAHSIREKIPSISKDKVSMVFPSTLHLENVSKILEGSSVIVGAQNCYHSGLAAFTGETSPDQLKEIGVKVVMVGHSERRQFLGESNFFCNDKIRFLLKNEFTVLYCVGETLSERESGKTLEVLSSQIREGLKGIDSVFFSNLILAYEPVWAIGTGKVATPSQAQEVHSFIRKEISGLFVGASSISESISILYGGSVKPDNIQDLLKEKDIDGGLVGGASQKISSFAGLF

SEQ ID NO: 54975 - protein, 540 aa, Prochlorococcus marinus str. MIT 9313
MPSSSSGNSRHFSRVAPVVLAILDGWGHREEVEHNSIRSAETPIMDALWHAYPHTLIEASGAAVGLPDNQMGNSEVGHLTIGAGRVIRQELVRISETVQAGRLGQTPALIALAERLRKSDGTLHLLGLCSDGGVHSHINHLCGLLHWAAAAGLNKVAVHLITDGRDTPIQSASKYLHQIEDAINASGVGELASLCGRYWAMDRDHRWERTIRAYEVLTDPNQSISRVTAEDVLSASYANGTTDEFLEPTRLSNNYFKDGDGLVMFNFRPDRARQLVQALTLPDFDGFPRANQPSLDVVTFTQYEHDLPVGVAFPAESLDDLLGQVVSEHGLRQYRTAETEKYPHVTYFMNGGIEQPLAGEERHLVPSPRVATYDLAPAMAADTLTESCVNAIESGVYSLVVINYANPDMVGHTGVMGAAQEAISTVDRCIGRLLDSTGRMGGTLLITADHGNAELMQGSDGQAWTAHTTNPVPVILVEGEKRKLAGYGNDIQLREGGGLADIAPTLLQLLDLPKPDAMSGLSLIQAIDSPTPSARLPQPV

SEQ ID NO: 54976 - protein, 289 aa, Zea mays
  misc_feature (166)..(166): Xaa can be any naturally occurring amino acid
MEGKEEDVRLGANKFSERQPIGTAAQGTDDKDYKEPPPAPLFEPGELKSWSFYRAGIAEFVATFLFLYISILTVMGVSKSTSKCATVGIQGIAWSFGGMIFALVYCTAGISGGHINPAVTFGLFLARKLSLTRAVFYIIMQCLGAICGAGVVKGFQQGLYMGNGGXAPNVVAPGYTKGDGLGAEIVGTFILVYTVFSATDAKRNARDSHVPILAPLPIGFAVFLVHLATIPITGTGINPARSLGAAVIYNQHHAWADHWIFWVGPFIGAALAAIYHQVIIRAIPFKSRS

SEQ ID NO: 54977 - protein, 433 aa, Bacillus cereus G9241
MQPSAPPHLESTETIFSSSITKLVVFICWLAILADGYDLGIYGAVLPKLLEDKSWALSPAHAGTIASYALFGMFIGAILVGTITDLIGRKWTLICCLALFSITMGLAAIAPSPELFGIWRFIGGIGLGGVIPTASALTVEYSPKKRQSFIYALMFTGYPLGIVLGAILSMFMLEGFGWRTMFGIGMIPLLLIPFIIRYLPESIQFLLSRNRQEEVDQILNRFQIEFYAKNETHQTPSNIRKKNGFLSLFSKEYIKATLLFWITYIMGMFLIYGLNTWLPQMMRQAGYPLGSSLSFLLMLNITAAIGALFAGAIADRIGAKIVISISYLMAAICIGLLTIKPSVTIIYLLIGLAGIGSVGITQILNAYVTQYFPSHIRATSLGWGLGLGRVGAIAGPILVGIIMTMQYDLVWNFYLFSFAGLLAAISVFFIPTK

SEQ ID NO: 54978 - protein, 480 aa, Prochlorococcus marinus str. NATL1A
MSEISFDFDLIVVGAGYGGFDAAKHAAEAGLKVAIVESRDMGGTCVNRGCVPSKALLAASGKVRELADVPHLAEFGIHSAPVRFERKKIAEHAKNLVETIRKNLTKTLERSGVEILRGEGRLEGNQKVGLRETNGVDRIFSARDIILATGSDPFVPPGIEIDGRTVFTSDEAINLEWLPRWIAIIGSGYIGLEFADIYTALGCEVTMIEALDKVMPTFDPDITKIASRNLIDKRDIETRAGVFATKVKPGCPVEVELTDAKSREVIEELQVDAVLVATGRVPSTENLNLQSVGVETTRGFIPIDDQMRVLVNEKPVSNLWAVGDVTGKLMLAHTAAAQGSIAVENILGKAIEIDYRSIPAATFTHPEISSVGLSEEEAKDLAKNEGFELGIVRSYFKANSKALAELESDGIMKLIFNKETGEVLGAHIYGLHAADLIQEVSNAISRRQRVIDLAKEVHTHPTLSEVVEVAYKQASLQIKK

SEQ ID NO: 54979 - protein, 712 aa, Haemophilus ducreyi 35000HP
MSRTIILIPITTDVGLTSVSLGLVHALEQKGIKVGFLKPIAQPISGEDKLDRSTSIIQAAQTTEVGEPLLLSEAELLIGQNQADVLLEKIVERYQQLSKNNEVIIIEGLIPTRKNSYANSINYDVAQALDAEIILVAAPGSDKPVQLKERIEAVASEFGGRDNPNLLGVIINKFNAPVDESGRTRPDLTEIFDSFQHSAQNIAEVEALFAKSPINLLACIKWKSDLIATRAIDVAKHLHAAIINEGDLHTRRIRGVSFCACSIPHMVDYFKAGNLLVTSADRPEVLVAASLAVMNGIEIGAILLTGGYKIDHNVAKLCQQAFETGLPVFRVEGNTWQTALNLQSVSLEVPVDDKGRIDAIKEYVASQFDAHFVDEVSKVATRVRRLSPAAFRYQLTEYAREAKKRIVLPEGDEPRTIKAAALCAKRGIAECVLLANPVDVQRIAEAQGVVLGKGITIINPEDVSENYVSRLVELRKNKGMTEVVAREQLTDTVVLGTMMLEAGEVDGLVSGAVHTTANTIRPPMQIIKTAPGSSIVSSIFFMLLPDQVLVYGDCAVNPDPTAEQLAEIAIQSAESAKAFGIDPRVAMISYSTGSSGSGADVEKVKEATRIAQEKRPDLIIDGPLQYDAAVMEDVARSKAPNSPVAGKATVFVFPDLNTGNTTYKAVQRSADLVSIGPMLQGMRKPVNDLSRGALVDDIVYTIALTAIQATQS

SEQ ID NO: 54980 - protein, 330 aa, Deinococcus radiodurans R1
MKVGINGFGRIGRLVFRILEARGVEVVAINDLTDNHTLAHLLKYDSTAGRFDGTVEYDESSLTVNGKKIQAIAERDPANIKWGEYGADIVIESTGIFTSREGASKHMQGGAKKVIITAPAKGEDFSIVLGVNDEQYDPANHHIISNASCTTNSLGVPMKVIDEAFGIEKAIMTTVHSYTNDQRVLDLPHSDLRRARAAAINIIPTSTGAAKAVSQVYPALKGKFDGTSLRVPTPTGSISDVSVILGRDVTVEEVNNVFREAANGKYKGIMAYTEDPIVLTDIQGDPHSAIIDGGLTMAMGNLVKFFSWYDNEWGYSNRIADLVQLVQNKG

SEQ ID NO: 54981 - protein, 587 aa, Glycine max
  misc_feature (242)..(242): Xaa can be any naturally occurring amino acid
  misc_feature (261)..(261): Xaa can be any naturally occurring amino acid
MAAAAAAKRCHYEVLGLPRDCAPDEIRSAYRRLALQRHPDKLVKSGISQEEATAQFQELQHAYEVLSDPKERAWYDSHRSQILFSDPNTVSNSFVPDLFSFFSNTVYSGYSDTAKGFYKVYSDVFDKIHANEINFARKLGLDSDAVRQAPVMGNLDSPYAQVTAFYSYWLGFCTVMDFCWVDEYDVMAGPNRKSRRLMEEENNKVKEKATREYNYTVRRLGDFVKKRDKRVIDIKVKRSVQXERNKEDERERVEEREHKLXFYCVLCKKKFKSEKQWKNHEQSKKHKERVAEFRDSIGDEEDLEEEEEEEGKEGLESEEDQVGVNDEIDNGIGDLEARIRDGVNVEEGETRNGIELNDGDEFFDASRVKEGEEANVKVNFRYDGNDEDDENGVLEAMVAGHKNRKPRASAHKPKASVAPSPIENENDELGSKEYNNRKGARKKRGAKKEKGRKNWEESQGAASSGDYENINSNGNDNSHAEESCSQHFVENEDNGIENEQVGRDDKISNQPADKKGRDKNISHQPADTKGAGKDTKTKAKVSSKGRKGKVTSKNVGNICEACGEEFDSRNKLHKHLGDSGHATIKGR

SEQ ID NO: 54982 - protein, 420 aa, Prochlorococcus marinus str. NATL1A
MELVDAPHSKCGTFGFVGSSPTAPTSLMKTYNRFPLDLIRGKGSWVWDKKGRKYLDAVAGIATCSLGHSDKALIKSLSKQLKRLQHVSNLYGIPEQEELAQWLTSKSFAKSVFFCNSGAEANEAAIKLARKYGHIERNIDNPVILCSKESFHGRTLAAVSATGQTKYHKGFEPMVQGFQFFSYNDSESFENLFDTLEKTGPQIAAVFIEPIQGEGGINIGKKSFFELLRKKCTHSNVLLIFDEVQTGMGRTGTLWGYEQLGIEPDVFTLAKGLGGGHAIGALLVNQLADVFQPGDHASTFGGNPFACRAALTVGQEIQKRDLLNKVTERGAQLKEGLIKLSNKYSDIFISTRGVGLIQGLVLKDNIKTTSLDIVKFALEEKLLLVSAGVKVLRIVPPLTITKKEINELLSRLDKCLMKLS

SEQ ID NO: 54983 - protein, 502 aa, Zea mays
MSTHAASRRSSSSSAVAKRPAIAEGATKAAGPGPTAAQAKKRTALVNITNVAAPGARVAAVGKVAPPVTGAKLNPATSGAPLKKPSLANARTIRGSAAKSASIKPAPPVSRHDSSSEQKHNVLVPTTVHVPSRAPALVPYSSFVSPGRSRDSVSTDETMSTCDSMKSPDFEYIDNGGCSMLASLQRRADEHLRTSEDRDVEENKWKKNGPAPMEIDSICEVDSNLEDPQLCAALASDIYMHLREAEMKKRPSTDFMKTIQKDVNPSMRAILIDWLVEVAEEYRLAPDTLYLTVNYIDRYLSGNEINRQRLQLLGVACMLIAAKYEEICAPQVEEFCYITDNTYFRDEVLEMEASVLNYLKFEMTAPTAKCFLRRFARSAQACDEDPALHLEFLANYIAELSLLEYSLLSYPPSLIAASAIFLARFVLQPTKYPWNSTLAHYTQYKPSELSECVKTLHRLSSVGPGSNLPAIREKYSQHKYKFVAKKQCPPQIPAEFFRDAAC

SEQ ID NO: 54984 - protein, 150 aa, Zea mays
  misc_feature (111)..(111): Xaa can be any naturally occurring amino acid
LPHTHNLEQNAYSKGQPAWGAQLADELERIVALHDASTIAAVIVEPMAGSTGVLIPPKGYLEKLREITSKHGILLIFDEVITAYGRLGAATASEFFGVTPDLIAMAKGVSXNAAVPAGAVAVRREVHDAIVNGPAGGIEFFHGYTYSAHP

SEQ ID NO: 54985 - protein, 248 aa, Glycine max
  misc_feature (99)..(99): Xaa can be any naturally occurring amino acid
  misc_feature (194)..(194): Xaa can be any naturally occurring amino acid
QWSQPQPPQLSLSSSSSATSASPSRVQLSSSLRSRPLARRLGFAAADPLLAANVAARVAAVRGGKGARGVVSMAKKSVGELSAADLKGKKVFVRADLNXPLDDNQNITDDTRIRAAIPTIKHLIQNGAKVILSSHLGRPKGVTPKYSLAPLVPRLSELIGIQVVKAEDSIGPEVEKLVASLPDGGVLLLENVRXYKEEEKNDPEHAKKLASLADLFVNDAFGTAHRAHASTEGVTKYLKPSVAGFLLQ

SEQ ID NO: 54986 - protein, 390 aa, Deinococcus radiodurans R1
MMFEDTHDEHVLLTPGPTPIHPRAQKALIRSMLGHMDPEVFALNSEIQRDLREMYGTEPEGFTALLAGTGSLGMEAGFANLVEAGDEVLVCANGSFGRRMAEMAARYGAKVRLVTAPLGEAIKPADVAAHLDDDISMVAVVHGETSTGVLNPVPEIAELVRGSGALLTVDAVTTAGMEPFHMQQWGVDYAYTGAQKCLSAPPGLAPVAISERAFSRFAARRTQTPLWYCDFEGLRDYWVNHTYHHTVPVNLHFAFHAALRAALEEGLEARQARVRLMGRVIERTLAPLGFSHYVRRPEDRLPTVLALRLPEGFDDAGLRQALRQREISVTGGLGPTAGVIWRLGLMGESARPGPYHRLMTELEDLLGAPGLLDRYEAVLAEEQRGELALA

SEQ ID NO: 54987 - protein, 531 aa, Shewanella sp. MR-7
MIKDFILPDIGEGVVECELVEWLVQEGDTIAEDQPIADVMTDKALVQIPAPFAGVVTKLYYAKGDIAKVHAPLYAVQIESDEAAPVAASQPQAHTATQTPASQASAAGTSVEEFLLPDIGEGIVECELVEWLVQEGDTVVEDQPIADVMTDKALVQIPAIKAGKIVKLHYRKGQLAKVHAPLFAIEVEGGVSAPVSHAQEASAAVSNTAAPAACAAVSSEPARQGKALASPAVRRMARALDIDLSRVPGSGKHGRVYKEDITRFQAQGGAVPAAAPVAAAPTVAQSTVSTAVASAARGDIVEPIRGVKAVMAKMMVESVSTIPHFTYCEEFDLTDLVALRESMKAKYSSDEVKLTMMPFFMKAMSLALTQFPVLNSQVNADCTEITYKARHNIGMAVDSKVGLLVPNVKDVQDKSILEVAAEITRLTNAARSGRVAPADLKEGTISISNIGALGGTVATPIINKPEVAIVALGKLQTLPRFNAKGEVEARQIMQVSWSGDHRVIDGGTIARFCNLWKQYLEQPQDMLLAMR

SEQ ID NO: 54988 - protein, 194 aa, delta proteobacterium MLMS-1
DHDRDVVLMMDSVTRYAMSSREVGLAIGEPPTSRGYTPSVFGQLPKLLERAGTCQGKGSITGIFTVLVEGDDMNEPIADAVRSIVDGHIVLSRDLAGQGHYPAIEVSGSVSRCMSDVASAEQIEAAHRFLEIISLYRRSEDLINIGAYAKGSNPKIDNAIAMIDQLNGYLRQQVEQQVPYKDSVAQLLALFKKK

SEQ ID NO: 54989 - protein, 687 aa, Cucumis melo
MAKVANQPLFPLPFLVFFVLSIIFGFGITLSKAVSQTRYYKFEVDYMFWSPDCVENIVLGINGTFPGPPIRANVNDTVVVEVINNLSTEGVVIHWHGILQRGTPWADGTASISQCPINPGENFTYEFKVDKPGTYFYHGHFGMQRAAGLYGSLIVDLEEGKKEPFQYDEEINLLLSDWWHTSIQEQEVGLKSNPMRWIGELQVILINGTGQFNCTSLDKYNTSSEHCEWKDQCAPFVLKVEPNKTYRIRIASTTSLSALNFAIANHTMLVVEADGNYVDPFETSDIDIYSGESYSVLVTTNQATTQNYWASIGVRGRKPKTSPALLLFNYLPNSVAKLPISPPPETPKWDDYDRSKSFTNRVLASAMNTTKPPPIFTRRISLLNTQNRINGKFTKWAINNISLTLPSTPYLGAIKFGLNSTFNQTPPPETFPKNYNIKIPPPNPNTNTGNGVYRFRSGEIVDVILQNANALTNNTSEIHPWHLHGHDFWVLGFGDFKFSAADETKLNLKNPPLKNTVVIFPFGWTAIRFVADNPGVWIFHCHIEPHLDMGMGVIFAEAVERVREIPPYALACGRTATHNVVPIIPQPKPPRGPGPVIPYFMLWVIGLVIIVCGIGLFGVCLYRIGLRRGYTFNNLSWRPYLGLSDSQSNQIEFSDLSRSNLTQEESNPTQEESNPTQEESNPILEEP

SEQ ID NO: 54990 - protein, 512 aa, Bacillus cereus ATCC 10987
MKKQHDTIIVLDFGSQYNQLIARRIREFGVYSELHPHTITAEEIKEINPKGIIFSGGPNSVYGEGALHCDEKIFDLGLPIFGICYGMQLMTQKFGGKVERANHREYGKAVLKVENESKLYANLPEEQVVWMSHGDLVTGLPEGFVVDATSESCPIAGMSNEAKNLYGVQFHPEVRHSEHGNDLIKNFVFGVCGCSEGWNMENFIEVELEKIRETVGDKKVLCALSGGVDSSVVAVLIHKAIGDQLTCIFVDHGLLRKGEAEGVMKTFSEGFHMNVIKVDAKERFMNKLKGVEDPEQKRKIIGNEFIYVFDDEASKLEGMDFLAQGTLYTDIVESGTATAQTIKSHHNVGGLPEDMQFKLIEPLNTLFKDEVRVLGSELGIPDEIVWRQPFPGPGLGIRVLGEITEEKLEIVRESDAILREEIIKAGLDREIWQYFTALPGMRSVGVMGDERTYDYTVGIRAVTSIDGMTADWARIPWDVLEKISVRIVNEVKHVNRIVYDVTSKPPATIEWE

SEQ ID NO: 54991 - protein, 459 aa, Wolbachia endosymbiont of Drosophila melanogaster
MTDYDLIVIGGGPGGYKCAIAAAKLGLKVACIDKNSIFGGTCLRVGCIPSKALLHSSYQYAHTKNDLSKLGIKIKDASFDLKEMLGYKDARVQELGKGIEYLFNLHKITKINGLASFDQGNLEVSVEGKVLKTKNIVIATGSDVISLPGINIDEKSIISSTGALSLTEVPKKLVVIGAGAIGLEMSSVWRRLGSEVTVVEFFDRIAAAMDGELSKSLLSSLQKQGIKFLLSTKVEEIKQSSNSLSVKVCSVKDNQTNTIEADKVLVAAGRKPCTENLGIDEKIEKDNRGFVQVNNRYETNVKGIFAIGDVIGGAMLAHKAEEEGVAVAEIIAGQSPHVDYGIIPSVIYTHPAVSSIGKTEEELKNAGRKYKVGKCQFAANGRAKITDDAEGFVKVLTCSRADTILGVHIIGAYADTLINEAAVAMAYSAAAEDIYRICHSHPDINEAFRDACIDAFFKK

SEQ ID NO: 54992 - protein, 640 aa, Cryptococcus neoformans var. neoformans JEC21
MYSTTALLASALALAATAAHAATHEHWWNITYSAANPDGLQERRVIGVNGTWPPPVLTATQGDVIIVHATNSLDDDTVGTSLHSHGMFFNHSNWYDGAVGVNQCPIPNGQTLDYVIDTTTQVGTYWIHGHLDGQNTDGLRAPVVIFPQNGTGRTDNVTWDAEFIVAAADWYHEEYPVLEQRDFLTWKNPTGAEPVPKSAVIYAAYQNGTYMSTNEEICAGEGVSDGLSLYFEPGKSYRIRMINMGTLAMFWAALEGHEMYIIEMDGIEVEPYLVDAVTISVAQRYSVWVRALNQTDRNYAFMFIQDTDMYDAVPDDLVLNNTIQIVYNSSAPPATPYIVYDIETFDDTKVVPLEQEDFLRNPDVEIDLHAYFDTYDDGTNRASFNNITYQMPTSTPSMLTALTMGNDSFNDAVYGAMTNAFAYRHNSIVQLTVYNWDAGFHPFHLHGHVFQLASKSFDVTSNDTDINPPLNESQSNPARRDTVVVPPTGKVVLRWRADNPGTWMFHCHIDWHLSSGLAAIMVEAPEAFQALASDVPEQITDQCRWWNKGTEGNVVGKFSTTDFAGQPWGPWPLKMGWTPKAIGALAGCIITALLGIATIIWYASGELDEEELEEEIKREVERKKSKVPIWKKVLKTEVKV

SEQ ID NO: 54993 - protein, 467 aa, marine gamma proteobacterium HTCC2080
MLVPVILSGGVGSRLWPVSRQGRPKQFLPLGADGSMLQETSQRLAGLQTAPPIVVCNEAHRFLVAEQLREIATPASALILEPAGRNTAPAIALAAIHAVQEDPDATLLVLPADHHIGNPSAFLTAVQQGLQGAEEGQLVTFGVVPSAPETGYGYIRGGKKLSTGIFELAEFVEKPDADTAGKYLKAGNFYWNSGMFLLGAQSYLDALFQHQPEMHRLCSAAMDGATRDLDFLRPDADLFLACPSDSIDYAVMEHTDRGGIVPLDCGWSDIGAWSALWEVGSADTAGNVVQGDVLTHETTNSYVRSESRLVTTTGVNNLVVVETADAVLVADRNNVQGVKEIVSALKTADRTEATVHQRVFRPWGSYESLAADAGFQVKRIIVQPGQTLSLQKHFHRAEHWIVVKGTAEVTRGEEVFSLTEDQSTYIPLGTVHRLANPGKIPLELIEVQSGSYLGEDDIVRFEDVYGR

SEQ ID NO: 54994 - protein, 245 aa, Bacteroides fragilis YCH46
MNYPQEKIKPYSNDGKKSEQVEQMFDNIAPAYDQLNHTLSLGIDRSWRRKAINWLKPFRPQQIMDVATGTGDFAILACHELQPEQLIGTDISEGMMNVGREKVKKEGLSEKISFAREDCTSLSFADNRFDAITVAFGIRNFEDLDKGLSEMYRVLKTGGHLVILELTTPDRFPMKQMFTIYSKIVIPTLGKLLSKDNSAYSYLPQTIKAFPQGEVMKNVISRVGFSQVQFRRLTFGICTLYTATK

SEQ ID NO: 54995 - protein, 275 aa, marine gamma proteobacterium HTCC2080
MLRKCLFPVAGYGTRFLPATKSMPKEMLPVVNKPLVQYGVEEAIEAGMTNCALVTGRGKRAIADHFDISYELEHQISGSSKETLLGSIRDVIDQGIFTMVRQREMLGLGHAVLTGEPLIGPEPFGMVLSDDLCLNTGGPSVLAQMAQLFEEFGCSIVAVQEVPDEDIHNYGVIAGEQLRDGIYRVERMVEKPNAAEAPSNLAIIGRYILTPDIFDIIRRTAPGASGEIQITDALQQQANTGGVIAYKFEGRRFDCGSVPGFVEATNHVYETIYRP

SEQ ID NO: 54996 - protein, 479 aa, Dechloromonas aromatica RCB
MTQVIPVVLSGGSGTRLWPLSREKYPKQLLPLVGDKSMLQETVARLDGLAGLSEPLLVCNEEHRFVVAEQLRVLGKHGQILLEPFGRNTAPALTLAALLARQNGDDPVLVVMPADHVILEGDVFREAVANAVKLAEQGYAVTFGITPDCPETGYGYIHRGAAIACEEEAFLLRRFVEKPDRGTAQAYLDSGDYLWNSGIFVLRVSTWLSALEICRPDILAACGKALNCVSQDGDFVRLDRAEFERCPSDSIDYAVMERLSGGEANLPKSAVIPLSAGWSDVGAWDALWKVLPKCEAGNAIRGDVMLESCSNTLAFSESRLVTCIGLKDLVVVETNDAVLVAHQNATQDVKKIVDRLKADKRSVAQWHRKIHRPWGWYDGVDSGQRFQVKRICVKPGASLSLQMHHHRAEHWIVVTGTAKVTKGDEAFLVSENQSTYIPLGTKHRLENPGIVPLEMIEVQSGSYLGEDDIVRFEDTYGRN

SEQ ID NO: 54997 - protein, 92 aa, Zea mays
GEGYGMLGQAGRGKLRFSVGQSKLVVKGGKKFKEKSYGSRGATSGLTSSLAFPPVRGIELSNPQVQGTFLGGGTQSIYFSEPGPFSKIRGTQ

SEQ ID NO: 54998 - protein, 199 aa, Wolbachia endosymbiont of Drosophila melanogaster
MNLVTKSAIDFTASSVLSDGEIVDDFCLSKRIKNKYAVLFFYPLDFTFVCPTELISLNNRINEFAKRGVKVIGISVDSKFSHYKWRNTPVNDGGIGEISYTLVSDIKKSISRDYGVLYDDSIALRATFVIDDKFIVRHQSINDFSLGRNIDEFVRIVDAIQHNEEHGEVCPAGWKKGKPAMQASDEGVADYLNSYSEEL

SEQ ID NO: 54999 - protein, 474 aa, Bifidobacterium longum NCC2705
MATKETTATKQTAESSEETETKKKASSTTTARKTSAKKSKSAEPSKKTTRKSAAKKTAKKAKDDELVKDEDTQVDDELDDDAEVNDDDLDVDDLDEDLDDVDEDDADDEDLDEDDADDDDVEDDEDEEEAKSKAPEQPKEKGAYVVSDTDDEEENIIPSGNPKRRVIAAGATADPVKDYLKQIGRVSLLNAEQEVDLSERIEAGLYAQHLLDTESEGMEFKRKRELKWAAADGKKAKDHLLEANLRLVVSLAKRYTGRGMLFLDLIQEGNLGLIRAVEKFDWKKGFKFSTYATWWIRQAITRAMADQARTIRVPVHMVEVINKLSRVQRQMLQDLGREPTPDELARELDMPVEKVQEVQKYGREPISLHTPLGEDGDSEFGDLIEDTDAIAPSDAVAFSLLQEQFKQVLETLSPREAGVIKMRYGLEDGQPKTLDDIGRVYGVTRERIRQIESKTMSKLRHPSRSQTLRDFLDQ

SEQ ID NO: 55000 - protein, 222 aa, Glycine max
  misc_feature (52)..(52): Xaa can be any naturally occurring amino acid
MAAKISLAIGLRTLFTVLGLLMLAIVLYTVFTDGLPFRKELLTPWMAGTLIXAHINVVALAVWIAYKESNLISSILWIVLLVCLGSITTSAYIVVQFLKLSSQESSQDPMYYVLLRNPNTERRSTSKIAFIYRDSNNILHLHPPLSGEGAPKNTAIIEIALFTAVSSRKRRDSVRETCIASRRTTTHMAVRQKSCQDPAYLVLVHHGDRAENDSTGHSRSAT

SEQ ID NO: 55001 - protein, 320 aa, Bifidobacterium longum NCC2705
MPEPVRERLRALKDAPGSVIVVGSMNADYTVTTKRLPKPGETVNGGAMKVLPGGKGANQASAAARLGVNVQLLGAVGEDSNADFLLSKLDEAGVDTADILHVEGPSGTTVITVSAEGENTIVYSPGSNAKASAGYVQSHRTTIAECAVLGLCLESPIATVIAAAQTAHDAGVTVLLNDSPFMDELPHELVEATDILLVNQHEVAQLLGLPDDDVESLDWYEVAERFTDYGFDRAIVTLGASGSVVIENGRWHRVSAAQVNAVDTTGCGDSFMGTVLAGLAAGHTLLQSAQIGSYVSAYAATKLGAQSAYGTAEEVIAYFS

SEQ ID NO: 55002 - protein, 377 aa, Thiobacillus denitrificans ATCC 25259
MTASFLPPKRILMGPGPSDVPQRVLDAMARPTIGHLDPAFVDLMEQIKAMLRMAFRTENALTFPVSAPGSAGMEMCFVNLVEPGDKVIVCRNGVFGGRMLENVKRTGGVPVVVDDAWGAAVDPQKVRDAFKSNPDAKVLAFVHAETSTGAQSDAAALAKIAQEAGALTILDCVTSLGGTPVLLDQWRIDAAYSGSQKCLSCTPGLSPVSFSERAIEKIKARKTPVQSWFLDLNLVLGYWQSAGKRTYHHTAPINPMYGLHESLVMLEEEGLENSWARHRAMHEKLKAGLEGLGLRYVVEESARLPQLNSIYVPEGVDEAAIRSRLLSEFNLEIGAGLGDMAGKIWRIGLMGYSAKQANIDLCLQALSACLEKSAAGA

SEQ ID NO: 55003 - protein, 296 aa, uncultured bacterium
MSRTRNVLAIVMAGGEGSRLHPLTDERCKPAVPFNGKHRIVDFVLSNLVNSEIYSIYLLVQYKSQSLIEHIRSSWTMTRFIPQHFVTVVPPQMRNGPEWFQGTADSVYQNIHLIESFQPDIVAVFGADHIYRMDVRQMVDFHRASEAHVSVATLPVPLSQCNQFGIVEVDAHHRIANFVEKPKNTRPMPGSSTHALASMGNYLFNADVLLDALKKAHATGHSDFGRDILPTMLQSHRLMAYDFTQNEIPGTASYEEHAYWRDVGTIDAYFDAHFDTLGATPRFRMTNRDWPIYASP

SEQ ID NO: 55004 - protein, 208 aa, Oryza sativa Indica Group
MEVGSFARACSNVSVLFGCLGIAFKFAEMDYVAKASPRRHPRSLVFALPCPRGVRSAINCLLLPPFQVDDLLEASKSISKLPEMVELDIQKGTVRQAGSHTRNMLRVKRGIDMVKILFEQILVTEGNSLRDAASKAYAQVFAPHHGWAIRKAVAAGMYALPSKSQLLKKLNEDENSAKVQMQTFIRASGPVILYVEDLFTSRNLGMDW

SEQ ID NO: 55005 - protein, 633 aa, Bacillus cereus G9241
MIHVDLTQIQNPSFLKDMSISELEGLSEDIRKFLIEELSQTGGHIAPNLGVVELTIALHKLFDSPKDKFLWDVGHQSYVHKILTGRAKEFGTLRQYQGLCGFPKRCESEHDVWETGHSSTSLSAAMGMALARDLKKTKEYVIPIIGDGALTGGMALEALNHIGHEKTDMIVILNDNEMSIAPNVGALHNVLGRLRTAGKYHWVKDELEYILKKIPAVGGKVAATAEKIKDSLKYLLVSGVFFEELGFTYLGPVDGHDYEKLFETLQYAKKTKGPVLVHVITKKGKGYKPAESDVIGTWHGTGPYKIESGDFVKPKEVAPAWSAVVSETVLKLARTDERIVAITPAMPVGSKLEKFQKEFPDRMIDVGIAEQHATTMAAGMATQGMKPFLAIYSTFLQRAYDQVVHDICRQNLNVFIGIDRSGLVGADGETHQGVFDISFLRHLPNMVLMMPKDENEGQHLVYTAMQYEDGPIALRYARGNGLGVHMDEELKAIPIGSWETLKEGTQAAILTFGTTIPMAMEAAERLEKAGVSVKVVNARFIKPMDEAYLHDLLGKNIPILTIEEACLIGGFGTGVVEFASENGYHSALVERMGIPDRFIEHGSVTKLLEEIGLTTDAVVDRIHTMIPSKQKRA

SEQ ID NO: 55006 - protein, 296 aa, Bacillus cereus G9241
MTIAFDTFLKESKTFVEEKLVSYANELQCPNVLREAMAYSLEAGGKRLRPLLLFATLQAFGKEKNLGVGAACALEMIHTYSLVHDDLPCMDDDDLRRGKPTNHKVFGEAMAVLAGDGLLTYAFQVIMAYEQKEISAEKKVRLVLELAKAAGPEGMVGGQVADMEAEGKQLTIDELEYIHKHKTGKLLEFAVLAGSILSDATEEQEEKLLEFAKYIGLAFQIRDDILDVEGTEEEIGKPIGSDVSNEKSTYTTLFTVDRAKDILEETIAKAKDAIGSLQLQDEYLLSICDLIAKRNN

SEQ ID NO: 55007 - protein, 292 aa, Oryza sativa Indica Group
MTPGCVITIFLMIGVTFVPVGLVCLHASNHVAEIAHRYDIDCVPNAYKRNRQVYIKDSSISKNCTQEVKVKYLMRAPIYVYYELDNFYQNHRRYVKSRSDKQLRYGQKYTHSSCDPIERNDGLPIVPCGLIAWSLFNDTYGFTRGSTEIKVNRKNISWKSDREHKFGKDVYPFNFQNGSLIGGGKLDPALPLSQQEDLIVWMRTAALPQFRKLYGVIEEDLQADEIITMHIANNYNTYSFGGKKSLILTTSTWLGGKNDFLGYAYLITGSLSLFLTILFALIHVKNPSLSIN

SEQ ID NO: 55008 - protein, 334 aa, Bradyrhizobium japonicum USDA 110
MTSNPWLTLLGLINGFQVTQAIHVASTLRIADHLKGDSRSAEELAPLTQSHPGALYRLLRALAAVGVFEEDEDRRFALTPMGDCLRTDSATPIGAWAECVGSPYVWSTWGHLLHSIRTGENAFQSLNGKDIWNYRAERPEESAVFDRAMTEFSRGGAEAVIGAYDFSAFHHVVDVGGGRGLMLAAILTAHPRMQGTLFDQPGVIAGAEAVLEAHGVVDRCRMVSGSFFESVPEGGDAYVMRVVIHDWDDDEAIAILKACRRAMRETAKLVLIERIIAPANEVPATKFMDLHMLALPGGRERTRDEFSDLLAKSGFELTRVVPAGRINVIEARPY

SEQ ID NO: 55009 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKEGQ

SEQ ID NO: 55010 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKEGQ

SEQ ID NO: 55011 - protein, 397 aa, Shewanella sp. MR-7
MIFSQVVLAPADPILGLTDTFKADPRQDKVNLGVGIYKDEAGQTPVLQSVKKAEALLLEQEKTKNYLGIEGVQTYNHVVQELLFGEGSTLVTSGRAATAQAPGGTGALRIAAEFLLRNTPSRTVWVSNPTWANHQNIFETAGLTVKEYGYYNAAAHDIDFDAMMTDLANALAGDIVLLHGCCHNPTGIDLTLAQWELVANLCADKQLVPLFDFAYQGFGAGIEEDAAGLRLVAAKVPELLVANSFSKNFGLYNERIGAVTVVAQNADEAVRAFSQVKRTIRANYSNPPAHGALIVSTILSDAALKALWVQELTEMRERIAEMRTLFVQSLKDEGVTQDFSFISRQNGMFSFSGLNKAQVARLKDEFGIYIVGSGRISVAGMTKTNMPVICKAIAQVL

SEQ ID NO: 55012 - protein, 355 aa, Trichoderma atroviride
MSRSTAPNASASRKISFNVSEQYDIQDVVGEGAYGVVCSAIHKPSGQKVAIKKITPFDHSMFCLRTLREMKLLRYFNHENIISILDIQKPRSYDSFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEDALKHPYLEPYHDPEDEPTAPPIPEEFFDFDKHKDTLSKEQLKQLIYQEIMR

SEQ ID NO: 55013 - protein, 239 aa, Alteromonadales bacterium TW-7
MKYISHESGNLAFSDTRKPQLKNHEVLVKVAAIGVNRADCMQRQGKYPAPKGDSPILGLECAGTVVELGNEVDKSWLDKRIFTLCAGGAYSEYVAVETKQLMELPDDVTMVEGAAISEVYLTAFGALFELGKLQHGQTALIHAGASGVGGAAIQMAKSAGATVVITAGSDEKCQHAKSLGADHTINYKNTDFVDYMQSHNLIANVIVDPRCRQLFKQKCPSCCHGLPNNYACLFRWAFC

SEQ ID NO: 55014 - protein, 355 aa, Trichoderma atroviride
MGGCMSSNNDEVEQKKRSQAIDKELDEDSKRLRKECKILLLGSGESGKSTIVKQMKIIHLKGYSEEELYNYRPTVFKNLVECAKAVITAMQQFSIELAQDDNRAHADFLIDYQAESGPQAHIDPKVGLAVQAIWSDPAKEQLMEHQTEFYLMDSAEYFFQEAMRIVAPDYLPNEMDVLRARTKTTGIYETRFQMGQLSIHMFDVGGQRSERKKWIHCFENVTSIIFCVALSEYDQVLLEESSQNRMMESLLLFDSVVNSRWFMRTSIILFLNKVDIFKQKLGRSPLSNFFPDYTGGTDVNKAAKYLLWRFNQVNRAHLNLYPHLTQATDTSNIRLVFAAVKETILNNALKDSGIL

SEQ ID NO: 55015 - protein, 173 aa, Physcomitrella patens subsp. patens
MAFGISKGMVAPLMVINFCLYLISAAIAGYLLNSAFDHELTSFVSISGNPATSTFLTFVLIASMVGLASVIAGAHHLRVWRTESLASAAAAATIAWLLTLLAMGVACKEIHFRYGRNKRLKTIEAFMIILSLFELLYLLALHAGSVTREGYANTPGDRNVKNPNYGTPAAAAV

SEQ ID NO: 55016 - protein, 432 aa, Burkholderia sp. 383
MNEAMIQAVVPKTLTEQTCSDIRETLAGRRRGARTVLSFAGPAVVASIAYMDPGNFATNIQAGAGYGYTLLWVVALANVVAMLFQSLSAKLGLVTGRNLAELCRDSLPRRWVIAMWGMSEVAAMATDLAEFVGGAIGVSLLLHLPMIPSMLITAAVTYGLLQFEKLGFRPLELAIAALIGVIGLSYLAELLIAPVHWPSVALHSVTPSIPDSNALTISVGIIGATVMPHVLFLHSGLTQNRVRPRNDRECSQLLAFSNVEVVVALGIAGLINMAMVIMASSAFHLGHADIASIETAWRTLTPLLGGAAAGLFLTALIASGISSSVVGTMAGQMIMQGFVGFRIPVWVRRLVTMAPAFIVVASGVDATRALVLSQVMLSIALPVPMIALVWFTSRRDLMGRHMNRRVTTVSAVLGTLLVLALNGVLLVQLALG

SEQ ID NO: 55017 - protein, 422 aa, Alteromonadales bacterium TW-7
MQYQHIKMPEQGQHITVDEQGKWVIPSEPVIAYINGDGVGQDVMPVMRNIVDCAIKHCYKNKRKIHWMQVFNGEQAAKLYDGDWFPQETIQAVRACKIAIKGPLTTPLGGGFRSLNVALRQEMDLFVNMRTIKGFSALPSPLKNPFLTNITVLRDSSEDVYSGIEWQAGSIESEKMLDFLCEEMGVTRLRFSQDCGIGIKNISKEGSERLTRFALNFALNNNRDSVTFVHKGNVLKFTDGAFKRWGFALAKKEFNAIEHENGRWLKIERAGQAPLIIKEVIADNMLQQCLMNPEQFDVVATTNQNGDFLADMLSAQVGGVGIMPAANLNNDVAFFEPTHGTFERIAGQNKANPSSSILSAVLMLKFMKWDEAALTIENALENTLASGYVTFDLTQQGIDTSKTHNSTTLSCTDFADKVIEHF

SEQ ID NO: 55018 - protein, 737 aa, Aspergillus nidulans FGSC A4
MSPAHGHCDAAFQPLRDLFDQLLSNESELGASICVNIDGRNVVDLWGGYSNEERTKAWEQDTITTIWSTTKVITALAANILIERGLLDPSKKVSTYWPEFAANGKENVLVSHVLSHSSGLPSWESPNTIKDIYNAEKAAEKIAAQAPWWTPGEQLGYHLVTQGCLVGELVRRTTGQSLAQFIADEITEPLGADYRLGVPEPEWPRTADIIPPPPPEPTPALDPESVAAKAYAGVPIPADAVMTASFRNAELGASNAFTNARALARIASIVALGGTVDGKQYLSPAAIDQMLQEQIRGQDQVLFVNLRWGLGVGLPVPETVPWLPSNSRLCFWGGWGGSVMIMDLDRRMSIALKVNRMFESRTSDAGENAVGLLSGGFFVDTAGPGFSSTRSSYYDAIMQIIKSLWVQTFPSKPTLTAATLPPQTGKVIIITGATSGLGFELARILYKSGATVYIGARNESKAKATIETITASASSTALAASAGKLHFLPLDLADLRTIKPFVESFLSRESRLDILFNNAGVASIPLSNRTAQNLEPHLGTNCAGPYLLTQLLSPILVSTAQKHSTAPNTVRVVWSSSMLVDALAPRSGIRPSDLDPPSPNMNLNYALSKTGNWFLADRLAKQLGERGVVSITQNPGNIYTPIFDNAPRLTVWLSKPIYYKPEQGVNTMLWAGFSDGVTVERGGGYVIPFGRWHPYPRKDLLEAIMDKEEDGNEAENRGRGYAKAFEEWCDLVTREFR

SEQ ID NO: 55019 - protein, 314 aa, Bacillus cereus ATCC 10987
MRKNNYLIVGGNSFIGINLALGLLKKGQNVKVFSRHINNFPQNIISEVEFIKGDLANVEDIYKALVNVDIIIYLAATSNVTTSIEDVFGDINSSLFFLNFMESAKNFPIKKIVLASSGGTVYGEPEYLPIDEEHPLKPLSPYGITKVSLENYLYFYKKKYGMDYVVCRYSNPYGKYQNPLKKVGAINCFLYQHLSNEKINIYGNPQEIIRDYIYIDDLVEVTIQLSQLNHLKFCVYNIGSGKGLSLKRIIVELEKLTERKVEFICYKQKQENVQKIILNIDRVRRECNWEPKVDFKSGIRLNKLWIEEFLYSKK

SEQ ID NO: 55020 - protein, 415 aa, Arabidopsis thaliana
MTTMSNLPAEVLEEILSRTPVTSLRTMRSTCKKWNNLSKKKIIPEAARKQQGLMLIKKKICSLSFSLHEIHKDDYVVPCINQVDIPRNIEVEKIFHCDGILLCVIEDNCSLLVWNPYLGQTRRIEVSSDADMNDRYALGYDNNNSSHKILRIKKDFKNSDGLGYEIYRFASNSWSLLDEEVMKPEWDVWSVQRSSVSLKGNTYFLLQGNDYDDQEDEEEEDDEEYEDDDDVLPKDNFLLCFDYTTERFGPRLLLPFNPHVEETVALSCIGEERLVMLYQSFKTYKGIEIWVTDKIDPKAVSWSKFLKVDITPLTGFPVDFYADSFVIDEEKKVAAVFDIHCSYQKAHIIGEDGYLKCVNMGRASDVGNGQPLVFSSYVPSLVKVPVKQPKGKRKGRSSETKSNKNKKGRKIKIIG

SEQ ID NO: 55021 - protein, 182 aa, Bifidobacterium longum NCC2705
MERMTTIIMNTSEGSITINLFDDKAPNTVANFLGLATGEKEWADPYTGQPSHGKFYNGLTFHRIIKQFMIQGGCPLGTGTGGPGYEFDDEIDPSLKFDKPYLLAMANAGLRRGMDGKVHGTNGSQFFITTVPTPWLDGHHTIFGEVADDDSKKVVDKLEALDTDPMDRPLEPAVILSVDVAE

SEQ ID NO: 55022 - protein, 256 aa, Zea mays
  misc_feature (226)..(226): Xaa can be any naturally occurring amino acid
MAATIQSVKARQIFDSRGNPTVEVDVCCSDGTFARAAVPSGASTGVYEALELRDGGSDYLGKGVSKAVNNVNSIIAPALVGKDPTAQTELDNFMVQQLDGTKNEWGWCKQKLGANAILAVSLAVCKAGASVKKIPLYQHIANLAGNKQLVLPVPAFNVINGGSHAGNKLAMQEFMILPTGAASFKEAMKMGVEVYHNLKSVIKKKYGQDATNVGDEGGFAPNIQEXNKEGLELLKTAIEKAGYTRQVVIWNGMCCF

SEQ ID NO: 55023 - protein, 666 aa, Arabidopsis thaliana
MINFSLSLTKSMSYSFIWMLFVIHISCVLSADGNHILCSPSFTCGNQRGLLYPFWIAGRKECGHPDFELDCNAGVPELSISSVKFRILGADYDSGIITLARSDNIDDPCLPNSFTTSFNETVLPLASTTDLLTIYYDCNRNVSSFVSTFVKELDCPDDGTDDRRNYYLTRNLTFLPPSLKLEGNSFLLNDFGGSCSRNVSNPASRTALNTLESTPSTDNLKIALEDGFALEVNSDCRTCIDSKGACGFSQTSSRFVCYYRQEPQNPTRNKVILKLFFIVIYVLGIGAASFAMMGVILVVTCLNCLIRRQRKTLNDPRMRTSDDSRQQNLKALIPLKHYSYAQVTSITKSFAEVIGKGGFGTVYRGTLYDGRSVAVKVLKESQGNGEDFINEVASMSQTSHVNIVTLLGFCSEGYKRAIIYEFMENGSLDKFISSKKSSTMDWRELYGIALGVARGLEYLHHGCRTRIVHFDIKPQNVLLDDNLSPKVSDFGLAKLCERKESILSLMDTRGTIGYIAPEVFSRVYGRVSHKSDVYSYGMLVLDIIGARNKTSTEDTTSSTSSMYFPEWIYRDLEKAHNGKSIETAISNEEDEIAKKMTLVGLWCIQPWPLDRPAMNRVVEMMEGNLDALEVPPRPVLQQIPTATLQESSTFSEDISAYTEICSINVA

SEQ ID NO: 55024 - protein, 170 aa, Helicobacter pylori
GSGMHTHVSVWKNNENLFSGKTYKGLSELALHFLGGVLRHARGLAAFTNASTNSYKRLIPGYEAPSILTYSANNRSASVRIPYGISKNSARFEFRFPDSSSNPYLAFGAILMAGIDGIKNKMDPGEAMDINLFKLTLDEIREKGIKQMPHTLRRSLEEMLADKQYLKEGQ

SEQ ID NO: 55025 - protein, 514 aa, Arabidopsis thaliana
MASILEPSKSSFFPALTKIVGTLGPKSRSVEALSGCLKAGMSVARFDFSWGDADYHQETLDNLKVAVRSTKKLCAVMLDTVGPELQVINKSEKAITLKADGLVTLTPNQDQEASSEVLPINFNGLAKAVKKGDTIFVGQYLFTGSETTSVWLEVDEVKGDDVICLSRNAATLAGSLFTLHSSQVHIDLPTLTEKDKEVISTWGVQNKIDFLSLSYCRHAEDVRQTREMLKKLGDLSQTQIFAKIENVEGLTHFDEILQEADGIILSRGNLGIDLPPEKVFLFQKAALYKCNMAGKPAVLTRVVDSMTDNLRPTRAEATDVANAVLDGSDAILLGAETLRGLYPVETISTVGRICAEAEKVFNQDLYFKKTVKYVGEPMTHLESIASSAVRAAIKVKASVIICFTSSGRAARLIAKYRPTMPVISVVIPRVKTNQLKWSFSGAFEARQSLIVRGLFPMLADPRHPAESTSATNESVLKVALDHGKHAGVIKSHDRVVVCQKVGDASVVKIIELED

SEQ ID NO: 55026 - protein, 531 aa, Hevea brasiliensis
MEADPRKEPKLASSDHPLPPPPPPSSASIRKIVMVASIAAGIQFGWALQLSLLTPYVQLLGIPHTWAAFIWLCGPISGMLVQPIVGYHSDRCASRFGRRRPFIAAGSFAVAVAVFLIGYAADLGHLSGDPIAKSPKPRAIAVFVVGFWILDVANNMLQGPCRALLADLSGSNQKKTRTANALFSFFMAVGNVLGFAAGAYTHLYKIFPFTKTKACDVYCANLKSCFFISIFLLLTLTVLALTYVHEKQWSPEQGNAAAGDAEEEEDGPFESSPMPFFGEIFAALKNLQKPMWILLLVTCLNWIAWFPFLLFDTDWMGREVYGGDSNGTAEQVRLYDHGVRAGALGLMLNSVVLGFTSLGVEVLARAVGGVKRLWGIVNFILALCLFMTILITKMAESNRRFTTVRGGATVPLPPPGGVKAGALALFAVMGVPQAITYSIPFALASIFCNTAGAGQGLSLGVLNLSIVIPQMLVSVASGPWDALFGGGNLPAFVVGAIAAAASGIFAFTLLPSPPPDVPSAKASRAVTAAFH

SEQ ID NO: 55027 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFGAILMAGMDGVKNKMDPGEAMDINLFKLTLDEIREKGIKQMPHTLRSSLEEMLADKQYLKEGQ

SEQ ID NO: 55028 - protein, 179 aa, Bradyrhizobium sp. BTAi1
MTFDLDIKNTVRTIPDYPKPGILFRDITTLLADARAFRRAVDELVHPWAGSKIDKVAGIEARGFILGGAVAHQLSAGFVPIRKKGKLPHKTVSMSYALEYGTDEMEMHVDAVQPGERVILVDDLIATGGTAEGAVKLLRQIGATVVAACFIIDLPDLGGAAKLRALDVPVRALIAFEGH

SEQ ID NO: 55029 - protein, 473 aa, Deinococcus radiodurans R1
MSQPQPPSRLLVMKFGGTNMQSAHAIRHSASLAGRSVREGVKVVVVVSAMAGVTNGLLHLADAAQSGDIARANDEIAALRTRHFTAAQELGAAPDSETVRELRELHETLRQAVYGVYLLRELTPRSRDLIVAFGERLSAPLMSLALEQSGLRARHLTGGEAGILTDTNFGNARPLPGTYERVGDRLSGFLSAGVTPVIAGFMGETEQGAITTLGRGGTDFSATIVGKALGADEVWAWKDVDGVMSADPRVVGDASNIGVLSYGEVMELAYFGAKVLHPLAVTPLQDSGIPLRVKSAADPDFAGTLVRSQAEEIPGRPVKAVTAIKNVSLLTVTGAGVLGVPEVIASVFTAIARENITLLMVSQSSSMSNVSLAVPSADAARALQALRAGLSSELNVEETNGVAVLAIVGSGMRGQQGVSARLFTALASEDINILMISQGSSELNISVALSGEEVDRATAAVHAAFTLSQPVGA

SEQ ID NO: 55030 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKESQ

SEQ ID NO: 55031 - protein, 523 aa, Arabidopsis thaliana
MEAEKWNSDGGEYTSEDEGTEDYRRGGYHAVRIGDSFKTGRYVVQSKLGWGHFSTVWLSWDTQSSVQKSAQHYTEAAMDEITILQQIAEGDTDDTKCVVKLLDHFKHSGPNGQHVCMVFEYLGDNLLTLIKYSDYRGLPIPMVKEICYHMLVGLDYLHKQLSIIHTDLKPENVLLPSTIDPSKDPRKSGAPLVLPTDKDNTVVDSNGDFVKNQKTGSHRKAKLSAQGHAENKGNTESDKVRGVGSPVNGKQCAAEKSVEEDCPSTSDAIELDGSEKGKQGGKKGSRSSRRHLVASADLKCKLVDFGNACWTYKQFTSDIQTRQYRCPEVILGSKYSTSADLWSFACICFELVTGDVLFDPHSGDNYDRDEDHLALMMELLGMMPRKIALGGRYSRDFFNRHGDLRHIRRLRFWPMNKVLTEKYEFSEQDANDLSDFLVSILDFVPEKRPTAAQCLLHPWINSGPRSIKPSLKDENSDKLDTEKNKRENEEQEAVEVKMGNVVISSLDSKPGMSQSSSTLKLAI

SEQ ID NO: 55032 - protein, 170 aa, Helicobacter pylori
GSGMHTHVSVWKNNENLFSGEIYKGLSELALHFLGGVLHHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKESQ

SEQ ID NO: 55033 - protein, 122 aa, Aspergillus parasiticus
MSEQPYDPYIPSGSTTNAPAGASAAQNGDPRTREIDKKIQETVDTMRSNIFKVSERGERLDSLQDKTDNLAVSAQGFRRGANRVRKQMWWKDMKMRVCLVICVILLLVVIIVLPLSLLSIKH

SEQ ID NO: 55034 - protein, 209 aa, Deinococcus radiodurans R1
MSVPAVLAGIREAEAQAGRAAGTVRLVAVTKGHSLDEIRGQVLAHGDFPLAENRGQELRDKVAGLPGAEWHFIGPLQRNKIKYLRGVTLVHSIEEPWQAQAIADAAAEWGQAPAVLLQRHNGEGQKHGVLPDDLPAVLREVRATGLEVRGLMAMAPYDDEARAAQVFADTARQAQDLGLVELSMGMSGDYPLAVAAGATLVRVGRSLFA

SEQ ID NO: 55035 - protein, 303 aa, unidentified eubacterium SCB49
MNYKQILTNIHREVSALKNTGEVASYIPELAKVDKDHFGIYLNNIHGDNFEAGDADVTFSIQSISKVFSLAMAFANQGNKLWERVDVEPSGNPFNYLSLLEREKGIPRNPLINSGAIVVADCLVSTLKNPKEDFLQFVRDLANDQSINFDKNVVASEKKTGFRNYAIANLLKSFDNLHNSVEDVLDFYFHQCAIAMNCKQLSNAFFAFANRGKCMQNNTPIKPNQAKRINAIMLTCGFYDEAGEFAFEVGLPGKSGVGGGIVALLPNEYVITTWSPALNEKGNSYYGMQALERFTTETNSSIF

SEQ ID NO: 55036 - protein, 375 aa, Kluyveromyces lactis NRRL Y-1140
MFRLARAQTALANKASVSRSFLRLNSSFAIPETQKGVIFYENGGKLEYKDLPVPKPKANEILINVKYSGVCHTDLHAWKGDWPLPVKLPLVGGHEGAGIVVAKGENVKNFEIGDYAGIKWLNGSCMSCELCEQGYESNCLQADLSGYTHDGSFQQYATADAVQAAQIPKGTDLAEIAPILCAGVTVYKALKTADLKPGQWVAISGAAGGLGSLAVQYAKAMGLRVLGIDGGDGKEELFKQCGGEVFIDFRKSKDMVADIQEATNGGPHGVINVSVSEAAISMSTEYVRPTGVVVLVGLPADAYVKSEVFSHVVKSISIKGSYVGNRADTREATDFFTRGLVKSPIKIIGLSELPEAYELMEQGKILGRFVVDTYK

SEQ ID NO: 55037 - protein, 371 aa, Brassica oleracea var. italica
QMGQAENQVSFDLLESYLEKKNPEGSLWESKGSRGFRENALFQDYHGLKNFRQAMASFMEKNRGGKARFDPDRIVLTAGATAANELLTFILANPNDALLVPTPYYPGFDRDLRWRTGVRIVPIHCDSSNHFQITPEALEAAYKTARDANIRVRGVLITNPSNPLGATVQKKVLEDLLDFCVRKNIHLVSDEIYSGSVFHASEFTSVAEIVENIDDVSVKERVHIVYSLSKDLGLPGFRVGTIYSYNDNVVRTARRMSSFTLVSSQTQHMLASMLSDEEFTDKYIRINRERLRRRYETIVEGLKKEGIECLKGNAGLFCWMNLGFLLNTNTKEGELELWDVILKELELNISPGSSCHCSEFGWFRVCFANMD

SEQ ID NO: 55038 - protein, 200 aa, Alteromonadales bacterium TW-7
MGASQPIKIYFLDNFDSFSYNLVDELTMLGGELVVYRNNISADTIFNKMRQEQGQVLLVLSPGPGTPSDAGCLMDLIALCKGHFPMLGICLGQQALTQSYGGVIGHAGETVHGKSSIIDLSTHPVFKNMGDTMPVARYHSLMATQVPDSIEVIAQYQDIPMAIYHHDDGALGYQFHPESILTPNGAMLLQQSVAYLTNNN

SEQ ID NO: 55039 - protein, 284 aa, Pericallis appendiculata
PKSQITPYRVVITIRLVILGLFFHYRITNPVESSYGLWLTSVICEIWFAFSWVLDQFPKWYPINRVTFTDELSARYEKEGEPSQLAAVDFLVSTVDPLKEPPLITANTVLSILAVDYPVEKVSCYVSDDGAAMLSFESLVETAEFARKWVPFCKKFSIEPRAPEFYFSQKIDYLKDKVQPSFVKERRSMKRDYEEYKVRVNALVAKAQKTPEEGWTMQDGTPWPGNNPRDHPGMIQVFLGNSGAHDIEGNEIPRLVYVSREKRPGYQHHKKAGAENALVRVSAV

SEQ ID NO: 55040 - protein, 369 aa, Brassica oleracea var. italica
QMGLAENQLCLDLIKEWIKENPKASVCTPEGVHQFSDIANFQDYHGLKEFRQAIAHFMGKARGGRVTFDPERIVMSGGATGANETIMFCLADPGDVFLVPSPYYAAFDRDLRWRTGVEIVPVHCSSSNNFKLTVEAVEWAYKKAVESNKNVKGLLFTNPSNPLGTILDKDTLKNLVRFVTKKNIHLVVDEIYAATVFAGENLVSVAEVVKDSEVNADLIHIVYSLSKDMGLPGFRVGIVYSYNDSVVSCARKMSSFGLVSSQTQFMLASMLSDDSFVGNFLMESSKRLGIRHGVFTLGLKKAGINCLISTAGLFVWMDLRHLLRVRNSFESEIELWHIIIDKVKLNVSPGSSFQCTEPGWFRVCFANMD

SEQ ID NO: 55041 - protein, 171 aa, Oryza sativa
MEHKETGCQQPEGPILCINNCGFFGSAATMNMCSKCHKEMIMKQEQAKLAASSIDSIVNGGDSGKEPIIAGHAEVAVAQVEVKTLVAQPAEIAGPSEGVTVNPKGREGPNRCSTCRKRVGLTGFNCRCGNLYCATHRYSDKHDCQFDYRTAARDAIAKANPVVKAEKLDKI

SEQ ID NO: 55042 - protein, 113 aa, Arabidopsis thaliana
  misc_feature (38)..(39): Xaa can be any naturally occurring amino acid
  misc_feature (45)..(45): Xaa can be any naturally occurring amino acid
  misc_feature (48)..(49): Xaa can be any naturally occurring amino acid
  misc_feature (53)..(53): Xaa can be any naturally occurring amino acid
  misc_feature (58)..(58): Xaa can be any naturally occurring amino acid
  misc_feature (62)..(62): Xaa can be any naturally occurring amino acid
  misc_feature (65)..(65): Xaa can be any naturally occurring amino acid
  misc_feature (67)..(67): Xaa can be any naturally occurring amino acid
  misc_feature (75)..(75): Xaa can be any naturally occurring amino acid
  misc_feature (78)..(79): Xaa can be any naturally occurring amino acid
MASSMLSSAAVVTSPAQATMVAPFTGLKSSAAFPVTRXXNKDITXILXXGGRXSCMKXWPPXGKXKXFETLSYLXDLXXFIRKSLLVYSFVIILLAFFIFFLFFLLSFYSYYC

SEQ ID NO: 55043 - protein, 132 aa, Brassica juncea
DPYQRAQARFWVDFIDKKMYEAQRKVYATKGEEQETGKKEFIEILKTLETELGDKPYFGGDDFGYVDIGLIGFYTWFPGYEKFGNFSIEAECPKLIAWAKRCMQRESVAKSLPDPEKVVEFMAMLRKKFGVE

SEQ ID NO: 55044 - protein, 607 aa, Nostoc punctiforme PCC 73102
MDDIFKGFEHLLEIAKALEEKVEKGELKTSIQIRSHNLSSIPRQGNIPRTSNSSRVRSNSTVGTTPMDDTDVTPPSARTNSKAAWQGIGGLADVLQEIRELVEIPLKRPDLLVKLGLEPPRGVLLVGPPGTGKTLTARVLAEELELNYIAINGPEVMSKYYGEAEARLRSIFEKATRSAPCLIFIDEIDSLAPDRSQVEGEVEKRLVAQLLGLMDGFAKTEGVLVLAATNRPDYLDPALRRPGRFDREVQFRVPDRDGRLEILTILTSAMPLETSVNLGAIADLAVGFVGADIKALCQKAAYIALRRQVPSLNSPVPENMTIVQQDFLEAIKEIKPSVLRDVAIEVPSVSWDDIGGLDDVKQKLQESVEGALLYPELYEQTKAKPPRGILLWGSPGTGKTLLAKAIASQARANFIAVNGPELLSRWVGAAEQAVRELFRKARQAAPCVVFIDEIDTLAPARGRFTGDSGVSDRVVGQLLTELDGLHECPKVLLVGATNRPEALDPALLRAGRLDLQIKIDLPDRASRLAILRVHNLDRPLVDVDLETWATVTEGWNGADLALLSNQAALSAIRRYRAQGLTDSSLIQITNDDFQVTYQMLANQHQSQ

SEQ ID NO: 55045 - protein, 355 aa, Schizosaccharomyces pombe 972h-
MSDSKLADSLNCLSVSTPSTTANPGRQQLLRLAVSNQRQVNNVSLANGKENKRTSNSKFNSSLRKIEEPIAGVPSSAGPQWREFHIGMFEIGKPLGKGKFGRVYLAKEKKTGFIVALKTLHKSELVQSKIEKQVRREIEIQSNLRHKNILRLYGHFHDEKRIYLILEFAGRGELYQHLRRAKRFSEEVASKYIFQMANALSYLHKKHVIHRDIKPENILLGIDGEIKLSDFGWSVHAPSNRRTTLCGTLDYLPPEMVEGKEHTEKVDLWSLGVLTYEFLVGAPPFEDMSGHSATYKRIAKVDLKIPSFVPPDARDLISRLLQHNPEKRMSLEQVMRHPWIVKYKDSWTRKSSESS

SEQ ID NO: 55046 - protein, 298 aa, Debaryomyces hansenii CBS767
MSVRLVSKSFGRLEKPLIAYANSGVSIRRYSDNSLDSTTHFGYKTVNKDDKEKLVKGVFSSVASNYDVMNDVMSLGIHRVWKSHFINRLDAGMRPGASRPLDFLDVAGGTGDIAFGLLEHAEKKYNDRLSTMTVADINPDMLAEGEMRFQELKWNDGSDRVNFLVQNGETMDAIEDNSKDVYTIAFGIRNFTDIQAGLNTAYRVLRPGGIFACLEFSQVDNPILDYAYQAYSFSLLPLMGQLVANDRESYQYLVESIRRFPKQEEFRDMIEKAGFYIPERGYENLTFGVSSIHIGVKL

SEQ ID NO: 55047 - protein, 422 aa, Rhodospirillum rubrum ATCC 11170
MMASSTAAREPHPGDDSPYDVEAIRADFPIFGTQVHGQPLIYLDSGASAQKPRAVIDAMRLMYEGEYANVHRGAYWLSERSTTRYEEARQTVRGFINAARSEEVVFTMGATDAINLVAYSFGRGLLQAGDEIIISALEHHSNIVPWQILRDERGIVLKVCPITDAGDLDLGALETLLGPRTKLVAMAHTSNVLGTILPVETIIKMAHGVGARVLLDGCQAVVHTAVDVQALDVDFYAFSGHKLYGPTGIGVLYAKHELLEAMPPFRGGGDMIASVSFEHSVWAEPPAKFEAGTPPIVQAVGLASAIDYVSAIGLARIARHEADLLNYATQKMTVLPGLTIHGTSTRKAAVISFTMDCAHPHDMATLLDRSGVCIRVGHHCAQPLMARLGVSATARASFALYNTRADVDAFVKALEKVRAFFA

SEQ ID NO: 55048 - protein, 239 aa, Oryza sativa Indica Group
MAVATLSSRSRRACAEAASVLLVLLVIAPSVAAGGDTNGVYEPCADAAVQRGDGFTFGVAFAARGDFFSGGVQLSPCDGRLSLASKGAKLAVFRPEVDEISLLTVNTSAAGGFDPLNIMKPLVFLIGHYFAMCQATSGGYMVAFAGRKYAARSPPVFVSNSSYTVTSFTLSCAISTANCTGKGGSVDCSPGIQLAFSGTDKHEAVLNSWYEVSKLRQYSLVGLFSNLKDSLTSQFSIFF

SEQ ID NO: 55049 - protein, 504 aa, Debaryomyces hansenii CBS767
MSNASLSWLTKLNTSETPDKVLRRSSIIGTIGPKTNNVDVLVKLRKAGLNIVRMNFSHGSYEYHQSVIDNAKQSEEIYKGRPLAIALDTKGPEIRTGTTIDDKDYPILPNHEMIFTTDEAYAKKCDDKVMFIDYKNITKVIEAGKIIYIDDGVVSFEVLQIVDDKTLKVRSVNSGKICSHKGVNLPGTDVDLPALSEKDKADIKFGVKNGVHMIFASFIRTGDDIKEIRKVLGEEGKDIQIIAKIENQQGVNNFDEILVETDGVMVARGDLGIEIPAPQVFVVQKQLIAKCNLAAKPVICATQMLESMTYNPRPTRAEVSDVGNAILDGADCVMLSGETAKGNYPFEAVSMMHNTAIIAEKAIAYQPLHNEIRSLANRPTPTTETCAMASVSAAYEQDAKAIVVLSTSGFTSRLVSKYKPNVPVMMVTRNHRAARYCHLYRGVYPFVYEKKTVDNWQEDVENRLRWAVSEAIDLGIIKKGDSIVTIQGWTRGSGHSNTVRVVQA

SEQ ID NO: 55050 - protein, 154 aa, Zea mays
MDEWVRQAEAWAGQAERWIRQQPPEQIYVAVAVIAVTILVLLAASCLKSSKSNTIVLSGLSGSGKTILFYQLRDGSSHQGTVTSMDPNNDTFVLHSELERKGKVKPVHVVDVPGHARLKPKLDEFLPRAAGVVFVADAQDFLSSMQAAAEHLYD

SEQ ID NO: 55051 - protein, 543 aa, Oryza sativa Japonica Group
MGWTTVAQLEVQTVSHQLRLGKRVQKLANLAFHRTNQGCADANTTRPDHLLLELPLLPLFPNFPNLASLLPRIPQPRIPIPPADRAATSPKIPRRIGLADGLIGDFDSAMEAQWLAEYPHQGADKRPRKRPRLAWDVAPPLFQPPKAIPMLYCGQELINGNFATAFLPPPPIYYTGPPRNLSPPWRPDDKDGHYVFAVGENLTPRYRILSKMGEGTFGQVLECWDLEHQETVAIKIVRSLQKYREAAMIEIDVLQRLGKHDFTGSRCVQIRNWFDYRNHICIVFERLGPSLYDFLRKNSYRAFPIDLVREFARQILESVAFMHDLRLIHTDLKPENILLVSSESIRVPDYKVTIRPPKDGSFFKNLPKSSAIKLIDFGSTTFEHQDHNYVVSTRHYRAPEVILGLGWNYSCDLWSVGCILVELCSGEALFQTHENLEHLAMMERVLGPLPKHMIVRADRRAEKYFRRGLRLDWPEGAASRESLKAVWKLPRLQNLVMQHVDHSAGDLIDLLQGLLRYDPDARLKAREALQHPFFTRCHRRCGY

SEQ ID NO: 55052 - protein, 1267 aa, Kluyveromyces lactis NRRL Y-1140
MSCAVQAAVVAMKDNSSHGQVPYRANNEHLNRVVQSVTDATKRLSQISTASSNANVNNTKTSKRRNRDTVGPWKLGKTLGKGSSGRVRLAKNMETGKLSAIKIVPKKFVKSNQIKQLPYGIEREIIIMKLISHPNVMGLYEVWENKSELYLVLEYVEGGELFDYLVSKGKLPESEAIHYFKQIVQAVAYCHGFNICHRDLKPENLLLDKKKRSIKIADFGMAALETSDKLLETSCGSPHYASPEIVLGRKYHGSPSDVWSCGIILFALLTGHLPFNDDNVKKLLLKVQSGKYQMPQWLSVEAKDLISRILVVDPNRRITIDQILQHELLTKYDQKSRSKSNSDLNLLNRTPNIVSFSSERDIDETILSNLQILWHGAARKHLVTRLMKPGFTEEKMFYSLLWNYQEKQQKSMQKDLIPVPTLKTSSASSVSPLNISSDVNSVTNTAKKQQQSSNGTVLPASMAPTISAFGQQISSDSSESSTLQAPKIHQKSHFSISSLKNGSSKSPKKTKQGFIASSSSSKLFQPNFGAKSSSQSISKSSSKKSLTPTTPKKRTLQNSASKRSLYSLQSISKRSINLNELLHDELQHEYPPPPLPSISSSEHTSSKLESIVDDYDRSTSVHGATMDNFLGESGQHMKAQQNEKLTQPSKNILAQPKLNNQPQTENRQSVTSMKRKTADNTIATVPVSMTPLKDMTNTFQSKSMYVSSLDPKRNKPKPSLENLLRKVSVPQRIKSRSTIRKLRDSGDWTVSGEAQALFGGKGSSEGENQLQRQKTNPSKLTAPETVLTTSTPMTDIKPDLLRMPSSLINSSMTFKDLSQFIMNIDEDKVPVTQASNPVNTDHEKLSENQTLMIENDSNRFETSSNYDDYNVNTAPAVTTAGDIDIFEDAPDDANESVTTSESMIDQSQLNLKKKAASIDSIDTSHVLTPATDVRVSLYINQMDKLDNLPRETTEQIISKFKLSPIKDIKQKRFSNGDRDLTITGSMISMFKDLDGDESRAEYDDNGLGLLGSALDTRPVENETNEDTNGTTVKRNSTVLVSSINGDNLDLSTEEQKNDDGNHGQGQTRRVTLLFDDGSSESEQVFKPVAAERRQPTLNANSTTTNNVGSKRKSNYINKLPKIKEDEVKPITSMKSSSPVNWFSKLLQRIKTSKPKRTVYEYRTSSIPFDNIHILLMTQFGKNGVDCELKKMERKGDKEYVTYDCNFGGIKRNRPKSKFTVEMRCMNGTETVLSLETRSKRFVNDKDTMASFERFNKDVAGAISAQEE

SEQ ID NO: 55053 - protein, 157 aa, Deinococcus radiodurans R1
MTQDTKTDFQKPSDNDLRERLTPIQYQVTQHEGTERAFTGEYWDHDEDGIYVDVVSGEPLFSSLDKYDAGCGWPSFTQPIPDVALTENTDYKIGYARTEVRSASADSHLGHVFPDGPRDRGGLRYCINSAALRFVPLSELDAQGYGQYRALFEGRQG

SEQ ID NO: 55054 - protein, 523 aa, Haemophilus ducreyi 35000HP
MNNIHNHKILILDFGSQYTQLIARRIREIGVYCELWAWDVTEKQIREFNPTGIILSGGPESTTETNSPHAPEYVFKAGVPVLGICYGMQTMAMQLGGLTEASEQREFGYAAVELQHADQLFAKLNDDLTASQPKLDVWMSHGDKVTRLPAGFQTTAVTPTCPIAAMSDEKRRFYGVQFHPEVTHTKSGLALLTNFVENICGCARSWTPENIIEDAVAKIKQKVGNDQVILGLSGGVDSSVTALLLHRAIGKNLHCVFVDNGLLRLNEGDQVMEMFGDKFGLNIIRVNAEERFLEALKGIDEPEAKRKIIGKVFIDIFDDEAKKLTDVKWLAQGTIYPDVIESAASKTGKAHVIKSHHNVGGLPDYMKLGLVEPLRELFKDEVRKIGLTLGLPAEMLNRHPFPGPGLGVRVLGEIKKEYCDLLRNADAIFIEELYKSGWYYKVSQAFTVFLPVKSVGVMGDGRKYDWVVSLRAVETIDFMTAHWAHLPYELLGKISNRIINEVNGISRVVYDVSGKPPATIEWE

SEQ ID NO: 55055 - protein, 519 aa, Kluyveromyces lactis NRRL Y-1140
MTEHIEISKETINALSDVLKQLAVIEPRSRDVNNQNDKVTKKSTSKQSQFSNKATFREYSQEYIDFTYENPTIYHVVKYFAKKLEENGFGYLSEKSSWSNVEPGHYYTTRNGTNLCAFAVGPEWKPELGVGIIGAHIDALTAKLKPSSKKPDVEGFELLGVAPYGGTLNELWLDRDLGIGGRVLIKDPDTGKISSHLCNSAPHPIARIPSLAPHFGAPSVGPFDKEDQTVPVIGYVGNGDYDDDDEDHDVEDEKKSPLYGKHSIHLLRYIAKLLSVKVSAITQFDLDLFDVQKGTFGGLKDEFIFVPRIDDRICSFSAINGLIEHKKTGHKKDGFNVAVLYDDEEVGSLTRQGAKGGLLESVVERIVASRGNDVSETRTAFANSIIISADVTHMLNPNFNSVYLENHKPKPNVGITLALDSNAHMATDVVGTALVEELGRLNGDKIQYFQIKNNSRSGGTIGPSLASQTGARTIDMGIAQWSMHSIRATTGSKDIGLAVKFFNGFYNDWNQVYQSFGDL

SEQ ID NO: 55056 - protein, 249 aa, Variovorax paradoxus
GGNKPRKLEYLIPEALEGGYDTLVSIGGIQSNQTRQVAAVAAHLGLKCVLVQENWVNYSDAVYDRVGNIEMSRIMGADVRLDSAGFDIGIRKSWEEAMDDVRKAGGKPFPIPAGCSEHPRGGLGFVGFAEEVRQQEAELGFKFDYIVTCSVTGSTQAGMVVGFAADGRADRVIGIDASAKPEQTFDQIVRIAKGTAEPVELGRDITDKDVVLDRRFGGPEYGLPNEGTLESIRLCARLEGMLTDPVYPG

SEQ ID NO: 55057 - protein, 281 aa, Pericallis appendiculata
  misc_feature (281)..(281): Xaa can be any naturally occurring amino acid
PKSQITPYRVVIIIRLVILGLFFHYRITNPVESSYGLWLTSVICEIWFAFSWVLDQFPKWYPINRVTFTDELSARYEKEGEPSQLAAVDFFVSTVDPLKEPPLITANTVLSILAVDYPVEKVSCYVSDDGAAMLSFESLVETAEFARKWVPFCKKFSIEPRAPEFYFSQKIDYLKDKVQPSFVKERRSMKRDYEEYKVRVNALVAKAQKTPEEGWTMQDGTPWPGNNPRDHPGMIQVFLGNSGAHDIEGNEIPRLVYVSREKRPGYQHHKKAGAENALVRX

SEQ ID NO: 55058 - protein, 199 aa, Pyrobaculum aerophilum str. IM2
MSSKGPSYRIENIVATVNLGVELDLEQLAERLTMAEYNPDQFPGLILRLTKPRISALIFRTGKMVCTGAKNEEDLKNAVRALVKLLKDHGADVPFDPEVQIQNIVASGNLHAEVDLEQAVLMLENAMYEPEQFPGLIYRMSSPRVVILIFGSGKIVCTGAKSEKDVATAVQKLYNQLKELGVLYVEEGGEELEEFEEEL

SEQ ID NO: 55059 - protein, 437 aa, Actinobacillus pleuropneumoniae serovar 1 str. 4074
MGIYAYICFLSALSILLGFITSKISAKVQSTIAISAAAMVCSLLVWILGSLGLFNIDTMAKEVMEQIDFKSFLLNGILGFLLFAGSLGVKLPILKDQKWEITVFALFSTLASTFFIAGLIYAVSHLIGLPIDFIYCIVFGALISPTDPIAVLAIIKNLRAPKRLSMQVEGESLFNDGVGLVIFITVFTIAFGGKETGFSDIMGLFLHEAIGGILFGFVLGFIAHILISSTDDGSMEMLITLTIPTAGFMFASNVLHVSGALAMVVAGIMMGNWTRHSGFSEQSQRYLDHFWEMIDHFLNSLLFFLIGFALLLVDFNIYGVILMIAAIPICLISRYFSLWIPFKLMQQFRTYNPYTLKIMSWGGLRGGLALAMALSIPSKVVFVEDIDVKDLILVMTYAVVMFSILVQGSTIEPMIRKAKTVDPNREEYLKPSGHSLH

SEQ ID NO: 55060 - protein, 279 aa, Pericallis appendiculata
  misc_feature (9)..(11): Xaa can be any naturally occurring amino acid
TPYRVVIIXXXVILGLFFHYRITNPVESSYGLWLTSVICEIWFAFSWVLDQFPKWYPINRVTFTDELSARYEKEGEPSQLAAVDFFVSTVDPLKEPPLITANTVLSILAVDYPVEKVSCYVSDDGAAMLSFESLVETAEFARKWVPFCKKFSIEPRAPEFYFSQKIDYLKDKVQPSFVKERRSMKRDYEEYKVRVNALVAKAQKTPEEGWTMQDGTPWPGNNPRDHPGMIQVFLGNSGAHDIEGNEIPRLVYVSREKRPGYQHHKKAGAENALVRVSAV

SEQ ID NO: 55061 - protein, 185 aa, Coccidioides immitis RS
MGGQVSKLMGKIFGSKEMRLLMLGLDAAGKTTILYKLKLNQDVTAIPTVGFNVESVTYKNVKFNVWDVGGQDKIRPLWRHYFTGTQGLIFVIDSNDRSRIEEARQELHRIILDREMKEALLLVFANKQDIKGAMDPKEVTEKLQLNQLKDRIWFVVPSCATTGEGLFEGLAWLSNNVKSQQQRQG

SEQ ID NO: 55062 - protein, 279 aa, Pericallis appendiculata
  misc_feature (9)..(9): Xaa can be any naturally occurring amino acid
  misc_feature (11)..(11): Xaa can be any naturally occurring amino acid
TPYRVVIIXRXSILGLFFHYRITNPVESSYGLWLTSVICEIWFAFSWVLDQFPKWYPINRVTFTDELSARYEKEGEPSQLAAVDFFVSTVDPLKEPPLITANTVLSILAVDYPVEKVSCYVSDDGAAMLSFESLVETAEFARKWVPFCKRFSIEPRAPEFYFSQKIDYLKDKVQPSFVKERRSMKRDYEEYKVRVNALVAKAQKTPEEGWTMQDGTPWPGNNPRDHPGMIQVFLGNSGAHDIEGNEIPRLVYVSREKRPGYQHHKKAGAENALVRVSAV

SEQ ID NO: 55063 - protein, 274 aa, Coprinopsis cinerea okayama7#130
MNNETPEMPAHTEAIYYLIEILNDAGFRSDGRRQYELRDLSIDLSRHGEADGSALISHGLTQVLVSVHGPREAKMRSHTFHDRANINVEVTVASFSTGERRKRLKGDKRILEFAATIKSTFEPVVRTSLYPRSQIDIYIQILQQDGGTLQTCINGTTLALINAGIPMSDFVCAISGGVHSTSPMLDLTTLEENDVPHVTVAVMPKSKKVVLVTMETRLHVERFEEVLCLARDAAAVLHKEMKEAVLGRSEGLIKMGEVAIGQKGRGEDDMVLDS

SEQ ID NO: 55064 - protein, 418 aa, Kluyveromyces lactis NRRL Y-1140
MRIPTRRGLSALSRVTRAPADKILGLTEKFNVDRHPNKINLTVGIYKDNRGRVTTFPSVASAQSLLETSLDLNNDLSYLPITGSQDYQNNVLNFLYRESSDGSELLENNRITFVQTLSGTGALAVASKLLATFVSKTVWIPNPSWANHSNVFQWNGFNQIKYYTYYEDGKLSIDKWLKELKESCSSRDPDWPPSIVLHACCHNPTGVDPTLEQWQQILPVIHDLGITPIIDMAYQGMESGNLIQDAYLLRMCLEYEWPNGLFVCQSFAKNMGLYGERVGSLSVVVPPNPLDLKSTIDSQLKKIVRGIYSSPPGYGSRVANLVLSNPKLKQQWFVDVKNMSDRLWNVRIQMHERLNWPNLVDFKTQHGMFYYTGLNPYQVQILQERYGIYLTEDGRMSLSGVNDGNIDYLCDSLRQVVQ

SEQ ID NO: 55065 - protein, 284 aa, Pericallis appendiculata
PKSQITPYRVVIIIRLVILGLFFHYRITNPVESSYGLWLTSVICEIWFAFSWVLDQFPKWYPINRVTFTDELSARYEKEGEPSQLAAVDFFVSTVDPLKEPPLITANTVLPILAVDYPVEKVSCYVSDDGAAMLSFESLVETAEFARKWVPFCKKFSIEPRAPEFYFSQKIDYLKDKVQPSFVKERRSMKRDYEEYKVRVNALVAKAQKTPEEGWTMQDGTPWPGNNPRDHPGMIQVFLGNSGAHDIEGNEIPRLVYVSREKRPGYQHHKKAGAENALVRVSAV

SEQ ID NO: 55066 - protein, 384 aa, Actinobacillus pleuropneumoniae serovar 1 str. 4074
MKPQQLATQKFSEHYGYSAAQTVFAPGRVNIIGEHTDYNDGFVMPCAINYGMAVSFSKRDDSVWRVYAIDIDEQDEFDLSRPIEPSEHKWANYVRGVVKYIQEKCPEFKQGADLAMTSDVPMSSGLSSSAALEISIGKTAQVLGDLPLGLAEIALIGQQAENKFVGANCGNMDQLTSALGQKDQVIMIDCRSLEITPTPVPHGYSIAIINSNVKHDLVTGEYNSRRQECEFAARFFGVKALRDVTPEQFIERAAELQAENELAYKRAKHIISENQRVLEAVEALKANDMVKLGQLMAGSHDSMRDDFEITIPEIDYLVELAQIAIGKNGGARMTGGGFGGCIVCLVPDGKVEHLRRIIADNYEKQTGIKETFHLCTACDGVHLI

SEQ ID NO: 55067 - protein, 345 aa, Arabidopsis thaliana
MASSTGEKGLIVSFGEMLIDFVPTVSGVSLSESPGFLKAPGGAPANVAIAVSRLGGRAAFVGKLGDDDFGHMLAGILRKNGVDDQGINFDEGARTALAFVTLRSDGEREFMFYRNPSADMLLRPDELNLELIRSAKVFHYGSISLITEPCRSAHMKAMEVAKEAGALLSYDPNLREPLWPSPEEARTQIMSIWDKADIIKVSDVELEFLTENKTMDDKTAMSLWHPNLKLLLVTLGEKGCTYFTKKFHGSVETFHVDAVDTTGAGDSFVGALLQQIVDDQSVLEDEARLRKVLRFANACGAITTTKKGAIPALPTDIEALSFLKDQKKRQTNLKFSKWCCTASPC

SEQ ID NO: 55068 - protein, 563 aa, Clostridium acetobutylicum ATCC 824
MSKVIYKISIDLGGIVKRNFEKETKNCGKVNEEVLFKILKSNDKSEIGIKFKFKDIKSIRQFKDSVPITEYKDYEKYINRMADGEGNVLMSEKVEYFGHTSGTTGKQKLVPCTKNSRRRASKYMALLVNRFCYDNFKENWNYARGMMIADIVMTTYTKGKIPICSATSGGMKGIKHLLPYLYTSPIEVMEIKDKETALYLHLLFGLEEEELLYISGVFISNILDLFRTLEKNNKALVRDIQKGSISEELNIDEGLRKVLNKKLKPNNKRAMELEKEFKKGFKGIAKRIWPNLLYIASVTGANFSIYNDKVYYYIDSIPIYSAAYGSTEAMIGINPYASKVLYVITPSAVFYEFIPIGEKGEESFDTLLLSELKLGGRYEVVITNYAGLYRYKIGDVVKVVGFYNKCPEIEFLYRKNQVLNMAAEKTNEEHLTYAIKNTIKKLNLDLVDYTTEPDNSITPGRYIFYFEFRNNMYGFSTEKLQNILDDELRVSNLAYNRARNNKKLGMLKVEVLAPNTFDLIKEALFNKGISKNQIKIPRVIINNKIVMDIINRNKIKFVKKSVI

SEQ ID NO: 55069 - protein, 284 aa, Pericallis appendiculata
PKSQITPYRVVIIIRLVILGLFFHYRITSPVESSYGLWLTSVICEIWFAFSWVLDQFPKWYPINRVTFTDELSARYEKEGEPSQLAAVDFFVSTVDPLKEPPLITANTVLSILAVDYPVEKVSCYVSDDGAAMLSFESLVETAEFARKWVPFCKKFSIEPRAPEFYFSQKIDYLKDKVQPSFVKERRSMKRDYEEYKVRVNALVAKAQKTPEEGWTMQDGTPWPGNNPRDHPGMIQVFLGNSGAHDIEGNEIPRLVYVSREKRPGYQHHKKAGAENALVRVSAV

SEQ ID NO: 55070 - protein, 440 aa, Tuber borchii
MITKIHARSVYDSRGNPTVEVDLTTTDTGLHRAIVPSGASTGQHEAIELRDKDKTKWAGKGVLKAVENVNTIIAPALIKEKFDVKDQATIDKFLIDLDGTPNKAKLGANAILGVSLAVAKAGAAAKKVPLYAHVADLAGTKKPFVLPVPFMNVINGGSHAGGRLAFQEFMIVPSEAPSFTEAMRQGAEVYQILKTLTKKKYGQSAGNVGDEGGWPDIQTVEEALDLITDAIDKAGYTGQIKIAMDVASSEFYKEDAKKYDLDFKNPDSDSSKWLTYQELADLYKSLAQRYPIVSIEDPFAEDDWEAWAHFYKTSDFQIVGDDLTVTNPIRIKRAIDEKSCNALLLKVNQIATLTESIQAAKDSYSAGWGVMVSHRSGETEDVTIADIVVGLRAGQIKTGAPARSERLAKLNQILRIEEELGEQAIYAGTSSEPPHLYIFI

SEQ ID NO: 55071 - protein, 699 aa, Pseudomonas fluorescens PfO-1
MQTFFIAPTDFGVGLTSISLGLVRTLERAGLKVGFFKPIAQPHPGDTGPERSTELVARTHGLKPPQPLGLAHVERMLGDGQLDELLEEIITLYQQAAIGKDVLVVEGMVPTRSASYAARVNLHLAKSLDAEVILVSAPENEVLTELSGRVELQAQLFGGPKDPKVLGVILNKVKTDESMDAFAARLKEHSPLLRTGDFRLLGCIPFQPELNAPRTRDVADLMGAQVLNAGDYETRRMTKTIICARTMRNTVDLLKPGVLVVTPGDRDDIILAVSLAAINGVPLAGLLLTSDTLPDPRIMDLCRGALQAGLPVLSVSTGSYDTANLLNGLNKEIPVDDRERAEIITDFVASHLDANWLHQRCGTPREMRLSPAVFRYQLIQRAQAANKRIVLPEGSEPFTVQAAAICQERGIARCVLLAKPADVEAVARAQGITLPPGLEILDPDLIRERYVEPMVALRKSKSLNAPMAEQQLEDTVVIGTMMLALDEVDGLVSGIINTTANTIRPALQLIKTAPGCTLVSSVFFMLFPEEVLVYGDCVMNPHPSASELAEIALQSADSAAAFGITPRVAMISYSSGESATGEEVEKVREATLLAHEQQHSLLIDGPLQYDAAANETVARQLAPNSQVAGRATVFVFPDLNTGNTTHKAVQRSADCVSLGPMLQGLRKPVNDLPRGAQVDDIVYTIALTAIQAANRPLDI

SEQ ID NO: 55072 - protein, 333 aa, Triticum aestivum
  misc_feature (186)..(186): Xaa can be any naturally occurring amino acid
  misc_feature (194)..(194): Xaa can be any naturally occurring amino acid
  misc_feature (200)..(200): Xaa can be any naturally occurring amino acid
  misc_feature (222)..(222): Xaa can be any naturally occurring amino acid
MVKICCLGAGYVGGPTMAVIALKCPDIQVVVVDITKSRIDAWNSDTLPIYEPGLDEVVKQCRGKNLFFSNDIEKHVSEADIIFVSVNTPTKTRGLGAGKAADLTYWESAARMIADVAKSDKIVVEKSTVPVKTAEAIEKILTHNSNGINFQILSNPEFLAEGTAIQDLFNPDRGLIGGRETPQGQXKAVQTLKXVYAHWXVPEDQIPTTNLWSAELANLAAXNAFLAQRISSVNAMSALCEATGANVSEVSYAVGKDSRIGPKFLNASCWDLGGSLLPEGISLTRFKFSECQGPPTGPQTSGTRCARSQYYQKERSVNRGSSPYVPHGVQPRR

SEQ ID NO: 55073 - protein, 117 aa, Picea sitchensis
MRKANACVYVCVLLVLIAALEWQVVLSTDQGINGSGVTTVHPASSPSPSPAPAPPLIDCKSECDRRCKVAPRQKACLKFCGICCNACKCVPSGTRGNKDECPCYRDKRSSQGKPKCP

SEQ ID NO: 55074 - protein, 337 aa, Oryza sativa
MGKPGKLALPSHESTIGKFLTQSGTFKDGDLLVNKDGLRIVSQSEEGEAPPIEPLDHNQLSLDDLDAIKVIGKGSSGIVQLVRHKWTGQFFALKVIQLNIQENIRRQIAQELKISLSTQCQYVVACCQCFYVNGVISIVLEYMDSGSLSDFLKTVLKGLMYLHHEKHIIHRDLKPSNILINHMGEVKISDFGVSAIIASSSAQRDTFTGTYNYMAPERISGQKHGYMSDIWSLGLVMLELATGEFPYPPRESFYELLEAVVDHPPPSAPSDQFSEEFCSFVSACIQKNASDRSSAQILLNHPFLSMYDDLNIDLASYFTTDGSPLATFNTSNRYDDR

SEQ ID NO: 55075 - protein, 141 aa, Glycine max
MASPPHFDEDFDFGGGFSGTHSGNKRSSPDYDEDEYENDPFGHKKAKSKAEEAASGVTTGMILSLRESLQNCKDMLVTCQNELEAAKSEIQKWHSSFQNEPFIPAETTPAPKLVINYLQALKSSEESLREQLEKAKKKEAA

SEQ ID NO: 55076 - protein, 1003 aa, Chlamydomonas reinhardtii
MPLAGVGSEAGSLQQQSSMMKNASDPSLRSTSSSFADLAETAAFGRHQFQRHEEQDIFSAVGGMELGVDADLDSLGADIASTSGHEPHSEPSRTLFVRHINPTASDEELLAMFKVFGDVRHMYMVSKHRGFIMVTYFDLRAAARAQAALHGAPITSLPLDIHFCAPKGDPTVSQGTVSLFNLDPDTSNDHLVWLFSKFGDVKDIRESPDRRSQKFITFYDTRHALAALRAMNKAEHLGKLPSNITPQLAASLSQMTMHDTSAGGEAAQLAASKSHPSRASSQPGTTSPSPLPGTSPAGPPFMSAQARTDMHQVSPQVAAGLRSGMHVSDSASSMSGSVSGQAAATSQLLAAAAAAAGRSPLGMQGPHGLHGPHGPHGHAHAHMHKVVPSLATLSEAQALDDPTAGLYAAAAAAAAAGSMGSMLTGSGAGSGVGLDQSSGGSSAADVNATANMLMGLQLSAAAAGQVSASPEQQLWALQQMAASGGAGQGQGPMWGAGGAMYNQQAAHGAAAAAAAAANLQALRNLQELQARQQQQQQQQQQQLAMAANLATLQGQALSAAELNAAAAQLLHIAGLGQALGPAGGAGAPFGGAGGLGALGALGGLGAGGAGGLGANAAAAQQLLQQAMAMGNVNALSALGNMQAAALAAGVGAGGRLGGSFGALAGLAGVHGHPGGPGAAGRDAAANSRGGGRLSRRTTDPAAEMERKMQQEKLYALDAVKIRSGEDKRTTLMIKNIPNKYTQKMLLATIDEQFRGTYDFFYLPIDFKNKCNVGYAFINMINPFDIIALVERFNNRRWERFNSEKVCSISYARIQGRAALVAHFQNSSLMHEDKRCRPILFTANGTETTDPEAFQNDPSLQPPHHGMGGPGGPGGSSSSLPHHNAGGMAGSSLSGAGGSSASLGSMHSAAAGATSPPTGGAGTSLGGMSASSAAAAMAGPARIRAAAAAVAAAGASGGMLVGMGGHGGGHGHANLGGSSQGQLNLDMLSGMAHHGAHGGTGGGS

SEQ ID NO: 55077 - protein, 151 aa, Glycine max
  misc_feature (114)..(114): Xaa can be any naturally occurring amino acid
GGGPLTKVLKKKWTREGGRPFVFPVGGQTFWEPGGILKPDRKMDQKIKKGPGMAKLEDLVVVGGRGGPMAGLQLEPQWMAWKEGVHAFFVGKDQNSFTTFVKGWLDELKVAVGXKNMANIKNPRGLGYARIPSKELNLEKKMAAPTGVVLD

SEQ ID NO: 55078 - protein, 158 aa, Glycine max
MATIVSIKARQIFDSRGNPTVEVDLTCSDGTFARAAVPSGASTGIYEALELRDGGSDYLGKGVSKAVDNVNTVIGPALIGKDPTEQTAIDNLMVQQLDGTVNEWGWCKQKLGANAILAVSLAVCKAGASVLKIPLYKHIANIAGNKKLVLPVPASMSW

SEQ ID NO: 55079 - protein, 368 aa, Oryza sativa Indica Group
MDEKVKMESKLSSAAAFVEGGVQDACDDACSICLEAFCDNDPSTVTSCKHEYHLQCILEWCQRSSQCPMCWQPISMKDPMSQELLEAVEQERNIRANRLNTAAVFHHPVLGDFEVPVGADDAELEERIIQHLAAAAAMRRSHRHGRRDGHRSRSGSHSRPQIVVFSRNEAIPGGSLHASSGQDEDHEQSSDLGSAHPFAALAAIDQGHMGGGSQLYVGHSDQGASNPSLHDERAMSRYKDSITKSTRGWKERWFSRSNTISGLGTEVRREVNAGIAAVSRMMERLETKDDTGPSAVPAASACSPSDANNQRTDLALNEPTPCSLKNWIHCEDRKFAEAFASRSRDIRLVLADEPLHFFTLCNIYARLL

SEQ ID NO: 55080 - protein, 573 aa, Cryptococcus neoformans var. neoformans B-3501A
MSSSNSTVRVALRGGAILNNPRFNKGSAFTHQERSEFALRGRLPYAVDSLEIQVKRAYEQYKSRETNILKNSFLQSMKAQNWTLFYALLQAHLVEMFPIVYTPTEADAIADYSHLFRRSEGLYLTPPGEKNMEEDFLDACEGRELELIVVSDGEAILGIGDQGSGGIGISGAKAVIYSLIAGVDPAKCLAITLDVGTNNQDLLNDPLYIGYREKRLRDDPYDQFVDKFVGLVKKHQPECLLHFEDFGVTNAERLLRRYRDQHSIFNDDIQGTGAVTLAAVQAAISVTKSSLKDQRIVIYGSGSAGLGIARQLRDAIALDSSGSPSEAAKQFWLIDKHGLIKKSLGKDKIRSEIEDEFIRDEGDWGEGETGLKEVVKKIKPTILVGTSTQAGAFTEEVVKEMSKHVDRPIIFPLSNPTRLCEAQPKDVSEWSKGKALMSTGSPFDPVDISDSGEKYIVAECNNALIYPGLGLGSILAKSSKMTDKMIIAGAQRLGQLAPALVKKNANKSLLPDFGDAQKVNFEVALAVLEQAMEDGVARAKDIPEDKDERRKWAENNRWSPGYPNFKYDPEGLK

SEQ ID NO: 55081 - protein, 198 aa, Candida glabrata CBS 138
MVAQVQKPAPTFKKTAVIDGMFEEVSLDKYKGKYVVLAFVPLAFTFVCPTEIVAFSEAAKRFEALDAQVLFASTDSEYSLLAWTNVARKDGGLGPVDIPLLADTNHKLSRDYGVLIEDEGIALRGLFIIDPKGIVRHITINDLPVGRNVEESLRLVEGFQWTDKNGTVLPCNWTPGSATIKPTVEDSKEYFKEANSKN

SEQ ID NO: 55082 - protein, 281 aa, Pericallis appendiculata
QITPYRVVIIIRLVILGLFFHYRITNPVESSYGLWLTSVICEIRFAFSWVLDQFPKWYPINRVTFTDELSARYEKEGEPSQLAAVDFFVSTVDPLKEPPLITANTVLSILAVDYPVEKVSCYVSDDGAAMLSFESLVETAEFARKWVPFCKKFSIEPRAPEFYFSQKIDYLKDKVQPSFVKERRSMKRDYEEYKVRVNALVAKAQKTPEGGWTMQDGTPWPGNNPRDHPGMIQVFLGNSGAHDIEGNEIPRLVYVSREKRPGYQHHKKAGAENALVRVSAV

SEQ ID NO: 55083 - protein, 242 aa, Campylobacter lari RM2100
MSEIYILGNGAMASAIAKGIGDAYEVIIVARDLKKASSLNFKVISYNEFDMDNKNIILAFKPYALEEVAVKLKGKARWLISVLANTTFEQLHCIDAQNYIKIMPNTAAQFKASATAYLMENDLYKDEILSLLSTFGKAISLQNEKEFDIAMVLSGCAPAFLALVAESLANAGVKNGLKNELSYELTRASFESFGALFNHIHPAIIKEKICSPAGVTIRGVEALEKRALRGAFFEAFNASLNK

SEQ ID NO: 55084 - protein, 180 aa, Triticum aestivum
MAGAASSVAPVLVICLLSLALFLHRCRSCEAVERERTLAMIKPDGLSGNYKEKIKEAILGSGFDIIEEAVVHLDAERASLFYAEHADRSFFNSLVKYMTSGPVCAMVLESPDAISRWRNLIGPTDARKAKTSHPDSIRAMCGLDSEKNCVHGSDSPQSAAREISFFFRDDKSEALEHDEL

SEQ ID NO: 55085 - protein, 673 aa, Desulfitobacterium hafniense Y51
MTMDFASTPIWAVLAGLVGLAFAFYFASSVLKESPGNARMQEISLAIQEGAMAFLNRQYKTLIPFVIIIFLILTFLKGWQTAVSFLVGALLSAVAGYVGMGITTRANARTTEAARTSLNKALGVSFRAGAVMGLSVNGLGLIGVAALFLWFQDAETINSFAFGASAIALFARVGGGIYTKAADVGADLVGKVEAGIPEDDPRNPAVIADNVGDNVGDTAGMGADLFESYAATTIAAMLIGAVAFKSLGGGVSGLMLPLMIGIAGILSSIIASFFVRTGENANPQTALNKGLWGTNLLTAIASYAIVQLMITEPVHVSESLTLTANNIFIAIVCGLVVNILIGLLTEYYTSNQKAPAQAIAKASETGAATNIIQGLATGMKSTALPVVVICVATYVSFAAAGIFGIAMAAMAMLSTAGMVVAIDSFGPVADNAGGIAEMADLDPSVRKTTDKLDSVGNTTAAVAKGFAIGSAALTALALFNAYSELAHLDRIDILVPTTIIGLFIGAALPFLFSAFAMEAVGKAAFEMIGEVRRQFREIPGLMEGKAKPDYRACVDISTKAAIRQMIVPGLLAIGSPILVGFLLGKDALGGMLAGGTVSGLLMAIFMANAGGAWDNAKKYVEAGNLGGKGTPTHAAAVIGDTVGDPFKDTAGPSLNALIKVMGTISLIIAPLLI

SEQ ID NO: 55086 - protein, 392 aa, Roseovarius nubinhibens ISM
MFPERFSTLPEYAFPRLRALLDVHEAGGEPVHMTIGEPKHAFPAWVTDVIAKHAEGFGRYPVNEGIPELRAEIAAWIARRYGVTVDAEREVMALNGTREGLYNAMMALCPEAKGSARPKVLIPNPFYQVYMVGALSVAAEPVFLNATAETGFLPDFGAVAPEVLDQVAVAYLCSPSNPQGAVAERSYWEHLIGLAEKHDFYIFADECYSEIYRGEAPVGALQVAREMGADPERVVIFHSLSKRSNLPGLRSGFVAGGPKSITRIRQLRNYAGAPLPMPLQHAAAAVWADEAHVIENRAAYGEKYALADEIMADFPGYQGPQAGFFLWLPVEDGQAAALKLWTETGVRVLPGAYLSRDTDGGNPGKHYIRAALVAPKDEMAQGLIRLRDCLQR

SEQ ID NO: 55087 - protein, 425 aa, Desulfitobacterium hafniense Y51
MSYIEEIYGREILDSRGNPTVEVEVLLEDGSMGRAAVPSGASTGAFEAVELRDGDKGRFLGKGVLQAVANVNEVIAPELEGLNPFDQPAIDRELIALDGTENKGKLGANAILGVSLANAKAAAECVGLPLYQYLGGVNAKELPVPMMNILNGGQHADNNVDIQEFMIMPVGAKSFAEALQMGTEVYHSLKAVLKEKSLATAIGDEGGFAPSLESNADALLAIMDAIQRAGYTPGKDIALALDVAATELYRDGKYHLEGEGLTKTADEMIAYYEDLVEKYPIVSIEDGLSEEDWEGWKKLTEKLGSKIQLVGDDLFVTNPARLARGIKEKCANSILIKLNQIGTLTETLDAIEMAKRAGYTTVISHRSGETEDVTMAHVAVAVNAGQIKTGAPARTERVAKYNELLRIEEELGETGVYPGHEALGR

SEQ ID NO: 55088 - protein, 510 aa, Desulfitobacterium hafniense Y51
MKPLLLMILDGWGYNPQSAGNAVAKAPKPHFDRLLEEYPHTLIVASGEEVGLPPGQMGNSEVGHLNIGAGRVVYQEFTRISQAIRTGEFARNRVLQEAMERVKDGPNALHLMGLLSDGGVHSHSEHLFALLAMAKTMGVKKVFIHALLDGRDVLPQSAKGFMTQLNSKCRELGLGQVATVSGRYYMMDRDKRWERVEKGYRALVNGEGLKAPNSLAAIEQSYDVRVTDEFVAPTVIVDSAGEAVGPLRDGDSFIFFNFRSDRAREISYALLDEEFTGFDRGKPLQLHYVCMTEYDDKLKGAAVAFPAQNLDNTLGEVLAKHQKKQLRIAETEKYAHVTFFFNGGVEEPCPGETRCLIPSPQVATYNLLPEMSAYGITEELLKRLEREEDEVIILNFANADMVGHTGEFEATVKAIAAVDQCIGQIVPRVLERQGTVIITADHGNAEAKVDLQTGQPLTAHTTNPVPLILVNDQLKGKTLREGGALRDVAPTMLRLLEIPQPQEMTGKSLI

SEQ ID NO: 55089 - protein, 261 aa, Desulfitobacterium hafniense Y51
MKGAHFMAKRHPIIAGNWKMNKSLRETQEYAVKLLGVLGEVTAIDVVVCAPFTALNVLKNELEESVIHIGAQDMFYAPDGAYTGEISAAMLVDVACTYVILGHSERREILRETDEEIAKKVKAALKAGLTPILCVGENLANREEGKAFAIVRGQVEKDLTDLAPDDLKRVVIAYEPIWAIGTGKTASSEDAQEMCAMIRSTLAGIAGVVADEVNILYGGSVKADNIGELMSQPDVDGALVGGASLEAEGFAQLVQNAVAVL

SEQ ID NO: 55090 - protein, 395 aa, Desulfitobacterium hafniense Y51
MMNKKGLKDIAVQGKRVFVRVDFNVPMDDHGNITNDTRIRAALPTIDYLIDEGAKIILASHLGRPKGKPDPNYSLAPVAKRLGELLKRPVAMATDCIGPEVEKAAAQLQEGEVLLLENVRYHAEEEKNEPEFVKQLARLAEVYVNDAFGTAHRAHASTEGIAHHLPGVAGFLLQKEIESMGKALENPERPFVAIIGGAKVSDKIGVIENLLHKVDALIIGGGMANTFLKAQGYSLGKSLVEGDKLSLAQEILEQGRELQVDILLPQDVVAAKEFKADAPYRVTPVREIAEDEMALDIGPESAGLFSARIQKARTIVWNGPMGVFEMEQFAKGTEKVAQAVALCPGLTIVGGGDSVAAVEKMGVGEQMSHISTGGGASLKLLEGKTLPGIAALQNI

SEQ ID NO: 55091 - protein, 144 aa, Glycine max
  misc_feature (99)..(99): Xaa can be any naturally occurring amino acid
MGSAASPPRALDAATQEDLKRVSTHRAVYMVESGMTLGLDTCSTARHTLDCLESTLRTGALCSLSGEPTSLKTEAHTARDGIPLLALGNTNQIQLSVEXAHEVDAKLNLPKGHGGSLLHQNMIEGDGAHYAIMFDNPKHQPRVL

SEQ ID NO: 55092 - protein, 136 aa, Coprinopsis cinerea okayama7#130
MSGKGKAGKSSGGKAGGDNKSQSRSAKAGLQFPVGRVHRLLKKGNYAQRVGAGAPVYLAAVLEYLAAEILELAGNAARDNKKQRIVPRHLQLAIRNDEELNRLLGDVVISQGGVVPHIAAELLPSKSSRGKKDEEA

SEQ ID NO: 55093 - protein, 507 aa, Roseovarius nubinhibens ISM
MCATSHPLAAQVAVSILQDGGNAMDAAIAGAVLLGLCEPQMTGLGGDCFVLWGRPGEAIKGYNGSGRAPAALDAADLRARGLKTVPLQEVEAVTIPGAVEAFCSLAETEGKLGIDRLLAPAIRYFDEGVPVASRVAFDWPIAASALKGHGKTHFLNNGQPYREGEIFKSAGQAEALRHVARSGRAGFYEGPVAEDMVAALRAAGGVHTLDDFANHRGNDTTPISGQYKDHEIVEHPPNGQGATGILMANILSRFDIAGMDPWGAERAHIEAEAAKLAYDARDRIIADPDHTARVQFMLSEDLANGLAALIDPTRAMTHVSRLTEAVHKETIYITVIDRDRMAVSLIYSTFHGFGAGLASETFGIGFQNRGAGFTLAEGHPNELKGGKRPMHTIIPGVLRNAGGMVMPFGVMGGAYQPNGHARLVSNLLDFDMDIQAAIDAPRAFAAGGKMQVERGYDDSVRAKLADMGHEVEIPETAIGGAQAIVARPDGLLIGGSDPRKDGCALGY

SEQ ID NO: 55094 - protein, 158 aa, Picea sitchensis
MARECKVSLKSSDDELFDVNEAVAFESQTIKNMIEDTGTASAIPLPNVSSKILSKVIEYCKYHVEAQKPADEKSAISEDEIKTWDQEFVKVDQATLFDLILAANYLNIKNLLDLTCQTVADMIKGKTPEEIRKTFNIKNDFTPEEEEEVRRENQWAFE

SEQ ID NO: 55095 - protein, 727 aa, Oryza sativa
MAQHTAAAAGGDEEVAEAEAAAAAAAGSTLRHRHAGKGAEEHEAAGGGGGGRNGGADDPDATSVERVFADKAVPSWREQLTLRAFVVSALLAVMFSVIVMKLNLTTGIIPSLNVSAGLLGFFFVRLWTSAVERIGLLKQPFTRQENTVIQTCVVSAYGIAFSGGFGSYLFGMSETIAKQATEAKDAQNIKDPHLGWMIGFLFLVSFIGLFALVPLRKIMIVDYKLTYPSGTATAYLINGFHTPEGAKLAKKQVKTLGKYFLFSFFWGFFQWFYTAGDDCGFKNFPTLGLEAYNNRFFFDFSPTYVGVGMICPYIVNVSVLLGGILSWGVMWPLIAKKKGSWYPADISDNSLHGLLPLQVFISIALILGDGLYNFLKVLIRTLAGFISMVQNNSKGMLPVSDNGMSMSTAEEVSFDDERRTEIFLKDQIPKSVAYGGYVVVAALSIGTLPEIFPQLKWYYILVAYIVAPVLAFCNAYGSGLTDWSLASTYGKLAIFVFGAWAGLSHGGVLVGLAACGVMMSIVSTASDLMQDFKTGYLTLASPRSMFISQVIGTGMGCVIAPCVFWLFYKAFSNIGTSGTEYPAPYAIVYRNMAILGVDGFNSLPENCLTLCYIFFAAAIAINLIRDLAPHKVSRFIPLPMAMAIPFYIGSYFAIDMFLGSVILFVWEKLNKAKADAFGPAVASGLICGDGIWTLPQSILALAKVKPPICMKFLSRAANAKVDSFLAG

SEQ ID NO: 55096 - protein, 362 aa, Sorghum bicolor
MGSTAEDVAAVADEEACMYAMQLASSSILPMTLKNALELGLLEVLQKDAGKALAAEEVVARLPVAPTNPAAADMVDRILRLLASYDVVKCQMEDKDGKYERRYSAAPVGKWLTPNEDGVSMAALALMNQDKVLMESWYYLKDAVLDGGIPFNKAYGMTAFEYHGTDPRFNRVFNEGMKNHSVIITKKLLEFYTGFDESVSTLVDVGGGIGATLHAITSHHSHIRGVNFDLPHVISEAPPFPGVQHVGGDMFKSVPAGDAILMKWILHDWSDAHCATLLKNCYDALPEKGGKVIVVECVLPVTTDAVPKAQGVFHVDMIMLAHNPGGRERYEREFRDLAKAAGFSGFKATYIYANAWAIEFIK

SEQ ID NO: 55097 - protein, 511 aa, Zea mays
  misc_feature (415)..(415): Xaa can be any naturally occurring amino acid
MEAPSLTKPNDPTKPSNTSSTLSLEGGPGEASPLRKMFAVASIAAGIQFGWALQLSLLTPYVQLLGVPHAAASFIWLCGPISGLVVQPIVGYYSDHCTSRFGRRRPFILGGALAVAIAVFLIGYAADIGHSAGDDITKKTRPRAVGVFVIGFWILDVANNMLQGPCRAFLADLAAGDQQKTRIANGFFSFFMAVGNVLGYAAGSYSGLHKIFPFTETKACDVFCANLKSCFFFSILLLLFLATVALLYVKDKQVEAIPLDDATQPSCFFQLFGALKELKRPMWMLMLVTAVNWVGWFPYFLFDTDWMGREVYGGTAGEDAYAKGVRVGSLGLMVNAVVLGFMSLAVEPLGKMVGGVKRLWAIVNFILAIGFGMTVVITKVAEHQRRMNPAAVGHPSEGVVVGSMVFFGVLGVPLXITFSVPFALASIYCSASGAGQGLSLGVLNLAIVVPQMVVSALSGPWDSLFGGGNLPAFMVGAAAAALSAIMAIVLLPTPKPADEAKASSMMAGGFH

SEQ ID NO: 55098 - protein, 445 aa, Acidobacteria bacterium Ellin345
MSKAQQLVRSVGLFDATMLVMGGIVGSGIFINPYVVAQQVHTAPLILGAWLAGGVIATLGAFIYAELAGRQPSVGGQYAYLRDAIHPLAGFLYGWVLLLVIQTGGMAAVTVTFARYFLVLTHWAVPERVVAVVTLSLLTLINCLGVKFGSRVQSALMILKIGAIAFLVVAGFLYIREPFAVGGTVLDRPLSPGLLSSFGAAMVPVLFAFGGWQTANFVAGEVRDPRKNLARALLLGVAGVIVLYLAVNFVCVRALGPVGLAATRVPATDVMRLAMAQRGATIVTLGITVSTLGFLSQSILTAPRVYFAMAEDGVFFRAVAKVNEKTHVPILAIVLQSVWTIVVALTGRYEQILNYVVSMDFVFFGLTACTLFVFRKRSSLENGASGGFQVPGHPWTTLVFIAASWLVVTNTIYKYPANSLLGFAILLVGMPVYWLWRRKGKVLSQ

SEQ ID NO: 55099 - protein, 756 aa, Erythrobacter sp. NAP1
MTAAASARQILTRLHEVMASRLHAQGKLDQVVEIIGECLSSEVCSIYLLREGMLELYATRGLNKTAVHVTRMAIGEGLTGTIADNVETLNLAEAKAHPDFSYRPETGEDKFHSFAGVPIVYRERAVGVLCVQHVDPRRYEEVEIEALQTTAMVLSELITNAELVDEEEALSLSPQQSGTQTLSGLTLVRGLGAGVAAYHQPRVQITQVMADDIEAERQRVYRAFDKMREQIDGLTNQADFGVGGEHEEVLETYKMFAYDEGWSRRINEAIDSGLTAEAAIERVQQHTRMRMREIDDPLLADRMHDLEDLANRLLRIVSGQIGTAAQQGLRNDTILIARNLGPAELLEYDRRRLKGVILEEGSLTAHVVIVARAMGVPVLGRASRARSTIREGDEILLDATAATATVRPSGQMADAFAQRFAKSKERQAAYAELRDVEPFTRCGTRVTVMMNAGLRDDMSALAMTGADGVGLFRTEFQFLVSATLPQRERQLKLYRDVLDAAGDKPVIFRTVDIGGDKSVPYLASDIADNDENPAMGWRALRLALTREGLMKAQARALLEAAAGRSLYVMFPMVSEVWEFDAAKKVFDEQLEFLRSKKKMVPEQIHFGAMLEVPALAEMLDLLVPRLSFLSIGTNDLTQFLFAADRGNPALAERYDWLSPPIFRFLRRVVQGTVGSNIDLGVCGEMGGRRLEALALLGIGVRRLSITPAAVGPIKELVRKVDLAEITDAMNQWLSEPGVNLREALAHWAAEREIETE

SEQ ID NO: 55100 - protein, 578 aa, Oryza sativa Indica Group
MGNNCVGPSAAGQNGFFANVALWRPRPADAAPPALPPPSSAPSDQAPEPVTIPPSEHSSHHSSRSTDPSTPTSAAEQPANKAAPKVKRVQSAGLLADSVLKRDVNTARLKDLYTIGKKLGQGQFGTTYLCVEKATGREFACKSIAKRKLLTQEDVEDVRREIQIMHHLAGHANVVSIVGAYEDAVAVQLVMELCAGGELFDRIIQRGHYSEKAAAQLARVIVGVIEACHSLGVMHRDLKPENFLFIHQKEDSPLKAIDFGLSIFFKPGETFTDVVGSPYYVAPEVLMKHYGREVDVWSAGVIIYILLSGVPPFWDESEQGIFEQVLKGDLDFSSEPWPNISESAKDLVRKMLIRDPKKRLTAHEALCHPWVCVDGVAPDKPLDSAVLSRLKQFSAMNKLKKMALRVIAESLSEEEIAGLKEMFKMLDTDNSGHITLEELKTGLQRVGANLMDSEIDALMEAADIDNSGTIDYGEFIAATLHINKVEKEDKLFAAFSYFDKDGSGYITQDELQKACEEFGIGDTRIEDIIGDIDQDNDGRIDYNEFVEMMQKGNNAMGKMGQHSTGNFGLGEALKLRCC

SEQ ID NO: 55101 - protein, 333 aa, Bacteroides fragilis YCH46
MIKVGINGFGRIGRMVFRAAVKNFGNDIQIVGINDLLDAEYLAYMLKYDSVHGRFEGEVAVEDGALIVNGNKIRLTAEMDPANLKWNEVDADVVVESTGFFLTDETARKHIQAGAKKVIMSAPSKDSTPMFVYGVNHTSYAGQDIISNASCTTNCLAPIAKVLNDKFGIVKGLMTTVHAATATQKTVDGPSKKDWRGGRGILENIIPSSTGAAKAVGKVLPVLNGKLTGMAFRVPTSDVSVVDLTVVLEKAATMAEINAAMKEASEGELKGILGYTEDAVVSTDFRGCANTSIYDSKAGISLDSNFAKVVSWYDNEWGYSNKVCEMARVIAAK

SEQ ID NO: 55102 - protein, 280 aa, Acidobacteria bacterium Ellin345
MTSKAKSTSKLSQQTVAILGLGKIGSILLQAMLREGLLSPKRVRATVNHADKTAKLTQEFGIQVGTDNAAAIKGADIILVALKPQQIGTVLTSLRDEIKPNQLLISVAASVPTAYMEERLAAKVPIIRAMPNTPSMLGAGMTGICKGAHATAAQLDLAQAMFNTVGRTAIVEEKHMDAVTGLSASGPAFIYIIIESLAEAGVKVGLPRDLATLLAAQTTMGAAQVVLETGQHPAQLKDAVTTPAGCTIDGILELEEGKLRVTLIKAVVKAAQRAKELVFS

SEQ ID NO: 55103 - protein, 534 aa, Bradyrhizobium sp. BTAi1
MSIVRIFGKDTVPCSAETVGAKAANLARMAALGLPVPPAFVLPVDLCADIIANQADAEQRLRDGLRSGIRFLEQATGRVFGDHRQPLLVSVRSGAARSMPGMLDTVLNVGCTSAAARGLIRSTGRPRLAFDCRRRLIESFSETVLGLEATRLTALCRDLVTQEGVATDRELDSEAIARLAADEQALVETGSDGWLEDAEGQLHAAARAVYQSWASERAQTYRKLQNLEHLPGTAVTVQAMVFGNGGLASGAGVAFSRDPSTGAKLPMIDLVLDAQGEDVVSGRRTPDSEETIARALPNLRTELVAVLRRLETEFGDVQDVEFTVEDGRLWILQTRAAKRTPRAALKIAVDLVHERVISPQQALQRLEEIDLEQLVETSLVAAGEPAATGIAASGGIAAGRAAFDSESAKRLADSGEPVILMRPDTSTADIAGFAAAAGVVTTVGARTAHAALVARQLGRPCIVGCPALTVSGGAERALLGTTAIARGDWVTIDGDQGRVYCGRLEIVTARPDAELAEVAAWRRGDLQPVRRLSA

SEQ ID NO: 55104 - protein, 273 aa, Nostoc punctiforme PCC 73102
MLEDLQIAFIGGGTMGEMIISRLLLTKIVPKADLIIVSDPVSARCLHLEREYGVRTTTSNIEAVLGASIVILAVKPQVLAEVLGMLKDKIPPNALVISIVSGANISSLCQGLNHPAVVRTMPNIAVQVGHGTTVWSASSSVTEIQRSHTQVILQALGKEFTTQNEHYLDMATALSSAGTGFVFLYIEAMIDAGVQMGLTRTQAQELTLHTIAGSVELMFQTHEHPAVLRNKVTSPGGVTAAGLYELEKGGMRTVISNAVLAALSRNQQLGNIS

SEQ ID NO: 55105 - protein, 408 aa, Acidobacteria bacterium Ellin345
MHLRCNNRNCAHTLDLHERAVACPKCGDLLEVVMEAPKQDPAQVKRMWLERRMSNASADRSGVWRFRDLLPGPYSLEDLVTLSEGNTPLVHGLKTGKSTGLDQLFFKHLGWNPTGCFKDLGMTTGMTEAKHVGAKIVACASTGNTSASLAAYASRAGLEAHVYLPSGKISLNKLAQALEFGAKIVEVDGSFDAALDQLLNTKNDDIYFLNSVNPFRVEGQKTVIFEMMEQLDWRVPDVVICPGGNLGNSAAFSKGLEELKEFGFIDRLPKLVVVQAAGANPFAELWRTGADELTPTEHPETVATAIRIGNPRSWRKALHGVKMTGGFVMEVTDEEIGEAKALIGLDGIGCEPASATTLAGLRKLHAEGKLDRDATVVAILTGHALKDTDYILKAHAKANEARLAEVNG

SEQ ID NO: 55106 - protein, 375 aa, Triticum aestivum
HSRTSLYKKAGWYRSGIPGISSTHASEKIKVEFTGHEESVQALAEAFHDSGEVPERYIRQEIDADPLAADAGGPALPTIDMSMLLDPEFSAEESAKLGSACEHWGFFQLVNHGVDGGLLGRTKADVADFFGLPLEVKSAVAIPPNGMQGFGHHFVFSEEQKLDWVDLLFLATRPAHERCLDFWPTKPSTFRDTLDKYTTELASVAEQLFRFMAKDLGVDQEALLGTFKGLPQCVRINYYPPCRQAGKVLGLSPHTDGVGMTLLLHANDVQGLQIRKDGEWFSVHALPGALVVNIGDVLEILSNGKYRSIEHRAVVNPDKERITIAAFHSVHLPCTIGPFQELGDARYKTVDGLDFTKGYFAAKLEGRRYLESLKL

SEQ ID NO: 55107 - protein, 520 aa, Kluyveromyces lactis NRRL Y-1140
MSSVRPRVTPVKAPVLPKQTTPEQRYWRSYSSTQLVKEHNAVTHIAFNPQHPHDFAVTSSTRVQVFSSRTRQVIKTFSRFKDVVHSATFRQDGKLLVAGDATGLVSVYDSYNPRTLLLSIQASSHPTHVTKFHDQDNKTLVTANDDRVVRLWDVSHAYEPTLQLTGASDYVRSVCFVPNAPHMVATGSYDGVVRLYDIRTKSDKPQTTLDHGLPVEDITAISPTQLASCGGNGFKVWDLTSDRALCERQNFAKTVTCLNYTNMGEESPMSSVLVASSLDGHVKIFSPLENFQFKFGWKFSNAVLSCAVSPGDAQGNKHFVAGLSSGILAIKTKKKSKKINLADVSDLEDLPLQQQEKSAKSNNFQRMMRGSEYRGDQEHIIHNDKPNPQRKLRQFERHINQFKWSDALDSAFIPGMAKELTLTVLQELRKRGKIKVALYGRDESSLEPLLNWCLKGIEDVRSAPIVADWIAVVIELYGSVLEKSPVLEEMVITLKKRVREEIRKAKEAQKIEGMLQLLTN

SEQ ID NO: 55108 - protein, 403 aa, Campylobacter lari RM2100
MVELNKIYQAKQKIADFVLKTPFVHSSFLSEFLETDVFLKCENLQKTGAYKIRGAYNTIANLTKEQKQAGVIAASAGNHAQGVAISAKKFGIEAVIVMPEATPLLKVSATKNLGAKVILKGDNFDEAYAYALNYAKEHHLNFIHPFENESIIAGQGTLMLEMLDEISDLDMILAPVGGGGLISGVASAAKQINPAIKVIGVSAKGAPAMYESFKSKKMINSKAVRTIADGIAVRDVNKINFDIILECVDDFIQVDDEEIANAVLYLLEKHKITVEGAGASAVAALLHKKIDLKNHKKIGVILSGGNIDVQMLNIIIEKGLFKAFRKMLINVTLIDKPGALSALSDAIKEAQANIVKIDYDRFSTKLEYGDAMISITLETKGKEHQELVRKILYDKGFNFNEIL

SEQ ID NO: 55109 - protein, 415 aa, Opitutaceae bacterium TAV2
MSYKTIRDLNLAGKRVFIRVDFNVPQDKATGAITNNQRIVAALPTIKYALEKGASVVLASHLGRPDGKKAAKYSLKPVADELAKLLGKPVKFLDDCVGPAVEAACAPGTLKAGDVVLLENLRFHIEEEGKVKNEDGTSTKADKAAVEAFRASLSKLGDVYVNDAFGTAHRAHSSMVGVNLPAKAAGVLMEAELAAFAKVLDNPQRPLLAILGGAKIADKIPLINNLIEKANAIIIGGGMAFTFKKVINNMEIGNSLFDAEGAKLVPELVAKAKAKGVQLVLPVDYVIADKFAPDAASKTADDASGIPAGWMGLDIGPKSIALFTETIKASKTIIWNGPAGVFEFEKFAAGTAAQAAAVAAATASGATTVVGGGDTATAAKKFKVADKVSHCSTGGGASLEFLEGKALPGVVFLES

SEQ ID NO: 55110 - protein, 348 aa, Opitutaceae bacterium TAV2
MAVKVAINGFGRIGRLVFRALVEQGLLGTTFDVVAVGDIVPADNLAYLLKYDSTQGAFQGTVSSKKSAADKADDDVLVVNGKEIKVVAARTPAELPWKALGVELVIESTGLFTEAEKAKGHITAGAKKVIISAPAKGEDITVVLGVNDDKLDVSKHNIISNASCTTNCLAPITKVILEKFGIVEGLMTTVHSYTATQKTVDGPSRKDWKGGRTAALNIIPSTTGAAKAVALVIPEVKGKLTGMAFRVPTPTVSVVDLTVKTEKDTSLAEIKAAIKAASESGPLKGILGYTEDEVVSTDFIHDKRSSIFDAGSSIELNKNFFKLISWYDNEWGYSNRVVDLTKIIAAKL

SEQ ID NO: 55111 - protein, 388 aa, Arabidopsis thaliana
MVVLHEILDGPNGDDPNNNPQEGEDNQNENPQEEVENLRNLLELPEELIERLIAHIPRCYYPYISLVSRDFRQVITSDKLFRTRSLLGFNEPVLYALIGSTQTPLSWFFLRWSNFPLELHRIRSLPTVLLGAAVVTIGYKMYVMGGTIGLNHHVSTVIVIDCRNHTWNYLPDMKRARYRAAAGEIGGRIYVIGGRKKQDADWVEVFNATTESWETVSSVCPNDASANGVFSTYVVMQGRIFALDRWGCFAYKPVQGLWQSWGVASELTRFWHPLSSFTVIGELLYTVDLTCSLGHPIVVYYPNESVWRPVMGFHLPILSQCWSKIANFGGKLVIFCTCLGTFKHILCIVIALEARQGGHIWGVVESNSRVFRDDMMLPYIRLCQTVTF

SEQ ID NO: 55112 - protein, 509 aa, Zea mays
  misc_feature (204)..(204): Xaa can be any naturally occurring amino acid
MMIARRLLRPNAPAQATSLLKHVTGTASLQGNADSLLDGTVRHFGSAPSAQPEENGFKGHGMLAPFTAGWQSNDLHPLIIERSEGSYVYDINGNKYLDSLAGLWCTALGGSEPRLLKAATEQLNKLPFYHSFWNRTTKPSLDLAQEILSMFTAREMGKVFFTNSGSEANDSQVKLVWYYNNALGRPNKKKFIARSKAYHGSTLXSASLTGLPALHQKFDLSAPFVLHTDCPHYWRYHLPGETEEDFATRLATNLENLILKEGPETIAAFIAEPVMGAGGVIPPPKTYFDKVQAIVKKYDILFIADEVITAFGRLGTMFGCDYYNIKPDLVSLAKALFNAYVPIGATLVSPEISDVIHSQSNKLGSFAHGFTYSGHPVACAVAIEALKLYRGRDIPGHVKQIAPKFQDGIKALADSPIIGEIRGLGMIMGTEFTNNKSPTDLFPAEWGVGAIFGEECQKRGMLVRVAGDAIMMSPTLIMTPGEVDELVRIYGEALKATEERVAALQSKKN

SEQ ID NO: 55113 - protein, 355 aa, Linum usitatissimum
MAPTSSHVVALTIMLSAVLFASTTTAQIPAPAKGMSWTFYKSSCPKLESIITKRLKEVFKKDIGQAAGLLRLHFHDCFVEGCDGSVLLTGSAGGPSAEQGSPPNLSLRKEAFRIIDDLRARVHKECGRVVSCSDIVALAARDSVVLSGGPKYQVALGRRDGTTLVTQDTTLANLPPPFATTGTILSSLATKNLNPTDAVALSGAHTIGISHCSSFTDRLYPNQDPSMDQTFAKNLKATCPQAATTDNIVDIRSPNVFDNKYYVDLMNRQGLFTSDQDLYTDSRTRGIVTSFAINQTLFFEKFVVAMIKMGQISVLTGKQGEIRANCSVTNSAKVQTSSFLEEAVEEAVELLAGMR

SEQ ID NO: 55114 - protein, 172 aa, Arabidopsis thaliana
MAFPKVYFDMTIDGQPAGRIVMELYTDKTPRTAENFRALCTGEKGVGGTGKPLHFKGSKFHRVIPNFMCQGGDFTAGNGTGGESIYGSKFEDENFERKHTGPGILSMANAGANTNGSQFFICTVKTDWLDGKHVVFGQVVEGLDVVKAIEKVGSSSGKPTKPVVVADCGQLS

SEQ ID NO: 55115 - protein, 234 aa, Triticum aestivum
  misc_feature (208)..(208): Xaa can be any naturally occurring amino acid
  misc_feature (214)..(214): Xaa can be any naturally occurring amino acid
MASATLLKSSFLPKKAEWGTTRQAAAPKPVTVSMVVRASAYADELVKTAKTIASPGRGILAMDESNATCGKRLASIGLENTEANRQAYRTLLVTPPGLGNYISGAILFEETLYQSTVDGKKIVDILVEQGIVPGIKVDKGLVPLVGSNDESWCQGLDGLASREAAYYQQGARFAKWRTVVSIPNGPSELAVKEAAWGLAPLRAISQDXGLVPNXEPEILLDGEPGIERTFEGAP

SEQ ID NO: 55116 - protein, 232 aa, Triticum aestivum
  misc_feature (87)..(87): Xaa can be any naturally occurring amino acid
  misc_feature (168)..(168): Xaa can be any naturally occurring amino acid
  misc_feature (184)..(184): Xaa can be any naturally occurring amino acid
  misc_feature (198)..(198): Xaa can be any naturally occurring amino acid
MWSKNQPHLHSLLLIVVPFLLVSTASAANPGSDILDKARNITDGETLVSAGGSFTLGFFPPGMLGKRYLGIWFSMDEDAICWVANRXRPLTDARGALMISDRGNLLLIDSSGQVVWSSNTTGTASTTVQLLESGYLLSRDGNASGAITWQSFDHPSNTLLPGMKIGQXLWTGEEWYLTSWHSAXDPATGKFRYITDTXGVPQNVMFDGCQRIYRTGPWNGLRVSGVTEMGTY

SEQ ID NO: 55117 - protein, 530 aa, Arabidopsis thaliana
MATKLESSLIFALLSKCSVLSQTNLAFSLLAVTIIWLAISLFLWTYPGGPAWGKYLFGRLISGSYKTGNVIPGPKGFPLVGSMSLMSSTLAHRRIADAAEKFGAKRLMAFSLGETRVIVTCNPDVAKEILNSPVFADRPVKESAYSLMFNRAIGFAPHGVYWRTLRRIASNHLFSTKQIRRAETQRRVISSQMVEFLEKQSSNEPCFVRELLKTASLNNMMCSVFGQEYELEKNHVELREMVEEGYDLLGTLNWTDHLPWLSEFDPQRLRSRCSTLVPKVNRFVSRIISEHRNQTGDLPRDFVDVLLSLHGSDKLSDPDIIAVLWEMIFRGTDTVAVLIEWILARMVLHPDMQSTVQNELDQVVGKSRALDESDLASLPYLTAVVKEVLRLHPPGPLLSWARLAITDTIVDGRLVPAGTTAMVNMWAVSHDPHVWVDPLEFKPERFVAKEGEVEFSVLGSDLRLAPFGSGRRICPGKNLGFTTVMFWTAMMLHEFEWGPSDGNGVDLSEKLRLSCEMANPLPAKLRRRRS

SEQ ID NO: 55118 - protein, 200 aa, Brassica napus
VEDRKSVKPSWAAIELTLALHYVFRAPVDKILWDAVEQTYAHKVLTRRWSSIPSRQNNGVSGVTSRLESEYDSFGTGHGCNSISAGLGLAVARDIKGKRDRVVAVIDSVTITAGQAYEAMSNAGYLDSNMIVILNDNRHSLHPNMADGSKASISALSSFMSKIQSSQIFRKFRELAKAMTKKIGKGMYEWAAKVDEYARG

SEQ ID NO: 55119 - protein, 257 aa, Solanum lycopersicum
MFSSDENLFNFIVFFILVMAFPTFILCQFFTSPYGKHYTSADSGTTISPPIAWAFMESPTLWLTIIVFRLGKNYTNPLAFLLISPYLFHYTNRTIIYPLRLRSRNTKNNFPLNIAVTAFIFNLLNAYIQSRWVSHYANYQEDDWFWVRFGIGLVIFGSGMLLNIWADGVLLGLKSQGGGYKIPRGGLFDYVSSPNYLGEIMEWLGWALMTWSWAGLAFFVYTCANLVPRAVSNHKWYLQKFGEDYPKNRKAVFPFLY

SEQ ID NO: 55120 - protein, 401 aa, Staphylococcus aureus subsp. aureus NCTC 8325
MVTRSVLKFGGSSVSDFTKIKRIAEMLKERVNQDEQLIVVVSAMGNTTDQLMTNVSTLTKAPKQQELALLLTTGEQQTVSYLSMVLNDIGMNAKAMTGYQAGIKTIGHHLKSKIAQINPQTFEQAFQENDILVVAGFQGINEHQELTTLGRGGSDTTAVALAVSNQIPCEIYTDVDGVYATDPRLLPKAKRLDIVSYEEMMEMSALGAGVLETRSVELAKNYNIPLYLGKTLSNVKGTWIMSNEEILEKKAVTGVALDKHMMHVTISYPLPDNQLLTQLFTELEEGAVNVDMISQIVNLDGLQLSFTIKDSDFHQISMILETLKNQYEALAYKINEHYVKISLIGSGMRDMSGVASKAFLTLIENNIPFYQTTTSEISISYVIDDFNGQQAVEKLYDAFNI

SEQ ID NO: 55121 - protein, 507 aa, Bacteroides fragilis YCH46
MQEKIIILDFGSQTTQLIGRRVRELDTYCEIVPYNKFPKGDETVKGVILSGSPFSVYDESAFKVDLSEIRGKYPILGICYGAQFMAYTNGGKVEPAGTREYGRAHLTSFCKDNVLFKGVREGTQVWMSHGDTITAIPENFKTIASTDKVAIAAYQVEGEQVWGVQFHPEVFHSEDGTQMLRNFVVDVCGCKQDWSPASFIESTVAELKAQLGDDKVVLGLSGGVDSSVAAVLLNRAIGKNLTCIFVDHGMLRKNEFKNVMHDYECLGLNVIGVDASEKFFSELEGVTEPERKRKIIGKGFIDVFDEEAHKLKDVKWLAQGTIYPDCIESLSITGTVIKSHHNVGGLPEKMNLKLCEPLRLLFKDEVRRVGRELGMPEHLITRHPFPGPGLAVRILGDITPEKVRILQDADDIFIQGLRDWGLYDQVWQAGVILLPVQSVGVMGDERTYERAVALRAVTSTDAMTADWAHLPYEFLGKVSNDIINKVKGVNRVTYDISSKPPATIEWE

SEQ ID NO: 55122 - protein, 268 aa, Pisum sativum
MAESSSTKTGLRLAGKVAIVTGGASGIGKETAHLFANQAARMVVIADIQDELGIQVAESIGTDRCTFIHCDIRIEDDVKNLVQSTVDTYGQIDIIHCNAGIISPSDQTLLELDVSQANGVFATNAIGTALCVKHAARAMVDGKVRGSIVCTASISASYGVTTGTDYSMSKHAVLGLMRSASVQLAKYGIRVNSVSPNGLATPLTEKLLDADAKTVEEIFSKFSMLKGVVLRTNHVADAVLFLASNDSDFVTGFDLRVDGNYITSHAVI

SEQ ID NO: 55123 - protein, 426 aa, Dechloromonas aromatica RCB
MTTIAVVGLGYVGLPLAVEFGKKYRTIGFDLSTHKIECYKKHYDPTGEVSTDDLKAATLLEVGTDPAAIREADFVVVAVPTPVDDAHQPDFSPLVGSSTAVGQNLKQGAIVVFESTVYPGATEEVCIPIIERESGKTWKKDFFVGYSPERINPGDKERTVTKIIKIVSGDTPETLATVQEIYGSIITAGVYPASNIKVAEAAKVIENTQRDLNIALMNELAIIFDKIGIDTLEVLQAAGTKWNFLPFRPGLVGGHCIGVDPYYLTHKAQKLGYHPEVILAGRRINDGMGKFIAEQTIKMLVKAGHPVKDCPIIVLGLTFKEDCPDLRNSRVIDVIRELESYGAKVVVHDPVADAAEARHEYGVDLVAWNDLPKAAAIVAAVNHKEYKALPIGDFLARLEKDGVIADVKSMLDSKAFSENGITVWRL

SEQ ID NO: 55124 - protein, 319 aa, Microcystis aeruginosa PCC 7806
MRIAHDVTELVGRTPLVQLNRIPQAEGCLGRIVMKLEGMNPAASVKDRIGTHMINSAEKAGLINPETTVLVEPTSGNTGIALAMTAAAKGYRLILTMPETMSLERRAMLKAYGATLELTPGSQGMKGAILRAQQIVDSIPGAYMLQQFRNPSNPEIHRLTTAEEIWQDTEGQVDFIVAGVGTGGTITGVAEVIKSRKPSFQVVAVEPFNSPVISGGNPGPHKIQGIGAGFIPEVLRTDLIDEVITVSDEEAFQFGRRLAKEEGLLSGISSGANLCAAIQLAQRPENEGKLIVVIQPSFGERYLSTLMFQNIEERELTLV

SEQ ID NO: 55125 - protein, 256 aa, Pisum sativum
MAESSSTKSSLRLAGKVAIVTGGPKQGARIVVIADIQDKLGIQVAESIGTDKCRFIHCDIRIEDDVKNLVQLTVDCYGQIDIIHCNAGIVSPSDQTLLELDVSQTNGVFATNAIGTALCVKHAARAMVDGKVRGSIVCTASISASYGVTTGTDYSMSKHAVLGLMRSASVQLAKYGIRVNSVSPNGLATPLTEKLLDADAKTVEEIFSKFSMLKGVVLRTNHVADAVLFLASNESDFVTGLDLRVDGNYITSHAVI

SEQ ID NO: 55126 - protein, 469 aa, Acidobacteria bacterium Ellin345
MIVMKFGGTSVEDAAAISRVAGIVRDRAKQKPAVVVSALGGFTDSLVAMGKAAAKGDLAAALKLWKAGRQRHLAVLAGVKGAGAAEEQVQELFGNLQDVLKGIAALGELSPRTQDNVLSFGEMLSSVMVVALFKAAGVDAIHIDARQCIVTDNCHTKAVPLLDQTNSRLRSALKEHLAKNRVPVLGGFVGATEDGTQTTLGRGGSDFSAAIVGAALGAKKIEIWTDVEGMLTTDPRICKDARRIEVIGFEEASELAYFGAKVLHPATLIPAVESNIPVYVLNSRNPKSTGTCIQQHAPHSATTFRAIALKKGTKILNIRAPRLLINHGFLRSLFEVFEKHSLSPDLVNTSEVSVSVALDGTRDVKALVSDLKRLGQVDVENGKAIVCLVGDNIRGRVGICADVFAVVAKHGVNIHMVSQGASEINISFVAEENEAVRAVKALHAHFFEEEKLTFAAKGDEVYAGCSGVA

SEQ ID NO: 55127 - protein, 177 aa, Pseudoalteromonas tunicata D2
MALRSYKGHIPKICINTYVDESAVLVGNIDIGHDSSIWPLVAARGDVNCIKIGERTNVQDGAILHVTRPTEGNENGYPLIIGDDVTVGHQAMLHGCQLGNRILVGMSAIIMDNVIVEDDVIIGGGSLVPPGKRLESGFLYVGSPVKQARPLTEEERAFLTVSAQNYVKLKNEYLEEY

SEQ ID NO: 55128 - protein, 87 aa, Zea mays
MATAPRRLLPALLKALAPAGARGLSTEKAVGAAAVAVVGSHTAKWMQDTSKKSPMELINEVPPIKVDGRIAVCEGAAEGVGLGQGRS

SEQ ID NO: 55129 - protein, 486 aa, Erythrobacter sp. NAP1
MTEFAADRLLLFGATGDLSRRKLLPSLCALDADGLLPERLAIIGTARSDIDDGEFRNMAREALEQFLPAERRGSMAQFLNRLSYQPLDASSVEGFDALAAKVAEVGQSDEENGGLAIFLSTAPSLFGPTIAGLQHAGLTGEKVRMCLEKPLGTDLESSAEINDAVAGAFPEERIFRIDHYLGKETVQNLLALRFANILFEPIWNSNIIEHVQITVAETVGLEGRVTFYDDAGALRDMVQNHMLQLLALVAMEPPTSFDATAVRDEKVKVLRALRKAVASETVTGQYRAGAVNGQAVPGYDEELGKPSNTETFTAIKTHVDNWRWKGVPFYLRTGKRLPERVTEILVKFRCVPHSIFESMGAGLQPNHLLIGIQPEEDITLSLMAKVPGLDEDGVRLREVPLKIAMPSAFAETQRRIAYERLLLDLIKGDQTLFVRRDEVEAQWHWIDAIRAEWEANGVTPKTYTAGSWGPSAAIALTERDGVSWHE

SEQ ID NO: 55130 - protein, 339 aa, Brassica napus
MADNKKIKIGINGFGRIGRLVARVILQRNDVELVAVNDPFITTEYMTYMFKYDSVHGQWKHNELKIKDEKTLLFGEKPVTVFGIRNPEEIPWGEAGADFVVESTGVFTDKDKAAAHLKGGAKKVVISAPSKDAPMFVVGVNEHEYKSDLNIVSNASCTTNCLAPLAKVINDRFGIVEGLMTTVHSITATQKTVDGPSMKDWRGGRAASFNIIPSSTGAAKAVGKVLPQLNGKLTGMSFRVPTVDVSVVDLTVRLEKAATYDEIKKAIKEESEGKLKGILGYTEDDVVSTDFVGDNRSSIFDAKAGIALSDNFVKLVSWYDNEWGYSTRVVDLIIHMSKA

SEQ ID NO: 55131 - protein, 238 aa, Prochlorococcus marinus str. MIT 9313
MADLQTQMKQAVAAAAVEQIKDGMVLGLGSGSTAALMIQALGAKLASGELRDIVGVTTSFQGEVMAAELGIPLRNLTAVDRIDLAIDGADEVDPSFQLIKGGGACHVQEKLVASRADRFVVVVDSTKIVDRLNLGFLLPVEVLPGAWRQVQGRLAELGGIADLRMAQCKAGPVVTDQGNLVLDVSMAGGIGDPEDLECRINNLPGVLENGLFVNLTDEVLVGQISDGVAGVRRLQRRE

SEQ ID NO: 55132 - protein, 214 aa, Bacillus cereus G9241
MIKIAPSILSADFSKLGEEIKDVEKGGADYIHVDVMDGHFVPNITIGPLIVEAIRPITSLPLDVHLMIENPDNYIPTFAKAGADIITVHVEACPHLHRTIQLIKSHGIKAGVVLNPHTPVSMIEHVLEDIDMVLLMTVNPGFGGQKFIHSVLPKIKQVAEMVKERNLEVEIEVDGGVNPETARLCVEAGANVLVAGSAVYNQKDRGEAIRVIRG

SEQ ID NO: 55133 - protein, 497 aa, Zea mays
MASPPPPPAAAAAPAAAASGPPPPAQVVGNAFVHQYYNILHQSPELVYRFYQESSRLGRPSGTGDDGMETVTSMDAINDKIVSMGIDRAEIKAVDAQESLCGGVTVLVMGHLTGRNSVSREFVQSFFLAPQEKGYFVLNDILRYVGEEGGDEGGEQQPATEVAADVVAADVEAATPASILANGTVGGDTVTVPQDASPQPECQVAEPALNPKEEVLNREVVCNPPNDVNPIVEETPVPEVINEVPNNVGVAPPISSPSAPPEEAPKKSYASIVKVMKEYRPPAPAVPSRPAPPKTEKQSSPAPALVADAPAFTPNPQSGSFQDPEVDAHAIYVRSLPLNATPQQLEEEFKRFGAIKHDGIQVRSNKIQGFCYGFVEFEDASAVQTAIEASPVTIGERQCYVEEKRTTGGSRGGSRGGRFPPVRGGNFRGEGIRGRGTYNGGRGYGRGEFNYRSDYGGRGGGRGGSSRGDVGYQRVDHSSAASGRGARAPSAATAVAK

SEQ ID NO: 55134 - protein, 105 aa, Medicago sativa
IAPGLASIGMTPLLTAVYVGAMQNIFSKSAKYSLFDPCKEMAYIPLDEDTKVKGKAAIDVVCNPLGKSGGALIQQFMILTFGSLANSTPYLGGVLLVQNWTREKL

SEQ ID NO: 55135 - protein, 428 aa, Zea mays
MVKICCIGAGYVGGPTMAVIALKCPDIEVVVVDISKPRIEAWNSDTLPIYEPGLDDVVKQCRGRNLFFSTDVEKHVAEADIIFVSVNTPTKTRGLGAGKAADLTYWESAARMIADVSKSDKIVVEKSTVPVKTAEAIEKILTHNSKGINYQILTTNLWSAELSKLAANAFLAQRISSVNAISALCEATGANVTEVAYAVGKDTRIGPKFLNASVGFGGSCFQKDILNLVYICECNGLPEVANYWKQVIKINDYQKSRFVNRVVSSMFNTVAGKKIAVLGFAFKKDTGDTRETPAIDVCKGLLGDKAQISIYDPQVTEDQIQRDLAMNKFDWDHPMHLQPTSPTAVKQVSCVWDAYEATKGAHGLCILTEWDEFKTLDYQKIFDNMQKPAFVFDGRNIVDSEKLREIGFIVYSIGKPLDAWLKDMPAVA

SEQ ID NO: 55136 - protein, 329 aa, Glycine max
MVTDQDIAKGVESLLRHSDPNSITTVNGVVQQLEAKLGLDLSHKASFIRDQIDHLLRSQPQTFAPHPPPLHKDYFAPHTQLHFPTTHFAPHFALHDEINFLQHPHPPPPRKVETFPPQNVAPPQVPKESVQTGSKRRGGAGGLNKVCGVSPELQAVVGEPAMPRTEIVRQLWAYIKKNNLQDPGNKRKIICDDALRLVFETDCTDMFKMNQLLAKHIIPLGPTKESQAKRVKVDTEIKTESAEPAPSTVAISEALAKFLGTEGREMQQSEAIRLVWEYIKLHHLEDPLNSMVILCDAKLQELLGCESISALGIPEMLARHHLFKQSDTC

SEQ ID NO: 55137 - protein, 99 aa, Prochlorococcus marinus str. NATL1A
MTSFKITFINELSGLKEIIDIPDDKYILDAACEQNIELPASCREGTCSTCVAKLEKGNVDQQDQSFLDDDQIEKGYILICKAYPLSDCIIRTHAEDQLY

SEQ ID NO: 55138 - protein, 412 aa, Candida glabrata CBS 138
MSELHSLLTFPVRPISEEHYLGELSRFLKAGIPATYTLEQVAAFERSELREDADEVSDEEEQSNTTPLHILARSLPGNLSDDEEQVVLHMMDMLFEYGAGWNFIDFENKTVGDLILERNGGNRESPLYQRVVEAGVSAELLLRKLNGGDVEFIDENEIDICAEASAEVVPKDALDDSTGKVSSVSDDDATAADPDTYLNTKLKYTEDALITENNKDGVMMDWETDIMKLAADTLVSRKPVGESVVLNIGFGMGIIDTFIQERNPKKHYICEAHPDVLKKMKNDGWYQKPNVVILEGKWQDSLNKLLDEGNVFFDGIYYDTFSEHYEDMLDLYDIVVGLVNPEGVFSFFNGLGADRPLCYDVYKKIVEVDVATYGMNCEYTYVDLKGKLPDWKDVKRSYYNCEYYYHPKISFA

SEQ ID NO: 55139 - protein, 560 aa, Cryptococcus neoformans var. neoformans B-3501A
MANESVEGGNWGRVLICGGTDWATNGRKERSSGKVPTDLMEPHILRSLCNVKASKIITGPSANYAIILDIHGAAYLFGRPPAMVQSNGVISENTPLKISPSSVGSPKGTKWVNGAAGRSHFLLVDSNGDVWGCGNNVVGQIGVPVAMVVEKLTKVAGPWVRDPEAKVVQVTAGHTFSLFLTFTGQVYASGSSEFGQLGNGKTGERLVKAGKIAYDIEVPPRLVQGLENVKITEIASGNQHSLALDDNGYVYSWGFAGYSRLGLQDQKDRLLPTIVPSFAGNNELTRARSIACGPTSSTVVDRQNMILIAGKWKLSGDGSTGQPYTRFKHIQDVMACKVIKTSSGGCTHFITTPDPEGGVMTVGFGQGVLYGELGLGSDSAKSATKPQKIIPLSGVDMIDVVGGAFFTLFLARPNSALSDLDRYPLHINSASLCLVCNTDHEQDAPLECERCDQPYHIGCLSPPLSAVPEGEWFCPECALEADAGPDEPFKPALGITIPKLANGKKGAKQDVVESRGNPEAAVSATNGALTPSKSVKGGKRSWDEERSAQGSGKKARNSKN

SEQ ID NO: 55140 - protein, 274 aa, Pyrobaculum aerophilum str. IM2
MASISPYGKRFISYLRREQIRRLLATKYRVDGRGPEQTRNVEINVGVVKTADGSAEVKLGKTHVVAGVKVGLGQPFPDAPDEGVLVVNAEVLPHASPYTEVGPPDEFAIELARVVDRGIRHCGYVDFKKLAVEGGKAYVLWIDLYVINDDGNLIDVANLASVAALKNTQLPVVVKDEAGVVKLDRNNKAPLPVDISKAPIAVSVGKIGNVLFLDPTFEEELSLDGRITFTFSEDKIVAAQKTLGYFTQSEIEAALNLALRGRDRLLEALKSALK

SEQ ID NO: 55141 - protein, 246 aa, Pyrobaculum aerophilum str. IM2
MKRPPVPLLQNGVRADGRTPDQMREVKIAVGVVSNADGSAMVSYGATTAVAAVYGPREMHPRHLSLPDRGVMRVRYHMAPFSTKDERKSPTPSRREIEISKILREALEPAIVLEQYPRSRIDVFVEILQADGSTRVASLTAASLALADAGIYMRDLVVGVSVGLVDGTVVLDLNGLEDQYGEGDLPLGYMPNLKRFTLLQLDGAWTRDMFLQALNLAVRGAEYVYQIARDALKNKYMSIAEEIYGR

SEQ ID NO: 55142 - protein, 306 aa, Opitutaceae bacterium TAV2
APSRQSRVLLALSGGVDSSVCAALLHKAIGKQLTCVYVDTGLMRKDETKHIEALYAKHFKIDLRIVDASRTFLKRLKGITDPERKRKIIGAAFIEVFEKKVRELKHKEGIEYLGQGTIYPDVIESMAIGNNPAAMIKSHHNVGGLPERMKFKLVEPLRQLFKDEVRLVGTKLGLPKEVVWRQPFPGPGLGVRVVGDITKQRLDVLREADAILHEEMMNAGLYYKIWQSFCVYLPVKSVGVIGDERNYADVIALRLVESIDAMTADWAKLPNPLLQRISNRITNEVRGVSRVVLDISSKPPATIEWE

SEQ ID NO: 55143 - protein, 379 aa, Zea mays
PQLAETEPSPAMPPPPQANGGKVTPNLAMDAEATRMLNLTVLQRLDPAVEDILITAAHVTLYDFNIDLNQWSRKDVEGSLFVVKRNSQPRFQFIVMNRRNTDNLVEDLLSDFEYELQPPYLLYRNASQEVNGIWFYNQHDCEAVASLFGRILNAYAKVPPKPKVPTTKSEFEELEAVPTSAAIDGPLEPPLSSTAVVSNAPDESLVNYFNGAASIGSVPSAQMAGRAHPSNDTVTPSHVPLIVPSATPTHQMSHPLGGSSAPPLPLHDTNPHASQSANLLTPAFFAPPPPSSTSVTPPASSMMPTAPPLHPTSTAAQHPSYGTPLLQPFPAPSPPPSLTPAHNDGLVISRDKVKDTLQRLVQNDEFIDLIYRELQSVHM

SEQ ID NO: 55144 - protein, 367 aa, Roseovarius nubinhibens ISM
MSTPSLLILPGDGIGPEVMTEVRKVIDWFGAKRDLAFDVSEDLVGGAAYDKHGVPLHDDTMARAQEVDAVLLGAVGGPKYDELDFSVKPERGLLRLRKEMDLFANLRPAQCFDALADFSSLKKDVVAGLDIMIVRELTSGVYFGEPRGIFEEGNERVGINTQRYTESEIERAARAAFELAMRRNKKVCSMEKANVMESGILWREVATRVGKDYPEVELSHMYADNGAMQLVRAPKQFDVILTDNLFGDILSDCAAMLTGSLGMLPSASLGAPMANGRPKALYEPVHGSAPDIAGQGKANPIACILSFAMALRYSFDQGDEATRLENAIEAVLASGARTADLMGPEGGTPLSTAEMGDKVIEALDQSL

SEQ ID NO: 55145 - protein, 302 aa, Clostridium acetobutylicum ATCC 824
MIRKYNLYQIDSFTKEKFTGNPAGVITNADGLTDYEMQKIARELNNSETAFIFSSKDERYDAWVRFFTPTSEVPICGHATIAAHYARAIENNLETSRVYHKTGAGILPVDVIKENDDYKIIMTQGKIEFGSVIDGEKKEKLLRALNIEKSDLLENYKIQIVSTGHSKVMIGIKSLKTLNKLQPNYDVLSKLSKIIKCNGYYVFAVTSEDSDILIHGRMFAPAIGINEDPVTGNANGPLGAYLVHHKLACYDNSIFKFKAKQGEAIGRQGIIEVEVRVDKEEPVEVKISGNAVVVFKSELVLN

SEQ ID NO: 55146 - protein, 291 aa, Thiobacillus denitrificans ATCC 25259
MKRILIVGFGDVAERLVRAYLGQAEFIGVVRRAERVSALRALGVRPYLGDLDDPATLKRLPRADAVFHFAPPPADGRSDSRTAHLLHALGRHKPGALVYISTSGVYGDCGGNWVAETRPVAPVNARAVRRVDAERRLRAWGRQRHVQVTILRAPGIYAADRLPLARIQRGTPALLSQDDSYTNHIHADDLARLAWAALFRGRDQRIYHAVDAHPLKMGDWFDSCADAFGLPRPPRVERAEAEKVLSEALLSFLRESRQLSNARTTRELRMKYRYPTSDALLREIGRARVAQ

SEQ ID NO: 55147 - protein, 345 aa, Thiobacillus denitrificans ATCC 25259
MSHQVTIQPSGHRFTVEDDETILEAALREGFSLPYGCRNGACGSCKGTVLQGELDYGVYQPNALKDEEKARGRALFCRAKPLSDMAIEVREIGASKDIIVKTMPCRVEKLEKLADDVMRVRIKLPANERLQFLAGQYIDFQLKDGRTRSYSLANAPHDDALLELHIRHVPGGLFTDQVFTTLKERDILRLKGPLGSFFIREDSDKPMIFVAGGTGFAPIKSMLEHAFATHTDRELVLYWGARARKDLYLAELPQQWLAERPNFSFIPVLSQAEPDDAWQGRTGFVHEAVLADFADLSGYEVYTSGAPAMVDSARESFVNTRGLPEDAFFADAFVYAADTLAATSA

SEQ ID NO: 55148 - protein, 426 aa, Escherichia coli [sequence omitted]

SEQ ID NO: 55149 - protein, 368 aa, Treponema pallidum subsp. pallidum str. Nichols
MAVNCGIIGLPNVGKSTIFSALTANVVEAANYPFCTIEPNVGMVTVPDVRLEALAGHFRPKKTVYASIECVDIAGLVKGASQGEGLGNRFLAHVREVGVLAHVVRCFEHTDIVHVHNKVDPLSDIETVHIELALADLASVEKRAVRAQKESRMGKSLQKESTLVLRALDTLREYLEMGKAACMAPLSDEERNAVRDMRLLTMKPHLYVCNTDESGMQYGNDFVRAVQEHARVHNTQAIVMCGKFEAELAQLSDVAEQNAFLQELGLRESGRAALARAVYSLMGLRTFFTAGPEECRAWTIRAGLRAPHAAGVIHSDLERGFIRAETYSFDDLASCGSVAKVREANRVRQEGKEYEVQDGDVIFFKFNV

SEQ ID NO: 55150 - protein, 197 aa, Vitis vinifera
MALQIAPCVSRFLVLLLLVSVSLIGRSSSSGSAEKEKTFAMIKPDGLSGNYADEIKNAILESGFIILREMTVRLDEDTAGKFYAEHSSRSFFPALVKYMTSGPVLVMVLEKINAVADWRALIGPTDAQKAKVTHPHSFFAGFLIVSALIFSIRAMCGQDLEKNCVHGSDSPQSAEREISFFFEEFSSGAVGSKHDEL

SEQ ID NO: 55151 - protein, 426 aa, Escherichia coli [sequence omitted]

SEQ ID NO: 55152 - protein, 448 aa, Acidobacteria bacterium Ellin345
MDKPRRNFWQIVNMSVGFLGIQFGWNLQMANMSAIYEYLGARADQIPILWLAAPLTGLIVQPLIGHASDHTWGKLGRRRPYFLTGAILSSLALILMPRSGALWMAAGLLWILDASINISMEPFRAFVADILPEEQRTRGFAMQSLMIGLGAVMANVLPYLLLKFGNLKADTTGYAIPLAVRISFYVGAAAFFGAVMWTILTTKEYPPDDLEAFRKKKEKKGGLGLGEIVNAVREMPMTMRQLAPVQFLTWLGLFCMWLFFGVAVARNVLGATDAKSKLYTDGIAWGGICFAFYSGVTFVYSFFLPAIAKAVGRRRAHSLSLLCGAAGLISVAFIHDKNFLLLSMVGVGIAWASTLAMPYSILAASLPPERTGVYMGIFNFFIVTPEIIASLVFGWVMVHWLNNNRLYAVIAGGVFMIAAAIMMQFVTDPAEKKVRATEPEAVVASRRG

SEQ ID NO: 55153 - protein, 262 aa, Zea mays
MANLFLKQAKQYVATRPVYPPELFDFIASKTPRRDMAWDVGTGNGQAAASLAKLYKHVVGTDTSAQQLAYATRLSNTRYVHTPADLPLEGIHATVAPPASVDLVTVAQAFHWLDLPRFYAQARSVLRPGHGVLAAWCYTEPRVDAAVDAVFWRLYHGSQGYWAPNRRMVDDEYRSADFPFDPVEGENHTGPFQFSTHRRMDLDDYLMYITSWSAYQTAQDNGVELLDAPTVQEFAAAWGGDAKEVKTVTYPIFLRIGKVRSE

SEQ ID NO: 55154 - protein, 987 aa, Bradyrhizobium sp. BTAi1
MAKAVAKSKKVAAKSKPSKPGKAKAAPLAPPRKALKTAPKPAAKAPAKVAAKAAPKAPVKTAPKKPAKTVAKPVGKPAKASAAKPAAKSAATAIKPNKWVYTFGDGKAEGKAGLRDLLGGKGANLAEMANLGLPVPPGFTIPTSVCTYFYANDKTYPKELQAQVDKALDYIGKLTDKTFGDPENPLLVSVRSGARASMPGMMDTVLNLGLNDQTVEALASLSGDRRFAFDSYRRFITMYSDVVLGFEHHHFEDILDSFKDSQGYQLDTDLSSEDWEMLVGKYKEAVATETGKEFPQDPHDQLWGAIGAVFSSWMNARAVTYRKLHDIPESWGTAVNVQAMVFGNMGDTSATGVAFTRNPSTGESKLYGEFLINAQGEDVVAGIRTPQDITEDARIESGSDRASMEVAMPEAFKELTRIYTLLEKHYRDMQDMEFTVERGKLWMLQTRSGKRTAKAALRIAVELANEGLISENDAVLRVDPASLDQLLHPTIDPAAKRDVVATGLPASPGAASGEIVFSSDEATKLQADGRKVILVRIETSPEDIHGMHAAEGILTTRGGMTSHAAVVARGMGKPCVSGCGTIRVDYGRGTMSIGGRTFKTGDVITIDGSVGQVLAGRMPMIEPELSGEFGTLMGWADAVRETGVRVNADTPEDARTAIKFGAEGIGLCRTEHMFFEETRIRTVREMILSEEEQERRAALAKLLPMQRADFVELFEIMKGLPVTIRLLDPPLHEFLPHTQAEVEEVARAMNTDPRRLADRARELSEFNPMLGFRGCRLAIAYPEIAEMQARAIFEAAVEAEKRTGEAVGLEVMVPLIATKAEFDLVKARIDAMAQAVIRETGAKLEYQVGTMIELPRAALMAGQIAEAAEFFSFGTNDLTQTTYGISRDDAGSFLGAYVAKGILEIDPFISIDRDGVGELVKIGVERGRATRPNLKVGICGEHGGDPASVAFCHKIGMNYVSCSPYRVPIARLAAAQSALGKEIASQA

SEQ ID NO: 55155 - protein, 500 aa, Kalidium foliatum
MAFPIPSRQLFIDGEWTEPIKKNRIPIINPATEEIIGDIPAATAEDVELAVAAARRALKRNKGEDWASASGAHRAKYLRAIAAKIMERKGQISKLEAMDSGKPLDETEWDIDDVAGCFEYYAEQAEALDAKQKAPISLPMDTFKCHVLRQPIGVVGLISPWNYPLLMATWKVAPALAASCATILKPSETASVTCLELADVCREVGLPPGVLNILTGLGPEAGAPLACHPDVDKVAFTGSTATGSKIMSSAAQMVKPVTLELGGKSPILVFEDVDLDKAAEWAAFGCFWTNGQICSATSRLLVHESIAADFLDRLLKWCKNIKVSDPFEDGCRLGPVISKAQYEKVLKFISTAKSEGATVLCGGSRPEHLKKGYFIEPTIISDVSTSMQIWKEEVFGPVLCVKTFRSDDEAVELANDSQYGLGSAVLSKNLERCEKVTKELQAGIVWVNCPQPCFCQAPWGGSKRSGFGRELGEWGLENYLNIKQVTEYISDEPWGWYKSP

SEQ ID NO: 55156 - protein, 190 aa, Campylobacter lari RM2100
MKVLIIDNYDSFTYTIAFYLKELNIAYKIIKNDKFKNPKKLKKYDFTHLLISPGPNSPKESKLSLKAIKYFKKDKKILGICLGHQCIAHVFGGKISKLPNPTHGKVKTIKFKPNPLFKNLEQNFKICLYHSLYVSRIGKKCEILAQSEDNIIMALKHKKYDIYGIQFHPEAILSQNGKKLLKNFLALSLL

SEQ ID NO: 55157 - protein, 384 aa, Mycobacterium tuberculosis H37Rv
MRAVVIDGAGSVRVNTQPDPALPGPDGVVVAVTAAGICGSDLHFYEGEYPFTEPVALGHEAVGTIVEAGPQVRTVGVGDLVMVSSVAGCGVCPGCETHDPVMCFSGPMIFGAGVLGGAQADLLAVPAADFQVLKIPEGITTEQALLLTDNLATGWAAAQRADISFGSAVAVIGLGAVGLCALRSAFIHGAATVFAVDRVKGRLQRAATWGATPIPSPAAETILAATRGRGADSVIDAVGTDASMSDALNAVRPGGTVSVVGVHDLQPFPVPALTCLLRSITLRMTMAPVQRTWPELIPLLQSGRLDVDGIFTTTLPLDEAAKGYATARARSGEELRFCLRPDSRDVLGAHETVDLYVHVRRCQSVADLQLEGAADGVDGPSMLN

SEQ ID NO: 55158 - protein, 366 aa, Opitutaceae bacterium TAV2
MADTTPSPFDSVESAIQDIAAGKLVIVTDDEDRENEGDLIMAASKAMPETVNMMIRYCSGIVCVPTIDPQLRRLGLGPMVQQNREVQRTDFTVTVDAADGITTGISAYDRTRTIRLLADPETRPDQLVQPGHVFPLRARPGGVLERAGHTEAAVDLATLAGLHPSGVLCELVNDDGTVQRLPQLLEFKKKFGLKMISIAQLIEFRSQRDQLVERVCTRPFPSEFGDFTLHVFRNRLDGRHHLAFTLGALGAEPVLVRVQAENILGDVFRLRGSDSRHSLEASLEAIARAGRGVVLYMEHLQAGAEIIRRLEGKPDAAAMDFRAYGIGAQILVALGLKRIRLLSNNPRRVVGLDGHGLEIVEQVALQ

SEQ ID NO: 55159 - protein, 300 aa, Herminiimonas arsenicoxydans
MQYLTIEDTIGNTPLVQLKRMDGEESARRNNVILGKLEGNNPAGSVKDRPALSMIKHAEERGTIKPGDTLIEATSGNTGIALAMVAAMRGYKMILLMPENLSEERRQAMAAYGAKIVLTPKAGGMEYARDLAEQMQKNGEGLILDQFANPDNPRSHYETTGPEIWRDTGGKITHFISAMGTTGTIIGVSEYLKEKNPDIRIIGVQPEEGSQIPGIRKWPEAYLPKIYDASKVDQLEYVSQGVAERMARRLAMEEGIFCGISAAGACEVALRISQTTENATIVFVVCDRGDRYLSTGVFPA

SEQ ID NO: 55160 - protein, 457 aa, Mycobacterium avium 104
MPPADSRRRAADSSTGALRAGKVVEAQPHPHAALRRSTLPGGLRVVTEYLPAVRSASVGVWVGVGSRDEGATVAGAAHFLEHLLFKSTPTRTAVDIAQAMDAVGGELNAFTAKEHTCYYAHVLDADLELAVDLVADVVLNGRCAAEDVELERDVVLEEIAMRDDDPEDALGDMFLGALFGDHPVGRPVIGTARSVASMTRTQLHSFHVRRYTPERMVVAVAGNVDHDEVVAMVREHFGPHLVRGRQPIAPRKGAGRVNGRPGLLLGTRDAEQTHVSLGVRTPGRGWQHRWALSVLHTALGGGLSSRLFQEIRELRGLAYSVYSTVDIFADSGALSVYAACQPERFAEVMAVTGGVLESVARDGITESECRIAKGSLRGGLVLGLEDSGSRMSRLGRNELNYGRHRSIEHTLAQIDRVSVDEVNAIARRLLTQRYGAAVLGPYSTKRSLPQQLRAMVR

SEQ ID NO: 55161 - protein, 148 aa, Brassica rapa
MEQTFIMIKPDGVQRGLVGEIICRFEKKGFTLKGLKLITVDRPFAEKHYQDLSAKPFFSSLVDYIISGPVVAMIWEGKNVVLTGRKIIGATNPAASEPGTIRGDYAIDIGRNVIHGSDSVESANKEAALWFPDGPVNWQSSLHSWIYE

SEQ ID NO: 55162 - protein, 199 aa, Asparagus officinalis
LDEYSKFHGYSPAVVTGKPIDLGGSLGRDAATGRGVVFATEALLAEYGKSISGLTFVIQGFGNVGSWAAQLIHERGGKVIAIGDVSGAIKNSNGIDIPALVKHKSGGGVLKDFRGSDAFDPKELLVHECDVLLPCALGGVLHRENAADVKAKYIIEAANHPTDPEADEILSKKGVVILPDIYANAGGVIVSYFEWVQNI

SEQ ID NO: 55163 - protein, 354 aa, Methanocaldococcus jannaschii DSM 2661
MEAVLILEDGTILKGKGFGAEKEVFGELVFTTVMTGYVEVLTDPSYKGQIVMMTYPLEGNYGVKKDWFESDGIKAEGFVVREVTSKALDDFLKEYDIPGIQDIDTRFLTRKIRDKGVVKSCLKVAEEISDDEISELLERVKRYSDISDIDLVPLVSTKEPKIHKTANPKARCVLIDCGVKLNIIRSLVQRNCEVIQVPYNTKYDEILEYKPDFVLISNGPGDPARLKEVIKNIKNLIGVVPITGICLGNQLLSLAFGGETYKMKFGHRGGNQPVKDLKTQKVYITSQNHGFAVRKESLPDDVEVSFINLNDMTVEGIRHKDLPIFSVQFHPEARPGPHDTMFLFDEMIKLKDRK

SEQ ID NO: 55164 - protein, 440 aa, Roseovarius nubinhibens ISM
MNEHPLHTDWNFDSTAARRDQYYAASLTRFTPFRDPIVFKKGQGQYLWDTEGRKYTDLLGMNVCISVGHSHPRVVAAAMEQAQELTHCTTMFYHPTPAHLAEELAATMPKGHDWVVHLTNSGSEAIDLAMTMARTYTGNLDLLALRTAYHGPTAAAQSITGIAGWRHPGMPGNVAFVPEPNQYRGIFGEGTAPYLDEITRTIQTATSGKLAGIFVESVQGYGGIIAMPPGYMSGAADRVRAAGGLYIADEVQSGFGRTGDHFWGFEADGVVPDIVVMAKGLGNGFPIGAVVARKDVAAPMAEKFMFHTYGANPTSAAAARAVLAVMRDEGLQENARAVGAKLLERLQDLKDKHSAIGDVRGKGLMLALEFVTDRDSKTPDKEMTAEVFEACRAEGIILSKSGPFQQCLRMVPPLCLSQEDVDHVTTSLDGALSAAANLRR

SEQ ID NO: 55165 - protein, 546 aa, Desulfotalea psychrophila LSv54
MSFQYHREKKMIELIQKTTANLRTEITSGITVALALVPEAVAFSFVAGIDPLVGLYAAFMVGLITSIFGGRPGMISGATGALAVIMVSLVQEGNAMGLAMANPVVGMGLYYLFVTVILMGCFQAMAGFFKLGKFIRLVPHPVMLGFVNGLAIVIFLSQLNMFKTVDGGVSVWLHGPNMLTMLALVGTTMAIMYFLPKLNRQLPAALTAILVISFITIVCKLDVPTVGSFIRDGGGEGLGGVLPSFQLELFSIIPFTLDTLIFIAPYAFLLAGVGLIESLLTLNLLDEITETRGNSNRECIAQGCANIVTGLFGGMGGCAMIGQSMINVNAGARGRTSGIVAALSLLCFILFASTYIEMVPIAALTGIMFMVVIGTFAWSSLRIIPKIPRSDAFVLIAVSALTVIFDLAIAVFVGIIMSALVFSWENALRIRARKHIKENGTKVYEIWGPLFFASCQAFTSKFDAKGDPQNVEIDFMESRVSDFSGVEAISTVIEKYQREGKKVMLKHLSDDCKKLLNTNNSKYQALIIEKVDDPRYFVIADRDLRD

SEQ ID NO: 55166 - protein, 272 aa, Dioscorea japonica
MSSSTLFHLFLLSSLLFSCLSNARPDEDDFSYIEGSPNGPENWGNLNPEWKTCGNGMEQSPINLCDDRVIQTPALGKLRTSYQAARATLKNNGHDIMVNFKSDAGSQFINQVQYQLKRIHFHSPSEHALNGERFDLEVQMVHESQDQRRAVTAILFRFGRSDPFLSDLEDFISQISNSEKNEVDAGVVDPRQLLQFDDPAYYRYMGSFTAPPCTEDITWTVIKKLGTVSPRQVLMLKQAVNENAINNARPLQSQKFRTVFFYPRQKSNHVAI

SEQ ID NO: 55167 - protein, 125 aa, Vitis vinifera
MACSSLPKLLVLCAFFVYISNVVVVAQVDESSLKLITDSLEWPSTMSLYNEFGDEDGEDPDGVIDRRSMFWHRMRYYISYGALSANRIPCPPRSGRSYYTHNCFQARGPVRPYTRGCSTITRCRR

SEQ ID NO: 55168 - protein, 272 aa, Dioscorea japonica
MRSSTLFHLFLLSSLLFSCLSNARPDEDDFSYIEGSPNGPENWGNLNPEWKTCGNGMEQSPINLCDGRVIQTPALGKLRTSYQAARATLKNNGHDIMVNFKSDAGSQFINQVQYQLKRIHFHSPSEHALNGERYDLEVQMVHESQDQRRAVTAILFRFGRSDPFLSDLEDFISQISSSEKNEVDAGVVDPRQLLQFDDPAYYRYMGSFTAPPCTEDITWTVIKKLGTVSPKQVLMLKQAVNENAINNARPLQPQKFRTVFFYPRQKSNHVAI

SEQ ID NO: 55169 - protein, 285 aa, Mycobacterium sp. JLS
MAAARVCVVGSVNADLRFAVPSLPRPGQTVLASSMTTSPGGKGGNQAIAAARAGGDVSLVAALGDDPAAGQLRAHLRANGVGLDGVVTVPGPSGSAVVIVDAAAENAIVVAPGANAHLSVASSAVREAIAGADVVLLQLEIPLHTANDAARVARDAGAVVMVNASPAGAPPHELLRLSEVADVVVVNQAEAGEWHWPVPHLVITRGARGASYLGDGERFDVPAPAVEAVDTTGAGDVFAGVLAVHWRSGHENALRRACVAGALATLVPGAGDCAPTAEAIDDALR

SEQ ID NO: 55170 - protein, 268 aa, Dioscorea japonica
MSSSTLLHLLLLSSLLFSCLANVEDEFSYIEGNPNGPENWGNLKPEWETCGKGMEQSPIQLRDNRVIFDQTLGRLRRNYRAADARLRNSGHDVLVEFKDNAGSLSINRVAYQLKRIHFHSPSEHEMNGERFDLEAQLVHENQDQKRAVVSILFRFGRADPFLADLEDFIKQFSNSQKNEINAGVVDPNQLQIDDSAYYRYMGSFTAPPCTEGISWTVMRKVATVSPRQVLMLKQAVNENAINNARPVQPTNFRSVFYFEQLKSKLGVI

SEQ ID NO: 55171 - protein, 308 aa, Brassica napus
MEGQALKIQSLIIFPIKSCRGISVPQATVTQTGFEWDRYWLVVNHKGRACTQNVEPKLALVEAELPKEAFFEDWEPTKNSFLVVRAPGMSLLKIPLTTPSWVAEGVSMWEWSGSAFDEGEEAAKWFSDYLGKQSRLVRFNKETECRATPPQYAVGYSTTFSNTFPFLVSSQASLDHLNTLLPEPVPMNRFRANIVVENGDPFDEDLWDEIKINDLVFKGVRLCYRCKITTVDQDTGVPSTEPIQTLRKFRSDTLLMPDKKSQRKVFFGKEMVWNWNISNSQGKGKKTIKVGDSISILSKIPSITEAAT

SEQ ID NO: 55172 - protein, 426 aa, Escherichia coli [sequence omitted]

SEQ ID NO: 55173 - protein, 67 aa, Physcomitrella patens subsp. patens
AATLAYAHPVFALVDERLSTEGTGLGLGISNTKLTWILVGVTALIWALYFSYSSTLPEGDDDSGLDL

SEQ ID NO: 55174 - protein, 1241 aa, Zea mays
LQFNCALLPSPRRAVALVARVHRTHGRPATRVWVRDGDDGFRLPPLAKSPRRLRPRSPAPARVLLLLPPWRKPRKSPSAGRTRIELAVAAQFPGRYIYQIYTSSVYLVWPQHGTGSPGPWAHVSAPPRGPGSTCQLPLVADGHRVTGSPPAVTERPRRLVRLLSGAAGHARRIAGAVKEAGAGRAPRSRLRIDASLATALHFFAIDPVGPLILHSTMAPLIHSTPSNQFPVASAAAACCLLVLVTFLVVAACWWDPRTREASSWFLSPPRSAPSSFSSLTSAGGVGGGGEHLLATASSYYSAAAGFRNSTGKEVHQEVRGHGGDDRGFLSFVNSSFGYDEAPPPSAPAPASPVTGGSDEVIIQSTPPQVERRRDDVKLERLELGLARARSAIMEAIRKKDKVSPLPDKDYVPMGPVYRNAHVFHRSYLEMERQLKVYVYEEGEPPVFHDGPCRSIYSTEGRFIHSMETETEAEEGRRLRTRDPARAHVFFLPFSVVKMVQTIYEPGSRDMAPLKRTVADYVRVLSSKYPYWNRSLGADHFMLSCHDWGPYVSSANAQLFGNSIRVLCNANTSEGFDPARDVDVSLPEVNLRSDAVERQVGGPSASRRPVLAFFAGGNHGPVRPALLAHWGPGGRRGGGDPDVRVSEYLPRGGGAPSYADMMRRSRFCLCPGGYEVASPRLAEALYLGCVPVVVDDGEYALPFADVLDWDAFALRLRVADIPRLKEILAAVSPRQYIRMQRRVRMVRRHFMLHGGPPRRYDAFHMILHSVWLRRLNVGPRDAGAAAIQNYRHDDIHRSHPRAQQTTPTRWLVLGRQATPRPNPEAPPPPIDRPSTHAPLGALPLRYARGPAAPRRAGAFLSLTDRATDPTLPHARSPRAPPVSGDGPLIHRRRRRRSVALQRPCLRPGTCPRLLPVPQSVLCFCLIARAALGTSSRLTSRIPPPQSRVRLLIGGEFVESRADEHVDVTNPATQEVVSRIPLTTADEFKAAVDAARTAFPGWRNTPVTTRQRVMFKFQELIRANMDKLAENITTEQGKTLKDAWGDVFRGLEVVEHACGMGTLQMGEYVSNVSNGIDTFSIREPLGVCAGICPFNFPAMIPLWMFPIAVTCGNTFVLKPSEKDPGAAMMLAELAMEAGLPKGVLNIVHGTNDVVNNICDDEDIKAVSFVGSNTAGMHIYSRASAAGKRVQCNMGAKNHAIILPDADRDATLNALIAAGFGAAGQRCMALSTAVFVGGSESWNG

SEQ ID NO: 55175 - protein, 337 aa, Thiobacillus denitrificans ATCC 25259
MHTGTTLTQFIIEEQRRTAGATGDFTSLLNDVVTACKAISNAVNKGALLGVMGALESENVQGETQKKLDVITNDIMIRSNEWAGHLAGMASEEMDDVYAIPGQYPLGKYLLVFDPLDGSSNVDVNISVGTIFSILKAPVAGRAAKAEDFLQAGTKQVCAGYAIYGSSTMLVLTFGHGTNGFTLDRDVGEFVLTHPAMKIPTETKEFAINASNMRFWEKPVQRYVDECLAGKTGPRGKDFNMRWVASMVAEVHRILTRGGIFMYPKDTKDPSKAGKLRLMYEANPMAFIVEQAGGAATTGYQRILDIAPEGLHQRVPVILGSKTEVDTVTGYHHEKAA

SEQ ID NO: 55176 - protein, 305 aa, Rhodospirillum rubrum ATCC 11170
MGDLGTVSHLNEVMAAEALAINDHLSQLMPATDGPEGRVVDAMRYAALEGGKRLRPFLVLQSAQLFSVSRACALNVAAAIEMIHCYSLIHDDLPAMDNDDLRRGRPTVHRQYDEPTAILAGDALLTKAFEVIALPGTHSDPAVRCDLVTELAIAAGAKGMVGGQMIDLMAERGLIDGALDVPAITRMHQLKTGRLISFSSIAGAILGKAPRSQRQALFNYAHDLGLAFQIADDLLDVEGDTATLGKTAGKDEASGKSTFVSLLGLERARDQADMLAEQAVNHLDAFDEKADLLRAVARFVVDRKS

SEQ ID NO: 55177 - protein, 645 aa, Rhodospirillum rubrum ATCC 11170
MTSRPITPLLDTIRGPSDTRGLSVAQLEQLAREVRAEMIDAVSVTGGHLGSGLGVVELTVALHHVFDTPDDRIIWDVGHQCYPHKILTGRRDRIRTLRQGGGLSGFTLREESPYDPFGAGHSSTSISAGLGMAIGSALAGDARDVVAVIGDGSMSAGMAYEAMNNAGAAKSRLIVILNDNDMSIAPPVGAMSAYLSRLLSSKSWLSIRTLAKEIVARLPDALERTAKRAEEYARGMVTGGGTLFEEMGFYYVGPIDGHRMDHLVPVLRNVREAGRDGPVLIHVVTQKGKGYAPAENAPDKYHGVSRFNVVTGVQEKAKPQAPSYTAVFGKQLVAAAAKDHRIVAVTAAMPGGTGLDKLAAAYPQRCFDVGIAEQHAVTFAAGLACEGLKPFVALYSSFLQRGYDQVVHDVVLQKLPVRFAIDRAGFVGADGATHGGVFDMAFLGCLPNLVVMCAADEAELARMVVTAAGHDSGPIALRYPRGEGVGVEIPEDPQPLAIGKGRIVREGKGVALLSIGTRLQSCLEACEILAARGLTPTVADARFLKPFDEELVADLAARHEVLIVVEEGAIGGFCSHVATWLANQGLLDGGLKLRALHIPDRFFEHDAPEVQCAKAGIDAQAITTAVLDALKLETSATIDAGALKA

SEQ ID NO: 55178 - protein, 479 aa, Streptomyces avermitilis MA-4680
MSSTFRNYIDGAFADASDGRTLDVVDPTTGDVYATSPLSGAADVDAAMAAAAAAFPVWRDATPSVRQRTLLKIADAMEARADELVAAESRDTGKPLHLTRSEELAPAIDQVRFFAGAARMLEGRSAGEYMEGMTSIIRREPVGVCAQVAPWNYPLLMAVWKFAPALAAGNAVVLKPSDTTPASTVLIAEIIGGVLEELGLPRGIFNVVCGDRETGRLMVEHPTPAMASITGSVRAGIQVAQSAAKDVKRVHLELGGKAPAVVFEDADLAKAVEDLVVGGFFNAGQDCTAATRVLVHESVHDEFVAALAKAAADTKTGQPDDEDVLYGPLNNAGQLAQVSGFIERLPEHATIEAGGHRVGEKGYFYAPTVVSGLRQDDEIVQNEVFGPVMTVQSFTDEAQAVQYANGVDYALASSVWTKDHARAMRMSKNLDFGCVWINTHMALVAEMPHGGFKKSGYGKDLSAYGFEDYTRIKHVMTSL

SEQ ID NO: 55179 - protein, 367 aa, Buchnera aphidicola (Tetraneura caerulescens)
MIKKFKLAILAGDGIGPEVMEEGIKILEVIKKKFMLKLDIKEYLVGGVAIDKFGTALPKSTIDGCLNADAVLFGSVGGDKWKHLPVEQQPERAALLPLRKILNLFVNIRSSKLYSSLSHLSPLKSKIVNNGFDILCVRELIGGIYYGIPKGQKMDNYKRRYAVDTSIYYEEEITRIANFAFEIATFRRKKVTSVDKANVLETSILWREVVNKVAKKYPEISLNHLYVDNASMQIIKNPMDFDVILCPNLFGDILSDECGMITGSIGMLPSASLNKSKFGLYEPAGGSAPDISGKNIANPIALILSISMLFKYSFEQLNIADAIESSVINVLKDGYRTFDILTTNTNEKLLSTSSMGSKISDYLKHEE

SEQ ID NO: 55180 - protein, 127 aa, Arabidopsis thaliana
  misc_feature (20)..(20): Xaa can be any naturally occurring amino acid
  misc_feature (35)..(35): Xaa can be any naturally occurring amino acid
  misc_feature (88)..(88): Xaa can be any naturally occurring amino acid
RAPESFYKFEIKTPNPETIXAVERKLMEKGVPPIXPHPSDGIPLRPPPSNSRPPGKYTWEGPHRMEDYEIHPDPPPIDEGNPNYDEEXVKKIVDDVPLELLKGEVEVAKEAPPGVARVEVYPRLFAP

SEQ ID NO: 55181 - protein, 358 aa, Herminiimonas arsenicoxydans
MTTDDKLKPLREQIDAIDAQILDLLNRRARVAQEVGHVKAETNAPVFRPEREAQVLRSVAERNPGPLLDTDIQTVFREVMSACRALEKRVTVAYLGPAGTFSEQAVYQQFGRAVEGMPCVSIDEVFRATEAGTADFGVVPIENSSEGVINRTLDLLLQTTLTISGEVSIQVNHSLMTRSGNMSGINSICAHSQALAQCQVWLNQNYPNIERRAVASNGEAARLAGEDATVAAIASEIAGQKYNLQVVKAHIQDDPHNRTRFAVVGRLHTAASGKDQTSLVLSVPNKAGAVYNLLAPLAKHGVSMTRFESRPARMGTWEYYFYVDVEGHLKDSKVADALKELKDNAAFFKVLGSYPFSL

SEQ ID NO: 55182 - protein, 1338 aa, Kluyveromyces lactis NRRL Y-1140
MSFLKKKSSTAGHSRSGSASSILNKHVDPANISEFYPSSLDHKVTSGLKNDYSFDSSSKGSRKSSGGSTNSLTSERLLFNWDVTDPSQWTMPRIIQWFRANDFNDQWITFFKRNSISGNKFLKLLAYDNFAPYEKSLQQSKSSSYERFQYLLKKTLEENVVKGNNRNGNRIINNSRSSSESAKVSQRLSTSFSTHIRSTSESALLNIENITKDSSSSEPTTSKKQEASNYSLPLRQAKTNSASALYRRSLISLRNASSTKDNASKNDIKITIPPRPLSTTENTNKSPTTPSSVSPSHTAYTGIFRRQHKTSSSESSLFTSIFGHGVVEEPEETPKPRPVENRRIPAASTVNASTSKQSINVDDKARLWDKIKRKGQLPAEPSSQPAARIIIEEVKESPKAEPPEIVIPEEIYPKRPSDSRELFIMLTKDNSTFSPFNVQPHLGTDVSELKKAVALALGLTHSNFSIHLTDFGAEFGSQIPDGLLADFQKTSFQNIPNKLYIQDLEKKANLNPRPRTETLASQHSTAASTKSKTSVKSNASAASNGEGSSSDLTSIDDQGSSHRRAYPQTPSHYYDNSTSAETDYWSFKDSVPETISDAPHITLPKSRPSLKLNSSVLNTHASEKSTFRIIRQTSDTDIDFNKRRESPYVRVAELAPKRKAPKPPVNGNPVTSGSLPSAAAKNVSESPLESPPKLDRNGKTIYQKNKPRPPPPLTTELGSRRSVSSLSGQDLNEVKESPVQSFTPASTQVMVPQPYKGALETLKPRKSSADLSIRPRMSLRQFSRSNSSLNRKVLSTSRQTLNRTNSKPLVTSSTAADIFDENDISFADAPELSDSDDYSASSDEIIWSRDRKSISNDVPEFSFNTEDTIDLVGTDTTQVSVGATEGSDTPKKMALRPSPDVVYQNLEKFFPDADLDNPILEGLTPPPSPNADSSPPSPRGFEKSLKTKSEQQPAFLSSRGESSQFLTPVKSLKPPKRTKTIRIIAQEASEARKNEVSQKLQRKNTKMWGTKVVEITDKRTISINKSRNSRGEYKEFAWIKGEIIGKGSFGAVYLALNVTTGEMLAVKQVTVPEFSSQDESAISMVEALKSEVSTLKDLNHVNIVQYLGFEEKNGIYSLFLEYVAGGSVGSLIRMYGRFDDQLIRHLTKQVLEGLAYLHSKGILHRDMKADNLLLDNDGVCKISDFGISRKSNNIYSNSDMTMRGTVFWMAPEMVDTAHGYSAKVDIWSLGCVVLEMFAGKRPWSNFEVVAAMFQIGKSKTAPPIPDDTKDLVSPAGQSFLDQCFEIDPEMRPTADSLVGHPFCKTSSSFDFPKTKLAQFIKSNDKLNSSRLRISSQEL

SEQ ID NO: 55183 - protein, 366 aa, Opitutaceae bacterium TAV2
MPGGWWPDQRPDGEAGGRKPFQSPCRRISFNPGRSQPTVHTVRTASELRGNQLIMTLDDITLALLASYESNGGINHLDGVNLPSEESVNRLAVDCMHLLFPGYFDQTGISRKDIAAHTAARVRALHDRFRAEIEKSLRFAEYEDPVGHAEHVTMRLLGGLPGLRDIVQTDVQAAYNGDPAARSLEEIILAYPCVLVISLQRIAHLLYNLAVPILPRMITEYAHEKTGTDIHPGARIGSHFFIDHCTGVVIGETAIIGSHVKIYQGVTLGAKSFEVDNHGNPIKGVKRHPNIGDHVTIYSHATILGGDTTIGEHTIVGANVWLLESIPAHCIAYYKGENLVVRSRRKQEKAVETRNQDELQAWNWSI

SEQ ID NO: 55184 - protein, 268 aa, Dioscorea japonica
MSSSILLHLLLLSSLLFSCLANVEDEFSYIEGNPNGPENWGNLKPEWETCGKGMEQSPIQLRDNRVIFDQTLGRLRRNYRAVDARLRNSGHDVLVEFKDNAGSLSINRVAYQLKRIHFHSPSEHEMNGERFDLEAQLVHESQDQKRAVVSILFRFGRADPFLSDLEDFIKQFSNSQKNEINAGVVDPNQLQIDDSAYYRYMGSFTAPPCTEGISWTVMRKVATVSPRQVLLLKQAVNENAINNARPLQPTNFRSVFYFEQLKSKLGVI

SEQ ID NO: 55185 - protein, 350 aa, Oryza sativa
  misc_feature (22)..(22): Xaa can be any naturally occurring amino acid
MENGGGDVPENANDHCPGTQSXAAGKADACAGCPNQQICATAPKGPDPGAITHLLAIIERMNTVKHKILVLSGKGGVGKSTFSAQLSFALAEMDHQVGLLDIDICGPSIPKMLGLEGQDIHQSNLGWSPVYVESNLGVMSIGFMLPNPDDAVIWRGPRKNGLIKQFLKDVDWGEIDYLVVDAPPGTSDEHISIVQYLQIAGIDGAIIVTTPQQVSLIDVKKEINFCKKVGVPVLGVVENMSGLRQAFSDMKFVKPSEAGETDATEWALNYIKEKAPELLSVVACSEVFDSSKGGAEKMCQEMEVPFLGKVPMDPQLCKAAEEGRSCFTDQKCSASAPALKSIIKKLVKTK

SEQ ID NO: 55186 - protein, 628 aa, Kluyveromyces lactis NRRL Y-1140
MHIPRSRNASARNFSTNFELSTRALTESVGFKAERLEILSIDPSSKWFIVWFAVSCYFPVVTACLGPLSNMISVACAVDHWRIDPHTGHQVSDPPGIRVLNIISLVSGVIANFVLLLNFTGKLAYVKAQIICISGWIIAQLTLTIALLISTLIYFEDGYQRSIGYWYAVITACLYLLCLILQSIHVSGYYKKKYPATFNLLDNERLLMKFTFVFAIWFLWGAAMFSQLLGQTYGASLYFCVVSVLTIGLGDIFPDNTASEVMILIYSLVGLIVLGLIVVMISGTMKSSSGPIFFFYSVEIQREKVYQKYLANPALEFTDHDAYETIQSIRKRSKMLQRRNSIILTITLFALFLMLGALVLYFSESWTYFEAFYFCLLSVLTIGYGVPSPVSGCGRAFYVIWCLGAVPLMTVLISTVGDWIYEISKSIDNNILEYFHLGNLYRMAKYCVGKVREQFVVKTSSMATVDQTAESETLPDEQEFENYEQRVISDNICSLSSSKLRRRGSKTLLLKCKSLPSLVTSVRKETRFSKIAEIKELLDDLEDIDQLSHQDQAYEFTYTEWVQYLRLESKPSQPNQHLFWISEDSPLRYPLRQPLYLSYKIIEMINATLDSLLAEIEIDELMNTPEVE

SEQ ID NO: 55187 - protein, 271 aa, Dioscorea japonica
MSSSTLLHLLLLSSLLFSCLSCLTNVEDEFSYIEGNPNGPENWGNLKPEWETCGKGMEQSPIQLRDNRVIFDQTLGKLRRNYRAVDARLRNSGHDVLVDFKGNAGSLSINRVEYQLKRIHFHSPSEHEMNGERFDLEAQLVHESQDQKRAVVSILFRFGRADPFLSDLEDFIKQFSNSQKNEINAGVVDPNQLQIDDSAYYRYMGSFTAPPCTEGISWTVMRKVATVSPRQVLLLKQAVNENAINNARPLQPTNFRSVFYFEQLKSKLGVI

SEQ ID NO: 55188 - protein, 268 aa, Dioscorea japonica
MSSSTLLHLLLLSSLLFSCLANVEDEFSYIEGNPNGPENWGNLKPEWETCGKGMEQSPIQLRDNRVIFDQTLGRLRRNYRAVDARLRNSGHDVLVEFKGNAGSLSINRVAYQLKRIHFHSPSEHEMNGERFDLEAQLVHESQDQKRAVVSILFRFGRADPFLSDLEDFIKQFSSSQKNEINAGIVDPNQLQIDDSAYYRYMGSFTAPPCTEGISWTVMRKVATVSPRQVLMLKQAVNENAINNARPLQPTNFRSVFYFEQLKSKVCAI

SEQ ID NO: 55189 - protein, 583 aa, Zinnia elegans
MPKHYRPPGKKKEGNAARYITRSQAVKYLQLSLSVFRRLCIFKGIFPRDPKKKVKGNHHTYYHMKDILFLKHEPLLDKFREMRAYEKKVKKAISKKNKDLAERLLTRKPTYTLDMLIRERYPKFIDALRDLDDCLTMVHLFAALPAIERENIQAERIHNCRGLSLEWQAYISRTHKLRKTFISVKGIYYQAEVEGQKVTWLTPHALQQVMPQDVDYKIMLTFLEFYETLLGFVNLRLYHSIKLKYPPILDPRLKALAADLYALTRYADAKDRTNGANNEESELRLAQLQDQLPANEPGALMHLVENVSGDNEEDEETRACKTLFKNKTFFLGREVPRESLLFVITAFGGVVSWEGEGAPFEESNQDINYQIVDRPTQSHRFISRDYIQPQWVFDCINARIILPTEDYMVGKILPPHLSPFVDNEAEGYVPEYAETIKRLQAAARNEILLMPGGVQDDIESAQNLLAAGIVDRTEAKQAAEAKQKMALHEKQYHEELKKEMEGVQYTPDANIGETKSDDEENMDDVSPQQLVKDDENMTMVSMSRKKRRLYEAMKISQGRKKANVETLETRKKNIQKNKKKSSD

SEQ ID NO: 55190 - protein, 354 aa, Hordeum vulgare subsp. vulgare
MAGSDEVNRNECKTVVPLHTWVLISNFKVSYHMLRRPDGTFERDLAEYMDRRVPANPKPVEGVSSFDHVIDHSVGLEARIYRAVAGNAAAAEGAAALTLPILEFLSGAPSPDPLPVIIFFHGGSFAHSASSTTIYDNLCRQLVKLSKGVVVSVNYRRAPEHRYPCAYDDGWTALKWAQAQPFLRSGEDAQPRVFLAGDSSGGNIAHHVAVRAAEEGIKIHGNILLNAMFGGKERTESERRLDGKYFVTMQDRDWYWKAYLPEDADRDHPACNPFGPNGRRLKGLPFAKSLIIVSGLDLTCDRQLGYAEGLREDGHHVKVVHREKATIGFYLLSNTDHYHEVMEEIADFVQLNLR

SEQ ID NO: 55191 - protein, 353 aa, Glycine max
  misc_feature (140)..(140): Xaa can be any naturally occurring amino acid
  misc_feature (189)..(189): Xaa can be any naturally occurring amino acid
  misc_feature (282)..(282): Xaa can be any naturally occurring amino acid
MDNPKQTLGSFAVVTLLFAGVILLYNWSTSFSNELVLSQKEPLCEQSNSTTTNVEAYGDSLDYALAKASMGNKTVIIAIVNKAYVEQDVKSDTTMLDIFLGSFWLGEGTRSLIDHLLIVAVDQTAYNRCQFLRLNCFRLXTDGVGFEGEKIYMSQDFIKMMWRRTQFLLEVLKRGYNFVFTDTDVMWLXNPFIRLSKNETEDFQISTDSYLGNPWSEKHPINTGFYFVRSNNKTISLFETWYGQKDNATGKKEQDVLLDLIRSGIVEHLGLRVRFLDTLYFXGFCQDSKDFRAVVTIHANCCRSITAKVADMKVALRDWKKFKKLEANSTVNPQWTKHNWCWQSWGRPIKTNS

SEQ ID NO: 55192 - protein, 281 aa, Glycine max
MALRVHFSIVSIAVLALCTSADYFSANFSYAGPNGPEYWGSLSPSYAACSHGKSQSPVELMKTDIVINKQLKNLNRNYLPTNATLVDNIFNIGVHFEGKVGDININGKNYSLKQLHWHSPSEHMANGRIHDAELHLVHLTEDNYNIAVVAVLYKLGDPDPLISQFEDKLVDLEKEIRAGNKDAQIAIGTFDVEEINRSSHRYYRYVGSLTTPPCKEGVTWNILGKLRTLSKKQLELLKAPLGPEFKHNARPLQQLNGRKIQMYYHPNHLHGSHATPSKYHK

SEQ ID NO: 55193 - protein, 151 aa, Glycine max
MKQPTFPNAAAEETKPEQNQTAPKQKSKKFPTATELISHYQKQGGLEPAEASVKVIEDLQNALVRVASSSKNASSKNKLLADARKIDAISGRLAVVDAKLETKPGYVETFALGLASGAALNGISAVWPHVTRGIGQVWSAVKSGTDPSAAS

SEQ ID NO: 55194 - protein, 292 aa, Campylobacter jejuni
MKGIILAGGSGTRLYPSTLTLCKQLLPIYDKPMIYYPMSVLMLAKIKEVLIISTPKDIDRFKELFKDGSFLGMQIQYKIQERPEGLAQGLILAQDFIQNDDIALILGDNIFYGQGFSDILENAKDDLKKGFASIFSYHVKDPERFGVVEMDQNGNVLSLEEKPKNPKSNYVATGLYFYNNDAIDIAKNIKPSARGELEITDVNIEYLRLNKLKSQHLGRGFAWIDTGTHDSLIEASSFVQTIELRQGYKIACLEEIAYNNNWIDNETLEKRALLLSKSNYGQYLYKILSQGK

SEQ ID NO: 55195 - protein, 762 aa, Bacteroides fragilis YCH46
MNKIISKEHFSEKVFKLVIEAPLIAKSRKAGHFVIVRVGEKGERMPLTIAAADPKAGTITLVVQEVGLSSTRLCELNEGDYITDVVGPLGQATHIENFGTVVCAGGGVGVAPMLPIVQALKAAGNRVITVLAGRSKELIILEKEMRESSDEVIIMTDDGSYGRKGLVTEGVEEVIKREKVNKCFAIGPAIMMKFVCLLTKKYEILTEVSLNTIMVDGTGMCGACRITIGGKTKFVCVDGPEFDGHQVDFDEMLKRMGAFKTIEREELHKLDECEATKVIDENGRTAPWREALRKAIKAKDRANIERCQMNELDPEYRSHSRKEEVNQGLTKEQAVAEAQRCLDCANPGCMTGCPVGIDIPRFIKNIERGEFLEAAKTLKETSALPAVCGRVCPQEKQCESKCIHLKMGKEAVAIGHLERFAADYERESGQISVPEVGEKNGIKVAVIGSGPAGLSFAGDMAKYGYDVMVFEALHEIGGVLKYGIPEFRLPNKIVDVEIENLAKMGVTFIKDCIVGKTISVEQLEEEGFKGIFVASGAGLPNFMNIPGENSINIMSSNEYLTRVNLMDAASPDSDTPVAFGKNVAVIGGGNTAMDSVRTAKRLGAERAMIIYRRSEEEMPARLEEVKHAKEEGIEFLTLHNPIEYLADEQGRVKQVILQKMELGEPDASGRRSPVPIPGATETVDIDLAIVSVGVSPNPIVPSSIKGLELGRKGTITVNDQMQSSIPTIYAGGDIVRGGATVILAMGDGRRAAAAMNEQLSSK

SEQ ID NO: 55196 - protein, 399 aa, Synechococcus sp. WH 7803
MEALQAKGYSHPSPIQAQAIPAVIDGRDVMAAAQTGTGKTAGFTLPVLERLRHGKRAGRAQIRALVLTPTRELAAQVLENVKAYSRHLPLRSDVVFGGVKANPQIDRLRGGVDLLVATPGRLLDLHQQGALRFDQLECLVLDEADRMLDMGFIHDIRRLIRLMPAKRQTLLFSATFSAPIRKLASGLLHDPVHLQVTPENQTARSVEQVVHPCDMARKSDLLSHLIRTGEWRQVLVFSRTKHGANRVADRLNKEGLAAAAIHGNKSQGARTRALQGFKQGSVRVLVATDIAARGIDIQQLPHVVNLDLPNVAEDYVHRIGRTGRAGETGHAVSLVAAEEALLLKAIERLTGEELTRQTVDGFEPTVLKAPPLDLSGGRRRSPGKPRARRAPSPVRGRHR

SEQ ID NO: 55197 - protein, 50 aa, Brassica napus
DKGPQASGEGPKPSTSNNNATDSGNTRQAATDQIMMERFRKRERNRVMRR

SEQ ID NO: 55198 - protein, 229 aa, Trichodesmium erythraeum IMS101
MKSPIKAVQTSSYYGDVSFRTPPPDLESLMLKERIVYLGLPLFSSDEVKRNVGIDVTQLIIAQLLYLQFDNPEKPIYFYINSTGTSWYTGDAIGFETEAFAICDTMSYVKPPIHTICIGQAMGTAAMILSAGTKGYRASLPHATIVLNQAKTGARGQATDISIRAKEVLVNKTTFLDILSKNTGQSVEKIAKDTDRMLYMTPEIAKEYGLIDQVLASRKELPKPLPANV

SEQ ID NO: 55199 - protein, 486 aa, Buchnera aphidicola (Chaitophorus populeti)
MLNKNLIDLFRSFSNMSLQKVGVIGMAVMGRNLALNIESKGYTVSIFNRSKNKTKEVILKNKNKNLIPFFTIKDFILSLQKPRIILLMVQSGTATDLTIKSIIPYLDPEDILIDGGNSFYKDTIKRSSLLFKKKIYFFGIGISGGEEGALKGPAIMPGGNKLIYKKISSLLKKIAAKTENNESCVSYIGTDGSGHYVKMVHNGIEYGDMQLISESYFILKHSLNLNNKQLSKIFSNWNKGELKSYLIEITKNIFLKKDSSGKYLIDVILDKANNKGTGKWTSQSALNLGEPLSLITQSVFFRYLSSFKNQRLQASKILYGPKPSQDVLNHEDFIENIRRSLYLGKIISYAQGFSQLKKASQVYHWNLNYSKIAKIFRAGSIIRADFLKEIIHAYQKSNGLENLLLAPYFIKISKEYQNSLRKIVSYSVMHGIPIPAFSAAISYYDSYRSPILPANLLQAQRDYFGAHTYSRIDKKGTFHTNWIDIK

SEQ ID NO: 55200 - protein, 363 aa, Buchnera aphidicola (Chaitophorus populeti)
MHKKYKIAILPGDGIGPEVMQETYKIIEIIKKKLLINIQTSEYDIGGISIDKHGIALPKKTLIGCEKSDAILLGSIGGPKWDILPPKERPEIASLLPIRKHFNLFANLRPSILHKKLNYLSPLKKNNIKDGFDILCVRELTGGIYFGKPRIEINKKNMHYAIDTSIYHKYEIQRIAEIAFQESLKRRCKVTSIDKANVLYTSKLWRKTVNKISKKYPKVHLSHLYFDNAVMQIIKNPNQFDVILCPNLIGDVISDECGSLTGSIGMLPSASLNTKNFGLYEPAGGAAPDTQGKNIANPIAQILSLSMLIKHSLKMNHISNLINTAVYKTLLKGFRTHDISHDKNFVTTKEMGNEIVKSFIEEL

SEQ ID NO: 55201 - protein, 131 aa, Zea mays
GAPEYFLDFVQGRVGGLNLGLVSPDIVTRENVRGLGFPRTPAGGVKFFKEKGASPGFVLVPFSGGRGVLGLLKARGGTPPKGKGGKVLFFPPGGFFGLFDRGAQFSFLGGGGGGRVFEVFFPPKEGPGKIF

SEQ ID NO: 55202 - protein, 201 aa, Oryza sativa
MPSKIEPTKPQELPSPSKESTIRGQSMADQDVAEPWGLSAWPPLTSLLLRAMRKRRTWAALFLAVYASLLCSSWRLVESVRAWYYSAAGGAGAVAAWPAAFYASVMYGAVFGLLSMGAALAVAAPAMLITWITVLVLLAFAGKPRRSLVAEGRRATADIARLALRVLLREGNAVAALCAAASFAALLLGRRDDDPAEGSGS

SEQ ID NO: 55203 - protein, 232 aa, Vitis vinifera
MAGREEGEEAEIERLPMDLLANIFVMLTSFTDLAQASSVCRKWKQGVKQSLGRRESLSFAGWQMDDDSIARLLRHAYGLKELDISRSRWGCQVTDNGLYKISLAKCVNKLTSISLWGVTGITDSGVVQLISRAISLQHLNIGGTFITDESLFAIAESCPCLKTIVLWSCRHVTENGLLVLVSKCRKLQSINVWGTRVPVDCFFALLAIRPALQIKPGRLLLNVERVSMWPVL

SEQ ID NO: 55204 - protein, 428 aa, Vitis vinifera
MFPSFSDQRSLCRASAIPNGYFLLLLIISVLIINSAACSNRNCQVLEPCSLPTDCGPGLYCGNCPAMGKNQPICTRGQATIPTTIINGLPFNKYSWLMTHNAFSIVDAPPLPGVQRITFYNQEDTVTNQLRNGVRGLMLDMYDFENDIWLCHSFRGQCYNFTAFQPAINTLKEVETFLSENPSEIVTIVIEDYVHTTKGLTNLFTNAGLDKYWFPVSKMPRKGEDWPTVTDMVQENHRLLVFTSIASKEADEGIAYQWRYMVENEPGDGGVVQGSCPNRKESRPLNSKSASLFLQNSFPSFPVESDSCKEHSATVGELVGTCYKAAGNVMPNFLAVNFYMRSDGGGVFDVLDGMNGQTLCGCSSVAACQAGAPFGTCKNVAVSNTTQTPNTFGSFSGSVQLSGSASTIHFMNLLYFFLLFFSFLVFQL

SEQ ID NO: 55205 - protein, 127 aa, Alteromonadales bacterium TW-7
MQQLKNEQRGEVTFHREVYRPWGKYDSVDCGERFQVKRITVKPGAKLSVQMHHHRAEHWIVVSGTAKVHLDGQEQYLTENESVYIPITAVHALENPGKVDLELIEVQSGSYLGEDDIVRFEDRYGRS

SEQ ID NO: 55206 - protein, 94 aa, Alteromonadales bacterium TW-7
MEHTKDAVVVPMDAGWNDVGGFEALWEVSQQDENGNAFKGDVKAVDTKNTLVFGEDKLVATVGVENLVIVNTKDAVLVAHKNESQKVKSHCAAA

SEQ ID NO: 55207 - protein, 195 aa, Alteromonadales bacterium TW-7
MLIRNEEHFFIAAEQARQLNVEHSGMSLEPVGRNTAPAIALAAFKAIENKQDPLLLVLAADHVIKNTTAFQQGVNQAAMLAEQGKLVTFGIVGNKPETRFVYIKRGEQYQAGFVVDRFVEKPDLATANTYIESGDYYWNSGMFLFKASRYLQELKAFRPHIYSACEAAMQVQNDDLDFVRVDKAAFEQCPDESIG

SEQ ID NO: 55208 - protein, 685 aa, Coprinopsis cinerea okayama7#130
MANNTKLNVEGILLFEQPFVRVPYENYRKVFRISQKNIERDLGNVQNSAKELVSNAQKGEVDAEAYVTAIDNMISKVENLKQKLNNLQDTAGKPTLDVMRERLNHLATVDSSEPPTSVEFSRWADTRLDRWIVDWCLRTGKERTAKQIAKEKGIETLVDVELFSDIRRIEAALSRHSCTEALAWCSENKAALRKIKSTLEFELRLQEYIELCRARNKTEAIAYIRKYLSSWHETHMSQLNQASGLLAFPPDTKCAPYRRLYDHSRWNSLVRSFRVAIYSLNTIPTEPLLHLALYAGLVALKLPACYDHSTKNVDCPVCDGESGSSTAPLGLGKLAEEVPFSHHSNSTIVCRISGKIMDENNPPMAFPNGRVYSLEIVEGVHKKSGKLFAIKMLNKMQLSKKKMVRSAMLEKDALIALSSHPHPGIVRLHYCFQDAANLYFVLDLAPNGDLKSLTLKTGSLSLECARYYTAQMIDAINLMHEAGVAHRDIKPENCLLDKSMRIKIADFGSAYVTSTPLSTPKTNTFVGTAAFLSPEVLLRQEANPRGPDLWAVGACLFFYLFGTYPFSAMTDYLIMERIKKLDYKIPEGCDPDAADLIKRLLERLGVPPNSSIDELRQHPFFVGSREDGKSGHIDWDTIWTVPAPEIKPGPFKSNPRSSRAESDKAEEELWAKFEEIHLIEDEGRI

SEQ ID NO: 55209 - protein, 471 aa, Coprinopsis cinerea okayama7#130
MPYCLGLQAAARAFLSIGLSTQFTLAIVLSLIIIILSSSFQKDPTDAPAPLPGSSLLHILPFFRRRFDFLNWGFHASGHNIFRFNLLRIPMVRGVTSDLQTRRIQLIHKRLANAQRNAPLSNLIPILLEDSRRQMESWGTSGKFDPFEKVYELLFQLTVRSVSCKEIADNPALVAQLKRLYDDLDTGTTPATVLLPWLPTPAMIKKLWSTKTIYDIVCKAISERESSGAQHNDTLQMLLDAGDEKLVVVGFIMGLLIAGARATGTTASWLLTFLGGHPEWRSKAAAEVETLLASVGSPSPSTQPLSTRLASIPLDVWETETPVLDAIIKETLRVAQPHTAMRRNLGPDCYIDNKRVPTGSYVIYPFSDVHLDPEIYPDPWKFDPGRKDADHVPFGYVGWGGGKTICLGTRLAKVELKLITSMFVLGFEHHIIDPSGQPAKTLPQPNWNDILLCRPPIGSFNISYTRTSTPL

SEQ ID NO: 55210 - protein, 287 aa, Brassica napus
  misc_feature (192)..(192): Xaa can be any naturally occurring amino acid
MEGKEEDVRVGANKFPERQPIGTSAQSDKDYKEPPPAPLFEPGELASWSFWRAGIAEFIATFLFLYITVLTVMGVKRAPNMCASVGIQGIAWAFGGMIFALVYCTAGISGGHINPAVTFGLFLARKLSLTRAVYYIVMQCLGAICGAGVVKGFQPKQYQALGGGANTVAPGYTKGSGLGAEIIGTFVLVYTXVFSATDAKRNARDSHVPILAPLPIGFAVFLVHLATIPITGTGINPARSLGAAIIFNKDNAWDDHWVFWVGPFIGAALAALYHVIVIRAIPFKSRS

SEQ ID NO: 55211 - protein, 123 aa, Synechococcus sp. WH 7803
MSRHSQNWACLQHCGACCRLAPEERQEAIEALTPEQQSQYLAMVGNDGWCIHFDSGARRCRIYAERPDFCRVASLCSLFNIPEDRADAFAIACCRQQIRSVHGGRSLELRKFERLIRSTPPSR

SEQ ID NO: 55212 - protein, 68 aa, Oryza sativa
MASAAIYSLFIINKSGGLIYYKDYGSAGRTDTNDSLRLASLWHSMHAISQQLSPTHGCEGIDLLQAHN

SEQ ID NO: 55213 - protein, 92 aa, Oryza sativa Japonica Group
MTTMDKGRALPKFGEWDVKNPASAEGFTVIFQKARDDKKTTGPGNARVGIPPAFRSTDDDGGYRPEFKPAESYQQHTPPKRVKKKWAFCAGC

SEQ ID NO: 55214 - protein, 363 aa, Trichodesmium erythraeum IMS101
MLRAGIVGLPNVGKSTLFNALVANAKAEAANFPFCTIEPNVGVVAVPDNRLNVLAQISNSAQTVPTRIEFVDIAGLVKGASKGEGLGNQFLSNIREVDAIVQVVRCFDSEDIIHVSGSVDPVRDIEVINLELALSDLAQVERRIERTKKQARTSKEAQTELEVLEKLEVVLNEGNSVKMAGLNKDESLIIKPLNLLTSKPIIYAANVSEDDLANGNDWVEKVRNIAAVENAQVVVISAQVESELIELPEEEITDYLKSLGVEEGGLKSLIKATYELLGLHTYFTTGEKETKAWTIKAGTLAPQAAGVIHTDFERGFIRAETIAYKDLVTSGSMTTAKEKGLVRSEGKDYLVKEGDIMLFRFNV

SEQ ID NO: 55215 - protein, 259 aa, Datura stramonium
AGRWNLEGCTALVTGGSRGIGYGIVEELASLGASVYTCSRNQKELNDCLTQWRSKGFKVEASVCDLSSRSERQELMNTVANHFHGKLNILVNNAGIVIYKEAKDYTVEDYSLIMSINFEAAYHLSVLAHPFLKASERGNVVFISSVSGALAVPYEAVYGATKGAMDQLTRCLAFEWAKDNIRVNGVGPGVIATSLVEMTIQDPEQKENLNKLIDRCALRRMGEPKELAAMVAFLCFPAASYVTGQIIYVDGGLMANCGF

SEQ ID NO: 55216 - protein, 477 aa, Sinorhizobium meliloti 1021
MTCGGFPANKTTPGSAAGSLKRPSRQQNWTPILTSPHHDRLLESISGRTARVGVIGLGYVGLPLAVAVARSGFHVTGFDIDPGKIVALDAGSSYIEAVSDEALAREAGAGRFRSTTDFSDLGFCDVIIICVPTPLTRHRDPDLSFVENTSRAIADCLRPGQLVVLESTTYPGTTDGIVRSILEETGLKSGTDFFIGFSPEREDPGNRAYETTSIPKVVAGDGPMAAGLMERFYAAVVTTVVPVSSNATAEAVKLTENIFRAVNIALVNELKVVYEAMGIDVWEVIDAAKTKPFGYMPFYPGPGLGGHCIPIDPFYLTWKSREYELPTRFIELAGEINSAMPRHVMARLAEALDRREGKALSRSAVLVIGLAYKKNVPDIRESPSLKLIELIEERGGKAAFYDPHVEEIPSTREHMALKGRRSVVFDEATVRGFDAVLIATDHDAVDYAALADWSPLIVDTRNVFARLGLAAEHIVKA

SEQ ID NO: 55217 - protein, 289 aa, Herminiimonas arsenicoxydans
MNSQPVPLTPVVPEIDFERRFGGIARLYGPAALTRFRAAHVCVVGVGGVGSWVVEALARSAIGKITMIDLDNLAESNVNRQIHALTDTLGKAKVTALAERIDQINPYCVVTEIEDFLSADNLDEMIGAHHYDYIIDAIDNVRAKTALIAYCRKHGLKLVTIGSAGGQIDPTKIAVLDLCRTEQEPLLAKVRKRLRAEHGFPRGTKNKFGIDAVFSTEPLRFPESEEACDIDSDTPAGITGLNCAGFGSAMVVTASFGLVAAAHVLRKLAAEAELAAPGNTATVLPQPFE

SEQ ID NO: 55218 - protein, 365 aa, Desulfotalea psychrophila LSv54
MTVRGEPISSSVIRPASESEPTPCRSFHFSSHPAQEDPMKNNKIAVFITGGTIGMSPSDSGLGVSPDNNFEQILASLAPRDDIEVEAIFWADIPSPHMTPEHMLQLAHDIDQLLEKNDYSGAVVLHGTDLLAETSFVLNVSLTTSKPVITTGSMRHLGEAGYDGIRNLQNGLIACTSLPPGGDVLVQMADWLFSAQDAIKQDSLSVDPFVSQSRGAVGRIAAGTLILNQNISKRANKIGKKVEGISANVVLVTAYPGMPGSLLINLLNQGIEGLVIEGFGAGNIPPTAVGAVRHILQAGIPVVLASRCIRGGVAPIYDYPGGGAELIDMGCISAGALNGTKALLLLKIAISNQVDRSSLQELFSL

SEQ ID NO: 55219 - protein, 542 aa, Flavobacteria bacterium BBFL7
MDINFNKNEDHNKLLLSDLKRRLGEVHLGGGKKRIEKLHSKGKMTARERIDYLVDNPEECIEIAAFAGEGMYKEHGGCPSGGVVIKIGYVKGRQVMVVANDATVKAGAWFPITGKKNLRAQEIAMENRLPIIYLVDSAGVYLPMQDEIFPDKEHFGRIFRNNAVMSSMGITQIAAVMGSCVAGGAYLPIMSDEALIVDKTGSIFLAGSYLVKAAIGESIDNETLGGATTHCEISGVTDYKAADDKDALDKIKNIIDKIGDYDRAGYSRVEAVKPALDPEELFGVLPRERSAQYDMMEIINRVVDADTFEPYKDGYGQTIITGYARIDGWAVGIVANQRKIVKTKKGEMQFGGVIYSDSADKSTRFIANCNQKKIPLVFLQDVTGFMVGSKSEHGGIIKDGAKMVNAVSNSVVPKFTIVIGNSYGAGNYAMCGKAYDPRLIAAWPSAELAVMSGNSAAKVLMQIEKASLEKSGKKLTEEEEKELFAKTKDRYDEQVSPYYAASRIWTDGVIDPRDTRKWISMGIEAADHAPITKDFNLGVIQT

SEQ ID NO: 55220 - protein, 391 aa, Gloeobacter violaceus PCC 7421
MRLATRLEKLQSNVFSLMDEAKARARRAGLEVVDLSLGSSDLSPPAHALERIRESILDPTSHGYLLFQGTRSFREACAAWYERRYGLALDPETEILPLIGSQEGTAHIPLAVLDPGDVALLTDPGYPSHEGGVHLAGGQIYPLALRPETGYLPQLEQIPEEVLERSRLLVLSYPHNPTAATATLAYFERAVAFCRAHDIVLVHDFPYADFHLSGEQPPSILQADRERAVAIEFFSLSKSFHMGGFRIGFAVGNRDLVAALRQVKASIDFNQYRGILDGAEAALRGPQDYVREAVAVFRARRDRAVAALAQAGWQVPAPEATMYLWAALPECWRGSSAEFCIRLVEQTGVALAPGSGFGSSGEGYVRFALVRSEDMLERAIAQIAGFLQRSC

SEQ ID NO: 55221 - protein, 435 aa, Aeropyrum pernix
MQVMASPPCTTEELSPPPGGSLVEYSGGSLRVPDNPVVAFIRGDGVGPEVVESALKVVDAAVKKVYGGSRRIVWWELLAGHLAREKCGELLPKATLEGIRLARVALKGPLETPVGTGYRSLNVAIRQALDLYANIRPVRYYGQPAPHKYADRVDMVIFRENTEDVYAGIEWPHDSPEAARIRRFLAEEFGISIREDAGIGVKPISRFATRRLMERALEWALRNGNTVVTIMHKGNIMKYTEGAFMRWAYEVALEKFREHVVTEQEVQEKYGGVRPEGKILVNDRIADNMLQQIITRPWDYQVIVAPNLNGDYISDAASALVGGIGMAAGMNMGDGIAVAEPVHGTAPKYAGKDLINPSAEILSASLLIGEFMGWREVKSIVEYAIRKAVQSKKVTQDLARHMPGVQPLRTSEYTETLIAYIDEADLNEVLAGKRG

SEQ ID NO: 55222 - protein, 168 aa, Triticum aestivum
HPRPPRRSHPDDALDPAARARGPKPGQRRPRTAWIPAPHGGADGYEDEEGHHHYYDDADQSDSAAAAARAARVSGSREASVDESDGVADWGLPNGGAACYGGGGGVRAWLDGLGLSRYAPVFEIHEVDDEVLPLLTLEDLKDMGIGAVGSRRKMFAAIQKLRSTDTVS

SEQ ID NO: 55223 - protein, 547 aa, Flavobacteria bacterium BBFL7
MRKIFNNFTKNPKDDILSGITVSLAMIPEVVAFAFVIGIDPLVALSGAFMIGLITALFGGRPGLISGAAGAVAVIFADLIIEGHEKGLAMDVPVDNMQYIYLFAAVILMGIIQVLAGVFKVGKFVRLIPHPVMMGFVNGLAIVIFWAQIKMFRNRTAVVDENGVTDYVASYMQGSQLYIMIGLVALTMAIVFFLPKLTKKIPAALTAIIVVTAIVILGDMEGVSTVGSYIRDGGGTGLKGELPSFNTELWEKLPLGLETFKFILPYAFLAAAVGLIESLMTMNLVDELTETRGSGNRECVAQGAGNIVSGLFGGTGGCGMIGQTVININAGGRGRLSGVMMSLTLLVFLLFTDQYIEQVPIAALVGVMFMMVIETFAWSSFRILGKIPKSDAIVLIIVSVVTVVFDLAIAVFVGVIISALVFAWESAKRIRARKSIKADGTKVYEIWGPLFFGSVTDFNMKFDPKNDPDKVIIDFIEARVQDHSGIEALRGVANKYLDLGKEIKLTHLSPECKQLLIKNNPEFDTIIESSIEDPRYHIATDLLDAEV

SEQ ID NO: 55224 - protein, 483 aa, Pseudomonas fluorescens PfO-1
MIPVILSGGSGSRLWPLSRKQFPKQFLALTGEHTLFQQTLERLVFEGMDTPIVVCNKDHRFIVNEQLASRNLECQRILMEPFGRNTAPAVALTAMMLVNEGRDELMLVLPADHVLEDQKALQRALALATVAAENGEMVLFGVPATKPETGYGYIKSTGDSLLPEGVSRVSHFVEKPDVKRATEYVESGGYYWNSGMFLFRASRFLEELKKHDPDIYDTCLLTLERSQQDADTVTLDEATFACCPDNSIDYSVMEKTQRACVVPLTAGWSDVGCWSSLWEVNEKDANGNVSKGDVVIQDSKNCMIHGNGKLVSVIGLENIVVVETKDAMMIAHKDKVQGVKQMVNTLNAQGRSETQNHCEVYRPWGSYDSVDMGGRFQVKHISVKPGACLSLQMHHHRAEHWIVVSGTAEVTCDENVFLLTENQSTYIPIASVHRLRNPGKIPLEIIEVQSGSYLGEDDIERFEDIYGRSTPIERGVSVKTIAQ

SEQ ID NO: 55225 - protein, 425 aa, Flavobacteria bacterium BBFL7
MTFKELGLVEPILRALQDQGYENPTPIQAQSIPVLLKGKDLLGVAQTGTGKTAAFSIPILQHLYNSAPPKGRRSIKALVVTPTRELAIQIDENFKAYAKYTDIRNTVIYGGVKQAQQVNRLKSGIDVLVATPGRLLDLINQGFITLKHIEYFVLDEADQMLDMGFIHDIKKLLKLLPHERQSLFFSATMPKTIVELSRQILGDFERVTIAPEKTTAEKVEQQIYHVNKKNKTKLLIELLETKLLDSTLVFSRTKHGANKIVKDLEKAGIGSAAIHGNKSQAARQRALGAFKEGKIQTLVATDIAARGIDIDELSYVVNYDLPNVAESYVHRIGRTGRAGASGLAVSFCMLEERPFLKDIEKLIKQQIPVIEDHDFPFKMEDAAEPSLKKQGQRGRRPQRKGGSNNGKSKSGGSKNAGSNKPRRRY

SEQ ID NO: 55226 - protein, 280 aa, Triticum aestivum
  misc_feature (252)..(252): Xaa can be any naturally occurring amino acid
HYRTSLYKKAGWYRSGIPGISSTHASVRVLGHEELEMHSVSAWKEAKLQYYGGADVAGMQRRPLVHVKDSDNLRDVALTIIQNEISSVPIFKSSTDISGIPLLNLATLPGILKFLCSKLQEQPEGYPILRNQISSIPIGTWSQHTGRASTRQLRTSGLSAPLITCLDFLLEDRISSIPIVDDNGSLLDVYSLSDIMALAKNDVYACIELEQLTVENALELQYQVNGRRQCHTCLSTSTLLEVLDQLSVPRGXRRLVVIEPMTRFVQGIISLRDAITFLLG

SEQ ID NO: 55227 - protein, 101 aa, Glycine max
  misc_feature (63)..(63): Xaa can be any naturally occurring amino acid
MNQTAIANFEKAIGCYSPSVQELIVIDDVLSAMGCIEGRYILIKTICGKSDDITFLVDPSMDXALHELAKRIFPLCTSLVLINQFAESRSEFHSGAVNPCL

SEQ ID NO: 55228 - protein, 224 aa, Cryptococcus neoformans var. neoformans JEC21
MSLRIATTTARAIPARAVATRSIMTLRRVAVPQASPKGYRQSSILQDTAKTAHSAFANLASAAPIKKGDKMPDVEIKIDGPEGKVNLGKEKGKNVVVLVPGAFSGVCSNQVPPYITSFSDFKAKGINNVYVVAVNDIFVVNAWKDKMIGEFSSKEGEGVKFAADDTAALASALGLTFDAQPVFGGPRLKRGVLVVNDGVVEYVGVEDSPGDITISAADKVIKQL

SEQ ID NO: 55229 - protein, 436 aa, Acidobacteria bacterium Ellin345
MSDTIRKYQEYVITSFVKAVQPVVIESASGAIIKDISGREFIDCFAGISVVNAGHCNPKINAAAKAQIDKLVHCGSYIYHSQPTAQLAEKMAKITPGRLKKSFFANSGAEAIEGAMKVARLFTGKHEIISLQQSFHGRTWGTLSITGNQGRKKRGGPYAPGIAFAPAPYAFRSPWPNEPEKFASYCAKQVEETIRYSTSGDVAAFIAEPVMGEGGIIVPPQNYFREVKEVLDRHGILFIADEVQSGFGRTGKMFAIEHYDVEPDILVTAKGIANGYPIAAFTTRDEIAAAFKPGDHLSTFGGNPICCAAALANIEFFEEEKLCDQSTEKGQHALTRLRALQGRQSGIGEVRGLGLMIGVELVKDDHLTPAAAEAEAVRDTCFKAGVLIGVGGTNANVLRLQPPLVITYEQLNTALDVLEGAITEVVGRTAAVAGKA

SEQ ID NO: 55230 - protein, 490 aa, Acidobacteria bacterium Ellin345
MSTTAQTELLQVQNFVNGEWRTSHSGDVLEIYNPATAEPLAHVPLSGADEVNEAVRAAAAAWPAWRETPPGDRIQYIFKLKQLMEEHFEEIARTVTIENGKTLTEARGEVRRGIENVEVACGIPLMMQGYNLENISRGIDEIMYRHPIGVVAAITPFNFPAMIPFWYLPYAIATGNCFILKPSERVPFTMQKVFELIHQIGLPKGVINLLNGGKPAVDALLDHPEVRAISFVGSTPVARYIYERAAKNGKRVQCQGGAKNYAVILPDADMKVATNIVGESAFGCAGQRCLALSVGVTVGEAQKGFREAVSEFAAHLKTGNGLEAGTQMGPVITAQSKSRIEEVIDHAVKQGAKAVTDGRGYRVANHERGNFLAPTILDEVPADSDVPQTEIFGPVLSLVHADSLEHAIELLSKSAYGNAASLFTTNGAHARRFRHEAPAGNIGINIGVPAPVAYFPFSGWKESFFGDLHGQGRDAIEFYTDKKVVIERWS

SEQ ID NO: 55231 - protein, 453 aa, Acidobacteria bacterium Ellin345
MASIVLRTKVPGPKALELASRRSAAVPRGIYASTPIYVSRAEGALIEDVDGNTFIDLAGGIGVINVGHRSPAVVEAIHRQTDRFLHTCFQVVGYESYIRLAEKLNEITPGEFPKRTFFVNSGAEAVENAVKIARYHTKRPAVICFEDAFHGRTTLGMALTSKTHPYKAGFEPFPSEIYRIPYAYCYRCSYGKKYPSCEVACADALEGVFKRTVAAESVAAIIIEPVLGEGGFVTPPSDFLRKLHGICKQHGIVFIADEVQTGFGRTGAMFACERYGVEPDILIGAKSLGGGLPIGSITGRAEIMDAPIPGGIGGTFGGSPLACEAALATIEAMQRQDLPARANALGERFRARALRWQAQWPQIGEVRGLGGMQAIELVRSAESRTPNDSATKHIIQYCYERGVITLNAGTYSNVIRILMPLVISDAQFEEALDVMESALSHEFATSRVTTGVS

SEQ ID NO: 55232 - protein, 320 aa, Oceanicola granulosus HTCC2516
MPRKLILDVDTGTDDAVAIMLAALHPELELVGVTTVNGNVPVEHCTDNSLRTLDHIGRGDIPVYEGLQRPIVRRDFPVPRAIKKDVKVHMDELPIPPARSRKQRMSAPEYLVSAFAEARGELTLVAVGPLSNLAAAIAIDPNFVRNVPELVIMGGAVDKSNITPAAEFNIWADPEAARVVMEAGFERIVLVPLDATHRALVSLEQTRAMRDLGTPAGTAAASIIDYRINGYQTNQPTGIPETAPVHDALCIAYLVQPDVITTRHVNCVIETLGEYTVGRTVVDHEFRTKRAPNCHVAFDADRQAFVTLMTETFGRPHTSA

SEQ ID NO: 55233 - protein, 493 aa, Acidobacteria bacterium Ellin345
MDTATKTSTKTYQMYIDGKFVESATGKLFPVYDPSTEEVIAECPAGNAADVDRAVAAARTAFDDGPWNATTAQERGRVLFRIAEKIRQHTAELAEIECRNSGKPIVEAEYDIADCATCFEYYGGLATKITGQVNPVPDNAVSLSLKEPIGVAGQIIPWNYPLAMAAWKLAPAIAAGCTVVIKPAEQTPLTLLELAKHFEEVGLPNGVVNVVTGYGEEAGAPIVAHKDVDKIAFTGSGSVGKLIMREASATLKRVSLELGGKSPNIFFADADFEAAIDGALFGVFINQGEVCSAGSRILVERPIYKKFVEAMTEKAKKIKLGAPLDRDTKMGPLVSKDQYERVREYQEIGKKEAKVASGGNRPSGFAKGYYVEPTIFYDVDNSARIAREEIFGPVASVIPFDNEADGLKIANDTPFGLAAAVWTRDIFKAFRMVKKIRAGIVWVNHMQPTYYEAPWGGYKQSGFGRELGPWGVEEYLETKQVHINLSEQPIGWY

SEQ ID NO: 55234 - protein, 392 aa, Listeria monocytogenes str. 4b H7858
MSTVDKIGKTADQAIYEKKQGNKVIVVVSAMGKSTDKLVAMAEEISEAPDKREMDMLLSTGEQITIALLAMTLKEKGHDAISYTGWQAGIETEAVHSNARIADIDSARIESALDAGQIVVVAGFQGFTTDGEITTLGRGGSDTTAVAIASALNAVKCAICTDVVGVFTTDPRYVKKAQKLEQITYDEMLELANLGAGVLHPRSVEYAKNFRIPLEVRASHEQVPGTMIEEDLTMENTKVVRGIAFEDQITRVTIHWKQKEAMRVSKVFTKLAENNIDVDIIIQGITGLGHGNLSFTIKTSALLATLAVLEESKELLQIEKLESEQDLAKVSIVGSGMVSNPGVAAQMFEALTENNIPIKMISTSEIKVSTVVPARKMVEAAQVLHDQFELDK

SEQ ID NO: 55235 - protein, 200 aa, Synechococcus sp. WH 7803
MTANGCLRVGQQAPDFTATAVVDQEFKEISLSQYRGKYVVLFFYPLDFTFVCPTEITAFSDRYADFSSKNTEVLGVSVDSQFSHLAWIQTPRNQGGLGDINYPLVADLKKEIASAYNVLDDEEGVALRGLFIIDPEGVIMHATINNLPVGRNVDETLRVLQAFQYVQSHPDEVCPANWTPGEKTMKPDPVGSKEFFAAVN

SEQ ID NO: 55236 - protein, 306 aa, Bordetella petrii
MATSTYPTIEQTVGNTPLVRLQRIPGAAGQARGNVILAKLEGNNPAGSVKDRPALSMILRAEERGEIKPGDTLIEATSGNTGIALAMTAAMRGYRMVLIMPDNLSVERRAAMAAYGAELILTPASKGGMEYARDLAMSMQAEGKGKVLDQFANPDNPRAHIEGTGPEIWTQTEGRVSHFVSAMGTTGTIMGVSTYLKSRNAGVQVIGAQPAEGSQIPGIRKWPEAYMPSIFDRSLVDGYESISQVEAETMARRLAAEEGIFGGISSAGALVAALRVAERVENATIVFIVCDRGDRYLSTGVFNETR

SEQ ID NO: 55237 - protein, 263 aa, Bradyrhizobium sp. BTAi1
MADTRAILTELWSSLRHEAQLAAARDPVFGQALAAAILDHPDLGSVVAHQIGVRLGKTASERARFAAVAREAHAAAPALVEAASRDLGAIAAHDPATTALLPPLLNYKGYVALQAFRVAHWLWRHERFDLALLLQAESSTSLQVSIHPSATIGTSVFLDHATGIVIGAFAAIGDDVTILQNVTIGRQDALPGRSPRVGHGVLISSGATILGNVAIGDFAKIGAGALVTADVPAGCTAVGAPARLTNCPQQPISSGATPLDATS

SEQ ID NO: 55238 - protein, 895 aa, Methanocaldococcus jannaschii DSM 2661
MNISVIGTGYVGLIQAVGLAEFGFDVVGIDIDESKVKALNRGECPLYEEGLEGLLKKHVNKNLTFTTSYKPIKDSDVIFLCVGTPQDKDGNADLRFLFSAVEKIKETIDKEDYKVIVIKSTVPVGTNRRVKELLKDYNVDVVSNPEFLREGIAVYDFFNPERVILGFENLNNKKPIEIMEEVYKYFKDKNIPFVITNWETAELIKYASNAFLATKISFINELAKLSDKVKADIKTISYAMGLDPRIGNKFLNAGIGYGGSCFHPDEVLFIDRGRGLECITFKELFELEDKDNVKILSFDGEKLSLKKLKLASKRYYNDDLITLRFNLGREIKITKDHPVVILEDGELKIKLTSDVKEGDKVILPYGNFGEEREIEIDILEELSKTDLIEKVWIHNKDLATNEFNIIKPYLSNKYPHDVKRNGTIRAKDILPIKEILDKYGSKNRLFTAKSKSTTIPYKIKIDKDFARLIGYYLSEGWISKDYGRNGVVRKRIGLCFGIHEEEYINDVKNILNKLGIKYIEKIKDGSHSILISSKILAYVFENILNCGINCYNKNIPPQMFNAKEEIKWEFLKGLFRGDGGIVRLNNNKNLNIEFATVSKKMAHSLLILLQLLGIVASVKKCYNNKSTTMAYIIRINGLEQVKKIGELFGKKWENYKDIAESYKRNIEPLGYKKSDNFAILEVKEIIKEHYSGYVYSVETENSLLITSYGILIHNCFPKDVKALIKQFENNNIEPILIKATDIVNEEQIKWFFEKIKNYYGNLNGKTFAVLGLAFKPNTDDLRESRAIKLIDMLLESGAIVKGFDYVEKARENTINMYKLDKSKGFYGYNLYVLDDLYETVKNVDGIIITVEYDFNKEDWEKIGNLVKEKVVFDGRNILDVEKIKKLGFKYYGVGR

SEQ ID NO: 55239 - protein, 691 aa, Ashbya gossypii ATCC 10895
MERNTVQRSGTMQTGGSSSASKNYSNINANLHARVKAFQEQRKLQRSGSVGSKSSGQSQDSAAIQHIVNKPLPPLPPGKGKEAAPPLRRQGSMLKADSRPRSMSSFTGSPPAVGASIADAEPVASAERPAPVLQANVGQEADSMPVQQSIPLKAAAVPGRQPHQKTHSASDIFQRTSSHVLPQIPIPLNPIRKAPRPPDAGMGHQRGRQGSHSGIVLGPQSGAGGTGSASDAPKHIMTKSKPSLSARRGLKLPSGGISLKMKQPLQEFASQPSNKDTALATSGVVPGHRVSKSNPGSLTNGIQTTSTSSDKQVDTKGTEPSKSGNSGTNSNGGLFAVFSKYVDIKSGSLNFAGKLSLSSQGVDFSNGSSFRITLDELEFLEELGHGNYGTVSKVLHKPTNIMMAMKEVRLELDESKFRQILMELEVLHKCQSPYIVDFYGAFFIEGAVYMCMEFMDGGSLDKSYDPHEIGGIEEPQLALITESVIRGLKELKDVHNIIHRDVKPTNILCSATQGTVKLCDFGVSGNLVASLARTNIGCQSYMAPERIKSLNPDKATYSVQSDIWSLGLSIVEMALGAYPYPPETYDNIFSQLSAIVDGPPPRLPKDTFSSDAQDFVRLCLQKIPERRPTYASLLEHPWLKKYRGLDVHMSEYITKRLVQRQHYLEQSGGDELPKVLPALHGRLVKPQPHIP

SEQ ID NO: 55240 - protein, 326 aa, Methanocaldococcus jannaschii DSM 2661
MKYKNILVTGSAGFIGFHLSKYLMDNYEDLKVIGIDNLNNYYNPVLKEKRNEILKNYENYTFIKLDFSDWDDLVENLKDKEIDLIVHLGAQAGVRYSLQNPWAYIKSNEMGTLNIFEFARRFDIEKVVYASSSSVYGGNRKIPFSEDDRVDKPISLYASTKRSNELMAHVYHHLYGIKMIGLRFFTVYGEYGRPDMAYFKFAKNILLGKEIEVYNYGNMERDFTYISDVVDGILRAIKKDFDYEIFNLGNSKPVKLMYFIELIEKYLNKKAKKKFLPMQDGDVLRTYADLSKSEKLLGYKPKVTIEEGLKRFCNWFLENKDWLLRL

SEQ ID NO: 55241 - protein, 623 aa, Oryza sativa Japonica Group
MGGGVEERKVVDLEDGDGEEGEDAAAVAAGSSRETRMLPRMPVRVLLAEGDDSTRHIICALLRKCGYRVAAASDGVKAWDILKEKSFNIDLVLTEVELPLMSGFLLLSTIMEHDACKNIPVIMMSSNDSVSMVFKCMLKGAADFLVKPIRKNELRNLWQHVWRKQLSSGVLDVQHTQQEDNLTERHEQKTGVTKAEHVTENVVHKNMECSEQESDAQSSCTRSELEADSRQTNNLLEYKQPMGRHFSKPDHKNTEKNGGTKIHASNDGNLIPRREEDASLRRMTCSNDINCEKASRDMELVHIIDNQQKNNTHMEMDVARANSRGNDDKCFSIPAHQLELSLRRSDYSRLESQEKNERRTLNHSTSSPFSLYNCRTASSTINAGDAQACSTSATHIDLENKNGDSKTPSQDKRETNQPPIRVVPFPVPVGGLTFDGQPFWNGAPVASLFYPQSAPPIWNSKTSTWQDATTQAISLQQNGPKDTDTKQVENVEEQTARSHLSANRKHLRIEIPTDEPRHVSPTTGESGSSTVLDSARKTLSGSVCDSSSNHMIAPTESSNVVPENPDGLRHLSQREAALNKFRLKRKDRCFEKKVRYQSRKLLAEQRPRVKGQFVRQDHGVQGS

SEQ ID NO: 55242 - protein, 376 aa, Nicotiana tabacum
MGSLRAILKNPDDLYPLVKLKLAARHAEKQIPPSPHWGFCYSMLHKVSRSFALVIQQLPVELRDAVCIFYLVLRALDTVEDDTSIPTDVKVPILISFHQHVYDREWHFSCGTKEYKVLMDQFHHVSTAFLELRKHYQQAIEDITMRMGAGMAKFICKEVETTDDYDEYCHYVAGLVGLGLSKLFHASGKEDLASDSLSNSMGLFLQELKYEDNSAKAVQCLNDMVTNALSHVEDCLTYMSALRDPSIFRFCAIPQVMAIGTLAMCYDNIEVFRGVVKMRRGLTAKVIDQTRTIADVYGAFFDFSCMLKSKVNNNDPNATKTLKRLEAILKTCRDSGTLNKRKSYIIRSEPNYSPVLIVVIFIILAIILAQLSGNRS

SEQ ID NO: 55243 - protein, 751 aa, Cryptococcus neoformans var. neoformans JEC21
MGPNTRPAPQAPTHYSRHRPQSITGNNAPQSRTKPRIGQYIVERTLGTGSFGKVKLATHAVTGHQVALKLINRSKITTPDMNARVKREIQYLKVLRHPHIIKLYEVITTPTDVIMVMEYAGEELFNYIVQKGKHGMTEDEARRFFQQMIGAIEYCHKHHIVHRDLKPENLFLDSRRNIKIGDFGLSNLMTDGDFLKTSCGSPNYAAPEVISGKLYSGPEIDVWSAGVIMFVLLCGKLPFDDEHIPTLFKKIENGVFHIPSHVSEPARHLLKRMLEVDPLKRCTIAEIRQMPFFQENLPRYLQPLPELADMERYPSLTMDDMTTLLLINEGQADPKKVAEDKGLVFSEDLGVIDPDIVEELLEKITTYSEGMVWEALKMPGDNQVKVAYQLVRDHRRILKDSNAYEDEDSSAMEEFMASSPPAWNADIAPPIDVQQNGADEYPDLEDVDLEIQDIPNAHFDVLDSSLPGWMTPPSSSTSAMSTPTTTHPTSAQNSANPSFSSVTSDTTASGSTAEEAARALLSPAPSSASQSVTSFSSPTPQPQPQRRLDKSMTKPKWHFGIRSRSPPMEVMLEIYRTLNVLGMQWRLKDIPLPDIGGAPPGGYSEEVELVLEDLKEKNGERPVMGRKPPSKKDAMAQEKLAQGLYHVETRARYGDVMVRMDLQLYRVDDQHYLVDFRNLGYYMVSEKDMSLPDVSRQGHSHEEGASNAGGSVPSATSATAAGAKEAGIGGVSGPFHFLEMACQLIAELASG

SEQ ID NO: 55244 - protein, 397 aa, Herminiimonas arsenicoxydans
MQFKRLSDLIARNELKGKRVFIRADLNVPQDGKGNITEDTRIRASVPAIRQALQAGAAVMVTSHLGRPVEGEFKPADTLAPIAQRLSELLGQPVALKQDWVDGVDVAPGQVVLLENCRVNKGEKKNDDVLAKKIAALCDVYVNDAFGTAHRAEATTHGIAKYATVACAGPLLAAELDALGKALHQPASPLVAIVAGSKVSTKLTILKTLADKVDNLIVGGGIANTFMLAAGLKIGKSLAEADLVGDARAIMDMMAKRGASVPIPVDVVCAKEFSPTAIATVKDVADVTDDDMILDIGPKTADILAKQISQAGTIVWNGPVGVFEFDQFANGTKTLAHAIAESSGFSVAGGGDTLAAIAKYDIADKIGYISTGGGAFLEFLEGKTLPAVEILEQRATS

SEQ ID NO: 55245 - protein, 485 aa, Zea mays
LANYSCCSRRARSSDSEIAPRVVETREAVFTTASVRERERERGDASGRKRGSGSEAGEGEEMVGSGATGGGGGDDARSKEAAGMLALHEALRNVCLDSDWTYSVFWTIRPRPRCRGGNGCMVGDDNGSLMLMWEDGFCRPRVAECLADMSGGGGGGEDPVRKAFIKMSIQLYNYGEGLMGKVASDKCHKWVFKEPSECEPNISNYWQSSFDATIAVIQAGHGLLQLGSCKIIPEDLHFVLRMRHTFESLGYQSGFFLSQLFSSARGASPTPPPPAARPPPAQLFNWPGAHQPQLFPPGPGAFHHPSARAMPPLFPGGGKDEGHMFHIPPAHHGSKPLHMDELQHRHQQTMGAGGEAPDGELRGANGLSFFTPLTGRDDDAKLLFGGPGAADDEKAAPDAQTGHGRAGNVEEYLSLESHSDKAPSKVENGAQHSTKSKRSFTLPARVSSSTTTSPSVSASTAPQGMEYRGTHEGGVYSDLMETFLE

SEQ ID NO: 55246 - protein, 342 aa, Desulfotalea psychrophila LSv54
MGASRILLTGGAGYIGSHTCLELLEAGYQVTVVDDLSNSSYEALCRVESLTGKKVTFHQVNVFDEQALDAVFLNAPESFAAVIHFAGLKVIGESVAEPLRYYHNNITGTLVLCGLMAKHGVKNIIFSSSATVYGDPARVPITEDFPLSCANPYGRTKLMVEEILADLHGADHEWNACLLRYFNPVGAHKSGRIGEDPDGIPNNLIPYIAQVAIGRLDCLSVFGNDYPTVDGTGVRDYIHVVDLAKGHVCAVKKVLEGRGVTTYNLGTGLGYSVLEIVDAFSRACGRDIAYKIVARRAGDIAACYADSAKALTELGWSASLGLAEMCEDTWRWQENNPTGYRS

SEQ ID NO: 55247 - protein, 693 aa, Oryza sativa Japonica Group
MAAAAGEGEAEVTREVISVSTEKAFEGKALPAWSEQITVRSLVVSAVLGTFLSFIVMKLNLTSGIVPSLNVSAGLLAFFLMKTWTSALERCGVFPKPFTRQENTVVQTCVISCSSIAFSGGFGTYILGMSKKIAEGFDEAEAKTSINVEEPSLGRLIAFLFLVSFVGLFSIVPLRKIMIISYKLTYPSGSATAHLINSFHTPQGAIQAKHQVSILFKSFVGSFLWSLFQWFYAAGPGCGFSSFPTFGMVAYSRRFYFDFSATYVGVGMICPYIINFSLLIGSVVSWGIMWPYIESKKGSWYDAGLPKSSLHGLNGYQVFISIAMIVGDGLFNFFSIVLRTAYDLYLKRRGGASKQPQETPFAGATGTERQVLSFDDRRRTQVFLKDQIPTTIAAAAYVLLAAISVVAIPHIFRQLRPKHVVWAYVVAPLFAFCNAYGTGLTDWSLSSSYGKLAIFIFGANIGAKDGGVVAGLAACGLMMGIVSTASDLVQDFKTGYLTLTSPRSMFVSQVLGTGMGCIISPMVFWMFYKANNIGMEEGFPAPYAKIYRGIALLGVNGWDQLPRYCLRFCLAFFLLAIAICALKEVAKQRGWWIQDFIPSALGMAVPFFLGSFFTIDMCVGSLVLFLWSRSDPVRAHTFAPAVASGLICGDGIWSLPSSILSLANVNPPMCMRVFSTATNDKVQLFLRTLPTPP

SEQ ID NO: 55248 - protein, 597 aa, Vitis vinifera
MENKFVNGLKDGQVKEDMLNSLGEDRESAQGNDLDFSESKSKRMPKHIMSLDERYLRRCLELIHISASKAAPCNISLNLSSLKMGIFSDTLNLPKFRGRNTCDMSKLVIECPVATGTGDVVVSPAGQWVVGTLMGSKSMMKILKSPLFRQFGALEDDVKFGGTSLIDAKGAMCTDFISSPGGLSIRSPQNLPKGNISQGNHIYGPEAVHKRLISTSSTNSTCSDQSPSSGFATVSQGMLQCTWKGGIPHFVFSVDDQREVYVANQWKAELPDDKALDCMYLFHSRTGGQKEHKIPDNKADLVGKMKVSSSFTLCPNDSKIMETEFVFFGGRENYASKMQTSSSIIRKNKGLSKKVVEVFRTSHSSKQRTTSKFGGTTAILENDSWEQCQDTCNNPSALGRTNLLENDLPPNLELAAIVVKDHLPGKRQEAEVGGWGLKFLKKVGLKQNSASLEASLPSECCLRSTGDCSTSMDILVPAGIHGGPRTRNGGPSSLIERWRSGGHCDCGGWDIGCPLTVLKTRATKEEFSHHTDIQEEYKSFDLFAQGSELSAPILRVVNVHDGLYFIHFRSMLSALQSFSIAVAIIHTRSPILRPKTV

SEQ ID NO: 55249 - protein, 893 aa, Vitis vinifera
MGIAEELVRPVLNDLANLYDNNWALIEDENYRVLIDAIFEQQEVKGTKSKAREEEASLDDESEDSELPLKRLCSRQQKDALVAMVDSVAGFGGTPSRSSQELPQFHWRKNRVGSTQHFEGDELVKSVPLLPPEGVSNKYPETRPILREKEPPQPCLKDQRGRSDPLFPRTQVQDKGKKPIHPRLGQIENRLNYEKETHIECFKVPKIEPDCVNSPTEDAVNKCHNAPSIVPKNKTFTNDNLQLAVPLVVIHPASPSLKSEDGPSSGNCSHSKEDEHKVHESNYLDVADEANASGEDQANGVSDSSQFDIASSPNGEVKISLILNTSQQSGCHIPNLDAVSKALEDKCRGTYGITEPSFSVMKLMQEFCEYFLAIGADSTDDEKLKTMETSSTLDILKEPAAQDVLGRGDHKGKFCIPSSSSNGSVKCQNLVEVGQKIPRPIYMNGLDILRCTLTSNKVNKSCYIERDENLKVLRGPESLNSCGIVAVQKHCFSVDTVKPLQYFDDITKGEEMVKISLVNGTSSQLPPNFFYIPQNIVFQKAYVNFALARISDEDCCSNCFGDCTSLAIPCACARETGGEFAYQQGGLVKEKFLEECISMNRDPQNHRLFYCKNCPLERSRNENTSNPCKGHLVRKFIKECWCKCGCSKKCGNRVVQRGITVNLQVFLTPEGKGWGLRTLENLPKGAFVCEYVGEIVTNTELYERNLRSTGKERHTYPVLLDADWGSEGVLKDEEALCLDATFYGNVARFINHRCFDANLVEIPVEVETPDHHYYHLAFFTTRKVDALEELTWDYGIDFDDHNHPVKAFRCCCGSKGCRDTRNSKRHGVKRRKMEMKAPTPTRPQTNRLGPFLERITKLTKTRPNKERADQQNPDREYHYGIMVKDEGYIWEFS

SEQ ID NO: 55250 - protein, 590 aa, Cryptococcus neoformans var. neoformans JEC21
MPPRRSTSRAASAKPPSRAPSSRLAKVPEASIPAANGNTKRRRVSDTGEPVAKKGRPSTASVAGRGPKKIIGGINAIPSIPPVKTPHNALFVWGTGDQGQFGLGPDNLDEIGRPKLHSWFEEQIEEGKLSRDGKPGSGGLESVYCGGMHTLAIDEAGRVRSWGINDNAALGRITTDVPDPKNPDEMIPNEDLESYPYVVETLEKEGFRAVQVAAGDSISVAISDKGELRAWGSFRSNEGILGFDGVPGHPKFQYTPISLPALAKVQITQISCGADHVLALTTIGHVYVWGKGEENQLGRRIISRRRINGLEPERLGLRNIVHVAAGIYHSFAVDNKGVVYGWGLNTFHQTGVAEHQDMIITPTVVDALHPDKHNGSKVIKVSGGEHHSLFLFDNGEVWGCGRCDANELGLAEDHPAFEGIKERREELQREREERVAEKQKKLDEVLKKDKVDEEEKQKAEAELSEAQATLKVPPSGEYVPEPVRICFPPIPEKYEVVPEFPAYKDSKPEDNPVVDISAGMRHNLAVSKSGHLYAWGYGNLAQLGLGSEEVAEVPSLVRSKLLRPYRSVTVSAGGQHCVALAVKKPDGEQN

SEQ ID NO: 55251 - protein, 731 aa, Oryza sativa Japonica Group
MSSRKKPSRIEPFRHKVETDPRFFEKAWRKLDDAIREIYNHNASGLSFEELYRTAYNLVLHKHGPKLYDKLTENMEDHLQEMRVSIEAAQGGLFLVELQRKWDDHNKALQMIRDILMYMDRVFIPTNKKTPVFDLGLDLWRDTIVRSPKIHGRLLDTLLDLIHRERTGEVINRSLMRSTTKMLMDLGSSVYQDDFERPFLEVSASFYSGESQKFIECCSCGEYLKKAQQRLDEEAERVSQYMDAKTDEKITAVVVKEMLANHMQRLILMENSGLVNMLVEDKYEDLTMMYSLFQRVPDGHSTIKSVMNSHVKETGKDMVMDPERLKDPVDFVQRLLNEKDKYDSIVTTSFSNDKSFQNALNSSFEHFINLNNRCPEFISLYVDDKLRKGMKEANEEDVETVLDKVMMLFRYLQEKDLFEKYYKQHLAKRLLSGKAASDDSERSMLVKLKTECGYQFTSKLEGMFNDLKTSHDTTQRFYAGTPDLGDAPTISVQILTTGSWPTQPCNTCNLPPEILGVSEMFRGFYLGTHNGRRLTWQTNMGTADIKAVFGNGSKHELNVSTYQMCVLMLFNSADCLSYRDIEQTTAIPSADLKRCLQSLALVKGKNVLRKEPMSRDISDDDNFYVNDKFTSKLFKVKIGTVATQKESEPEKMETRQRVEEDRKPQIEAAIVRIMKSRRVLDHNSIVTEVTKQLQPRFMPNPVVIKKRVESLIEREFLERDKTDRKLYRYLA

SEQ ID NO: 55252 - protein, 438 aa, Pseudomonas fluorescens PfO-1
MRISIFGLGYVGAVCAGCLSARGHDVVGVDVAKDKIDMINAGKSPIVEPGLGELLAQGIQTGRLRGTTNFAEAIRDTDLSMICVGTPSKKNGDLELNYIEAVCREIGFVLREKSTRHTIVVRSTVLPGTVANVVIPILEDCSGKKAGVDFGVAVNPEFLRESTAIADYDLPPMTVIGEFDKASGDVLQSLYEELDAPIIRKDIAVAEMIKYTCNVWHATKVTFANEIGNIAKAVGVDGREVMDVVCQDKTLNLSQYYMRPGFAFGGSCLPKDVRALTYRAGSLDVEAPLLNSLMRSNESQVQNAFDIVESHDKRKVALLGLSFKAGTDDLRESPLVELAEMLIGKGYDLSIYDSNVQYARVHGANKDYIESKIPHVSSLLNSDFDSVIDNSDVIILGNRDEKFRALAEEAPQGKQVIDLVGFMSKATSAGSRTEGICW

SEQ ID NO: 55253 - protein, 251 aa, Treponema pallidum subsp. pallidum str. Nichols
MKLVLIRHGESEWNRLNLFTGWTDVPLTPRGESEAQEGGRVLQEAGFDFDLCYTSFLKRAIRTLNFVLQALDREWLPVHKSWKLNERHYGDLQGLNKTETAQKYGEQQVRVWRRSFDVAPPPLTVGDARCPHTQASYRGVCASGRTPVLPFTESLKDTVARVVPYFEEEIKPQMISGQRVLIVAHGNSLRALMKHIESLDETQIMEVNLPTGVPLVYEFEADFTLCGKRFLGNEADVAARAQAVADQGKSN

SEQ ID NO: 55254 - protein, 275 aa, Treponema denticola ATCC 35405
MEKAAQCVIISYCLYFKPDYIIDKCEVIYMKDDIKINLEEVHRRMEKACKACGRDLKEVRLLMATKTVTPERILKAFEYGELLIGENKVQELCEKYEPLSSVKHETHFIGHLQTNKIKDVIKYADCIESVDRLDLAEKLSKRLESEGKTMDILIQVNTSQEESKFGCKPEEALALTEKIAKLPCLKIKGLMTIGLFSDDMDKVRLCFKLLQKIRKEITEKNIPNVSMEVVSMGMTGDLEVAIEEGSTLIRVGTAIFGKRNYPDSYYWNENAKIEG

SEQ ID NO: 55255 - protein, 1706 aa, Physcomitrella patens subsp. patens
MALASSSRLAAFISDVHYRLVSHPLVFSCSSLICYGPLGMLKQSQKNNFSCTLRRTDGSLELLKLPSASNHVEVRWVKSYDVRCSCFKTNAESSFTTNACLRPSIPDTEDSSLSLRDNQLGNPPELVNREEKDIRTRAALNGSSSKVNRRRTMLASLAAFDVSCSCCKASMAEEWSYGGPSGASKWSGTCSIGARQSPIDVPIKKAQYEEALEELLMDYKMSTPTFKNPGHGTMEVHFPEGVNKLRINEREFNLVQFHFHAPSEHAFDGIRFPMEAHLVHRDPVTKAYAVVGVMLDAAPGGKSNSALAAALKYSPLERGKALTEPKIQISANDLLPPKEMKNDRRYIHYMGSFTTPPCSESVDWFLLKNPLRVPATDILEFMKFAGDEQTLAMNAANFRMALFFQFRDGALSRPQTATSFAAQIIFALDHLIFQTKHPSVPHLYLYRCSASILIPFASARMFLVRRPLFELVVLALSWEKQKDDCQRRGISIADTLKWEAEELLISFMLFYNASSVLYVMRVDVHLITSFSGERKQPSISTMQREFFDHRKEKQRRTESVEESRKPHTLADYIQQNLHGGESLDILGLRNLNPTAADACTTENPDVNFPDHPANDCECWHITAAVGPNSCDLEDLAVVTSNMSAFPNGALKEDAQIISSQQSGISVELDCTQWTTGVAATAQQKVKKHINRNTGIPVPANLRNPIHVGNLQTKKVCSTAPRLKHFDTISNDVPGGNRGTTRSPSEDYAVFSQEEFYAIDESAFDPVVENSQQMFNFSHRLYGQISDAYLVDTKQLHTPSLQLKNSSESHLESSAPETSELLSRFLSTQKLKVLEQEDELVNKPSGSQQHERWQLTHNETTDLPYEAHSLPNSVKAANECHNLDFSNPTFNMINVQVKQEPSEIDFSNEKFVIEDFPVKQEFIFSDPFLNTMKYQEYSQENERLNFGSNISDHRMTQDCQYLADLSYDEPAFKVDSKSFDLREGLECPNKDPTTWYCGTPLSAALTAPNSKGEFPFLDHLKLTKIPSSVGSQNKDLCQSGSYEVSPPYLTCRKKQFNLGIADVNKDNFFDTIEISSSQLEDEEFATAKFDNLQFPVDELEFEGQQTEAAFFSLDLHSPSQMKRNQCNFGSESPVCYDDLVGKNCTITERWNCESSVPWDALHQQEIFDPAISGKNLGQMHDLNDDNSWYHIAAGKDLLDGLKQDIEQHLSADHLMCLETVDSPKGGKDTTTAKTTSITKLLLEDKDLACDTTLTKDCHKFRNCYPLLPISLRSLRKETEVLSWKIELEPQREEDINGMSTTEGGLLRKQLRQEDSHDFHGRTPFSSQEECSPEFQLRKVHTVLCKLQRPTDSRSSKQGEVPDQGAGNVNTVLLKFQRPAEPSHSGPGLQDPESNRSAEKNVKQTSDVDQMINSELGTKPNVECGIRLLTDFNIHDSRGSLTLPHGGSCCVERSVSKPNNSCLNEDVEIKVQSEISKHMRKENRSSLHHIDTIASTDHWVPDELHQNANEEKAHSPLSVLQIKEGPKLCASPVEKQNSTSISQRNSTSLKPEKNHLSLGVTDPPAREEKQHSPPEVRRIAELIVPDEERSFLGVSDAPVTHTGALKFYSNTPQVFERQEIIELAHEQHDRTNIQRNPPPTQDVKQDAGSTTYDAAYVKMLESYVVQLKLENNHAPAARLKSYVAFVCNPKSVRHYFLPGFTSYRPKIP

SEQ ID NO: 55256 - protein, 513 aa, Glycine max
  misc_feature (4)..(4): Xaa can be any naturally occurring amino acid
  misc_feature (71)..(71): Xaa can be any naturally occurring amino acid
  misc_feature (442)..(442): Xaa can be any naturally occurring amino acid
GGGXWEGLFEAITGYGLGGSSMALFGRVGGGIYTKAADVGADLVGKVERNIPEDDPRNPAVIADNVGDNVXYPLLISSMGIIVCLITTLFATDFFEIKAVKEIEPALKKQLIISTVLMTVGIAIISWIALPTSFTIFNFGAQKEVKSWQLFLCVGVGLWAGARAVNSLDHHCLIVFSPVQDVADSCRTGAATNVIFGLALGYKSVIIPIFAIAISIFVSFTFAAMYGIAVAALGMLSTIATGLAIDAYGPISDNAGGIAEMAGMSHRIRERTDALDAAGNTTAAIGKGFAIGSAALVSLALFGAFVSRAGISTVDVLTPKVFIGLIVGAMLPYWFSAMTMKSVGSAALKMVEEVRRQFNTIPGLMEGHAKPDYATCVKISTDASIKEMIPPGALVMLTPLIVGIFFGVETLSGVLAGALVSGVQIAISASNTGGAWDNAKKXYIEAGASEHARTLGPKGSEPHKAAVIGDTIGDPLKDTSGPSLNILIKLMAVESLVFAPFFATHGGLLFKIF

SEQ ID NO: 55257 - protein, 381 aa, Listeria monocytogenes str. 4b H7858
MTKSIRPELRDIQVSGIRTFNTRVTGIPDMIRLTLGEPDFPTPEHVKQAAISAIEENFTNYTPNAGMPELLEAASTYFHEKYDLSYNNKEIIVTVGATEAISVALQTILEPGDEVILPDPIYPGYEPLITLNRAHPVKVDTTETNFKLTPEQLRAHITPKTKALIIPYPSNPTGVTLSKKELFALAEVLNETGIFVIADEIYSELTYHEEHVSIAPLLREQTIVINGLSKSHAMIGWRIGFLLAPEALTQEMLKIHQYSVTCASSISQKAALEALTNGKDDAFQMRTEYKTRANFTQDRLEKMGFTVIPPDGAFYFFVKLPDEITENAFDWAVKLAEEAKVAVVPGNAFSEKGDRYFRLSYATSFNNLAEALDRMAQFIAK

SEQ ID NO: 55258 - protein, 164 aa, Dickeya dadantii
SIGFDNFEQLLSGAHAMDQHFATTPAEKNLPVLLALIGIWYNNFFGAETEAILPYDQYMHRFAAYFQQGNMESNGKYVDRNGNPVDYQTGPIIWGEPGTNGQHAFYQLIHQGTKLVPCDFIAPALTHNALSDHHSKLLSNFFAQTEALAFGKSREVVEAEFAAA

SEQ ID NO: 55259 - protein, 163 aa, Pectobacterium carotovorum subsp. carotovorum
SLGFDNFEKLLSGAHAMDKHFASTPAEKNLPVLLALIGIWYNNFFGAETEAILPYDQYMHRFAAYFQQGNMESNGKSADRNGNPVDYQTGPIIWGEPGTNGQHAFYQLIHQGTKLVPCDFIAPAVSHNPLSDHHSKLLSNFFAQTEALAFGKSREVVEAEFAA

SEQ ID NO: 55260 - protein, 327 aa, Hibiscus cannabinus
CYVQFPQRFDGIDRSDRYANRNTVFFDVNMKGLDGIQGPVYVGTGCVFNRQALYGYGPPSMPSLPKSSSSSCSWCGCCSCCCPGKKEPKDPSELYRDAKREELDAAIFNLREIENYGEYERSMLISQTSFEKTFGLSSVFIESTLMENGGVAESANPSTLIKEAIHVISCGYEEKTAWGKEIGWIYGSVTEDILTGFKMHCRGWRSIYCMPLRPAFKGSAPINLSDRLHQVLRWALGSVEIFLSRHCPLWYGFGGRRLKWLQRLAYINTIVYPFTSLPLIAYCSLPAICLLTGKFIIPTLSNLASVLFLGLFLSIILTAVLELRWSG

SEQ ID NO: 55261 - protein, 311 aa, Physcomitrella patens subsp. patens
IDITSSLEKIKKQLNSCRAGNVLLQGPLLKRSEIIRKWEWRWFVLDVLTGKLEYWSHRGDASPKGAVNFDANSSVTISPKNMLKEAKYDACCFYIITSREKEYFFCAETPKAAEAWVATLRAAVSVLKAHKQAANFLSGNAFCKLENVASVFAAAIDITSEAALNLQLSMKAAALSPSASFKSPISAAETIKVKAEEIHQLASDLKSRDIIIKELAERLTETAEAAESAASSVHIVNKGCNEALSEVDRLRRQLLHAVKRVRDADARRAASLKVEETASKEAHRCRLELGKLREREVILEAAMVRVDEDIR

SEQ ID NO: 55262 - protein, 710 aa, Mycobacterium avium 104
MSDSIIGWDKDADGIVTLTIDDLDNGANMLTDAYVEQMGAMIDRLEAEVDETTGVVITSGKSTFFAGADLTQIRSAGPEHAQQLFDGSTAIKRDLRRLETLGKPVVAAINGAALGGGLELALATHHRIAADVAGSVIGLPEVMLGVLPGAGGVARSVRLLGIQNALMQVLLTGNRFKPAKAQQVGLVDELVESVEELVPAAKTWILANPDKHVQPWDVPGFEIPGGGPATSAFAANLPAFPANLRKQLKGSRMPAPRAIMAAALEGAQVDFDTAQVIETRYFVHLVTGPIAKNMIQAFFFDLQAVQGGTSRPADVPERTINKVGILGAGMMGAGIAYVTAKAGIDVVLKDITLQAARKGKAYSENLEQKALAKGRTTEAKSQALLDRITPTADAADFAGVDFVIEAVFENTELKNKVFAEIENIVEPGAVLGSNTSSLPITDLAAGVSRPENFIGIHFFSPVEKMDPIEIIRGAKTSDETLARVIDYTLAIKKYPIVVNDGRGFFTTRVFSTYLLEAFNMLAEGIDPATIEQAALQAGYPAGPLQVADELSFGTIRKIMDETVQAAAADGLPLDESVRVAAEVVTTLMDTFDRNGKQGGAGFYDYADGTRAGLWDGLRTAFNTTRALSVPFDDLQDRYLFIQAIETQKAYDDGVISSDPDANVGSIFGIGYPPWTGGVRQFATGYPGGADAFRRRADELAAAYGGRFRWI

SEQ ID NO: 55263 - protein, 239 aa, Ashbya gossypii ATCC 10895
MVKPIIAPSILASDFANLECGCHRVINAGAEWLHIDVMDGHFVPNITLGPPIVKSLRKAVPRVGDKESDKPKAFFDCHMMVAEPEKWVDVFVENGADQFTFHYEATKNPLELVKLIKSRGIRAACAIKPDTPVDVLFELAPYLDMALVMTVEPGFGGQKFMPDMMPKVAALREKFPQLDIQVDGGLGKETIPHAAKAGANVIVAGTSVFAAADQKDVISYMKDNVRDELRSRGLLDIDM

SEQ ID NO: 55264 - protein, 189 aa, Zea mays
MDKEWSDDQRAAFLDVAARQPGLKGIHDFRTRRSGSHDFAQFHMEVERELTVAAAHDIVEGVERALRRAFPKVEVLIHLDPEGHVDTDNPLVEADVTPHWFGKRVDAFASAAFGGNPAAVMMLSGWPDDALLLAIAQENNLSETAFLVPADGGEADFELRWFTPGDEGGDVRPRHAGERPCRAVVRYRA

SEQ ID NO: 55265 - protein, 398 aa, Mycobacterium avium 104
MSTPLPPLVAPADQLTADEMARYSRQLIIPGLGVDGQKRLKNARVLVIGAGGLGAPTLLYLAAAGVGTIGIVEFDAVEESNLQRQIIHGVADVGRSKAASARDSIAAINPLVDVRLHEFRLDASNAVELFGHYDLIVDGTDNFATRYLINDAAVLAGKPYVWGSIYRFEGQASVCWEDAPDGRGLNYRDLYPEPPPPGAVPSCAEGGVLGVVCAAIASVMSTEVIKLITGIGESLLGRLMIYDALEMSYRTIAIRRDPCDASRPAITTLVDYEQLCGAAPAASTDAATGGAEAAITPRQLRELLDSGAKLALIDVREPVEFDIVHLDGAQLIPQSSINSGEGLAKLPADRMPVLYCKTGVRSAQALAVVRQAGFSDAVHLQGGIVAWAQQMQPDMILY

SEQ ID NO: 55266 - protein, 224 aa, Triticum aestivum
MDEKAAKMEKLSSAAAFVEGGVQDACDDACSICLEAFCDSDPSTVTSCKHDFHLQCILEWCQRSSQCPMCWQAISMKDPLSQELLEAVEQEKNVQADRSRTTAVFRHPMLGHFEVPVDTDDAELEERLVQHLAAAAVTRRSHRHGRREGHRGRSGPHGRTQIVVFSTTETTSSDPISSDSPQVGDSEYSPAIISAPVDAMEEASANILVHNNTSSNCPVGSNDR

SEQ ID NO: 55267 - protein, 365 aa, Triticum aestivum
  misc_feature (237)..(237): Xaa can be any naturally occurring amino acid
VKLPTRPRGPQLFYRERERERERERERDLRSQVGSPEEPSRRQPEGERSEGLAAKMAKLKELLDRSENRICADCSAPDPKWASANIGVFICVKCSGVHRSLGTHISKVLSVTLDKWTDDEIDSMVEVGGNSQANAIYEAFLPEGYRKPHPDSAQEDRQKFIKSKYELQEFLEPSLRIVSNHPSNAGKQASNSHSGSSKSEIGMVEFIGILNVKVIGGTKLAIRDVSSSDPYVVLTLXGQQKAQTSVIKGNLNPVWNEELKLSVPRKYGPLKLQVLDHDMVSKDDLMGEAEIDLQPMINAAASFGDPELLGDIQIGRWLKSGDNALTADSAVMVTGGKVKQEVSLKLQHTESGEVTVEMEWMALNI

SEQ ID NO: 55268 - protein, 755 aa, Oryza sativa Japonica Group
CLDFISSKQLHRGGVDSPSWRSGAQPDNIVIKATGGGAFKYADLFKERLGVSLEKEDEMDCLVAGANFLLKSIRHEAFTHMDGQKEYVQIDQNDLFPFLLVNVGSGVSIIKVDGHGKFQRVSGTNVGGGTYWGLGRLMTKCKSFDELLELSQRGDNSTIDMLVGDIYGGLDYSKIGLSASTIASSFGKTISDDKELSDYRPEDISLSLLRMISYNIGQISYLNALRYGLKRIFFGGFFIRGHAYTMDTISFAVNFWSKGEAKAMFLRHEGFLGALGAFMSYEKHGLDDLRIHHLVERFPMGAPYVGGKIHGPPLGDLNEKISWMEKFVQKGTQITAPVPVGFPVTTGMGGFERPTAKGDILRSDASAALNVGVLHLVPTLDVFPLLEDPKMYEPNTIDLDLNEYKYWFKILSDHLPDLVDKAVASEGGTDDAKRRGDAFAHAFSAHLARLMEEPAAYGKFGLANLLELREECLREFQFVDAYVSIKQRENEASLAVLPDLLMELDSMNEEARLLALIEGVLAANIFDWGSRACVDLYHKGTIIEIYRMSRKKMQRPWRIDDFDMFKKRMLADKKGQPYKRALLFVDNSGADVVLGMIPLARELLRNGTEVVLVANSLPALNDVTANELPGIVAEAAKHCGILRKAAEAGGLIFDAMAGIQDDLKDEPVSVPLMVVENGCGSPCIDFRQVSSELAAAAKDADLLILEGMGRSLHTNLNARFKCDTLKLAMVKNQRLAEKLFNGNIYDCICKFEPVP

SEQ ID NO: 55269 - protein, 379 aa, Arabidopsis thaliana
RESPAEHGYYMPAEWDSHAQTWIGWPERQDNWRHNALPAQRVFADVAKAISKFELVTVCASPAQWENARKQLPEDIRVVEMSMNDSWFRDSGPTFIVRKRPVKLSSLNRNIAGIDWNFNAWVGANDGCYNDWSHDLLVSRKILALERIPRFQHSMILEGGSIHVDGEGTCLVTEECLLNKNRNPHMSKEQIEEELKKYLGVQSFIWLPRGLYGDEDTNGHIDNMCCFARPGVVLLSWTDDETDPQYERSVEALSVLSNSIDARGRKIQVIKLYIPEPLYMTEEESSGITQDGEAIPRLAGTRLAASYVNFYIANGGIIAPQFGDPIRDKEAIRVLSDTFPHHSVVGIENAREIVLAGGNIHCITQQQPAEPTSVAENGH

SEQ ID NO: 55270 - protein, 307 aa, Sinorhizobium meliloti 1021
MGIWIDTDMGFDDIAAMLVVLHAGEAVDGVSLVYGNVPLGQVKRNAAAAAQAFGWTFPIHQGRALPVLGKLETAERILGQTGMPTSGLSLPDAPALPDSDAFLALCRWLEDGEGPHRILALGPLTNIAALALARPDLAARIDELTWMGGGVSSGNHTASAEFNAFADPEALAIVLAHGVPFRMVDLDLCRKVIAYPKDVEAIRTAGGAKAALLADLLAGYVAIGTSRGRTGMAIYDPCAAVALVDGNAVSFRPARIDVELAGALTRGRTVVETRANHATFNAHYAIDVDAERARRHLLAALTKEAAR

SEQ ID NO: 55271 - protein, 198 aa, Neisseria gonorrhoeae
AEWNKTELDSYLIEITAAILGYKDEGGEPLAEKILDTAGQKGTGKWTGINALDLGIPLTLISEAVFARCVSSFKEQRVQTGKLFARTATPVEGGKQEWVEALRQALLASKIISYAQGFMLIREAGESYGWGLDYGNTALLWREGCIIRSAFLGNIRDAYEANPDLVFLGADPYFKNILENCLPAWRKVVAKAVECGIP

SEQ ID NO: 55272 - protein, 340 aa, Mesorhizobium loti
MRLSKFAPRHAVNAGERKTTSAMIASIAPDGIATRNAPFGHTLARLAHERLGIVGLTADLAKYTDLHVFAQEHPDRFYQMGMAEQVLMSAAAGLAREGFTPFATTYAVFASRRAYDFICMAIAEENLDVKIVCALPGLTTGYGPSHQATEDIAIFRGMPNLTIIDPCDALDIEQATEAIADYKGPVYMRLLRGKVPVVLDEYDYTFQIGKARLLRDGADVLFISSGLMTMRVLEAAKALEADRIDCAVLHVPTIKPLDTDAILAAARRAGRMVVVAENHTMIGGLGEGVAGLLMREGVTPVFRQIALPDEFLDAGALPTLHDRYGISTSEIVRRVRKWVK

SEQ ID NO: 55273 - protein, 308 aa, Salmonella enterica subsp. arizonae
INGFGRIGRIVFRAAQKRSDIEIVAINDLLDAEYMAYMLKYDSTHGRFDGTVEVKDGHLIVNGKKIRVTAERDPANLKWDEVGVDVVAEATGIFLTDETARKHITAGAKKVVLTGPSKDNTPMFVKGANFDKYEGQDIVSNASCTTNCLAPLAKVINDNFGIIEGLMTTVHATTATQKTVDGPSHKDWRGGRGASQNIIPSSTGAAKAVGKVLPELNGKLTGMAFRVPTSNVSVVDLTVRLEKAATYEQIKAAVKAAAEGEMKGVLGYTEDDVVSTDFNGEVCTSVFDAKAGIALNDNFVKLVSWYDN

SEQ ID NO: 55274 - protein, 501 aa, Arabidopsis thaliana
MENGKCNGATTVKLPEIKFTKLFINGQFIDAASGKTFETIDPRNGEVIATIAEGDKEDVDLAVNAARYAFDHGPWPRMTGFERAKLINKFADLIEENIEELAKLDAVDGGKLFQLGKYADIPATAGHFRYNAGAADKIHGETLKMTRQSLFGYTLKEPIGVVGNIIPWNFPSIMFATKVAPAMAAGCTMVVKPAEQTSLSALFYAHLSKEAGIPDGVLNIVTGFGSTAGAAIASHMDVDKVSFTGSTDVGRKIMQAAAASNLKKVSLELGGKSPLLIFNDADIDKAADLALLGCFYNKGEICVASSRVFVQEGIYDKVVEKLVEKAKDWTVGDPFDSTARQGPQVDKRQFEKILSYIEHGKNEGATLLTGGKAIGDKGYFIQPTIFADVTEDMKIYQDEIFGPVMSLMKFKTVEEGIKCANNTKYGLAAGILSQDIDLINTVSRSIKAGIIWVNCYFGFDLDCPYGGYKMSGNCRESGMDALDNYLQTKSVVMPLHNSPWM

SEQ ID NO: 55275 - protein, 198 aa, Neisseria gonorrhoeae
AEWNKTELDSYLIEITAAILGYKDEGGEPLAEKILDTAGQKGTGKWTGINALDLGIPLTLISEAVFARCVSSFKEQRVQTGRLFARTATPVEGGKQEWVEALRQALLASKIISYAQGFMLIREAGESYGWDLDYGNTALLWREGCIIRSAFLGNIRDAYEANPDLVFLGADPYFKNILENCLPAWRKVVAKAVECGIP

SEQ ID NO: 55276 - protein, 366 aa, Solenostemon scutellarioides
MVATMAVSPRVEELARSGLDTIPKDYIRPEEELKSIGDIFAEEKSMDGPEVPTIDLTEIDSSDEERRRKCHGELKKAAEDWGVMYVINHGIPEELISRVKAAGKEFFKLPVEEKEKHANDQAAGNVQGYGSKLANNASGQLEWEDYFFHCVFPEEKRDLSIWPQNPPDYIPATSEYAKQLRGLTTKILSILSLGLGLEEGRLEKEVGGMKDLILQMKINFYPKCPQPELALGVEAHTDVSALTFILHNMVPGLQLFYEGKWVTAKCVPNSIIMHVGDTIEILSSGKYKSILHRGLVNKEKVRISWAVFCEPPKEKIVLQPLPETVSEAEPPRFPPRTFAQHLKHKLFRKSDGEVDEKKKPKEDESN

SEQ ID NO: 55277 - protein, 340 aa, Coprinopsis cinerea okayama7#130
MATRDVSSQSDISKMQRDPDGSFKRQASAFRNTIERGGKFEPERGGYSTTAVPLDSIGLTRLMLADRYHLYVSYACPWATRTLIVRKLKGLEDIIPVTAVSPRMGAHGWPFASADDYPGTDPDPLHQSQHVKDLYLKADPDYAGRFTVPILWDKKNQTIVNNESSEIIRFFNSAFNHLLPEDKAKLDFYPQELRVAIDSLNEWVYHGINNGVYRAGFATTQSAYEKAVHEVFDSLDKVEKILEGKEYVVGDRLTEADIRLWVTIIRFDPVYVGHFKCNFRTIRDGYPAIHSWLRKLYWNVPAFKDSTNFDHIKTHYYWSHTSINPTRIVPVGPIPDIQPL

SEQ ID NO: 55278 - protein, 726 aa, Coprinopsis cinerea okayama7#130
MASTAVDHQPGALESRKRTDVEEGLDEKRQDSSVSSINHQLDEGFEGHDVTNPFPVDPDEPIETHQLTFRAIFVGCCLGAVVGSSNIYLGLKTGFTFGAQLFGAIFGFAILKSVSKIVPESGILGKFLGGPFGPKENCTVQTAATAAGGLGILFVSAVPAMYRLDLLSEDPAKDIGKLIALTVCAGFFGVFFVIPLRRYYIIHQKLTFPTPAATAYTIRQLHKGKSGAVVAKKKSLALLYTFLGVFAYKVATGYAPGIIYDWHIGWTLYQLGWKGAISIENYGWIIEFTPAFFGAGMLSGLNASWSFFGGAIMAWGIIAPSLIKNGLAFGRPNPELPEYVSYYAMVFTNTDDYIDRPSPRYWLLWPGVFIMLLYSFADIFVGLLPFLTAMKASTLKKYLDPRGWFVRGNPEDDEDKTPHEDRVPFLWWSVGLLASTITSVAILATLFHMNVGTALLSLILGFIFSFIAVQSAGHTDVNPVSTVAKASQLVFGGISKGTGMAEQPAQTINLVSGIIAAGSAAQASDMCGDLKTGYLLRAKPRNQFIAQLCGSVVAVFLTCGLFLLFTKATPCILKEVEGELCTYGAPSVAAWAAVALAVTRPRLPVPPSSGYTAIGLGIASVLTVFARHWLIPKKYHAWVPNWNAIGLAFVVPQVYYPIAMAVGSIFNFFWLKRSPATFDLYMFPISAGLLAGEGLGGVLQALLAIVGADGATYGTAVGCPLNSYCG

SEQ ID NO: 55279 - protein, 366 aa, Solenostemon scutellarioides
MVATIAPSPRVEELARRGLDTIPKDYIRPEEELKSIGDIFAEEKSIDGPEVPTIDLAEIDSSDEERRRKCHDELKKAAEDWGVMYVINHGIPEELISRVKAAGKEFFELPVEEKEKHANDQAAGNVQGYGSKLANNASGQLEWEDYFFHCVFPEEKRELSIWPQNPPDYIPATSEYAKQLRGLTTKILSVLSLGLGLEEGRLEKEVGGMEDLILQMKINFYPKCPQPELALGVEAHTDVSALTFILHNMVPGLQLFYEGKWVTAKCVPNSIIMHVGDTIEILSNGKYKSILHRGLVNKEKVRISWAVFCEPPKEKIVLQPLPETVSEAEPLRFPPRTFAQHLKHKLFRKSDTEVDEKKKPNEDESN

SEQ ID NO: 55280 - protein, 129 aa, Glycine max
MELARPASSRRKLKDLLLQSDNRLCADCNAPDPKWASANIGVFICLKCCGVHRSLGTHISKVLSVTLDDWSEDEIDAMMEVGGNASANSIYEAYIPEGYTKPGPDAGHEQRSKFIRSKYELQEFLKPSL

SEQ ID NO: 55281 - protein, 312 aa, Zea mays
MGSGSLLKVFANNFDVLAGPLVALAYPLYASIKAIETKSPVDDQQWLTYWVLYSLITLFELTFASIIQWLPFWPSMKLIFICWLVLPYFNGAAYVYQNYVRPAFIKNQMVNIWYVPQKKGLLGKSDDFLTALDKFIEENGTDALKKLANKAGKPFKQSGKSSKDQKETKSSKDSKEPKPSKDAKQPKPSKDTKEPKPPKDSKSSPKDSKEQKKAALKDPKKAPKDSKGLKKALKDPKEQESLEDPKEHTAKKAGKRVTFAEVEPEKEFKASNSDWHPSSDFHAAYPEQNPWASGFMIFEDENSYWNRGPLDC

SEQ ID NO: 55282 - protein, 563 aa, Vitis vinifera
MGQSHSSSSAGAAPAPPAIPMGPVVPTSLLAPAMSSAPGMYLRESNSSLRSTARSPLYISMPETDDCVESSEVDGPDYTSDLPDDILACIFQFLSTGDRKRCSLVCQRWLLVEGRSRHRLSLNAQSEIIPLIPCIFFRFDSVSKLTLKCDRRSISISDDALILISNLSKNLTRLKLRGCRELTDVGMAALAKNCKGLKKLSCGSCTFGTKGINAVLDHCSALEELSVKRLRGMNDRGVAEPIGPGVAASSLKSLCLKELYNGQCFERLVVASKKLRTLKLFGCFGDWDRFLETVTDGNSNLVEIHLERLQVTDMGLSAISKCLNLEILHILRTPECTNLGLVSVAGNCKLLRKLHIDGWRTNRIGDEGLIAVAKQCTNLQELVLIGVNPTSSSITAVASNCQKLERLALCGSQTIGDKEISSIAAKCTALRKLCIKGCPISDHGMEALAWGCPNLVKVKVKKCPGVTCEAVDSLRARREALIVNLDAVAVETLDASTSDGGAQEDGQEPPPMVSQVTVVDGPSGSNGLSALFKSKFGHFAGRNLVACAFGRWSNSRGSSADGK

SEQ ID NO: 55283 - protein, 384 aa, Coprinopsis cinerea okayama7#130
MSQPGPAQAQAQAKKHGHAASVAQPAPRKVRFNVGTQYQVLDVVGEGAYGIVCSAVHRPSGRKVAIKKIAPFEHSMFCLRTLRELKLLKFLSEAGVSENIISILDIIKPPSLEAFKEVYLIQELMETDMHRVIRTQDLSDDHAQYFIYQTLRALKALHSADVIHRDLKPSNLLLNANCDLKVCDFGLARSVKTAEPSGTETGFMTEYVATRWYRAPEIMLTFKQYTKAIDVWSVGCILAEMLSGKPLFPGRDYHHQLTLILDVLGTPTLDEFYAITTRRSRDYIRALPFRKRKPFSQLFPNANPLAVDFLTRTLTFDPKKRITVEDALAHPYLEAYHDPDDEPVAPPLDPEFFEFDLHKDDISREQLKELLYEEIMSFKPAPIT

SEQ ID NO: 55284 - protein, 374 aa, Chlamydomonas reinhardtii
MARTGALLLAALALAGCAQACIYKFGTSPDSKATHTGDHWDHSLNGENWEGKDGAGNPWVCKTGRKQSPINVPQYHVLDGKGSKIATGLQTQWSYPDLMSNGSSVQVINNGHTIQVQWTYDYAGHATIAIPAMRNQSNRIVDVLEMRPNDASDRVTAVPTQFHFHSTSEHLLAGKIFPLELHIVHKVTDKLEACKGGCFSVTGILFQLDNGPDNELLEPTREGTFTNLPAGTTIKLGELLPSDRDYVTYEGSLTTPPCSEGLLWHVMTQPQRISFGQWNRYRLAVGEKECNSTETDAAHADAGHHHHHHRRLLHNHAHLEEVPAATSEPKHYFRRVMEETENPDAYTCTTVAFGQNFRNAQYANGRTIKLARYE

SEQ ID NO: 55285 - protein, 372 aa, Vitis vinifera
MALQEQETLSQNAPFFLDGLYCEEERFGDDDDGEVEEASEIEKCDREKKQSLFPLTLLEHDLFWEDDELCSLISKEEQAHHCYSGIISDGFLTVARTKAVEWMLKVNAHYGFSALTAVLAVNYFDRFLSSSCFQRDKPWMSQLAAVTCLSLAAKVDETDVPLLLDLQVEETKYVFEAKTIQRMELLVLSSLQWKMNPVTPISFFDHIIRRLGLKTHLHWEFLERCERLLLSVIADSRFLCYLPSTLATATMLHIITEVEPCNPLEYQNQLLSVLKISKNDVDDCYKLILEFLGSHGHTQNQTHKRKHLSLPSSPSGIFDAPFSCDSSSDSWAMATSISSSSQPLFKKSRAQDQQMRLPSLNRVSVDVLSSPR

SEQ ID NO: 55286 - protein, 146 aa, Glycine max
MESAALSRIGLAGLAVMGQNLALNIAEKGFPISVFLDRIKKAYQRNPNLASLIVDPEFAREMVQRQAAWRRVVGLAVSAGISTPGMCASLAYFDTYRRARLPANLVQAQRDLFGAHTYERVDRPGAFHTEWTKLARNSGAGVGALN

SEQ ID NO: 55287 - protein, 540 aa, Phanerochaete chrysosporium
MSTSRLVLFLLINIPILSVVCNVIYQLLPKDKSLPPVVWHWFPWFGSAAAYGEDPIKFFFDCKEKYGNVFTFILMGRKVTVALTPAGNNFIMGGKHTTFSAEEGLTTPVFGKDVVYDCPNELLMEQKKFVKFGLSTENFRQYVGMIEEEVLQFMRNDASFKIYQMNDINEWGAFDVLKVMSEITILTASRTLQGKEVRANITKDYAQVYNDLDGGFTPLHFMFPNLPLESYRKRDAAHKKISDFYISIIRKRRENPGQEEEHDMIAALMNQKYRVGRPLKDHEIAHIMIALLMAGQHTSSATGSWALLHIADRPDVAEALYEEQVKHFRQSDGSWRTPEYEELKELPVLDSVIRETLRIHPPIHSIMRAVREDVVVPPTLAAPSEDGRYVIPKGHVVLSSAAISQVDPMLWKNANDWDPSRWSDPEGVAAQAYKQYDDAEGAKVDFGFGLVSKGTDSPYQPFGAGRHRCIGEQFAYLQLGTIISTFVRHVEMRLPETGVPPPNYHVRSHTRILRLVCADVASADDDHTPEGASQHSLQAA

SEQ ID NO: 55288 - protein, 275 aa, Bacillus cereus ATCC 14579
MNIGIIGTGNMGNILIDAFLETRAVKPSCLTIINRTPAKAYHIKEKYPSVHIAKTIPEVIEQSQLIFICVKPIDIYPILKKYAEHFSDETCLVSITSPISPSQLETLVPCHVARIIPSITNRALSGASLFTFGDNCSEEWQQKLLRLFKNISTPLVIEEDITRVSSDIASCGPAFFSYLLQCFINAAVDKTNITHEEATTLVSEMVVGMGKLLEKEIFTLPTLQEKVCVKGGVTGEGIRVLEEHVGDMFHKLIERTHEKFDEDLECVDQQFNKHT

SEQ ID NO: 55289 - protein, 164 aa, Pectobacterium carotovorum subsp. carotovorum
  misc_feature (44)..(44): Xaa can be any naturally occurring amino acid
SLGFENFEKLLSGAHAMDKHFASTPAEKNLPVLLALIGIWYNNXFGAETEAILPYDQYMHRFAAYFQQGNMESNGKSADRNGNPVDYQTGPIIWGEPGTNGQHAFYQLIHQGTKLVPCDFIAPATSHNPLSDHHSKLLSNFFAQTEALAFGKSRDVVEAEFSAA

SEQ ID NO: 55290 - protein, 444 aa, Hibiscus cannabinus
NWLQVGDDLNHRNLTDLTKKFGDIFLLRMGQRNLVVVSSPELAKEVLHTQGVEFGSRTRNVVFDIFTGKGQDMVFTVYGEHWRKMRRIMTVPFFTNKVVQQYRHGWEAEAASVVEDVRKNPEAATNGIVLRRRLQLMMYNNMYRIMFDRRFESEDDPLFVKLKALNGERSRLAQSFEYNYGDFIPILRPFLRGYLKLCKEVKEMRLQLFKDYFLEERKKLASTTRSDNNALKCAIDHILDAQQKGEINEDNVLYIVENINVAAIETTLWSIEWGIAELVNHPRIQQKLRDEIDTVLGPGVQVTEPDTHKLPYLQAVVKETLRLRMAIPLLVPHMNLHDAKLAGYDIPAESKILVNAWWLANNPAHWKNPEEFRPERFFEEESKVEANGNDFRYLPFGVGRRSCPGIILALPILGITLGRMVQNFELLPPNGQSKIDTTEKGGQF

SEQ ID NO: 55291 - protein, 174 aa, Silicibacter pomeroyi DSS-3
MTIYALGEHRPEIHPDTWVAPDANLIGKVVLEEGASVWFGCTIRADHEEIRIGQGSNVQENCVMHIDAGYPLTIGANCTIGHKVMLHGCTIGENSLIGMGATVLNGARIGRNCLIGAGALITENKEIPDNSLVMGVPGKVVRQLDEAAVARIAWSAKHYQDNMRRFRDSMIAVG

SEQ ID NO: 55292 - protein, 348 aa, Synechococcus sp. WH 5701
MFGLIGHSTSLEQARSKALELGFPEYADGDLDLWCVAPPQLVENVSITSPTGKTIEGAYIDSVFVPEMLSRFKTARRKVLNAMELAQKSGIDITALGGFTSIIFENFNLLKNQQIRSTALEWERFTTGNTHTAWVIAQQVETNAPALGIDLSRAKVAVVGATGDIGSAVCRWLSQNTGVGELLLVARQPQPLLDLQAELGSGRILSLEEALPEADVVVWVASLPQGLSIDPASLKSPCLMIDGGYPKNLDSKVTGAGVHVIKGGIVEFWQDIGWQMMQVAEMENPRRQLFACFAEAMLLEFEGLHTNFSWGRNNITLANMELIGAASLRHGFRSIGLNQVPRPQLAAV

SEQ ID NO: 55293 - protein, 194 aa, Acidobacteria bacterium Ellin345
MLVPMVIEQTSRGERAYDIYSRLLRDNIIFLGTPIDDNVANLIIAQMLFLEAEDPEKDISLYINSPGGSITAGMAIYDTMQFIRPDVATICIGQCASMGATLLASGAPGKRYALPTSRILIHQPLMSGLSGQATDIDIHAREILRMREITNQLLAKHCNQRLEKVEKDVERDFIMNAQQAKEYGLVDDIIYKHK

SEQ ID NO: 55294 - protein, 164 aa, Pectobacterium wasabiae
SIGFDNFVELLSGAHAMDKHFSTTPAEKNLPVLLALIGIWYNNFFGAETEAILPYDQYMHRFAAYFQQGNMESNGKYVDRNGNVVDYQTGPIIWGEPGTNGQHAFYQLIHQGTKMVPCDFIAPAITHNPLSDHHQKLLSNFFAQTEALAFGKSREVVEQEFVTR

SEQ ID NO: 55295 - protein, 1441 aa, Spirodela polyrrhiza
MEIAGYRGGSLRGSLQGSLRRSVSAWRSPSTSDVFGRSSREEDDEEALKWAALEKLPTYDRLRKGIMTGDGGEIQEVDIQGLGFQERKNLLEKLVRNAEEDNERFLLKLRNRMERVGIDNPTIEVRFEHLNINAEAFVGNRGVPTLVNFFVNKAIWILSALHLMPSGKRPISILHDVSGIIKPCRMTLLLGPPGAGKTTLLLALAGKLDNTLKVTGNVTYNGHGMHEFVPQRTSAYISQHDVHIGEMTVRETLAFSSRCQGVGTRYEMLTELSRREKEANIKPDPDVDVYMKAVAVEGQESVVTDYILKILGLDICADTMVGDGMIRGISGGQKKRVTTGEMLVGPSKALFMDEISTGLDSSTTFQIVNSLRQSVHILGGTALIALLQPAPETYDLFDDILLLSDGQIVYQGPRENVLEFFESMGFKCPERKGVADFLQEVTSRKDQQQYWVRENEPYRFVPVNEFSEAFKSFHVGAKLHEELSTPFDRSRNHPAALTTSKYGISKMELLKACIDREWLLMKRNSFVYIFKVVQLIVLALIAMTVFFRTKLPRNGLEDATIFFGAMFLGLVTHLFNGFAELAMSIAKLPVFYKQRDLLFYPPWAYALPTWILKIPISFVECGVWIAMTYYVIGFDPNVVRMFRHYLLLVLISQVASGLFRLLAAVGRDMVVADTFGAFAQLVLLVLGGFIIAREKIKKFWIWGYWSSPLMYAQNAIAVNEFLGHSWNKLVDATGQTLGERFLRNRGIFVDKNWYWIGVGALIGYMVLFNFLFILFLEWLDPLGKGQTTVSEEALQEKEANRTGANVELATRGSAATSDGGSVEIRKDGNRKKGMVLPFTPLSITFDNVKYSVDMPQEMKDRGVTEDKLLLLKGVSGAFRPGVLTALMGVSGRGKTTLMDVLAGRKTGGYIEGDIRISGYPKNQETFARISGYCEQNDIHSPHVTVYESLLYSAWLRLPAEVDEKQRKMFVDEVMDLVELNSLRGSLVGLPGVTGLSTEQRKRLTIAVELVANPSIIFMDEPTSGLDARAAAIVMRAVRNTVDTGRTVVCTIHQPSIDIFEAFDELFLMKRGGEEIYVGPLGRQSSHLIKYFESIDGVKKIKERYNPATWMLEVTTISQEEILGLNFAEVYRNSDLYKRNKDLIKELSTPPPGSKDLFFATQFSQSFVMQCLACLWKQHKSYWRNPSYTATRLFFTVVIALIFGTIFWDLGKKRSTSLDLINAMGSMYAAVLFIGIQNAQTVQPIVDVERTVFYREKAAGMYSALPYAYAQVLIEVPHILVQTLLYGLLVYSMIGFDWTAAKFLWYMFFMFFTFLYFTYYGMMAVAMTPNSDIAAIVAAAFYAIWNIFAGFIIPRPRIPIWWRWYYWACPVAWTLYGLVVSQFGEYTDTMSDVDETVKDFLRRFLGFRHDFLPVVGVMVVVFTVLFASIFAFSIKTLNFQRR

SEQ ID NO: 55296 - protein, 497 aa, Ashbya gossypii ATCC 10895
MSELFEEINVPETGFTYLQPLGLFIDNEFVAPMGGSQLQTTNPANGELIATFYAAGAADVDAAVAAARRAYEERWRHTSAQERGALLARLAELVDEEREVLAGIETLDSGKPYHTNALADLDQVAYVTRYYAGGADKMHQGDAFALSHTKQAYTLEVPYGVVAQIVPWNYPLAMASWKAQGCLAAGNCVVIKPSENTSLSLLYFASLVRRAGFPPGVFNVLPGLGPEVGQRLAEHKGVDKIAFTGSTAVGQKVMAAAAMSNLKDVTLECGGKSPAVIFADADLDSAVNYVAAGIFYNSGQNCTANSRIYVQEAVYDAFLDKFRAHVRSTYSFGSGLFSKDCNMGPVISKTQYDRVMGYINHGINEKLAYEQFGSVPEKGYYIPPTIFLDVPQSSRLCREEIFGPVAVVAKFKDYDEAIRYANDTNYGLASCVFTENIRVAHRFVRDVQSGTVWVNSSNDEEVGVPFGGFKMSGIGRELGKAGLQTYLQTKAVHLNFA

SEQ ID NO: 55297 - protein, 186 aa, Desulfotalea psychrophila LSv54
MSKSQRPRSIMLRPFLKVLPTVGKNVYVDSSSVVIGDVRLGDDVNIWPLVAIRGDVHTITIGARTNIQEGSVLHVSRKSKIKPNGFRIDIGTDVTIGHKAMLHGCQIGNRVLIGMGAIVLDGVIIEDDVLLAAGSLVTPGKRLESGFLYQGSPAQKARPLREDELDYLQESAQSYVTLKNDYLREI

SEQ ID NO: 55298 - protein, 183 aa, Physcomitrella patens subsp. patens
MSSPSKRREMDVMKLMMSDYKVEMVNDGMSEFYVEFHGPRESPYQEGTWKIRVELPDAYPYKSPSIGFVNRIFHPNVDEMSGSVCLDVINQTWSPMFDLINVFEVFLPQLLLYPNPTDPLNGEAAALMMRDREHYEQKVKEYCERYAKAEDIGRHPEDSSDDELSEEEDCMSSDEEMAGHADP

SEQ ID NO: 55299 - protein, 358 aa, Brassica napus
  misc_feature (193)..(193): Xaa can be any naturally occurring amino acid
  misc_feature (199)..(200): Xaa can be any naturally occurring amino acid
  misc_feature (202)..(202): Xaa can be any naturally occurring amino acid
  misc_feature (204)..(205): Xaa can be any naturally occurring amino acid
  misc_feature (215)..(215): Xaa can be any naturally occurring amino acid
  misc_feature (218)..(218): Xaa can be any naturally occurring amino acid
MGDWAQLAQSVIIGLIFSYLLAKLISIVVTFKEDNLSLTRHHDPEPESKNLKPEVDSRRIESSTGEADSLVAEQGSSRGDSVAGDTEDEDDDDWEGVESTELDEAFSAATLFVTTAASDRLSQKVPSEVQQQLYGLYKIATEGPCTAPQPSALKITARAKWQAWQKLGAMPPEEAMEKYIEIVTQLYPTLGGXRGRGKXXKXGXXGKGEAVSNTXGTXGGPVFSSLVYQEESENELKIDAIHEFAREGEVENLLKSIESGIPVNAKDSEGRTPLHWAIDRGHLDIAKLLVDKNADVNAKDNEGQTPLHYAVVCDREAIAEFLVKQKANTASKDDDGNSPLDLCESDWPWLRETAKQTD

SEQ ID NO: 55300 - protein, 240 aa, Brassica napus
MENNGVKSAASSAMEAFEKLEKVGEGTYGKVYRAREKATGLIVALKKTRLHEDEEGVPPTTLREISILRMLARDPHIVRLMDVKQGLNKEGKTVLYLVFEYVDTDLKKFIRSFKQAGQNIPQNTVKSLMYQLCKGMAFCHGHGVLHRDLKPHNLLMDRQKMTLKIADLGLARAFTLPMKKYTHEILTLWYRAPEVLLGATHYSTAVDMWSVGCIFAELVNKQAIFAGDSELNSSSAFQVA

SEQ ID NO: 55301 - protein, 605 aa, Gloeobacter violaceus PCC 7421
MRVGADVFVLDANAQQTTAAPSERARFRRTKIVATIGPAVDDPQALRKLIQAGATTLRLNFSHGNHEEHRRRIGLIRQISFELNQPVAILQDLQGPKIRLGKFADGPIVLKHGDPFILTSHDVPANQHISPITYSRLIQEVPTGATILLDDGRVELVVERVDLEAQYLHCRTVGGGKLSNSKGVNFPGVTLSVPAMTEKDREDLLFGLNQGVDWVALSFVRTPSDLLELKELIAQSGKRVPVIAKIEKFEAFENLDAVIAACDGLMVARGDLGVEMPAEEVPLLQKRLIASANRAGKPVITATQMLDSMVSNSRPTRAEVSDVANAILDGTDAVMLSNETAVGEHPILAVETMARIADRIERSMPQRTWVDTGRSIPNAISQAVGSVAQQLGAQAILTLTKSGATARNVSKYRPRVPIIAITPSVSVARELQMVWGVYPLMVLDLPSTRQTFQAAISAAQDENLVLEGDLVVMTAGTIQGLSGSTDLIKVEVVTAILGRGLGLGQNAVSGRARIVRHSDEAAALSPGDILIAPRTDANFIEAIKLAGGIVTEESGLTSHAAIIGLRLGLPVLLGVKDCTTRIPDGVVLTLDPQKGVIFSGAASAV

SEQ ID NO: 55302 - protein, 314 aa, Vitis vinifera
MATNIGMMDSAYFVGRSEILSWINSTLQLNLSKVEEACSGAVHCQLMDSVHPGIVPMHKVNFDAKNEYEMIQNYKVLQDVFNKLRITKHIEVSKLVKGRPLDNLEFMQWMKRYCDSVNGGLLNSYNPLERREASKGGKEASKKPSQPSAKSSTAAPKAQPSHNARKNDASSASTTNLSVKVSRPGSSGGPAYDEKITELKLSIDSLEKERDFYFAKLRDIEILCQCPEIEHLTVVGAIKRILYATDDNASVVAEAQAMVPISELPEEKPKPETQKRKIIMNHEVDVAAITTLSPRQRISDASDVHCSGSPLMTY

SEQ ID NO: 55303 - protein, 284 aa, Triticum aestivum
LHRTSLYKKAGWYRSGIPGISSTHASDLTPRQPAKAYGGDGGAYYEWSPAELPMLGVASIGAAKLSLAAGGMSLPSYSDSAKVAYVLQGKGTVGIVLPEATKEKVVAVKEGDALALPFGVVTWWHNTPESATELVVLFLGDTSKGHRPGQFTNFQLTGAQGIFTGFSTEFVARAAGTQGRTMPPQPHFPPRLPSGHCDNLLPGTKIFTEHRSMICPPRSIGLFTPPVTAPPRPCAPPPPRPHQLGRRHRTPTPPLLSPRILIIILRITHSSHLSILWQLIFFII

SEQ ID NO: 55304 - protein, 306 aa, Oceanicola granulosus HTCC2516
MCSKGVLAAVGNTPLIRLERLEPAGGAEVWLKLEAGNPTGSYKDRMAVSVLGRAMERGELAPGNRVVEYTGGSTGTALAFVSAALGVTFTAVFSDAFSASKRLAMEAFGAEVLVEESDGTITPELIQRMKARAYALAEEPGSFYADQFGSADVRAGYEPMGHEIAADLGQVDVLVAAVGTGAALMGTADGLAARGIDPRLIALEPAQSPLLTTGKGGPHRVEGIGVGFAPPFLDRGRLAEVRAIDQDRAFEMCRTLARQAGVFCGGSTGLNVVAAIELSRELGRGRKVVTLGCDSGAKYLGGHIYG

SEQ ID NO: 55305 - protein, 338 aa, Cryptococcus neoformans var. neoformans JEC21
MPPRKSKSRDVKSTAPSPSPSIGQRRSSRAPRKEPAPAVEVVEEKDEVSSESEEVDAAEGLETRETDAGEAEQDEQVQEVAEKEHVKSNKGKEKMSMAERMAKIKELRMKMNQSAAQNRRDLVEDHQKAQVTAKELARLEKQRKLAQTLRLKAEAEENGEDIERKKNWEWTIEDNERWQAKLEEQKVKQDTHFHNAEDDAYKKYNRNLRATKADLVAYERQKEAALGLAPGTLVPARATSSSLAASSSKPGLTGAEDLYRGADTLVYGDNKPSEDAVDRVISKINKDIGKKKRTKKDDEDGEINYINERNKVFNKKISRYFDKYTKEIRANFERGTAL

SEQ ID NO: 55306 - protein, 1237 aa, Synechocystis sp. PCC 6803
MPFEDALAIVNAAMQTLLGRQLSDIETLIFEGSWQSKTYPQIADGAGYSINYLTTDVGPKFWKVLSQALGEPVNKKNFKAAIRRYCVVQSGGEWESEGFQTQLPSYPSILSWGEAPDVSQFYGREEEQALLQRWIEAERCRLIAVLGMGGIDKSTLTTKVVQGFVQGDGVEEWEGDNINIKKIQNPLQEGQSPTKFKIQHLPSSPATPFTHIIWRSLRNAPPLEALLAELIDLLSEHQETVGDRARLLHWLRKTRCLIVLDNLETILQAGDHAGYYRDGYGDYGELIQLLGETPHQSCVLLTSREKPAEIAVLEGLDGNTRTLQLSGSVATAIAIIQQKGLQGTEEQQQVLCDRYSYNPLALKIVSTTIQDLFDGDISAFLTEDAVIFNSIRRLLDAQFQRLTELEQAIIIWLAINRDWTAIAELAADLVPPVPKVKLLEALESLRWRGLIETQDKRYTLQPVVMEYVTERFIEQINQELEMGQPQYWQQFALLKLTVRDHITETQRRLIVHSTAAQFGDCFPSPELQRQQLQTVLTAIRESVIAGYGVGNLINLSNALDLDLAGFDFSQLTIRQADLRHRLFQHLNFAQANFRDSAFKQTFGSIFSLSYSPAGDYLITGDDVGVVRLWKSAEMQPMQSYPLHRSYVWDLRPSADGRWLATCSEDQTVKITNLATGQLQATLVVAPTIARAIVWIGPDCLAIGGIDGHIRLWYPFTEQAPVLVTAHTDIVNSLSWDANSNLLASSSSDSTVKLWDVETGICHRIWREAVPVRWATWSPDGHTLAISREDGGIVLWNPHSDQAPRYLNGHPETVWSLDWNPDGAWLASSSHDATVRLWDVVTGRCRRILRSHQNWVWYARWHPHQPRIISGGHDGTLKLWDTGTGQCLKSLTGHMANIRAIAPAPDGQTLALGCDDTIVRLCGADSPPSFIHAFGHSHLISDLCWNPTGENLASASHDCNLRVWQRSPLRCTQVLKGHTNWVWSVDWHPTQDLLASGSVDSTIRLWYPTQSTPVKTLMAQTSWILSVRWHPTGRWLASAAGDFTIGLWNSKTWECTHLLTGHTHWIWCLAWSPNGQYLASGGYDNTVFIWKVEKEVTSLRTLEHPTILSAIAWHPDGELLATSCHDGNIRLWHWQTGQCVTRISGHQGEILTLKFSPDGKRLYSSSQDETWKTWDWQTGTCLASDRLDRPYEGMNISEVRGLTEVRKAALRALGATEGSQPPGDLVRWLRKTEQGRKL

SEQ ID NO: 55307 - protein, 475 aa, Synechococcus sp. WH 5701
MTTIADPATSPEAISVADHDRFDLVVIGAGSGGLAAAKRAASHGARVAVIEGHRVGGTCVIRGCVPKKLLVYGSAYRHLLADAASYGWSVGQTHCDTSQLLAAVRAEVDRLNGLHIGFLESAGVELVKGWGRFLDAHHIEVGVAEGKGSSDRSRRLLRGERVLIAVGGRPHRPSFPGAELGWVSDDMFLLERLPQRVLIVGGGFIACEFACILRGLGVEVDQFVRGDHLLRGFDRELSAAVHEGMEADGITIHMAQTLSAIAGEPGELIATTCQGRQERCGGVLLATGRQPYLAGLDLAAAGVGVDGGSITVDADQRTNVPHIFAVGDVTDRINLTPVAVDEGRAFADSVYGGQARQVNHDLVASAVFSQPELASVGLSEEQALARFGPDGVRLYRARFRSMAQALPKRGPRCLLKLVVEVASGRVLGCHMVGEHAAEIIQMAAIAIGMGATKADFDRTMALHPTVAEEFVTMPQ

SEQ ID NO: 55308 - protein, 582 aa, Silicibacter pomeroyi DSS-3
MNQQLRGLARTYLPILDWGRSYGRGELSGDLIAAVIVTVMLIPQSLAYALLAGLPAEVGLYASILPLVAYALFGTSRALAVGPVAVISLMTASALAPLNLSSVSEYVAAAGVLALLSGAMLLLMGALRLGVVANFLSHPVIAGFITASGLLIAASQLKHILGVPLHGHTLPEILLDLARHLGQINLATLVTGIVALAFLFWVRKGLAQVFHARLGLTKPLAATLARVGPIFAVIGTTLAAWVLNLPSLGVAVVGEVPTGLPPLGLSGVDWGLVPALIGPAALLSIIGYVESVSVAQTLATKRKQRIDPNQELIALGAANISSSLSGGYPVTGGFARSVVNFDAGAETPAAGVFTAVGLLVAALFLTPLLYFLPKATLAATIIVAVLSLVDLSILSRAWRYSRADFAAVFATIALTLLAGVEVGVASGVLISLLLFVWKTSRPHVAEVGQVPGSQHFRNILRHKVETDPGVVTLRIDESLYFANARRMEDLILNRVLRDRDSLRHVILMCSAVNEVDFSALESLEAINRRLDDLGVKLHLSEVKGPVMDRLARSHFLEDLTGRVFLSQYDAFAALRMNRADRM

SEQ ID NO: 55309 - protein, 425 aa, Acidobacteria bacterium Ellin345
MASALRNVRKEVLPNGLTVLTEEMDHIRSVSIGIWVKNGSRHEDPQVNGISHFIEHMVFKGTTTRNAEAIAREVDSIGGNMDAFTGKEMVCFNVKILDEHVPVAMDVLSDMVLNPVFDGAEIDREKGVIQEEIKMDEDNPDYLVHEIFTQNFYKDHPLGKPILGTKETVKGFDRDIVLGNYGRKFAPGNLIVAAAGNINHKSFVDEVRRRFEHLKPSLNGFHQEPPKTHARIIMRNKKSLEQVQICLGVPAYSISDKRRYVCYILNTLLGGGMSSRLFQDIREKQGLVYSIFSELNPFQDSGSLAVYAGTSRESAPKVVTQVVKEFGNFKREMVSVEELQRAKAQLKGSLMLGLESSTARMSNLARQEMYYDHFHTMDEIIAKIEVVTREEVCEMANEIFRAEDIAVTVLGNMNGVKISRDQLAC

SEQ ID NO: 55310 - protein, 357 aa, Cryptococcus neoformans var. neoformans JEC21
MHQIGNSIKLLTGNAHPKLAEAVAARLGITLTPCHVSKFRSLETSVQIHSSVRDEDVFIIQSPSPPDVNDHLMELLIMISACKTASAKRITAVIPCYPYARQDKKDKSRAPITSKLVANLLAVAGADHVITMDLHASQIQGFFDIPVDNLFSEPTMMQYIKSEIPGWRDAIIVSPDAGGAKRATALADQLNLDFALINRKRRRDLAASMCLPTVPPTPTGSDSGSVHSHDIDDESNIVEKMELLVGDVKGKVAILIDDMIDTGHTVRLAAGVLRENGAKEVYALVSHGLLSDTTMENLSDLPVKKLIVTNSIDQTKRVIACNGLLETLDIAPVIAESIRRTHNGESISALFRPHDSF

SEQ ID NO: 55311 - protein, 568 aa, Clarkia gracilis
MASPALISETEAWKDLKAHLEGIKRTHLRELMGDTERCQSMMVEFDNIFLDYSRQQASPDTINKLYNLADAAHLKQKIDRMYNGDHINITENRSVLHVALRAPRNSAICSDGKNVVPDVWNVLDKIKDFSDRVRNGSWIGATGKELKDVIAVGIGGSFLGPLFVHTALQTDPEASKNARGRELRFLANVDPIDVARNISGLNPETTLVVVVSKTFTTAETMLNARTLREWISSALGPSAVAKHMVAVSTNLPLVEKFGIDTINAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSLSILLPTLDAYRIGQLLAIYEHRVAVQGFVWGINSFDQWGVELGKSLATQVRKQLHASRVKGEPVEGFNFSTKTLLTRYLEATSDVPADPSTLLPNI

SEQ ID NO: 55312 - protein, 300 aa, Synechococcus sp. WH 7803
MSKRHPVVAVTGSSGAGTSTVKRAFEHIFARESITPAVVEGDSYHRFERMEMKKAMAEALSKGENFSHFGPEANLFDKLEELFRVYGETGGGQKRYYLHSPEEAAEHNARLGVELDPGQFTPWEDIPSGTDLLFYEGLHGGVQGESYDVAALADLLVGVVPITNLEWIQKIHRDNAERGYSAEAIVDTILRRMPDYINHICPQFSRTDINFQRVPTVDTSNPFICRNIPTPDESFVIIHFRKGAREKWGIDFSYLLSMIHDSFMSSPTSIVVNGGKMGFAMELILTPIIHRMIEEKKKLG

SEQ ID NO: 55313 - protein, 362 aa, Bordetella petrii
MSQTSFHSLKVASVARNTRDAVVVTFDLPADLRAQFAFRPGQYLTLRTELGGEELRRSYSICSAPGDGVLRVAIKKVDEGVFSNWANHELQPGQTLEVMPPAGNFTVDFAPEHRRHYVAFAVGSGITPVFSLVKTALSTEPHSRFTLFFGNRASSSVLFREEIEDLKNLYMERFSLVYIMSRESQDIELFNGRLDGDKVDQLLSAWMRPDDIDYAFVCGPQTMIESVVQHLQARGIPKSQIKFELFGAPRGPRALRTGRDAPAAPGKGQCEVTVVQDGHRRTFIIDKNKDSVLDSALAQGVELPYSCKGGVCSTCRCKVIEGEVDMDANFALEDYEVARGFVLSCQSFPVSDRLVLDFDQET

SEQ ID NO: 55314 - protein, 251 aa, Physcomitrella patens subsp. patens
MVKVAFGEANEASSADALKGAFAEFLALFLFVFIGVGSVMSYEKIHAGDMDAAGLLVIAIAHGLAIAVLVSATANISGGHINPAVSLGLALAGKITVIRLVLYWIAQLLGAAAGAWVLKIVTTGEDVARHAIGVGMTPWSAVLMEAVLTFTLVFVVFATAVDPKKGTVGVIAPLAIGFTVLAQIFVGAPFSGASMNPGRSFGPALVAMDFTNHWVYWVGPFIGAALAALIYDGVFISPSPPPGHHAIPSDF

SEQ ID NO: 55315 - protein, 306 aa, Trichodesmium erythraeum IMS101
MDKLKGRDLLSLANLNSEELKEILQLAAQLKSGEINLKCNKVLGLLFSKASTRTRVSFTVAMYQLGGQVIDLNPNVTQVSRGESLEDTARVLDGYLDILAIRTFEQKDLESFANYAKIPVINALTDREHPCQILADLLTVQENFGKLDGITLSYFGDGNNVANSLLLGCAMVGINVRIATPENYLPNKEIVEQAKTIANGKSEVLVTQDPQVAVKDSQVLYTDVWASMGQEQEANNRIPIFQPYQVNEKLVESAADDVIILHCLPAHRDEEITDAVIEGKKSLVWEQAENRMHAQKALLISILGSD

SEQ ID NO: 55316 - protein, 357 aa, Synechococcus sp. WH 7803
MTHHRVVLLPGDGIGPEITAVTRQLLDVVADHHGFQLDFDDQLIGGAAIDATGEPLPDKTLDACRSADAVLMAAIGSPRFDTLPREKRPESGLLALRSGLNLFANLRPVKIVPALIEASSLKAEVIQGVDLMVVRELTGGIYFGQPKGRVEADGEERGFNTMTYSASEVDRIARVAFELARERGGRLCSVDKANVLDVSQLWRDRVDAMAPSYADVEVSHLYVDNAAMQLVRAPRQFDVLLTGNLFGDILSDEAAMLTGSIGMLPSASLGSDGPGLFEPVHGSAPDIAGEDKANPMAMVLSAAMMLRIGLKQKAAADALEQAVDRVLAGGFRTGDLMAEGCTPLGCQAMGEELRKAL

SEQ ID NO: 55317 - protein, 103 aa, Glycine max
MSRRGDWVYENNGGTCVAIAGADYCVVAADTRLSVGYSILTRDHSKICDLADKCVLASSGFQGDIKALQKNLAARELLYQHQHNKRMSCPAMAQLLSNTLYYK

SEQ ID NO: 55318 - protein, 510 aa, Pseudomonas aeruginosa
MSQAHTPSAPLAEVYDVAVVGGGINGVGIAADAAGRGLSVFLCEQHDLAQHTSSASSKLIHGGLRYLEHYEFRLVRDTLAEREVLLAKAPHIVKPLRFVLPHRPHLRPAWMIRAGLFLYDHLGKREKLPASRACVHRQQPLKAEIRRGFEYSDCAVDDARLVVLNAISAREHGAHVHTAPAASAPVAARDSGTCTWSAATAACIRSARALVNAAGPWVARFIQDDLKQKSPYGIRLIQGSHIIVPKLYEGEHAYILQNEDRRIVFAIPYLDRFTMIGTTDREYQGDPAKVAISEEETAYLLQVVNAHFKQQLAAADILHSFAGVRPLCDDESDEPSAITRDYTLSLSAGNGEPPLLSVFGGKLTTYRKLAESALTQLQPFFANLGPAWTAKAPLPGGEQMQSVEALTEQLANRYAWLDRELAPALGAHYGTRVWRLLDGVNGEADLGEHLGGGLYAREVDYLCKHEWAQDAEDILWRRSKLGLFLSPSQQVRLGQYLQSEHPHRPRVHAA

SEQ ID NO: 55319 - protein, 326 aa, Sinorhizobium meliloti 1021
MKAIEFRRFGSPDVLQSVDVATPSPGRGEALVRVGAVGVNYFEVLMRQDRYAVTPELPMIPGVEVAGVVVAVGEDLSQDIIGSRVAVPMFAHGRGTGGYAEYVSVDAAMLVPIPDGLSFEAAVALMVQGLTALYLVRQSSLQNKTLLISAAAGGVGSLLVQLARDGGARTIVAVASSQKKLDSARGLGAHLGINYAAPDWTATLREALNGGGVDILYDFVGGEFTHAAIDLLVPAGELVFGALGRFALSGRQVESMFALNQSLRGFALLPLLNLAGLKADLTELFTRAQEGALTVAIDSRFSLDRAADAHRAIESRRTIGKVVLVP

SEQ ID NO: 55320 - protein, 328 aa, Synechococcus sp. WH 5701
MASIFADSSLSIGRTPLVKLNRVVGDSRATVLAKIEGRNPAYSVKCRIGAAMIWQAEKDGRLGPGKELIEPTSGNTGIALAFVAASRGIPLTLTMPESMSLERRKLLTAYGAKLVLTEGKLGMTGAVGRAHEIAASDPERYVLLQQFANPANPQIHHDTTGPEIWNDTDGQVDVLVAGVGTGGTITGVSRYFKTTRGQKLLSVAVEPVNSPVIAQARAGEPPQPGPHKIQGIGAGFVPENLDLDLVDRVEAVSDQEAVAMARRLMREEGILAGISCGAATVAALRLAAEEEFAGKTIVVVLPDSGERYLSSVLFEGVFDAAGLAPVER

SEQ ID NO: 55321 - protein, 560 aa, Synechococcus sp. WH 5701
MSWLNQISSQHIKGDVFGGLTAAVVALPMALAFGVASGAGAVSGLWGAVLVGLFAALFGGTPTLISEPTGPMTVVMTAVIASLTAKAASPEQGMAMAFTVVMMAGVFQIVFGYLKLGRYITMMPYTVISGFMSGIGFILIILQFGPFLGQAIPKGGVMGTLTALPQLIAAARLPEVILAVVTVAIIWFTPSQVKRFAPPQLVALVIGTVLSLTLLNGGEGAEVEGIRRIGEIPSGFPQLVVPHFEPGLFQLMVVDALVLGLLGCIDALLTAVVADSITRSEHNSDKELIGQGLGNIVSGLFGGIAGAGATMGTVVNIQAGARSALSGITRALVLMVVILGASGLAASIPMAVLAGIALKVGIDIIDWSFLRRAHHVSIKGAVIMYGVILLTVLVDLIAAVGVGIFVANILTIEKMSTLETKSVKAISTADDDLNLPENEKALLDQGGGRVLLFQLIGPMIFGLAKTISREHNAIQECESIVFDLSEVSHMGVTASLALENAVKEALEKERNVYVVGAEGSTLKRLRSLKVYSLLPHDHVEMSRAEALADAVNSRSQIGML

SEQ ID NO: 55322 - protein, 386 aa, Ashbya gossypii ATCC 10895
MSATNPLSLGDFSKISPLPGIAAVPEQRTESFWSSNPISSYLISVYNNIHAHRQTLSLVNPGTMENLNKEVSRDVFLTQYFFTGLRADLNKAFALNPAFQTSHTFSMGSENLPNYAFSALFANDDLFMQGNVDNDLSLSGRLHYGWDKNNVSKVTLQVSQGQPTMCQLEQDFQGSDFSLNLKTLNPSLSADGTFSGVAVGSILQSITPQLAVGIEAVYSRGQSSMPADAAVSYATRYVSAKQDWIFSGQLQANGALTASFWRKVASNVEAGVESTLQASMVPIMDPVIGQPIGIQPTIEGLTTIGAKYEYRQSVFRGFINSNGRVGCFLERKILPTLSVLFCGEIDHFKSDSKLGCGLQFETAGSEELLMMQQGLDANGNPLPLPA

SEQ ID NO: 55323 - protein, 304 aa, Oryza sativa Japonica Group
MAAPSSLASSHLSRLADLRRAGVAAAAPAHPQQLRLGCSRRRAQRVVAMAGSGKFFVGGNWKCNGTKDSVSKLVTELNAATLEPDVDVVVAPPFIYIDQVKNSLTDRIEVSAQNVWIGKGGAYTGEISAEQLVDIGCQWVILGHSERRHVIGEDDQFIGKKAAYALSQNVKVIACIGELLEEREAGKTFDVCFKQMKAFADSITNWADVVIAYEPVWAIGTGKVATPEQAQEVHAAVRDWLKTNVSPEVASGIRIIYGGSVNAANCAELAKKEDIDGFLVGGASLKGPDFATIINSVTSKKVAA

SEQ ID NO: 55324 - protein, 356 aa, Glycine max
MNSTPANLESSLSVPSVQELAFQRPEKVPARYIRDQDGDGIIATYPSHPSLRVPFIDMAKLVNADTHQKEELRKLHLACKDWGVFQLVNHGLSNSSLKNMGNQVKRFFELPLQEKKRWAQRPGTLEGYGQAFVTSEDQKLDWNDMIFLKCLPIQNRKLDLWPQNPPEFRETLERYSEEIREVTMSVVKFLTMSLGIQDKEISESFREGLYDIRMNCYPPCPEPERVLGIAPHADNSGITLLLDCADFPGLQFLKDKKWVNVEPIEGAIVVNIGQIIEVMSNGIYKAPEHRAVVNKLKERFSIVTFCYPSPHMDIGPADKLTGEGKVAVFKKLTHAEYFRKFFNRDLDESFIDSLRV

SEQ ID NO: 55325 - protein, 339 aa, Cryptococcus neoformans var. neoformans JEC21
MVVKVGINGFGRIGRIVLRNAIEHGDLEVVAVNDPFIDLDYMVYMFKYDSTHGRFKGSVEVKDGKLYINNKAIAVFGEKDPANIKWGEAGAEYVVESTGVFTTTEKAGVHLKGGAKKVVISAPSADAPMFVCGVNLDAYKPEYQIVSNASCTTNCLAPLAKVIHDNFTIIEGLMTTVHATTATQKTVDGPSHKDWRGGRGAAANIIPSSTGAAKAVGKVIPSLNGKLTGMSFRVPTSDVSVVDLVCRIEKGASYEEIKNVIKKASESPELKGILGYTEDAVVSTDFIGSTESSIFDAQAGIALNANFVKLVSWYDNEYGYSRRVCDLISYIAGVDAKAQ

SEQ ID NO: 55326 - protein, 563 aa, Flavobacteria bacterium BBFL7
MSDDKQVIFSMSGLSKTYQSTGKQVLKNIHLSFFYGAKIGILGLNGSGKSTLMKIIAGIEKNYQGDIHFLPGYKVGYLEQEPELDESKTVMEIVREGVAETVAILDEYNKINDDFGLEEVYSDADKMEKLMNRQAELQDKIDATNAWELDTKLEIAMDALRTPPGDASIKNLSGGEKRRVALCRLLLQQPEILLLDEPTNHLDAESVLWLEQHLAQYKGTVIAVTHDRYFLDNVAGWILELDRGEGIPWKGNYSSWLEQKGDRLRKEEKTESKRQKTLKRELDWVRQGAKGRQSKQKARLNNYDKLLNEDQKQKEEKLEIYIPNGPRLGTNVIEAKGVSKAFGDKLLYEDLNFVLPQNGIVGIIGPNGAGKTTIFKMIMGQEQPDKGSFTVGETVKLAYVDQSHSDIDPDKSIWENFADGQDMVMMAGRMVNSRAYLSRFNFSGSEQNKKVSTLSGGERNRLHLAMTLKEEGNVLLLDEPTNDLDVNTLRALEEGLDNFAGCAVIISHDRWFLDRVCTHIIAFEGDSQIYSFEGSFTEYEENKKKRLGDVTPKRIRYKKLIRD

SEQ ID NO: 55327 - protein, 194 aa, Prochlorococcus marinus str. MIT 9312
MSLRVGQEAPDFTATAVYDQEFKEITLSGLRGKWVVLFFYPLDFTFVCPTEITAFSDRYQDFSSIDAEILGVSVDSKHCHLAWIQTPRNEGGIGDINYPLVSDLKREICQAYNVLNDDGEADRGLFLINPEGIVMHTTVNKAPVGRNVDETLRILQGYQYVAANPDEVCPANWTPGEKTMLEDPKGSKEYFSAL

SEQ ID NO: 55328 - protein, 190 aa, Methanococcoides burtonii DSM 6242
MLEVLQESLRKAPIVIRGEYPYFIHPISDGIPSLEPELLDEIADHMIDIAGKDYDRIVSIEAMGIPLATVLSMKTGKPMSIVRKRQYGLEGEVILSQSTGYSKGELYINGISKGETVLVVDDVISTGGTLKALLPALENMGANICNVIVVISRGDGAAKMSDMGYNVNTLVKIDVDMDGVSILEVAGEQQ

SEQ ID NO: 55329 - protein, 323 aa, Sporidiobolus salmonicolor
MVGTTTLNTGASLELVGYGTWQAAPGEVGQGVKVAIETGYRHLDLAKVYSNQPEVGAAIKEAGVKREDLFITSKLWNNSHRPEQVEPALDDTLKELGLEYLDLYLIHWPVAFPPEGDITQNLFPKANDKEVKLDLEVSLVDTWKAMVKLLDTGKVKAIGVSNFDAKMVDAIIEATGVTPSVNQIERHPLLLQPELIAHHKAKNIHITAYSPLGNNTVGAPLLVQHPEIKRIAEKNGCTPAQVLIAWAIVGGHSVIPKSVTPSRIGENFKQVSLSQEDVDAVSKLGEGSGRRRYNIPCTYSPKWDINVFGEEDEKSCKNAVKIK

SEQ ID NO: 55330 - protein, 630 aa, Cryptococcus neoformans var. neoformans JEC21
MVDTQYAFRAQKTAGVADAPAWEVSNRIPAETVGSKCYAYSPNGEWLAYAMNNCVEIIPSHSSSPTPVTLQQANIVALKFSPMSSYLFTFERPVKTESGEMYKNAKAWDVKNGEIVGGWYQKTMEDWEPIITPNETHLLRAGPSDLAIFSPPFAPRPSTRLKIEGIRGIFISDPSALPATSTNSRPIPAYHEPAVAIWIGEKKGAPASLGLWSLSSLMGKNALQANGNGDIQTETRDMPPTTARKAFYKADKLTVKWNNAGTMALFLAQSDVDNSGKSYYGETNLYLVGLDGTFDGLVELDKEGPIYDFAWSPISREFTVCYGYMPARTQMFDLKAKPVYSFGENPRNTLVYQPQGKLLLSAGFGNLAGGIDIWDVSTRNKVAEFKASNASHCEWSPCGRYVLTATLSPRLRVDNGVKIWWCNGQLLHIQPVEELYQASFAPQRVTEIGSFPAIVPKAPEANPSVAAYRPKGETDGVAAKPAGAYRPPGARNRPEGENASASFGSSRGKPGVRTVPGAGGRQPPGSAPGASTGAGGDDKKKRQRKRGGKDKEEEKKDEAPTQEAVKPEVKEEAGEDAVAKKIRNLMKKLKAIDELKTKLAAGEILEKTQLKKIESEAQVKSEIKALGGNV

SEQ ID NO: 55331 - protein, 519 aa, Trametes sp. I-62
MAKLQFSNFFVTLAVVTGALAAVGEADLTITNAVVAPDGFSRDAVVVNGVFPGPLITGKKGDRFQLNVIDNLTNHTMLKSTSIHWHGFFQAGTNWADGPAFVNQCPISTGHAFLYDFHVPDQAGTFWYHSHLSTQYCDGLRGPIVVYDPLDPHAFRYDVDDESTVITLSDWYHTAATLGLGSRLGADATLINGLGRSSSTPTANVTVINVQHGKRYRFRLVSLSCDPNHTFSIDGHNLTVIEVDGVNSKPLTVDSIQIFAAQRYSFVLNANQTVGNYWIRANPNFGTTGFAGGINSAILRYQGAPIIEPTTVQTTSVIPLVETNLHPLVPTIVPGLPVSGGVDKAINLGFNFNGTNFFINNATFTPPTVPVLLQILSGASTAQDLLPPGSVYPLPAHSSIEITLPATTLAPGAPHPFHLHGHVFAVVRSAGSTAYNYVDPIFRDVVSTGTPAAGDNVTIRFHTDNPGPWFLHCHIDFHLEAGFAIVFAEDVADVKAANPVPKAWSDLCPTYDALAEGDL

SEQ ID NO: 55332 - protein, 289 aa, Glycine max
MEGKEQDVSLGANKFPERQPIGTAAQSQDDGKDYQEPAPAPLVDPTEFTSWSFYRAGIAEFVATFLFLYITVLTVMGVAGAKSKCSTVGIQGIAWAFGGMIFALVYCTAGISGGHINPAVTFGLFLARKLSLPRAIFYIVMQCLGAICGAGVVKGFEGKTKYGTLNGGANFVAPGYTKGDGLGAEIVGTFVLVYTVFSATDAKRNARDSHVPILAPLPIGFAVFLVHLATIPITGTGINPARSLGAAIIFNKDLGWDDHWIFWVGPFIGAALAALYHQVVIRAIPFKSK

SEQ ID NO: 55333 - protein, 416 aa, Synechococcus sp. WH 7805
MTPERLGLLWGITVFAGAGARLLSALSGLPGVVLLLLSGLLIGRSGLGLVEPLDLGQGLETTVGLLVSLVLFDGGLNLRLPGDTIKATVLRISLIRLLLSLGAGVLAAHWLAGLGWSVAAVYSAIVLGTGPTVVTPIVQQIRLASPLGDVLEAEGLVLEPVGAVLALLLLELLLGDLHGWRELAIGLMSRLGGGVLIGLAVGWLLSEVLRRLPSEHSVGLRLQLTLGVLFLMFSITEWLLPESGLPASVAAGVVVGRRPSTQAVQLDELIRELARLAITMLFPLLAADVSWAELSPLGWGGISCVLVLMLVVRPAAVSVATVGLPLNWRQRLFLGWLAPRGIVTAAVASLFAIRLEQAGVLGAGRLQGLVFLTILMTVGLQGLTAQPLARVLGLIDLTPDASKDAAMPVEPSEAAP

SEQ ID NO: 55334 - protein, 520 aa, Trametes sp. I-62
MSRFHSLLTFIVASLASSALASIGPVADMTISNAEVSPDGFARQAVVVNGVTPGPLVKGNMGDRFQLNVIDNLTNHTMLKSTSIHWHGLFQHGTNWADGPAFVNQCPVSAGHSFLYDFQVPGQAGTFWYHSHLSTQYCDGLRGPLVVYDPHDPHKSRYDVDNDDTVITLADWYHVAAKRRSAFPLGADATLINGLGRSPTTPSADLAVINVTQGKRYRFRLVSLSCDPNHTFSIDGHNMTIIEVDSVNSQPLVVDSIQIFAAQRYSFVLNANQAVDNYWVRANPSFGNVGFSGGINSAILRYAGAPAIEPTTNQTTSVIPLNEVNLHPLAPTPVPGKAVAGGVDTPINMAFSFNGTNFFINGASFVPPTVPVLLQILSGAQSAQDLLPSGSVYVLPSNASIEISFPATAAAPGVPHPFHLHGHTFAVVRSAGSTEYNYDNPIFRDVVSTGTPAAGDNVTIRFQTNNPGPWFLHCHIDFHLEAGFAVVMAEDTPDVKAVNPVPQSWSDLCPIYDALDASDQ

SEQ ID NO: 55335 - protein, 180 aa, Synechococcus sp. WH 7803
MSSSGPSSSGEVPTVLVKDSEGRDLLCFLEQLIPLDGKDYALLTPVDTPVCLFKLRDGDDPQLIDSITSSEPILSVADVVLQEHDLTLVRSAVTLTVNGELDEPEPEDPDDEEGDDESETYELLVSFLVENQEYGLYIPLDPFFVVARMDDGCAVLVEGEDFDRIQPRIEAELDERDLPE

SEQ ID NO: 55336 - protein, 172 aa, Treponema pallidum subsp. pallidum str. Nichols
MDRHRDFGKDRLRDKEFTEKLIKLNRTAKVVKGGRRFSFSALTVVGDQKGRVGFGFGKAGDVSEAIRKSVERAKRSMVLFPLKDGTIPHEVQAKFKGSLVLLRPACSGTGIIAGGTVRAIMEVAGATDVLSKSLGSNSAINVVRATFGAVAQLMDARKLARERGKALVDMWG

SEQ ID NO: 55337 - protein, 510 aa, Zea mays
  misc_feature (469)..(470): Xaa can be any naturally occurring amino acid
MMIARRLLRSNNAPAQATSLLKHVTGTASLQGNADSLLDGTVRHFGSAPSAQPEENGFKGHGMLAPFTAGWQSNDLHPLIIERSEGSYVYDINGNKYLDSLAGLWCTALGGSEPRLVKAATEQLNKLPFYHSFWNRTTKPSLDLAQEILSMFTAREMGKVFFTNSGSEANDSQVKLVWYYNNALGRPNKKKFIARSKAYHGSTLISASLTGLPALHQKFDLPAPFVLHTDCPHYWRYHLPGETEEDFATRLATNLENLILKEGPETIAAFIAEPVMGAGGVIPPPKTYFDKVQAIVKKYDILFIADEVITAFGRLGTMFGCDYYNIKPDLVSLAKALSNAYVPIGATLVSPEISDVIHSQSNKLGSFAHGFTYSGHPVACAVAIEALKLYRERDIPGHVKQIAPKFQDGIRALADSPIIGEIRGLGMIMGTEFTNNKSPTDLLPAEWGVGAIFGEECQKRGMLVRVAGXXIMMSPTLIMTPGEVDELVRIYGEALKATEERVAALQSKKN

SEQ ID NO: 55338 - protein, 260 aa, Mycobacterium tuberculosis
MSGRLTGKVALVSGGARGMGASHVRAMVAEGAKVVFGDILDEEGKAMAAELADAARYVHLDVTQPAQWKAAVDTAVTAFGGLHVLVNNAGILNIGTIEDYALTEWQRILDVNLTGVFLGIRAVVKPMKEAGRGSIINISSIEGLAGTVACHGYTATKFAVRGLTKSTALELGPSGIRVNSIHPGLVKTPMTDWVPEDIFQTALGRAAEPVEVSNLVVYLASDESSYSTGAEFVVDGGTVAGLAHNDFGAVEVSSQPEWVT

SEQ ID NO: 55339 - protein, 367 aa, Zea mays
MGAVKHTLKMLSWLLLFAQLAAATTSKCTNATNGTETDSLGAMKLKLIAIASILTAGAAGVLVPVLGRSMAALHPDGDIFFAVKAFAAGVILATGMVHILPAAFDGLTSPCLYKGGSGGNIFPFAGLIAMSAAMATMVIDSLAAGYYRRSHFKKARPIDILEIHEQPGDEERSGHAQHVHVHTHATHGHSHGEVDVISSPEEASIADTIRHRVVSQVLELGILVHSVIIGVSLGASVRSSTIRPLVGALSFHQFFEGIGLGGCIVQANFKLRATVMMAIFFSLTAPIGIALGIGISSSYNGHSTTAFIVEGVFNSASAGILIYMSLVDLLATDFNKPKLQTNTKLQLMTYLALFLGAGMMSMLAIWA

SEQ ID NO: 55340 - protein, 794 aa, Sinorhizobium meliloti 1021
MSVATFFDEMSYGPAPEADTEARAWLTRHEGKLGHFINGAFVGSASGKSFDTFEPATGKLLAKIAHGGRDDVNAAVAAARKAQGPWAKLSGHARARHLYALARLIQRHARLIAVVEALDNGKPIRETRDIDIPLAARHFYHHAGWAQLQETEFADQVPVGVVGQVIPWNFPFLMLAWKVAPALALGNSVILKPAEFTPLTALLFAELAAAAGLPPGVLNVVTGEGETGALIVEHEDIDKIAFTGSTEVGRLIREKTAGSGKSLTLELGGKSPFIVFDDADIDAAVEGVVDAIWFNQGQVCCAGSRLLVQEGVAPVFHDRLKRRMETLRVGHPLDKAIDMAAIVAPVQLQRIEELVAKGVAEGASMHQPKIELPKGGSFFRPTLLTGVQPTSVVATEEIFGPVAVSMTFRTPEEAIQLANHSRYGLAASVWSETIGLALHVAAKLAAGVVWVNATNLFDASSGFGGKRESGFGREGGREGCYEYLKPKAWMGRKLRPEHGLPAPKQAAGDFAVPALDRTAKLFVGGKQARPDGNYSRPVLSPKGKVIGEVGEGNRKDIRNAVVAARGASGWSSATAHNRAQILYYIAENLSSRGAEFAGRIAAMTGASAANARAEVEASIARLFSYGAWADKYEGTVHQPPLRGVALAMPEPQGVVGVICPPEAPLLGLVSLVAPLIAVGNRVVAVPSEAHPLAATDFYSVLETSDVPPGVINIVTGSAIELAKALAAHNDVDALWAFGSPELSTLVEKLSVGNLKRTFVDYGKAIDWTDRSAAEGQAFLRRAVDVKNIWIPYGE

SEQ ID NO: 55341 - protein, 260 aa, Mycobacterium tuberculosis
  misc_feature (19)..(19): Xaa can be any naturally occurring amino acid
  misc_feature (27)..(27): Xaa can be any naturally occurring amino acid
  misc_feature (47)..(47): Xaa can be any naturally occurring amino acid
  misc_feature (127)..(127): Xaa can be any naturally occurring amino acid
  misc_feature (190)..(190): Xaa can be any naturally occurring amino acid
MSGRLTGKVALVSGGARGXGASHVRAXVAEGAKVVFGDILDEEGKAXAAELADAARYVHLDVTQPAQWKAAVDTAVTAFGGLHVLVNNAGILNIGTIEDYALTEWQRILDVNLTGVFLGIRAVVKPXKEAGRGSIINISSIEGLAGTVACHGYTATKFAVRGLTKSTALELGPSGIRVNSIHPGLVKTPXTDWVPEDIFQTALGRAAEPVEVSNLVVYLASDESSYSTGAEFVVDGGTVAGLAHNDFGAVEVSSQPEWVT

SEQ ID NO: 55342 - protein, 323 aa, Thermotoga maritima MSB8
  misc_feature (182)..(182): Xaa can be any naturally occurring amino acid
MEMRFFVLGAGSWGTVFAQMLHENGEEVILWARRKEIVDLINVSHTSPYVEESKITVRATNDLEEIKKEDILVIAIPVQYIREHLLRLPVKPSMVLNLSKGIEIKTGKRVSEIVEEILGCPYAVLSGPSHAEEVAKKLPTAVTLAGENSKELQKRISTEYFRVYTCEDVVGVEIAGALKNVXRIAAGILDGFGGWDNAKAALETRGIYEIARFGMFFGADQKTFMGLAGIGDLMVTCNSRYSRNRRFGELIARGFNPLKLLESSNQVVEGAFTVKAVMKIAKENKIDMPISEEVYRVVYEGKPPLQSMRDLMRRSLKDEFWAS

SEQ ID NO: 55343 - protein, 529 aa, Oryza sativa
MAARRAASSLLSRGLIARPSAASSTGDSAILGAGSARGFLPGSLHRFSAAPAAAATAAATEEPIQPPVDVKYTKLLINGNFVDAASGKTFATVDPRTGDVIARVAEGDAEDVNRAVAAARRAFDEGPWPRMTAYEFARVCMQERCRVLLRFADLIEQHADEIAALETWDGGKTLEQTTGTEVPMVARYMRYYGGWADKIHGLVVPADGPHHVQVLHEPIGVAGQIIPWNFPLLMFAWKVGPALACGNAVVLKTAEQTPLSALFVASLLHEAGLPDGVLNVVSGFGPTAGAALSSHMGVDKLAFTGSTGTGKIVLELAARSNLKPVTLELGGKSPFIVMDDADVDQAVELAHRALFFNQGQCCCAGSRTFVHERVYDEFVEKARARALQRVVGDPFRTGVEQGPQIDGEQFKKILQYVKSGVDSGATLVAGGDRAGSRGFYIQPTVFADVEDEMKIAQEEIFGPVQSILKFSTVEEVVRRANATPYGLAAGVFTQRLDAANTLARALRVGTVWVNTYDVFDAAVPFGAWL

SEQ ID NO: 55344 - protein, 408 aa, Methanocaldococcus jannaschii DSM 2661
MDAIILCAGKGERLRPLTENRPKPMIPIAGKPILQHIIEKVEDLVDNIYLIVKYKKEKIVDYFKNHPKIKFLEQGEIDGTGQAVLTAKDYVDDEFLVINGDIIFEDDLEEFLKYKYAVAVKEVKNPENFGVVVLDDENNIIELQEKPENPKSNLINAGIYKFDKKIFELIEKTKISERGERELTDAIKHLIKEEKVKGIKLNGYWNDVGRPWDILEANKYLLDKINTDIKGKIEENVVIKGEVIIEEGAIVKANSVIEGPAIIKKGAVVGPLAYIRPYTVLMENTFVGNSSEVKASIIMKNTKIPHLSYVGDSIIGENCNFGCNTITANLRFDDKPVKVNIKSKRVESVRKLGVIMGDNVKTGIQVSFMPGVKVGSNCWIGASCLIDRDIESNTFVYKRDELIFRKLK

SEQ ID NO: 55345 - protein, 120 aa, Streptococcus agalactiae A909
MDKIYLNKCRFYGYHGSFSEEQTLGQVFQVDAVLSLDLAKASQTDDLIDTVHYGEVFDCIKNHVENEQYQLIEKLAGVIVEDIFLQFHPVQAITLKITKDNPPINGHYESVGIELERKRV

SEQ ID NO: 55346 - protein, 134 aa, Triticum aestivum
  misc_feature (39)..(39): Xaa can be any naturally occurring amino acid
  misc_feature (68)..(68): Xaa can be any naturally occurring amino acid
  misc_feature (70)..(70): Xaa can be any naturally occurring amino acid
  misc_feature (74)..(74): Xaa can be any naturally occurring amino acid
  misc_feature (79)..(79): Xaa can be any naturally occurring amino acid
  misc_feature (85)..(85): Xaa can be any naturally occurring amino acid
  misc_feature (88)..(88): Xaa can be any naturally occurring amino acid
  misc_feature (90)..(90): Xaa can be any naturally occurring amino acid
  misc_feature (95)..(95): Xaa can be any naturally occurring amino acid
  misc_feature (97)..(97): Xaa can be any naturally occurring amino acid
  misc_feature (102)..(102): Xaa can be any naturally occurring amino acid
  misc_feature (105)..(105): Xaa can be any naturally occurring amino acid
  misc_feature (107)..(107): Xaa can be any naturally occurring amino acid
  misc_feature (118)..(118): Xaa can be any naturally occurring amino acid
  misc_feature (120)..(120): Xaa can be any naturally occurring amino acid
  misc_feature (122)..(123): Xaa can be any naturally occurring amino acid
  misc_feature (129)..(129): Xaa can be any naturally occurring amino acid
SSATTAAPFQGLKSTAGLPVSRRSCSAGLSSVSNGGRIXRCMQVWPIEGIKKFETLSYLPPLSKEALXKXVDYXIRSSXVPASNXTKXGXSSGEXKXPPGNXNGXKXTIWKLPNFRGXTXPXXVLNKVXKLKRT

SEQ ID NO: 55347 - protein, 115 aa, Prochlorococcus marinus str. MIT 9312
MKSWTCIENCGACCKFNLNERTEITDKLNKEDIELINSMTAKDGWCKNLDRENKKCLIYETRPHFCRVNEFSTSFEGYFKYGDKFLIDCCKQHISSNYGYKSKEMKNFKKAVSEK

SEQ ID NO: 55348 - protein, 555 aa, Euglena gracilis
MAYQSFTNQTKKVEGNSPLWAVAAGAFAGLCVVLLANQSATSLHSSVAVPTTPIVAQNTVTSYQAPLAHNAQVTQLKSQVSSDKSLEVSTAANSSVLVGVSGGLLLIAGMFFNILKKPSKQALPLPAPLQSVSVPASSQMVRLVTGMADAHTSVALMAVTAEKKKAVGIRSPVFNETCDQTGITLSRFMLEVARANPDLQELESVFASIQTACKTIAKLVKRSAIDGMTGLQAGGGAVNVQGEEQKKLDVITNDVLKRALKFTGRMGVIASEEEDVPVEVDNTMDESYGKDVLVEESGGRYISVFDPLDGSSNVDAGIPVGTIFGIFEEDDDCKLADNFFDDKTDISEAMKGCLRSTLKPGNSLVAAGYALYSSATHFVFTLGAGVNGFTLDESIGEFILTHPNIKIPPRGKIYSINEANRDIWDAPVQDFIQGLASGNNRGKKVYTSRYIGSMVGDVHRTLLYGGVFGYPADTRSPNGKLRLLYEAAPMSFLIEQAGGKSTTGLVRVMDIPPKSVHQRVPLMLGGADEMDELIELYNAKADAALKKSQLDRLAV

SEQ ID NO: 55349 - protein, 450 aa, Salmonella enterica subsp. enterica serovar Typhi str. CT18
MTKHYDYIAIGGGSGGIASINRAAMYGQKCALIEAKELGGTCVNVGCVPKKVMWHAAQIREAIHLYGPDYGFDTTINQFDWSKLIASRTAYIDRIHTSYDNVLGKNNVDVIKGFARFVDAKTIEVNGETITADHILIATGGRPSHPSIPGVEYGIDSDGFFALSALPERVAVVGAGYIAVELAGVINALGAKTHLFVRKHAPLRSFDPMISETLVEVMNAEGPQLHTHAVPKAVVKNADGSLTLELEDGRSETVDCLIWAIGREPSTDNINLAAAGVKTNEKGYIIVDKWQNTNVEGIYAVGDNTGAIELTPVAVAAGRRLSERLFNNKPDEHLDYSNIPTVVFSHPPIGTVGLSEPQAREQYGDEQVKVYKSSFTAMYTAVTTHRQPCRMKLVCVGPEEKIVGIHGIGFGMDEMLQGFAVALKMGATKKDFDNTVAIHPTASEEFVTMR

SEQ ID NO: 55350 - protein, 279 aa, Synechococcus sp. WH 7805
MNLFADLLASAQSGSVTATGPRIQQRRGVEIKSARELKIMAKASRIVATVLREIMDLVEPGQTTGDLDAHAERRIREMGATPSFKGYHGFPASICASINNEVVHGIPSSKRVIKAGDLLKVDTGAFFEGYHGDSCVTICVGDVSEEAATLSRVAQESLLAGLAQIRAGNTLLDIAGAVEDRVREGGFSVVEDYTGHGVGRNLHEEPSVFNFRTDALPNVKLRPGMTLAVEPILNAGSKDCRTLKDRWTVVTRDGRMSAQWEHTIVVTSDGCEILTDRGD

SEQ ID NO: 55351 - protein, 302 aa, Chlamydomonas reinhardtii
MKDRSAAKKRAEKALQPHLAGENRLHHADTPTDLAALARHLAEHPPTAPPLWRQQRPGVLVRENVPAPGEEEQTWPTEEDMEAAAAERRTRKRRVPEASCSTPCCSNLVFCFGGGTGIAPRGVGVVVDDGDEAPELEPIADDDDAGTYVAIRIADHEAKMSVVNFAFRKATGYSAPLANKEQLLLVTGLRTFTARPVLSTDDPGADKHRMEKFLHPGTPVRVSRRRATVRFMFHNPEDVRWFKPVELSTKYGRRGRIQEPLGTHGAMKCLFDSPLQQRDTVCMPLYKRVFPKWPADLTFAER

SEQ ID NO: 55352 - protein, 917 aa, Bacillus cereus ATCC 14579
MKKTTSTLLSMALVFSSFGALSAHAESLQKEKQFSPQLKTTIEQWGEHKIAQNVETKTTKEISVIVELQHAPLAAQSNIQHAPDLQNSNAQSYHAELKKAQEDTTKKIKEKAPGAKIKEVYNTLFSGFSISIPGDQITSLASLPEVKAVYPNLTYKLHETSKSAINEEAPNIGGPTIGAPEAWNLKDPFGKPLDGKGMKIAIIDSGVDYTHPDLKANYIGGYDTVDEDNDPMDGNVHGTHVAGIIAGNGKIKGVAPNASILAYRVMNDGGTGTTDDIIQGIERAIQDGADVLNLSLGQDLNVPDQPVTLTLERAAKLGVTAVVSNGNDGPKPWSVDAPGNASSVISVGASTVSIPFPTFQVTGSSKTYQGLPLSKSDFPIENDSPLVYVGYGNPSDYAKQDVKGKFALILQGTSSTLVKAEQAKQAGALGVLLISSEKEINMMPEYFSREHLAVPVMQLSNTNGEELKTLITKRKKNIKIGQPKQTELIGNFSSRGPSQGSWLIKPDVVAPGVQITSTVPRGGYESHNGTSMAAPQVAGAVALLRQMHPDWTTEQLKAALANNAKTLHDVNENTYPVMAQGSGLINIPKAAQTNVLVKPNNVSFGLIKPNSGKVKLTQNVTLQNLSSKKKSFSTRVELLDANTKTKVKASVPSSISIQPNSSTEKPFTITVDSSLQQGVYTGNVYVKEQGAKEEIRIPFTFSIDPKDYKRIDGLEIINSTFSPNGDHVLDDNLINYYLVAPVDDITLHANLVTKERVTYQGIIHQAKNATPGYKPFKWNGTKADGTPLTDGLYQIEAVASNSGGETKQTAAVFLDRTAPKLTHEVDQENLVIRGKVDDILLDWMSESGWIAPGIPVRMQYEINGNGVWEQAFLNPWEKSYDIYFDRTQLQEGKNTIHIVATDAAGNTSNLTVNLEVK

SEQ ID NO: 55353 - protein, 512 aa, Brassica napus
  misc_feature (160)..(160): Xaa can be any naturally occurring amino acid
MGKKSATKVEAAPAAIKATKPLKKGKREPEDDLETKVNLKKQKKDVVAAVKKEKAEKKVPKKVESSDESDSSDSEEEDKAKKVPAKKAPVKAASSSDDDDSSSDDEPAPKKATNGTVAKKAKDESSSEEESSDEEEVAVAKKPAAAKPAAKDSSSSEEDXSEDESEDEKVKPVAKKAAPVATKAASSSESSDAAADEESEDEKPAPKAKEGTKKAEKDSSSDDSGSEESESEDEKETPKKKSSDVEMVDAEKQQPKTPSTPATGGSKTLFVANLPFQVERSDVEEFFKEAGQVVDVRFATNRDDGSFRGFGHVEFASAGEAQKALEFHGRPLLGRELRLDVAQERGERPAYTPQSGTGNNSRSGGGGGQEVFVKGFDSSLAPNDIKSALTEHFASCGEITRVSVPVDRETGGSRGIAYVEFKEGTEKAFELNGSDMGGWNLVVDQPRPKENNSGGGFNSGRSNSFSGGRDNFRGRGRGGRDGFRGRGRGGRDNGRGRPSFTSQAKKTVFSDE

SEQ ID NO: 55354 - protein, 323 aa, Vitis vinifera
  misc_feature (157)..(157): Xaa can be any naturally occurring amino acid
  misc_feature (318)..(318): Xaa can be any naturally occurring amino acid
MDSNTNPELSFNFPPFLRVFKDGKVERFVGTDSVPPSLNIETGVNSKDIVIEPETGVSARLYIPKINDQSQKLPLLVYFHGGAFCIETSSSPTYHNYLDSLVAEANVVAVSIEYRRAPEHPLPVAYDDCWAAVKWVVSHSNSQGPEPWLNDYADLDXLFFAGDSAGANLSHNMAIRAGTRGHELGSVKVSGIILIHPYFWGKDPVGAEVKDLQKKGLVDSLWLFVCPTTSGCDDPLINPATDPKLASLGCQRVLVFVAEKDTLRDRGWFYHETLGKSGWSGVVEVMEAEGEDHVFHLFNPTCDKAVAMLKQMAMFLNXAQCNS

SEQ ID NO: 55355 - protein, 340 aa, Synechocystis sp. PCC 6803
MTQSSPPKILVTGGAGYIGSSVVRQLGEAGYSIVVYDNCSTGFPSSILYGQLVIGDLADTERLHQVFHEHEILAVMHFAGSLIVPESLIHPLNYYANNTSNTLSLIRCCQIFGVNRLIFSSTAAVYGNSSSNPISEAEIPCPINPYGRSKLASEWIIQDYAKSSALQYVILRYFNVAGADPEGRLGQMSKTTTHLVRSVCDAILNLKPSLDIFGTDFPTRDGTAVRDYIHVEDLAKAHLDALRYLENGGESQILNCGYGQGYSVREVVDRAKAISGVDFLVRETERRLGDPASVIACADSIRQVLNWTPKYNNLDIILRTALAWEIKRNNLNNRRIHNII

SEQ ID NO: 55356 - protein, 396 aa, Listeria monocytogenes str. 4b H7858
MAKKVVTDLDLKDKKVLVRVDFNVPMKDGKITNDNRIVAALPTIEYILEQNGKAILFSHLGKVKTEEDKEGKSLRPVAARLSELLGKEVKFVPTTRGPELEKAIDELKDGEVLLFENTRFEDIDGKKESKNDPELGKYWASLGDVFVNDAFGTAHRAHASNVGIASNLESAAGFLMEKEIKFIGGVVDNPARPLVAILGGAKVSDKIGVIENLLTKADKVLVGGGMTFTFMAAQGQEIGKSLLEADKVELAKGLLEKAGDKLVLPVDAVVSKEFSNDAPFHTVSADSIPADEMGLDIGQATIDLFTKELQGAKTVVWNGPMGVFELSNFAKGTIGVCEAIANLTDATTIIGGGDSAAAAMDLGFADKFTHISTGGGASLEYLEGKELPGVASISDK

SEQ ID NO: 55357 - protein, 81 aa, Brassica napus
  misc_feature (21)..(21): Xaa can be any naturally occurring amino acid
  misc_feature (24)..(24): Xaa can be any naturally occurring amino acid
  misc_feature (50)..(50): Xaa can be any naturally occurring amino acid
  misc_feature (75)..(75): Xaa can be any naturally occurring amino acid
MAKDGPNWDGLLKWSLSHADXEEXRKWFMEAMQSQTLDVVKRMKEITLVXQTPEQVLVEHGVTPDDIEDLLDELXEHVESI

SEQ ID NO: 55358 - protein, 224 aa, Pseudomonas aeruginosa PAO1
MQPFAIAPSILSADFARLGEDVDKVLAAGADIVHFDVMDNHYVPNLTIGPMVCSALRKYGVSAPIDVHLMVSPVDRIIGDFIEAGATYITFHPEASQHIDRSLQLIRDGGCKAGLVFNPATPLEVLKYVMDKVDMVLLMSVNPGFGGQKFIPGTLDKLREARALIDASGREIRLEIDGGVNVKNIREIAAAGADTFVAGSAIFNAPDYAEVIRAMHAELAQAHQ

SEQ ID NO: 55359 - protein, 347 aa, Brassica oleracea
MSSFLPVIFLVLVFVPSILSAPVTSLTKDYYQETCPDFSKIVRETVTTTQGPQGRTAAGILRLFFHDCFLEGCDASVLIAKNALNKSERDDELNHSLTEETFDIVTRIKAALEESCPGVVSCADILAQSTHDVVTMIGGPSYEVKLGRKDGFESKAHKVRENLPLPNHTVHDMMSLFQKKGFTLKEMVALSGAHTIGISHCKDFISRVIGPQPDPDIEARYAEVLKSLCKDYTVNETRGSFLDPVTPDKFDNMYYKNLEKGMGLLASDHILFKDNSTRPFVELYANDQTVFFEDFARAMEKLGMVGVKGDKDGEVRRRCDNLNKPNGSVAEPDKSFTGGNISFELNL

SEQ ID NO: 55360 - protein, 303 aa, Brassica oleracea
MTSVKVSNVSLGATERDLKEFFSFSGDILYLEMHSETERSKLAYVTFKDLQGAETAVLLSGATIVDSSVIVTMAPDYQLSPEALASLEPKEDSSKSPRASVFRKAEDVVSSMLAKGFILGKDAIAKAKSVDEKHQLTSTASARVASLDKKIGFTDKINTGTVVVGEKVREVDHKYQVSEKTKSAIAAAEQTVSNAGSAIMKNRYVLTGATWVTGAFSKVAKAAEEVGQIAKEKVGLAEEEDKRKVVDEFARVHLSESPKAAAASSEGEESKLSESPEAKKASEHQEPPQVQQAPPPPVAPAQP

SEQ ID NO: 55361 - protein, 437 aa, Kluyveromyces lactis NRRL Y-1140
MPISKVYARSVYDSRGNPTVEVELTTEKGTFRSIVPSGASTGVHEALELRDGDKSKWLGKGVLTAVSNVNNIIAPALVKANVDVTNQQQVDDLLLSLDGTANKSKLGANAILGVSLAASKAGAAAKNVPLYQHLADLAGAKTQPFVLPVPFLNVLNGGSHAGGALALQEFMIAPTGAETFAEALRMGSEVYHNLKSLTKKRYGASAGNVGDEGGVAPNIQTAEEALDLIVDAIKAAGYEGKIDIGLDCASSEFYKDGKYDLDFKNPESDPSKWLSGPQLADLYHELVKKYPIVSIEDPFAEDDWEAWSHFYKTAGVQIVADDLTVTNPVRIATAIEKKAADALLLKVNQIGSLSESIKAANDSFAANWGVMVSHRSGETEDTFIADLVVGLRTGQIKTGAPARSERLAKLNQLLRIEEELGSNAIFAGKKFHNGNQL

SEQ ID NO: 55362 - protein, 550 aa, Zea mays
  misc_feature (113)..(113): Xaa can be any naturally occurring amino acid
MTSSAGSHDVVVVHTGGCHCRRVRWRVEAPASIVAWVCNCSDCSMRGNTHFVVPAAKFRLQAGADESVTTYTFGTHTARHTFCKVCGITSFYTPRSNPDGVAVTVACVDPGTXLGHVEYRKADGRNWEEWFERSGIAGFSEGKADATAEYRNLRRPPVPVHVLPLRPRSAAISALHLAHRALIPPTPPHSIPPTPPRPQSSTPRPRPRHPPPRPRPQPVEISPARSRLARHQLTLALARDPSLPDARDPSSPPMAISGPRQVPSPLRQSSSRPRQAIRGKRPLTGEEHVAAPAVEETSEKKQASTTELPAPSGLTKKGCGGLLAFGSGGPDSEGMDEGTDDEGTDVAVEASLFPHPCLDGEGTDDDDGRGEENPPRTGTAGGISRQSRACTEMVVRKETTLHEAVRGGHEATPRAVNGKAPVICAAPGPATVVARRTTAQGLNGVSVAIAEPLGSHARPRFGETTVDVTGIPHRRSIRVADPPRTVDELATPSIVGENLLFMLAITPLGLSPTNVRASDCASAGEAPPWVGGAAIQTTVGREKISGSSIC

SEQ ID NO: 55363 - protein, 308 aa, Salmonella enterica subsp. indica
INGFGRIGRIVFRAAQKRSDIEIVAINDLLDAEYMAYMLKYDSTHGRFDGTVEVKDGHLIVNGKKIRVTAERDPANLKWNEVGVDVVAEATGIFLTDETARKHITAGAKKVVLTGPSKDNTPMFVKGANFDKYEGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSGYDN

SEQ ID NO: 55364 - protein, 416 aa, Zea mays
  misc_feature (405)..(405): Xaa can be any naturally occurring amino acid
MGNAVIPAIWLCFWILIVGDYFFTDCFFFGLVACVCALVYAAKIKIGINGFGRIGRLVARVALQSDDVELVAVNDPFISTDYMAICLFLRESYVNVVKVQSNLMMWIRFYFIAVDVIVYDETYMFKYDTVHGQWKHHEVKVKDSKTLLFGEKEVAVFGCRNPEEIPWGSVGAEYVVESTGVFTDQEKAAAHLKGGAKKVVISAPSKDAPMFVVGVNEKEYKSDINIVSNASCTTNCLAPLAKVINDKFGIVEGLMTTVHAITATQKTVDGPSSKDWRGGRAASFNIIPSSTGAAKAVGKVLPVLNGKLTGMSFRVPTVDVSVVDLTVRLEKSATYDEIKAAVKAEAEGSLKGILGYVEEDLVSTDFQGDSRSSIFDAKAGIALNGNFVKLVSWYDNEWGYSHPRXVDLIRHMNSTN

SEQ ID NO: 55365 - protein, 331 aa, Neisseria meningitidis
MNLKNRHFLKLLDFTPEEITAYLDLAAELKAAKKAGREIQRMKGKNIALIFEKTSTRTRCAFEVAARDQGAGVTYLEPSASQIGHKESIKDTARVLGRMYDAIEYRGFGQEVVEELAKYAGVPVFNGLTNEFHPTQMLADALTMREHSGKPLNQTAFAYVGDARYNMGNSLLILGAKLGMDVRIGAPQSLWPSEGIIAAAHAAAKETGAKITLTENAHEAVKNVDFIHTDVWVSMGEPKEVWQERIDLLKDYRVTPELMAASGNPQVKFMHCLPAFHNRETKVGEWIYETFGLNGVEVTEEVFESPASIVFDQAENRMHTIKAVMVAALGD

SEQ ID NO: 55366 - protein, 215 aa, Oryza sativa
MATWRLRRAAAAIAASSAVVAAGAAWPSASASDPSPAALEAARRRVAQPGAAPPPRAAQRAALAGSTPADPLDVLVVGGGATGCGVALDAATRGLRVGLVEREDFSSGTSSRSTKLIHGGVRYLEKAVFNLDYGQLKLVFHALKERKQVIENAPHLCHALPCMTPCFNWIEVVYYWFGLKFYDIVAGRRLLHLSRYYSVDESVELFPTLAKNSHD

SEQ ID NO: 55367 - protein, 250 aa, Flavobacteria bacterium BBFL7
MRKNIVAGNWKMNCDLSLTQNLIGDLKKGLKADYNCELMIAPSFPCLYPAFNSTLDTPIEVVAQNVCEQDKGAYTGEVSIDMLQSVGVKTVIIGHSERRDIYSETDELLAAKTIAAVENGMRVIFCCGEHLEQRKAGNHVSTVTAQIEKGLFQLNASQMEQIVIAYEPVWAIGTGETASPEQAQDMHADIRSFIQAKYGDMTARHTSILYGGSVKPSNAAEIFAKPDVDGGLVGGASLDAKSFLAIADAF

SEQ ID NO: 55368 - protein, 146 aa, Triticum aestivum
  misc_feature (47)..(47): Xaa can be any naturally occurring amino acid
MTSPTRRKELDVMKLMMNEYEVNVGENPAEYFITFYGPKDSPYEGGXWRVRVELPPTYPFKSPSIGFQNRIFHPNVDEASGSVCLDVINQTWSPMFDLVNVFESFLPQLLLYPNPTDPLNGEAAALLLKEPEKYKNKVRDYVQRFA

SEQ ID NO: 55369 - protein, 602 aa, Rickettsia montanensis
MTKEIDINKLLAQENNALNTILSQVNELCEQNKQLQGLIEIQNETKALEKEYNRSLPWFKRFVNTVSNVKYIFIKSEEQLTNEAIKYNNKILKDIDNKIYNIAEKSVSLKQELQEEIEKNFKDLTKKDLSKDQRERLSEVFFSYKSKPERFSALHMTNPLQFINAEELEKQYNSLNATKQNIQNLISENSNVKELKEIQKQVAEIREEVPYTFFEKLNNIWQNVKNVFVNNSEQVLAKNKESNTRTIRKIDEQLYKTKHKFEELIENKERNINDIIAKLPDNEELQKIVSNLTNHMASTKEPILTNSSLAKPLENNITPPPPLPGNNIPSPPPPPPPLPGNNIPSPPPPPPPLPGNNIPSPPPPPPPLPGNNIPSPPPPPPPLSGNNIPSPPPPPPPLSGNNIPSPPPPPPPLPGNNIPSPPPPPPPLSQNNIPPPPPPPMAPVSAQTEKLSKPVEATTVKKPENQPRPSIDTSDLMREIAGPKKLRKVEETDVKVQDSRDLLLQSIRGEHKLKKVEFDPNTGKPVAHSHSKPVQNVNKLSGVASILARRVVMEMSDSSGSESDSGNWSDVGVNRNTKTLKTKRERRKILNNRNSQKPSFVK

SEQ ID NO: 55370 - protein, 225 aa, Bordetella petrii
MLTQQELKQQAADAALALIEPLLGPDVIIGVGTGSTADLFIDGLARYRDRLRGTVASSERSAARLAGHGITVLDLNDVTSMPVYVDGADEIDARLHMIKGGGGAQTREKIVASVADRYICIVDESKLVERLGSFPLPVEVIPMARQAVARALVALGGQPRLREGFTTDNGNIILDVAGLQIDDAPALELTVNNLPGVVTCGLFARPGADVALLATQNGIRRLERP

SEQ ID NO: 55371 - protein, 423 aa, Kluyveromyces lactis NRRL Y-1140
MVSIGIIGAGPAGIAAARVLIANDRSYDIDLFETSSKIGGVWNYDPQSNNTAMYDVLETNLSSHLMAFKDYPFTNIDPNIKTFPGREQVQQYLESYYDSTVANYSKLGLFTEKRVISLEKVDSHWELKADSDDSTYIYDYIVVANGHFNKPFIPTVPGSYQWKNQSHSKNFVNSEHYRGLNVVVVGNASSATDIATQISTTASKVYHSVKPDSETNWPANSIIEVVSQIQSLDEPNSNTVHFIDGTSIQNVDHIIWATGFQYGVPFLKSYHSDLFRNQSNRLYNLWEQIVYKPDPTIFFSLLPKNIIPFQLAELQASIIDLVILGSITKSDMVDADNESITSSDYHSLPTPKDIEYYQHLGSIVARHGPDSKFKPLTWTDSLVQERISSSKVKAERQKLLVQWAIHQNLQNKPYSIPPDDFTG

SEQ ID NO: 55372 - protein, 307 aa, Bacillus cereus ATCC 14579
MNVYRGVHELIGHTPIVEITRFSLPIGVRLFAKLEFYNPGGSVKDRLGRELIEDALEKGLVTQGGTIIEPTAGNTGIGLALAALEHDLRVIVCVPEKFSIEKQELMKALGATVVHTPTEQGMTGAIAKAKELVNEIPNSYSPSQFANEANPRAYFKTLGPELWDALNGEINIFVAGAGTGGTFMGTASYLKEKNIDIKTVIVEPEGSILNGGKAGSHETEGIGLEFIPPFLKTSYFDEIHTISDRNAFLRVKELAQKEGLLVGSSSGAAFHASLLEAEKAAPGTNIVTIFPDSSERYLSKDIYKGWE

SEQ ID NO: 55373 - protein, 103 aa, Triticum aestivum
EPVLKYLKDIKWSRIDDPKGFKLEFFIDTNPFFKNSVLTKSYHMVDEDDPILEKAIGTEIEWYPGKNVTQKILKKKPKKGSKNTKPITQKLKSARASSTFSAP

SEQ ID NO: 55374 - protein, 120 aa, Listeria monocytogenes str. 4b H7858
MEIKDLQDYVAIVNDWPKKGIVFKDITPLMNDGEAYRFATDKIVEYAKELKIDIIVGPEARGFIIGCPVAYALGIGFAPVRKPGKLPRETIEMEYDLEYGTNKLSMHSDAIKTGQRVLIT

SEQ ID NO: 55375 - protein, 480 aa, Colocasia esculenta
MVKICCIGAGYVGGPTMAVIALKCPAIEVVVVDISVVRIAAWNSDQLPIYEPGLDEVVKQCRGRNLFFSTDIEKHVSEADIIFVSVNTPTKTRGLGAGKAADLTYWESAARMIADVSKSDKIVVEKSTVPVKTAEAIEKILMHNSKGINYQILSNPEFLAEGTAIEDLFKPDRVLIGGRETPDGQKAVKALKDVYAHWVPEDRIITTNLWSAELSKLAANAFLAQRISSVNAISALCEATGADVTEVAYSVGRDSRIGPKFLNASVGFGGSCFQKDILNLVYICECNGLPEVAHYWKQVIKINDYQKSRFVNRVVSSMFNTVSGKKIAVLGFAFKKDTGDTRETPAIDVCKGLLGDKATVSIYDPQVTEDQIQRDLAMNKFDWDHPIHLQPMSPTAVKQVRVTWDAYEATKGAHGVCILTEWDEFKTLDYQRIYDNMQKPAFVFDGRNIVNVDKLREIGFIVYSIGKPLDAWLKDMPAIA

SEQ ID NO: 55376 - protein, 748 aa, Oryza sativa Japonica Group
MPRRTDNAASANSVEPEKSEECLEFDDDEEEEVEEEEIEYEEIEEEIEEEEVEEDEDVVEEVEEVDEEEDEEEEEESDETEGVSKTKGVHQKDVTEKGKHAELLALPPHGSEVYVGGISSDVSSEDLKRLCEPVGEVVEVRMMRGKDDSRGYAFVNFRTKGLALKAVKELNNAKLKGKRIRVSSSQAKNKLFIGNVPHSWTDDDFRKVVEEVGPGVLKADLMKVSSANRNRGYGFVEYYNHACAEYARQEMSSPTFKLDSNAPTVSWADPKNNDSASTSQVKSVYVKNLPKNVTQAQLKRLFEHHGEIEKVVLPPSRGGHDNRYGFVHFKDRSMAMRALQNTERYELDGQVLDCSLAKPPAADKKDDRVPLPSSNGAPLLPSYPPLGYGIMSVPGAYGAAPASTAQPMLYAPRAPPGAAMVPMMLPDGRLVYVVQQPGGQLPLASPPPQQAGHRSGSGGRHGGSGGRYGGGGGSSGSSRPEECVSETRLYMRILPVSQSAESDGALYRQFTPVSHMDYEISGPESEVDSEVWLGWVAQRQIPTSLDDFLPSIRTTCTHTHTCNPPGPSATEHTHTCYHTHTRVFSSDDDSCGGDKAKPKKSRKPLGNREAVRKYRQKKKAHTAHLEEEVKRLRVINQQLVKRLQGQAALEVEVVRLRSLLVDVRSRINGALGSCPIQAQCGVDNVLGCDGMAQCFAGKPELGVRQSCAPSTVNCHISSDSGQNLVVPHALSPSDVIGSFMVSSTSKDE

SEQ ID NO: 55377 - protein, 460 aa, Staphylococcus aureus subsp. aureus Mu50
MKVSKFGGSSVSNATQIKKVLNIVNSDPERKIVIVSAPGKRHDNDIKTTDLLIRLYEKVINHLDYHDKKREIIQRYDDIVKELQMDESILRTIDVTLEHYINQLKNEPKRLLDALLSCGEDFNAQLIALYNNSQGIPTKYISPKEAGIFVTDVPQEAQILDSAYSEIKKLRDYDEKLIIPGFFGVSHEGYIVTFPRGGSDITGAIISSGVRATIYENFTDVSGIYKANPNIIKDPELIEEITYREMRELSYAGFSVFHDEALQPLYKDRIPVVIKNTNRPQDKGTFIVHDREINAKNVISGISCDKDFTVINIKKYLMNRQVGFTRKILGVLEDNNISFDHMPSGIDTISIVMRSKQIQNKETKVLNEIRQKCDVDELSIEHDLAILMIVGEGMNKVIGTANKITHALAESKINLKMINQGASEISMMFGIHVDDAEKAVLSTYEFCYHGVALKNLCDKN

SEQ ID NO: 55378 - protein, 353 aa, Staphylococcus aureus subsp. aureus Mu50
MRRWQGLVEEFKAHLPVNENTPKLTLNEGNTPLIHCENMSKILGIDLYVKYEGANPTGSFKDRGMVMAVTKAKEQGKKIVICASTGNTSASAAAYAARAGLKAIVVIPEGKIALGKLSQAVMYGAEIVSIEGNFDEALEIVKEIAKSGEIELVNSVNPFRIEGQKTGSFEIVQQLDGEAPDILAIPVGNAGNITAYWKGFKEYHEAKGSQLPKMFGFQAEGASPIVQNKVIKNPETIATAIRIGNPASWDKATNALKESNGLIDSVTDDEILEAYQLMTTKEGVFSEPASNASIAGLIKLHRQGKLPQGKKVVAILTGNGLKDPDTAISLLDNPIKPLQNDKDSIIDYIKGAL

SEQ ID NO: 55379 - protein, 308 aa, Salmonella enterica subsp. indica
INGFGRIGRIVFRAAQKRSDIEIVAINDLLDAEYMAYMLKYDSTHGRFDGTVEVKDGHLIVNGKKIRVTAERDPANLKWNEVGVDVVAEATGIFLTDETARKHITAGAKKVVLTGPSKDNTPMFVKGANFDKYEGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNLLKLVSWYDN

SEQ ID NO: 55380 - protein, 425 aa, Zea mays
MSWPTSPPSARAGAGGQPGAAAGGARAAVQPAAAVGQAGVALGGSRAGSQALAALGSSRAGAGSQALAALGGSRAGSQALAAAGGSRAGGQPGVPAVGARPGFQPAAGQRAAGSGRAASTKKARDDDQGDYIEWNDHHTTVVCSLFAEQVRKENRPNTHLNNVGYNEVITMFFQCTGIMLKKSQLKNKWDKLKSDLTVWRKLMRKQTGLGWNWDNGTINMDAEWWKKIKNEIPGVGKFKNRPLQNEDDMKVMFGSIINEETDHWNPMSSNPIMPPSPDQSPHIDLENGEDNVEENGEENGGQDIGDDIFEVSPTPSNKPKTKATIILDKPKKKSKTSTGLVIQEHISKISKSADAFVSSRLGGISIDEVMGHVIACGAALGTDEHFVATELFVKKEQREMFMTMPTPESRFNWLKRKYALMFGKD

SEQ ID NO: 55381 - protein, 334 aa, Thermoplasma acidophilum DSM 1728
MVCGKKRVGEELRCKSCGSPFEIRTGFHYRENIEDNFPYIKNMISLGESETPIFHGDDFDLKLDYMLPTFSYKDRGSRILISHIADIRDSYGITRISEDSSGNAGASIAAYGSAAGLAVDIYVPETVAGRKFSQIQAYGANVIKVKGSREDVQSAAERSESFYASHVLRPEFRDGIRTLAYEIYRQYDRMPRNIYIPVSAGTLLLGLYSGLRHLMESGEIAEMPAIVAVQTEAVSPLCAKINGLNYDPDNKLSSIADALVSRKPVLLQKMYQVISEYGRCMTVSDDEIIEARNRLAKKGFLVEYSSATVYAAFRKKPQENSLLVLTGSGLKNDS

SEQ ID NO: 55382 - protein, 718 aa, Zea mays
MAPHTTAAAGGGGGEEALEEASTLRHRHSAAKDGGEEGQANNGVAAAADDDGEGNALSVERAFADQAVPSWREQLTVRAFVVSFFLAIMFSVIVMKLNLTTGIIPSLNVSAGLLGFFFVRLWTAAIERVGLLRQPFTRQENTVIQTCVVAAYDIAFSGGFGTYLFGMSETIAKQATEADNPQNVKNPHIGWMIGFLFLVSFIGLFALVPLRKVMIVDYKLTYPSGTATAYLINGFHTPEGAKLAKKQVKTLGKFFLMSFLWGFFQWFYTGGDNCGFQNFPTLGLQAYKNKFYFDFSPTYVGVGMICPHIVNVSVLLGGILSWGIMWPLIGNQKGNWYDASLPESSLHGLQGYRVFISIAIILGDGLYNFVKVLIRTTAGFISMMKKNSTLPVSNNGSPITEGVSFDDERRRDLFLKDQIPRSVAYGGYVAVAAISIGTLPQVFPQLKWYYILVAYIFAPVLAFCNAYGTGLTDWSLASTYGKLAIFIFGAWAGASNGGVLVGLAACGVMMSIVSTAADLMQDLKTGYLTLASPRSMFISQVIGTAMGCVIAPCVFWLFYKAFADIGLSGSEYPAPYAIVYRNMAILGVDGFSSLPKNCLTLCYIFFAAAIVVNLVRDLVPKKVARFIPLPMAMAIPFYLGSFFAIDMFIGTVILFAWETINKAKANAFAPAVASGLICGDGIWTLPQSILALAKVKPPICMKFLSRSVNAQVDGFLGS

SEQ ID NO: 55383 - protein, 287 aa, Craterostigma plantagineum
MEAKEEDVRLGANKFSERNPIGTAAQTHDDKDYTEPPPAPLFEPGELSSWSFYRAGIAEFMATFLFLYITILTVMGVNRAPNKCASVGIQGIAWAFGGMIFALVYCTAGISGGHINPAVTFGLFLARKLSLTRAVFYMVMQCLGAICGAGVVKGFYKPTYNLEGGGANVVANGYTKGDGLGAEILGTFVLVYTVFSATDAKRSARDSHVPILAPLPIGFAVFLVHLATIPITGTGINPARSLGAAIIYNHDRAWHDHWVFWVGPFIGAALAALYHVVVIRAIPFKSK

SEQ ID NO: 55384 - protein, 642 aa, Staphylococcus aureus subsp. aureus COL
MILLQLNHISKSFDGEDIFTDVDFEVKTGERIGIVGRNGAGKSTLMKIIAGVENYDSGNVSKIKNLKLGYLTQQMTLNSNATVFEEMSKPFEHIKRMESLIKEETDWLSKHANDYDSDTYKTHMSRYESLSNQFEQLEGYQYESKIKTVLYGLNFSEEDFNKPINDFSGGQKTRLSLAQMLLNEPDLLLLDEPTNHLDLETTKWLEDYLRYFKGAIVIISHDRYFLDKIVTQIYDVALGDVKRYVGNYEEFIQQRDLYYQKRMQEYESQQAEIKRLETFVEKNITRASTSGMAKSRRKILEKMERIDKPMLDAKSANIQFGFDRNTGNDVMHVKNLEIGYQTAITKPMSIEVSKGDHIAIIGPNGIGKSTLIKTIANQQKALNGDITFGANLQIGYYDQKQAEFKSSKTILDYVWDQYPLMNEKDIRAVLGRFLFVQDDVKKIINDLSGGEKARLLLALLMLQRDNVLILDEPTNHLDIDSKEMLEQALQHFEGTILFVSHDRYFINQLANKVFDLTIDGGKMYLGDYQYYIEKVEEAEALKAHQEEQSVNVQAHKKSMEQSSYHNQKEQRREQRKLERQISECENEIETLETTILQIDEQLTQPEVYNNPQKANELAIQKQDSEQKLEHAMSKWEELQQKL

SEQ ID NO: 55385 - protein, 288 aa, Craterostigma plantagineum
MAENREEDVRLGANKYRETQPIGTSAQTDKDYKEPPPAPLFEPGELKSWSFYRAGIAEFVATFLFLYITILTVMGVSRAPNKCASVGIQGIAWAFGGMIFALVYCTAGISGGHINPAVTFGLFLARKLSLTRAIFYMIMQCLGAICGAGVVKGFQVGPYQRLGGGANTVAHGYTKGAGLGAEIIGTFVLVYTVFSATDAKRSARDSHVPILAPLPIGFAVFLVHLATIPITGTGINPARSLGAAIIYNKDHAWDDHWVFWVGPFIGAALAAVYHQIVIRAIPFKSGRA

SEQ ID NO: 55386 - protein, 241 aa, Prochlorococcus marinus str. MIT 9312
MRKSVIAGNWKMHMTCAEAKSYLEEFIPLIKNIRDDRKVVIAPPFTAISTFSKHSDFDYLDISSQNIHWEDEGAFTAEISPKMLIEHGVSYAIVGHSEPRKYFSESDEQINKRAVFAQCSGLTPIVCVGETLEQRERGEADRVITRQVEQGLENTDPSNLIVAYEPIWAIGTGKTCEAKDANNICSLIRKLIGFDDVIIQYGGSVKPNNIDEIMSMSDIDGVLVGGASLDPNSFARIANYQ

SEQ ID NO: 55387 - protein, 198 aa, Craterostigma plantagineum
MIFILVYCTAGISGGHINPAVTFGLFLARKVSLIRAVSYMIAQCLGAICGVGLVKAFMHNPYNRLGGGANTVAPGYNKGTALGAEIIGTFVLVYTVFSATDPKRSARDSHVPVLAPLPIGFAVFMVHLATIPITGTGINPARSFGAAVIFNNGKAWDDHWIFWVGPFLGALAAAIYHQYILRAQAAKALGSFRSNPTN

SEQ ID NO: 55388 - protein, 156 aa, Brassica napus
MSFREKMPTSPKSPLRRRRSSWTGSWLNHPTTSFKEVVSAVIQAQSPRSTSKPQTFDFDFDFSKVDRTLSLPDSLLLRILQKLPDSQNSNNDVSLVCKRWLSLQGRRLRTLKLLDYDFLLSEKLVSRFPKLTSIDLSNACMNPNPNPNPPRISSAT

SEQ ID NO: 55389 - protein, 211 aa, Oryza sativa
MATEIEAYYDDGSGTYLLSFDEDFLDATLTKSGGKVESWLGETYRIHRSCGHPLVVGLDVEWRPAAPVPGPVAVLQLCVDRRCLVFQILHADYLPDALSRFLADPRYTFVGVGVRDDAARLRVGYGLEVPRAVDLRALAADTLGRPDLRRAGLRALVREVMGVQMDKPHHVRVSAWDKRNLSEDQFKYACTDAFASREVGRRLYTCNCDGA

SEQ ID NO: 55390 - protein, 165 aa, Zea mays
  misc_feature (43)..(43): Xaa can be any naturally occurring amino acid
  misc_feature (52)..(52): Xaa can be any naturally occurring amino acid
  misc_feature (96)..(96): Xaa can be any naturally occurring amino acid
  misc_feature (107)..(107): Xaa can be any naturally occurring amino acid
  misc_feature (121)..(121): Xaa can be any naturally occurring amino acid
MAGTIQSVKARQIFDSRGNRTVEVDVLRSHGTLAWAAAPRGAXTGVYEALEXRDGGSDYLWKGVCKDENNAYTDIVPAMIGMDPTAHTEIDNLMDXHLDGTNNEWGXSKQKLDAHAILAVXIAVEGGCSIITRNASYQLNVNLADNEHHELPVHAFNVINGGTHA

SEQ ID NO: 55391 - protein, 475 aa, Colwellia psychrerythraea 34H
MNMSEKMNTELRELSSILTGQKQAYRSAPNPSAKERIAQLSALKSALLSFQDDLVNALNEDYGQRPAQDSLIADIMPCIVNINYTIKRLNKWMKPQRRHAGLLLAPAKVEVHYQPLGVVGIMVPWNFPVMLSIGPLITALAAGNRAMIKLSEFTPSTNQVIKKMLSSILEQNTVTCIEGEANIAAEFSALPFDHLIFTGSTTVGRHVMRAAADNLTPVTLELGGKSPVIIAPDMPIDTAVERLIFGKCLNAGQICVAPDYILCPKDKVEAFISSYQKQFQTMYGDKHQSTDYAHVINENQHNRLLSWLDDAVSKGAKVVSANGQDIDRNSRELATQLVTETTDDMLIMQQEIFGPILPIISYEDISETIDYINERARPLALYIMSFDTETQQHLLSQTHSGGVCINETIFHVAADDAPFGGIGDSGMGQYHGKEGFLTFSKAKTVLSRGKLNIGKLVHPPYGGLIQRLMLKFFLR

SEQ ID NO: 55392 - protein, 366 aa, Oryza sativa Japonica Group
MHSSTRARLLLAAAVLLLSGCSGGQSSGNRSTYHVIIVDDERKFGYVPGTENGPGNWSRLDPRWAKCNTGNMQSPIDLSHERLMRNLGYLDYSYLPAEASMVNRGHDIEVTISTYHVIIVDDERKFGYVPGTENGPGNWSRLDPRWAKCNTGNMQSPIDLSHERLMRNLGYLDYSYLPAEASMVNRGHDIEVKFMGNAGRVVINGKAYKLKQLHWHTPSEHTVNGRRYDMELHLVHDDGNSNTAVIGNLYQIGNPDPFLLMLEPFIRRIADTKDKSEPIGVVDPQLAKSPDAVYYRYMGSLTTPPCTEGVIWTVFKRVFLLAQTVAQYQLDLLREAVADGYENNARPLQKVNNRNISIFIPDPKKD

SEQ ID NO: 55393 - protein, 523 aa, Ricinus communis
MPAVGGIPPSGGNRKVYPGNLTLYVTVTCVVAAMGGLIFGYDIGISGGVTSMDSFLKKFFPSVYRKKKADESSNQYCQYDSQTLTMFTSSLYLAALIASLVASTITRKFGRKLSMLFGGVLFCAGAIINGAAKAVWMLILGRILLGFGIGFANQSVPLYLSEMAPYKYRGALNIGFQLSITIGILVANVLNYFFAKIKGGWGWRLSLGGAMVPALIITVGSLVLPDTPNSMIERGQHEEARAHLKRVRGVEDVDEEFTDLVHASEDSKKVEHPWRNLLQRKYRPHLSMAIAIPFFQQLTGINVIMFYAPVLFDTIGFGSDAALMSAVITGLVNVFATMVSIYGVDKWGRRFLFLEGGVQMLICQAIVAACIGAKFGVDGAPGDLPQWYAVVVVLFICIYVSGFAWSWGPLGWLVPSEIFPLEIRSAAQSVNVSVNMFFTFVVAQVFLIMLCHLKFGLFIFFSFFVLIMSIFVYYFLPETKGIPIEEMGQVWKQHWYWSRYVVDEDYPNGGLEMGKEGRIPKNV

SEQ ID NO: 55394 - protein, 426 aa, Oryza sativa Japonica Group
MGWGEPPAPQQRKAAGGGGLKLLLSVLLVGLALRLLVNPSAYLLLSSSSTTTTAAVALGQGDDAVLAGGGSLPSNGSCDLFHGKWVPDSSGPDYTNNSCRFIETPQNCMTNGRPDSGYLYWRWKPYGCEMSRFEGEKFLEAMRGKHWALIGDSILRNHVQSLLCLLAKVEEPTQVYHDKTFKSRKWHFALHNITVSLIWAPFLVEAEIFEDDDGVSTSELQLHLDILDSNWTRQWNSFDYVVISTGQWFPKTAVYWENGAVTGCHYCQDKSVAELTFEYAFRKSLRKTFQFITSSPHKPVVFYRTWSPSHFENGEWSSGGTCKRTVPFKPGETGDRESDMKMWRIEREEFAKAVVHDRHNNAGRLKLLDTFELSLQRPDGHPGPYRTYHPFEKATSAKVQNDCLHWCLPGPIDAWNDIIMQMLAIN

SEQ ID NO: 55395 - protein, 212 aa, Bacillus cereus ATCC 14579
MGTNKPVVIGIAGGSGSGKTSVTKAIFDHFKGHSILILEQDYYYKDQSHLPMEERLKTNYDHPLAFDNDLLIEHLQQLLAYEQIDKPVYDYTLHTRSEEIIPVEPKDVIILEGILILEDPRLCELMDIKLFVDTDADLRILRRMQRDIKERGRTMDSVIDQYVNVVRPMHNQFIEPSKKFADIIIPEGGQNHVAIDIMVTKIATILEQKVNL

SEQ ID NO: 55396 - protein, 492 aa, Kluyveromyces lactis NRRL Y-1140
MSEPAGDIGLIGLAVMGQNLILNAADHGFTVVAYNRTVSKVDHFLANEAKGKSIIGAHSVEELCRNLKRPRRIILLVKAGDAVDAFIQQLLPFLEKGDIIIDGGNSHFPDSNRRYDELKEKGIYFVGSGVSGGEEGARYGPSLMPGGAEEAWPHIKDIFQSISAKSDGEPCCDWVGPAGSGHYVKMVHNGIEYGDMQLITEAYDIMKRIGGFTDKEIGEVFSQWNKGVLDSFLVEITRDILLYDDVDGTPLVEKILDSAGQKGTGKWTAINALDLGMPVTLIGEAVFARCLSSLKDERVRASKLLPGPQIPKDAVKERQQFVDDLEQALYASKIISYAQGFMLIREAGKTYGWKLNNPAIALMWRGGCIIRSVFLGEITKAYRENPELENLLFNKFFADAVEKAQSGWRKTIGLAVSYGIPTPAFSTALSFYDGYRSERLPANLLQAQRDYFGAHTFRVLPEAASENLPADQNIHINWTGKGGNVSASSYQA

SEQ ID NO: 55397 - protein, 165 aa, Synechocystis sp. PCC 6803
MLLAEILENLRQPIAPQFISQKKTFKNKKPTGSVDFVAWYDLADLLDDLCGLGGWEWLIIDTQQIGDRLTLTGSLTIHGDDRSLTRQATGTEDIDCNSYGDPSSNAEAMALRRCCAKFGLGRDLWRKNKPQPLKMGQRQEPEKQTVLAPGTISREEWLKRKQAKS

SEQ ID NO: 55398 - protein, 744 aa, Oryza sativa Indica Group
MDTPLLLLLPFLAACLLAPRHAAEAAVTSCAPRRCGNVTIAYPFWLPDSSPPPSSSSAPCGPAAFQVNCDNGSRASLARSFRSGYKILGVSYANRTVVVANDNVQTDASGCPVPKIDVSASLTLAPFTASPANSQLVFLFNCTSSSRPPPAGFVNVTCPGAKAVVRLDTSYNNTAARVVAGGCDYAAVPVVGVPGASPTDYPQLLRGGYMLEWRAPAGDCMACNASGGQCGYDADTEAFACICSDGSSRPGICDAKKSGNKIILIVSLSICATGLVLLACIAIVYKCRRRMQNRFSFLNAMDGASRTDTAKVEKLLQSYGSLAPRRFRYSELKKITKSFSQRLGEGGYGTVFSGTLADGRAVAVKFLHHSKPNGEEFLNEVVSIGRTSHVNIVSLLGFCLEGSKRALVYEYMPNGSLDKYIYSTSAAAAAEAEEAEEAEATASPDRDVLGWKVLQEIAVGVARGLEYLHDGCNTRIIHFDIKPHNVLLDEGFRPKIADFGMAKLCNPKESILSMADTRGTIGFIAPEVFSRGFGDISTKSDVYSYGMLLLEMVGGGSNVKAYAEKGASGTFFPLWVYDHLLEDGGVLQSVAAAAAATAGGGAGSPGGEEIARKMALIGLWCIQTVPANRPSMGKVLEMLERSVHELAMPPRPYHSNSSSPSRPSSYPSSASDFTQRCGARHVRCGSEVLPWIMDTSVSGTPSAPDRRIRVARLCRKFSASRIDRADREPERRISVCPRAEPTLS

SEQ ID NO: 55399 - protein, 194 aa, Zea mays
  misc_feature (69)..(69): Xaa can be any naturally occurring amino acid
LCAGGRQADIPVAKGALGPRKKQRAMASGGPKPKLAYIILYVRDVEKAASFYDAAFGYTVRRLDQSRKXNTRACACPPDPDARLICRICAPFWVLLCRWAELESGATTIAFTPLHQRETDELSGAVQLPDSSAAGRGSVEVCFAYADVDAAYRRAVDNGAVAVSAPEDKPWGQKSGYVRDMDGNIVRIASYVRE

SEQ ID NO: 55400 - protein, 484 aa, Staphylococcus aureus subsp. aureus Mu50
MEDNKMNRSLNSRHISMIAIGGAIGTGLFVATGNIISQAGPGGAILAYLVIGVMLYFLMSSIGELATFYPVSGSFSSYSTRFIDSSLGFTMGWLYWALWSLVTSVDVIVASNVLYFWDTFKFFHPITWSLIFITILLLLNIFSVKSFGETEFWLSLIKVLTIIVFVIFGFLMIFGILGGHTYGFENYTKGQAPFVGGISGFLGVLLVAGFSVGGTEVVAVTAGESDDPKKSMPKAIKQVFWRILLFYVLSIAVIGAIIPYTDPSLLRASSSISQSPFTIVFDRVGIAFAASVINAVILTSLLSAANSGVYTTGRMLYSLSSDKKAPQFLSKLNKTTKLPLRALLTTYAVVVIVIIYANFNSNAVFNLLEIIGSMIIVVWGSSIWSQIRLRQAIKKQGQDPNKVLPYKAPFYPLGPIIVITTLLFLLFGGSVEYILKDQWLNAFKNFLPLIILALIYFIHKIIHKTKFVKLETINLKPHDYDNQN

SEQ ID NO: 55401 - protein, 382 aa, Zea mays
MGSVSLNVASSRRGGRRLAWLCSSALLNLLVLLSLLSTNLLALRAFLSPRAHSVPAAGAANLSSSAAISAQVAAIAREIDATRLVPRHGGGALPPELLLFLSPHALPLGRDARTGLTHMPASVAHACFRSPPTLALLAAFATYTPHTACPRRNATLPHRLISKACEPLPRRRCLSRGPRAALPASNMGVDSHRWVKPRHDHEFLIDDVLRLAGGGSKIRIGFDVAGGAANFAARMRERGVTVFTTVLDSAGKPMNEFVAARGLFPLLLSPAHRFPFYDGVFDLVHVGTTALAEGGSPALGQAGTEEALEFFMFDVDRVLRARGLLWIDSYVCHSDERRQLLVRLIGRFGYKKLKWVTGEKAGTGSAKPAMYLSAVLEKPARS

SEQ ID NO: 55402 - protein, 401 aa, Synechocystis sp. PCC 6803
MDLLEYQAKELFQQVGIPILPSQTIQNTTALKRLQIPYPMVLKSQVRAGGRGKAGGVRFVENTIDAIAAASAIFHLPIADEYPEVILAEARYDAQSELFLAIVLDYQRQCPVLMGSSEGGIDVETLLEQMQSVSLRTNFSPYLARRLAVKMGLTGPLVTAVSGIIGKMYELFVTYDLDVIEINPLGISADGEVMALDGKITVNDTAINRHPDLINWRSEQWTGHSWLPGNLAQGQIGLICNSEGLALSTWDLLNSFGITGAYLLDEGRSDITLGEQLELAFNHLSQAPNLKGIFVNLATRATDTSALAEDLRSFLPLPPNLSSEDRSLRGTGPSLPQRQRVPQRQTYTGEVLPVVIRFSQGNLDHLQQMYDNSLVHWHNDLETAIAKMLSLMPQETALAQG

SEQ ID NO: 55403 - protein, 210 aa, Zea mays
  misc_feature (56)..(56): Xaa can be any naturally occurring amino acid
RAFYDRRISQEVSGDALGEEFKGYVFKIMGGCDKQGFPMKQGVLTSGRVRLLLHRXTPCFRGYGRRNGERRRKSVRGCIVSQDLSVINLVIVKKGENDLPGLTDTEKPRMRGPKRASKIRKLFNLNKDDDVRKYVNTYRRTFTTKNGKKRKRARIADKKKRITKKKSEAAEYQKLLAQRLKEQRDRRSESLAKRRSKLSAAVKASAATSA

SEQ ID NO: 55404 - protein, 944 aa, Ostreococcus tauri
  misc_feature (1)..(1): Xaa can be any naturally occurring amino acid
  misc_feature (349)..(356): Xaa can be any naturally occurring amino acid
  misc_feature (509)..(515): Xaa can be any naturally occurring amino acid
XSPRTKSDAAAAALDANDDDEELTLVGKYGALDRARACVRVRTVVRSNAGEASASRAVTCARRGGVVEFMDAASGTRARAGFAVTLKDGATLIDAYGWCDSIESEVTKAVTVDDGGNVRSHAWEASRGEGGTWTETGAFKAMENAVSSDYDAHLGSLVVGGRGRGCDVMIYDVAHGTRTFKAGYPPANWLGYTAPPWVSASCFAATSECKRFFVGTGEHRFRHYDTRASDTAVLDLDLGKGVITCVASSLDGREAYVANARGAFEIVDLRIGKTRGKFKGNSGSIRGIAVSDDGAHVACAGLDQYVRVYDAKSRKCVASAYAKQPLTSIVFDSYTPAMEAKKAKAAKKXXXXXXXXRVGQRARTEEEIQRARDGRRRALAFFNNPKSLPRLAANRSSSVSRRSLIAHVSDFASCRAMSPHSTTLSPNKTHNFQSLLLNRCFANGFPPRPTRTSSPASKPLTRGSSTSVGSIARASPPRVDFFARRSRARGRRTRRRPRARGRRRAHRDXXXXXXXERSLTPAKRACAVALRNRWRRHRIESPMREEIAPKNILMIGPTGCGKTEIARRLAKITDSPFVKVEATKFTEVGFHGRDVDQIIRDLVDNGIALTKQKMRAKFEKYVEELIENKILDFICGEGANDETREAFRSLYRDGTLDDRMIEVDLPDNAGQGMKIDPSGGPIPIHELVIKVDKLFGNRKSTTKRKMTVAECKPLIEEMEFDNLLSAETIAKEAITSVENDGIVFIDEIDKIVSSSDYRHGADASSEGVQRDLLPIIEGSVVSTKHGNVNTDHILFVCSGAFHSAKPSDMLAELQGRLPIRVELKGLSEHDLYRILTEPEMNMIAQQKALMKTEGIDLVFTNEAIEHIAKLAHKVNKTVENIGARRLHTVLERIVEELSFSAPEKYTKFIADGGAGELVVTIDVKDVDEALGSMLKKDDLSRFVL

SEQ ID NO: 55405 - protein, 241 aa, Trichodesmium erythraeum IMS101
MRKTIIAGNWKMYKTQLEAKEFLEGLMSQLTKTPEEREVVLCTPFTALDFMSKILHGSLIRLGAQNVHWEDEGAYTGEISGLMLKDVGVSYVIVGHSERRQYFGETDETVNMRLKAAQKHGLTPILCVGETKQQRDSGETESHIFSQLANDLVDVDQENLVIAYEPIWAIGTGDTCEAKEANRVIGLIRGKLNNSNVTIQYGGSVKPNNVDDIMAQEEIDGALVGGASLNPESFSRLVNYQ

SEQ ID NO: 55406 - protein, 185 aa, Zea mays
METSSHKRAREAVDLAAAAGEAVWPEADAKRLRPQDLLDMLDDDTEAAAAGDLASVMRSLEEEIASFDEAAEAAPSQQPELGFLLEASDDELGLPPAGSAAAASSEEAGLAGPPEPAAALYGQIWGFDDEIDGGFGGYSPEAAAAAAAAAAWDDDVFGAGLFAFGDDACAPSDLAALRHESMPAV

SEQ ID NO: 55407 - protein, 432 aa, Schizosaccharomyces pombe
DREVDVGIPDPTGRLEILRIHTKNMKLADDVDLEQIAAETHGYVGSDLASLCSEAAMQQIREKMDMIDLDEDEIDAEVLDSLGVTMDNFRFALGSSNPSALRETVVEVPNVRWEDIGGLEEVKRELRETVQMPVMYAEKFLRFGVTPSKGVLFFGPPGTGKTLLAKAIANECSANFISVKGPELLSMWFGESESNVRDIFDKARAAAPCVVFLDELDSIAKARGASAGDSGGGDRVVNQLLTEMDGVNSKKNVFVIGATNRPDQIDPALMRPGRLDQLIYVPLPDEEARFSILQTQLRHTPVAEDVDLRAVAKATHGFSGADLEFVVQRAVKLAIKDSIEEDIKRENETGEAPADDVVMDEDASVSQVQRHHVEEAMKMARRSVSDAEVRRYEAYAHQLLTSRGLTGFQFDSADSNTNGPSFGNDGADDLYA

SEQ ID NO: 55408 - protein, 332 aa, Triticum aestivum
MGNCKSSSRARLGKAHVVPDSEWRMQDFGKTHVPDLEWRINDFSSLLETGAKSAKSDAFHCSGYNWYLQVSPMHKEIGSETPYVALCLKISQASMVPGHTVHVVFELSIYNHTKGMYCGCKDTYNFHFKNTYSKEQCLIPLQELLKSSAFLVDDSCVFGVEILKIDVSSPEKKAVVVQKKDTTVQNLFVQKKGFVKGTYTWNMNNFLELDLDHFVRSPTFEVGGHKWYIRIYPRGDKYSTDCLSLYLFLDASDELHLKSKKVVVMTLSILDQKNGKRLTATSGLLVFTGGHGWGWADFLGLMKLKDPSGGYVVGSSCIVKADLTIVGSSNDG

SEQ ID NO: 55409 - protein, 478 aa, Gibberella zeae PH-1
MATYYDAIIIGSGQSGNPVAKAFANAGHKTAVIERTALGGTCVNVGCTPTKTMIASGRAAYMARRGKDYGVHAGNGNFEIDMARVRQRKRAIVEQWNSGSVRGLNAAGVDVIMGEGSFVGDKKLKVVLNDGGEKEVSADKIFINVGERPLRPDISGLDGVEPARVLDSTSIMELDAVPEHLVVLGGGYIGLEFGQLFRRLGSEVTVIQRAKQLVPHEDPDVAECLYDILQQDGLTVYLSSTVNSVSASTDSKMPFTVNVQTANGQTDVAGSHILLAAGRVPNTDRLNLSEVGIKTTSKGHVVVDDKLQTSASNVYALGDCHGGAAFTHISYDDSRIIRTNLLPKTMASTTPAMPTTQSSTSRVLTPYVMYTDPQLGHVGLHARDLFNSKREVKIAKMPMSYVARALETAEPRGMMKATVEAKTGEILGFTCLGLEGGEIMSIVQTAMMGNLKWWDLEAAVYAHPTLAESLNNLWGHLE

SEQ ID NO: 55410 - protein, 503 aa, Physcomitrella patens subsp. patens
MPRTNSVDLPGCPPFRALCCDNLGYVKVVEVASDKGMPQVVARWGRDPVACSAYGEEGFALARKSGRVEVLNPVNGVRLAEVVVPTSISERVNGNREDASDAVCGLHLFKKNSIWGTAVLTCTEQGVAAIQRISFPADDEDMGVSNDGDEDMGVSTSSQVSSDAIVWSVADSGSVCCLRVDGSERYAIFGGKGVEVSMWDLEKRTRIWSAKNPRRDNLGLIAPAFVTALAFLSVKDHRKFVVGTGHHQIRLYDTGAQRRPMLMFDYGESPIKSIAPGGDGNTVYVGSGSGDLACFDMRTGQNVGGFKGKISGSVRSVVLHPTLPIVASCGLDRYLRIHHSRTRQLLSMLFLKQQLISVVFDTSADKSVPPTSGSSNKENSNAAEAKPASKTGTEKEGRTDKKKRSREELKDFAVPSQNLVKIKKKSAVVPNIETKQEKSSRKHLVLTGSVNAASRNSGLLRWKRRLARDVVDAALFRNLFAASIPRKAVLCSSLPMTCTLSAL

SEQ ID NO: 55411 - protein, 398 aa, Zea mays
MASPGVVAAALLMAVLAAFCGTDPLRMGSMAGFPGFEAHFVDLPDPAEMPPHADERERLRGAEVRFRGDVQGPESVAFDPQGRGPYTGVADGRVVFWDGERWVPFATASPRWTQELCGGPKASPVEYLPNEHICGRPLGLRFDKKTGDLYIADAYFGLLKVGPEGGLATPLATEAEGVRLNFTNDLDLDDEGNVYFTDSSIHYQRRNFMQLVFSGDPSGRLLKYNPQTKETTVLHRNLQFSHGVSMSKDGSFSLFCEGSRGRLSRYRLKGEKAGTVDLFAILPGFPDNVRTNEKGEFWVAIHCRRGLYARLMSRHVKLRKFLLSLPIPAKYHYLMQIGGRLHALIIKYSPEGQVLDILEDTKGEVVRAVSEVEEKDGKLWIGSVLMPFIAVFDLAKAS

SEQ ID NO: 55412 - protein, 111 aa, Capsicum chinense
MESSRGGQNGIQLLLAAEQEAQHIVNTARTAKQARLKQAKEEAEKEIAEFRAYMEAEFQRKLEQTSGDSGANVKRLELETDEKIEHLKTEASRVSSDVVKMLLRHVTTVKN

SEQ ID NO: 55413 - protein, 90 aa, Glycine max
MKLVFATLLLCSLLLSSSFLEPVIAYEDSSYCSNKCSDRCSSAGVKDRCLRYCGICCAECKCVPSGTYGNKHQCPCYRDKLNKKGKPKCP

SEQ ID NO: 55414 - protein, 455 aa, Rhodococcus sp. RHA1
MSDAFDLVVIGSGPGGYVSAIRGAQLGLRTAVVEGNALGGRCLNYACIPAKAVLRAADVLDEVRHASQFGIHVGTPRVSFDEVRARRDEVVASLTGGVRGLLKKNGVEVKHGWARLAGDGAVTVDGETVHGRAIVLATGSVARPLPGLDFHGRVIGTEQAWALDALPDTIAVVGAGASGVELASAYARLGSKVRLIEASDRILPAEDADISAIVHAKLRRQGIAISTGVTVSDTEQSTDAVSFTVDGRTEQTTWLVVAAGRSPDTDSLALDTAGVELDDRGLIRVDERLRTTAPGIWAIGDLVRGPALAHKASEEGIIAAEDAAEHIPEPLLHNLIPRATFCSPSVASVGLTEEQARQQGYEVVVGTARYGAVGAGTVLGERDGLVKLVGDAKYGELLGAHIVGAKATELIQELVTARALEAGLPEIATIIHGHPTLSEAVSEAARDAQGWMIHG

SEQ ID NO: 55415 - protein, 252 aa, Prunus microcarpa
AHYKSEADVGNAIAEAIQSGLVKREELFITSKASNHGHVVEACKNSLKKLQLDYLDLYLVHYPLATKHSGVGTTASLLDENKVLDIDVTVSLETTWHDMEKTVDLGLVRSIGLSNYELFLTRDCLSYAKIKPQVSQFETHPYFQRESLVRFCKKHGVIPMAHTPLGGATANVKAFGSISPLEDPVLIGLAKKYQKSVAQIALRWNLERGTPVIPKSSKVERLKENLEVLNFKLEKEDIELINTIDKKSRTTL

SEQ ID NO: 55416 - protein, 250 aa, Capsicum chinense
MVSDAAKKRDAQKKAAAAARRGGKGAATSKAAAAKGAAAESNGVDSLANGIGDLKISDRTCTGVLCSHPLSRDIRIESLSVTFHGHDLIVDSELELNYGRRYGLLGLNGCGKSTLLTAIGLRELPIPEHMDIFHLSREIEASDMTSLEAVINCDEERLQLEKEAEALAGRDDGGGEQLERIYERLEAMDAATAEKRAAEILFGLGFDKKMQAKKTRDFSGGWRMRIALARALFMNPTILLLDEPTNHLDL

SEQ ID NO: 55417 - protein, 252 aa, Prunus lusitanica
AHYRSEADVGNALAEAFETGLVKREELFITSKASNHGHVVEACKNSLKKLQLDYLDLYLVHYPLATKHSGVGTTASLLDENKVLDIDVTVSLESTWHDMEKTVSLGLVRSIGLSNYELFLTRDCLSYAKIKPQVSQFETHPYFQRETLVRFCRKHGVCPMAHTPLGGATANVKAFGSISPLEDPVLRALAKKYKKSVAQIALRWNLDRNTPVIPKSSKIERLKENLEVLNFKLEKEDIELINTIDKKSRTTL

SEQ ID NO: 55418 - protein, 252 aa, Prunus virginiana
AHYKSEADVGNALAEAFDTGLVKREELFITSKASNHGHVVEACRNSLKKLQLDYLDLYLVHYPLATKHSGVGTTASLLDENKVLDIDVTVSLESTWHDMEKTVSLGLVRSIGLSNYELFLTRDCLSYAKIKPQVSQFETHPYFQRETLVRFCRKHGVCPMAHTPLGGSTANVKSFGSISPLEDPVLHGLAKKYKKSVAQIALRWNLDRNTPVIPKSSKIERLKENLEVLNFKLEKGDIELINTIDKKSRTTL

SEQ ID NO: 55419 - protein, 422 aa, Rhodococcus sp. RHA1
MSIDITLPQLGVEMKSALLAEWVRKDGDEVDGGEVIAIIETDKVSYEIEAPTAGVLHTAADVDQEYKVGARLGAVSASRKEYLAVARGTDTHPDPPTSGTETTVQPERRVEQPPASTAAAERSTNGIVLATPLARRVAADAGMDISTIEGSGRRGQIRRRDVEAAQAQDPAAQDEPHPVSEPVDSPQPSDSPNHEQGKPLSAMRRTIADRMQQSLQTTAQLTDVREVEVSALVELRNRLAAKAERIGFKVSFTDLFLKATALALREVPELNVTVQADRIIEHDHVHLGMAVSVPDGLIVPVVRDADQLSLRAIHQRSEEAALAARERKVTAADLTGGTFTVTNIGSYGSHFGTPVLNLPQVAILATGAILDRPVVRDGEVRAGKVVHLSLTVDHRIIDGELAGRFHNTMAALLAEPDRLLVG

SEQ ID NO: 55420 - protein, 553 aa, Chlamydomonas reinhardtii
MLRGQRSSPVLRAGHRFFASAAAPSPVAAAAAPPKVKLLIDGQFVDSTTENWLDVVNPANQDVLGKLPLTTKSEFNAAVKAASDAFPKWRATPVPTRVRVMFKFQELIRANMEELARSVTMEQGKTLADARGDVFRGLEVVETACGIAPYMTGEMVENVAGGIDCYSIRQPLGVVAGICPFNFPAMVPLWMFPLAITAGNTFVLKPSERDPGAAVMLADLAQQAGLPKGVLNIVQGSRDVVNWICDDPAIRAISFVGSDSAGKYIYARGCAAGKRVQANLGAKNHAVVMPDADVDSTVKALAGAAFGAAGQRCMAISAAVFVGGFTDKWREPLLEAARGLKLNAGWEKDADVGPMISPEAKARAERLIASGAAAGAQVLLDGRGVSVPGYERGNFLGPTLLAGVTPDMEAYREEIFGPVLSCMDAATLDDALAIVNGNEHGNGTAIFTRSGAAARRFQNEVDVGMVGINVPIPVPLPFFSFTGWRGSFAGDLHMYGRAGVQFYTQTKTVTAKWPAEDIRGISAPAATTSSSSGSKSSCGPKERLPGLDRVGAS

SEQ ID NO: 55421 - protein, 195 aa, Synechococcus sp. WH 7805
MANLDQAPSRSMPNLLHVLPAFADESELRLNTIVELNSNTINKYELITETGHLKLDRVGYSSLAYPFAYGCIPRTWDEDGDPLDIEIVNVTEPLIPGSIVEARIIGIMTFDDGGEVDDKVIAVLADDKRMDHIKSFEDLGDHWKKETTYYWEHYKDLKKPGTCTVNGFFGTEKAVEIIKTCEARYMTEIDPKLVD

SEQ ID NO: 55422 - protein, 178 aa, Triticum aestivum
  misc_feature (148)..(148): Xaa can be any naturally occurring amino acid
MSSDYSSSWARALVHISPYTFSAIGIAVSIGVSVLGAAWGIFITGSSLIGAAIKAPRITSKNLISVIFCEAVAIYGVIVAIILQTKLESVPTSRMHDPESMRAGYAIFASGLIVGFANLVCGVCVGIIGSSCALSDAQNSTLFVKILXVIEIFGSALGLFGVIVGIIMSAQATWPTKV

SEQ ID NO: 55423 - protein, 256 aa, Thermotoga maritima
MDRLDFSIKLLRKVGHLLMIHWGRVDNVEKKTGFKDIVTEIDREAQRMIVDEIRKFFPDENIMAEEGIFEKGDRLWIIDPIDGTINFVHGLPNFSISLAYVENGEVKLGVVHAPALNETLYAEEGSGAFFNGERIRVSENASLEECVGSTGSYVDFTGKFIERMEKRTRRIRILGSAALNAAYVGAGRVDFFVTWRINPWDIAAGLIIVKEAGGMVTDFSGKEANAFSKNFIFSNGLIHDEVVKVVNEVVEEIGGK

SEQ ID NO: 55424 - protein, 295 aa, Hyphomonas neptunium ATCC 15444
MTNFEQRLTEVADKVTVALDQLIPPASGPEANLMRAMRHAALANGKRMRPFFVLETGAMFGASEKSLLRTAAALECIHCYSLVHDDLPCMDDDDFRRGQPTVHKAFDEATAVLAGDALLTLAFKILASSETHDDPAVRVLLIERLADAAGARGMVGGQMIDMLEEESPRDLNTITRMQRLKTGALISYALEAGGIIGHAREAERNALAGFANDLGLAYQIADDILDAEGDESIVGKAVSKDKDAGKANFVTLLGVDGARQRVRLLAAQAKEHLAIFRDKAHILLHSVDYVLNRPR

SEQ ID NO: 55425 - protein, 443 aa, Silicibacter pomeroyi DSS-3
MSHLFYQGRGRKPVLDQARGVYMWDKDGKRYLDGSSGAMVCNIGHSNPNVLAAMQRQMEKSTFGYRLHFETEASEKLASKLAALAPGGLDKVFFVSGGSEAVESALKLARQYMNATGQGSRWKVISRQPSYHGSTLGALAVTGYTPLSAPFEPMLRQMPKIPAPRAYLDGRDPRDPASGHHYANMLASAIEAEGPETVAAFIVEPVGGASTGALVPPAGYMERIREICDRYGILMIADEVMTGAGRTGRFLGSDHWNARPDIIVMSKGLGAGYVPLGAMIADARLVEPVLDAGGFAHGYTYAGNPLACAAGLAVVEEIEGQALCANADRMGERLLARLRGLMQKHEVIGDVRGMGLLTAFELMSDRDSKAPLPKGLNAYQRLVDIAYDKGLIVYSRRTRDGIEGDHILVCPPLIVTDDHLDEIIEGLDAALSQFADEIAGTAG

SEQ ID NO: 55426 - protein, 546 aa, Cryptococcus neoformans var. neoformans JEC21
MPVFSTLINSTESYQRRFDQMARAVLVYWVLKYVLLDGFRHIKARGLCGTANEIRNKIKSLVVRIMLAFPSNRAKLNSELAKTRAELKEKLAPSQYPDGVRLTTVRTLPETGRGREWLESEWENLKKLEKADVDNGRVSGAVYHGGDELNAVINEAMAKFVVTNPLHPDVFPGVRKMESEIVSMCLNLFNGPNGAGTTTSGGTESILMSVKTHRDWARVTKGITRPEMVIPSSAHAAFWKASEYFNIKLHVIPVNQKTRKAEVAAMKRAINPNTIMIVGSAPNFPDGAIDPIPELGALAKRRNVGLHVDCCLGSFIMPFLEKAGFSEGIDPFDFRVPGVTSISCDTHKYAFCPKGTSVIMYRSSELRRFQYYVITDWAGGVYASPSMAGSRPGSVLAGAWAVLNHIGADGYTSSCRQIISAARYLTSSLRTLFPDDLYVLGDPKGPVVAFNSKTINIYAVGDVMSKKGWHLSALGGDGGLHMAFTRLSAKSVDKLIEDLGDALKEVKASPQGAGGDMVALYGLGQTSAGPHVVGKLAETFLDTLYE

SEQ ID NO: 55427 - protein, 446 aa, Bordetella petrii
MSTTHVFHRSLRATPPVAVRGQGAWLYDSAGRAYLDGSGGAAVSCLGHNHPDVQAAMHAQIDQLAYAHTSFFTTEVAERLADRLVTDAPAGTSHAYFVSGGSEAVEAALKMARQYFVEIGQPQRRHIIARRQSYHGNTLGALAVGGNEWRRTQFKPLLIDVAHVSPCYEYRDRGANESPEDYGARLARELEDTIMKLGSDSVMAFVAEPVVGATAGALTAVPGYFRRIREVCDRHGVLLIADEVMCGMGRTGTLYAVEQEQVVPDLITIAKGLGGGYQPIGAVMAQEKIVSAMSAGTGFFQHGHTYLGHATACAAALAVQEVIRRDGLLQRVRDQGAGLRERLQAALGEHPHVGDIRGRGLFMGVELVADRATKETFDPKLTLHARIKREAMARGLMVYPMGGTIDGQRGDHVLLAPPFIISDDELDQLTERLTGAIDAAIAQTRS

SEQ ID NO: 55428 - protein, 220 aa, Ostreococcus tauri
  misc_feature (117)..(123): Xaa can be any naturally occurring amino acid
MSFAARAVHTGDAATDAGTDASKVAPVRAVELDGGAALKIIKHCADASPGSATGQLLGLDIGAALDVTAAFPFPKIGNDGSYDPDGAFASEEGAEYQLDMLRCLREINVDSNIVGWXXXXXXXDFANEQQKVAYYQRNMQRYQSQHAHWLQKRRQENARRRAAGEDVLPEEDPNYKAPQPPSRLENFLITNQVAEHVSQLENFTRKTEAKLELVGALAGK

SEQ ID NO: 55429 - protein, 231 aa, Raoultella terrigena
IFTKKDEDGKYLVDVILDEAANKGTGKWTSQSSLDLGEPLSLITESVFARYISSLKDQRVAASKVLTGPQAQPASDKAEFIEKVRRALYLGKIVSYAQGFSQLRAASNEYSWDLNYGEIAKIFRAGCIIRAQFLQKITDAYEENAGIANLLLAPYFKQIADEYQQALRDVVAYAVQNGIPVPTFSAAIAYYDSYRSAVLPANLIQAQRDYFGAHTYKRTDKEGVFHTEWME

SEQ ID NO: 55430 - protein, 336 aa, Raoultella terrigena
MNMKFLVTGAAGFIGFHTCKRLLEAGHQVVGIDNMNDYYDVNLKQARLDLLQSSLFSFHKVDLADRQGIAELFAEEKFNRVIHLAAQAGVRYSLENPHAYADSNLIGYLNILEGCRHNKVEHLLYASSSSVYGLNRKMPFSTDDSVDHPVSLYAATKKANELMAHTYSHLYGIPTTGLRFFTVYGPWGRPDMALFKFTKAMLEGKSIDVYNYGKMKRDFTYVDDIVEAIVRVQDVIPQSNAEWTVENGSPADSSAPYRVYNIGNSSPVELMDYITALEEALGMVAEKNMMPIQPGDVLETSADTKPLYDLVGFKPQTTVKEGVQNFVDWYKAYYKA

SEQ ID NO: 55431 - protein, 388 aa, Raoultella terrigena
MKITISGTGYVGLSNGILIAQNHEVVALDIVQSKVDMLNQKISPIVDKEIQEYLAEKPLNFRATTDKQDAYRNADYVIIATPTDYDPKTNYFNTSTVEAVIRDVAEINPAAVMIVKSTVPVGFIRDIKERLGIDNVIFSPEFLREGRALYDNLHPSRIVIGERSERAERFANLLKEGAIKQDIPTLFTDSTEAEAIKLFANTYLALRVAYFNELDSYAESQGLNSKQIIEGVCLDPRIGNHYNNPSFGYGGYCLPKDTKQLLANYESVPNNIIGAIVDANRTRKDFIADSILARKPKVVGVYRLIMKSGSDNFRASSIQGIMKRIKAKGIPVIIYEPVMQEEEFFNSRVVRDLEALKQEADVIVSNRMAEELADVADKVYTRDLFGND

SEQ ID NO: 55432 - protein, 348 aa, Staphylococcus aureus subsp. aureus COL
MTYNIVALPGDGIGPEILNGSLSLLEIISNKYNFNYQIEHHEFGGASIDTFGEPLTEKTLNACKRADAILLGAIGGPKWTDPNNRPEQGLLKLRKSLNLFVNIRPTTVVKGASSLSPLKEERVEGTDLVIVRELTSGIYFGEPRHFNNHEALDSLTYTREEIERIVHVAFKLAASRRGKLTSVDKENVLASSKLWRKVVNEVSQLYPEVTVNHLLVDACSMHLITNPKQFDVIVCENLFGDILSDEASVIPGSLGLSPSASFSNDGPRLYEPIHGSAPDIAGKNVANPFGMILSLAMCLRESLNQPDAADELEQHIYSMIEHGQTTADLGGKLNTTDIFEILSQKLNH

SEQ ID NO: 55433 - protein, 112 aa, Triticum aestivum
AWSRPRYINFSGIRMVFVSCHLAAHEHKVEKRNSECRHISHSLFSKNDIHYAKSADITVWLGGLNYRLEGISSMPARKMIEENRQSKLRDRDQLLQEAEKGQVFNGYLPGRP

SEQ ID NO: 55434 - protein, 456 aa, Synechococcus sp. WH 5701
MLNNSLMVLAEVATPNAQTNVLDLPLQAHLLFIGILFLGTLAISRFSPKIGIPAILGVLLLGLSINVNILEITHEQASNFQLLGLALLLFYAGLKTDLAAIRGFLEYGVVLAVGGVVVSSLILGGLIWFLGSPSAQVLSVGIETIPLGAAMLIAACLGSTDAGATLSVLRSVRDKVPLRLQHLLEFESSVNDPSALLFYGLVVGIFVVSSTAGVGPSLESTVVTQVKIFFQQIGAGLVVGFVFGYLARFVINDLVEERSQLLVVAMSVAFVVYGSATLLGGSGFIAVYVTGLFLTNTRYRSPEINHVTIQEVLLPFNTMTEITIFLIFGLLVYPPDLVDALPIGLLSALGLMFVARPISVLILQPLSPFSFKESLLVSWCGLRGAVPLALSHDLSLAIPRIRGIDPAIIGEISKNAESIIFIVVVVNLFVQGVSLPYLARTLGLKPDIHLDSGLAT

SEQ ID NO: 55435 - protein, 673 aa, Gibberella zeae PH-1
MAGYQRSMSFSERRGSALSDDLSLSTTTSPMINHRLEKLPEQQRHLRGPPTPSMSTPAADFDQQLTGSPPPPPTPAASPGPSHFQPDWSDAADDEDFFLAKVRQHFKNCSGPQRTRVLADLLNLCTSQQLSFVHQFVSPLLKKDPFTSLPDELCLRILSFIDDPKVLARASQVSKRWRDLLSDDMTWKNLCVKHDYGRRLSEVYTHAPNFSPRPSAQPLHGLDADLANMNVSSTRPYSYASGTRSFDGQSASGRPRLRTYKSHFKQRYLVEAAWRSGGTSTTRNITQEGGVVTSLHLTPKYIIVALDNAKIHVFDTEGDSQRTLQGHVMGVWAMVPWDDTLVSGGCDRDVRVWNLKTGACLHTLRGHTSTVRCLKMADANTAISGSRDTTLRIWDIRTGLCKNVLVGHQSSVRCLEIKGDIVVSGSYDTFARVWSISEGRCLQTLQGHFSQIYAIAFDGKRVVTGSLDTNVRIWDPTSGECLAILQGHTSLVGQLQMRGDTLVTGGSDGSVRVWSLEKMCPIHRLAAHDNSVTSLQFDDTRVVSGGSDGRVKIWDLKTGHLVRELIAQGEAVWRVAFEDEKCVALALRQGRTVMEVWSFSPPEEVLYDRPLTLQQRVLEDDPSRPLSAMAIDYRSSQQTLAGPSRDASAQDVDTHDAGPSTAPLQGVTFFHDD

SEQ ID NO: 55436 - protein, 422 aa, Staphylococcus aureus subsp. aureus COL
MTVKTTVSTKDIDEAFLRLKDIVKETPLQLDHYLSQKYDCKVYLKREDLQWVRSFKLRGAYNAISVLSDEAKSKGITCASAGNHAQGVAYTAKKLNLNAVIFMPVTTPLQKVNQVKFFGNSNVEVVLTGDTFDHCLAEALTYTSEHQMNFIDPFNNVHTISGQGTLAKEMLEQAKSDNVNFDYLFAAIGGGGLISGISTYFKTYSPTTKIIGVEPSGASSMYESVVVNNQVVTLPNIDKFVDGASVARVGDITFEIAKENVDDYVQVDEGAVCSTILDMYSKQAIVAEPAGALSVSALENYKDHIKGKTVVCVISGGNNDINRMKEIEERSLLYEEMKHYFILNFPQRPGALREFVNDVLGPQDDITKFEYLKKSSQNTGTVIIGIQLKDHDDLIQLKQRVNHFDPSNIYINENKMLYSLLI

SEQ ID NO: 55437 - protein, 491 aa, Sinorhizobium meliloti 1021
MALTPALTRHIRRPKIFASLDEVTRSSGQPAGPVFDVSNPSTGELLATLPDMGIDDARTAIDAAALAQPLWAGKPAKDRSIILRRWHDLIVEHADDLAAILTAEMGKPVGEAKGEVLHAASYVEWYAEEAKRVYGETFPAPANDRRMLVIKQPVGVVGTITPWNFPASMVARKISPALAAGCTIVLKPAEQTPLVAGAMFVLAEKAGFPEGVLNLLYASEGAPIGRELCGNPKVRKISFTGSTEVGRLLMRQCSDQIKKVSLELGGNAPFIVFDDADIDEAVDGAVQAKFRNAGQTCVSANRIYVQSAVHDAFAEKFVTRVRELTVGDGFAPDVAIGPMIDAHAIDKIEAHVADAVAKGAQVRSGGSRIGTTGTFFEPTVLTGISHDMRIAQEETFGPIAPIIRFETAEQVVAEANDTIYGLAAYFYAENLKRVWHVAEALEYGMVGINTGRMSSEAAPFGGIKQSGIGREGSRHGLEDYLEMKYLCMGNI

SEQ ID NO: 55438 - protein, 220 aa, Capsicum chinense
MANDEVILLDFWPSMFGMRLRIALAEKEVKYESKEEDLRNKSPLLLQMNPVHKKIPVLIHNGKPICESIIAVEYIDEVWKDKAPLLPTDPYERAQARFWADYIDKKFFDSSRKIWTTKGEEQEAAKKDFIECLKVLEGALGEKPFFGGDNFGFVDVALIGFYSWFFAYETCGNFSTEAECPKFVTWAKRCMQRDSVAKSLPDQHKVLEFVQTLRKKYGIE

SEQ ID NO: 55439 - protein, 252 aa, Prunus emarginata
AHYKSEADVGNALAEAFETGLVKREELFITSKASNHGHVVEACKNSLKKLRLDYLDLYLVHYPLATKHSGVGTTASLLDENKVLDIDVTVSLETTWHTMEKTVYLGLVRSIGLSNYEFFLTRDCLSYAKIKPQVSQFETHPYFQRESLVRFCKKHGVTPMAHTPLGGATANVKAFGSISPLEDPVLLGLAKKYKKSVAQIALRWNIERDTAVIPKSSKVERLKENLEVLNFKLEKEDIELINTIDKKSRTTL

SEQ ID NO: 55440 - protein, 575 aa, Magnetospirillum magnetotacticum MS-1
MRDGLGVSRGIAIGTVYLHDAGTITVPELRIPAARLDAECARFNEAAANAGHQVEQLQDKAGRLGGSAGEELGYLLDAYRQMLHGSRLVRGVEARIRNDRINAEAAVQQEINEIVRGFEAMDDSYLAARVADIKDIGRRLLRALTNTAYRPFTALPKNAVIVAEEMTPADTALLDPALVAGLATVVGGSEGHTAIMARSLGLPSVLGMAELLVGVKGGEQIIVDGTSGLVVINPRPETLAFYRKERAAFLKARRILGRLKDVPAVTRDAARITLQANMELPGEVGAVLESGAEGIGLLRSEFLYMNRDDVPSEDEQYLILKDVVERMGGRPVTVRTFDAGGDKLAPALGCTIGPNPSLGLRAIRLGLARQDLLEAQLAAILRASAHGPVRILIPMIATVGELRATREVMNRVIRRLRKSGVALPDPLPKLGAMIEIPGAALSADSIAWHADFFAIGTNDLVQYTLAIDRSDEAVAHLYNPLHPAVLRLIQFTAQAAHRANIPVSVCGEMAGDPRYAPLLLGLGLRDLSMTTSNLPVVKSRIRALELAAAEGLARTIMEQTDSGRIGQLLDAFLAR

SEQ ID NO: 55441 - protein, 252 aa, Prunus emarginata
AHYKSEADVGNAIAEAIQRGLVKREELFITSNASNHGHVVEACKNSLKKLRLDYLDLYLVHYPFATKHSGVGTTASLLDENKVLDIDVTVSLETTWHTMETTVYLGLVRSIGLSNYEFFLTRDCLSYAKIKPQVSQFETHPYFQRESLVRFCKKHGVTPMARTPLGGATANVKAFGSISPLEDPVLLGLAKKYKKSVAQIALRWNIERDTAVIPKSSKVERLKENLEVLNFKLEKEDIELINTIDKKSRTTL

SEQ ID NO: 55442 - protein, 252 aa, Prunus emarginata
  misc_feature (193)..(193): Xaa can be any naturally occurring amino acid
AHYKSEADVGNALAEAFETGLVKREELFITSKARHHGHVVEACKNSLKKLQLDYLDLYLVHYPLATKHSGVGTTASLLDENKVLDIDVTVSLESTWHDMEKTVSLGLVRSIGLSNYELFLTRDCLSYAKIKPQVSQFETHPYFQRETLVRFCRKHGVCPMAHTPLGGATANVKAFGSISPLEDPVLRALAKKXKKSVAQIALRWNLDRNTPVIPKSSKIERLKENLEVLNFKLEKEDIELINTIDKKSRTTL

SEQ ID NO: 55443 - protein, 280 aa, Physcomitrella patens
MSKVPVGVEPGFPGKDYADPPAAPLIDASEFGQWSFYRAIIAEFVATLLFLYITIATVIGASRNAGCAGVGTLGIAWAFGGMIFVLVYCTAGISGGHINPAVTFGLLLARKISLPRALAYMIAQCLGAICGAGLVKGFQQSFYMTYGGGANAVNAGYGIGTGLAAEIIGTFVLVYTVFSATDPKRNARDSHVPVLAPLPIGFAVFMVHLATIPITGTGINPARSFGAAVIYNRSKPWDDHWIFWVGPFVGAALAAAYHQYVLRAGPFKQLGSFRSAPSRV

SEQ ID NO: 55444 - protein, 251 aa, Prunus emarginata
AHYKSEADVGNAIAEAIQRGLVKREELFITSKANHGHVVEACKNSLKKLRLDYLDLYLVHYPLATKHSRVSTTASLLDENKVLDIDVTVSLETTWHTMEKTVYLGLVRSIGLSNYEFFLTRDCLSYAKIKPQVSQFETHPYFQRESLVRFCKKHGVTPMAHTPSGGATANVKAFGSNSPLEDPVLLGLAKKYKKSVAQIALRWNIERDTAVIPKSSKVERLKENLEVLNFKLEKEDIELINTIDKKSRTTL

SEQ ID NO: 55445 - protein, 141 aa, Methanococcoides burtonii DSM 6242
MKKAIIETNKGTIVLELFEKDAPKTVANFEKLIKQGFYNGLTFHRVISNFMIQAGCPKGNGTGGPGYSIKCEINPKKHTKGALSMAHAGKNTGGSQFFITHSPQPHLDGVHTVFGKVIEGMDVVNAIKQSDVMTKLTVEEE

SEQ ID NO: 55446 - protein, 289 aa, Physcomitrella patens
MNQDKDDDIALGTNKYGDRSALGTHAPVPEKDYTEPSVTPFFDGSEFRRWSFWRAGIAEFIATLLFLYITIQTVMGHKRSADPCLGVGIQGIAWAFGGMIFALVYCTAGISGGHINPAVTFGLFLARKVSLNRALFYMIMQCLGAMCGAEIVKGFQPNFYQEQGGGSNSVAHGYTKGDGLGAEIVGTFVLVYTVFSATDAKRNARDSHVQVLAPLPIGFAVFLVHLATIPITGTGINPARSLGAAVVFNKQNNAWADHWIFWIGPMLGAALAAAYHTLVIRALPFRKRV

SEQ ID NO: 55447 - protein, 252 aa, Prunus emarginata
SSLQSEADVGNAIAEAIQSGLVKREELFITSKASNHGHVVEACKNSLKKLRLDYLDLYLVHYPLATKHSGVGTTASLLDENKVLDIDVTVSLETTWHDMEKTVSLGLVRSIGLSNYELFLTRDCLSYAKIKPQVSQFETHPYFQRESLVRFCKKHGVTPMAHTPLGGATANVKAFGSISPLEDPVLLGLAKKYKKGVAQIALRWNIERDTAVIPKSSKVERLKENLEVLNFKLEKEDIELINTIDKKSRTTL

SEQ ID NO: 55448 - protein, 175 aa, Oryza sativa
MASSSSAQETGRWSLAGATALVTGGSKGIGRAIVEELASFGATVHTCARNEATLNSCLEEWSAKKLSITSSVCDVSARADREALAGRVAAIFDGKLDILVNNVGFLFLKPAVNVTPEELSRVMAGNLESCFHQSQLMHPLLKTSGKGNVVNISGISTVTGFPSLPICAFCAAKGS

SEQ ID NO: 55449 - protein, 293 aa, Synechococcus sp. WH 7805
MVSPDHEPMDDALRVSVLSEALPYIQRFAGRRIVVKYGGAAMAHAALQTAVFRDLALLRSVGVQPVVVHGGGPEINHWLKRLDIAPEFREGLRVTDPATMDVVEMVLVGRVNKQIVNGLNRLGARAVGLSGSDGSLVEARSWGDGSHGLVGDVARVNPDVLEPLLDRGYVPVISSVAANVEGVAHNINADTVAGELAAALEAEKLILLTDTPGILRDRESPESLIRQLKLSEARQLIDDGVVAGGMTPKTECCIRALAQGVSAAHIVDGRVPHALLLEVFTDAGIGTMVLGRG

SEQ ID NO: 55450 - protein, 170 aa, Glycine max
MESHDETGCQAPERPIPCINNCGFFGRAATMNMCSKCYKDMLLKQEQDNFAASSVENIVNGSSNGNGAVTTGAVDVQVEAVEVKTVSAQSSVDSSSGESLEMKAKNSPSRCATCRKRVGLTGFSCKCGNLFCAMHRYSDKHECPFDYRTVGQDAIAKANPIVKADKLDKI

SEQ ID NO: 55451 - protein, 500 aa, Oryza sativa Indica Group
MQPHILLPLLLLLAAVSPRPVLSRRHASPPLATETLDVAASLSRARAAVSAEAAPLHQSAAAVSTEVIGEEHEEGRLALRLHSRDFLPEEQGRQRHASYRSLVLARLRRDSARAAAVSARAAMAADGVSRFDLVPANVTAFEASAAEIQGPVVSGVGLGSGEYFSRVGVGSPARQLYMVLDTGSDVTWVQCQPCADCYQQSDPVFDPSLSTSYASVACDNPRCHDLDAAACRNSTGACLYEVAYGDGSYTVGDFATETLTLGDSAPVSSVAIGCGHDNEGLFVGAAGLLALGGGPLSFPSQISATTFSYCLVDRDSPSSSTLQFGDAADAEVTAPLIRSPRTSTFYYVGLSGISVGGQILSIPPSAFAMDGTGAGGVIVDSGTAVTRLQSSAYAALRDAFVRGTQSLPRTSGVSLFDTCYDLSDRTSVEVPAVSLRFAGGGELRLPAKNYLIPVDGAGTYCLAFAPTNAAVSIIGNVQQQGTRVSFDTAKSTVGFTSNKC

SEQ ID NO: 55452 - protein, 406 aa, Silicibacter pomeroyi DSS-3
MYDVDRIRAEFPILSRQVNGKPLTYLDNGASAQKPQAVIDAVTRGYAEEYANVHRGLHFLSNLATEKYEAVRGIVARFLNAGSEDEIVLNSGTTEGINMVAYGWAMPQMQAGDEIVLSTMEHHANIVPWHFLRERQGVVLKWVDPEPDGSLDPQAVLDAIGPRTKLVAITHCSNVLGTVVDVKSICAGARAKGVPVLVDGSQGAVHMPVDVQDLGCDFYAITGHKLYGPSGSGAIYARAERLAEMRPFMGGGDMIKEVTKDTVIYNDPPMKFEAGTPGIVQTIGMGVALDYMMALGMENIAAHEAGLRDYAASRFAGLNWLNVQGHAPGKAAIFSFTLQGAAHAHDISTILDKKGVAVRAGHHCAGPLMDHLGVTATCRASFGLYNTRAEVDTLIEALELAHELFA

SEQ ID NO: 55453 - protein, 141 aa, Synechococcus sp. WH 7805
MHAALTRLGRQLTSLTLSLCLGLTLLLTACGDSTTSLLSGDYVEDTVAVVHMLQNTLALPSDSEGLQDSEHEAHDLINDYMSRYRPRPQVNGLSSFTTMQTALNSLQGHYNTYTNRPVPDALKTRVEKELSKAEKAALRGT

SEQ ID NO: 55454 - protein, 255 aa, Bacillus cereus ATCC 14579
MLHQFSRNELAFGKEGLEILKNSTVGILGIGGVGSFAAEALARSGVGRLVLVDKDVVDITNVNRQIHALVSTVGRSKVELMKERIADINPECEVIGLEMFYTDETYEEFFKHGLDFVVDASDTITFKIHLIKQCLRRKIKIISSMGAANKMDPTRFRIADISKTHTDPIAKVIRTKLRKEGIKKGVKVVFSDENPIVIREEVRKEIVPDENAKIRKAKLPPSSNAFVPSVAGLIMASHVVRERIKNVEVKRVGQE

SEQ ID NO: 55455 - protein, 412 aa, Solanum lycopersicum
MNALAATNRNFKLAARLLGLDSKLELSLLIPFREIKVECTIPKDDGTLASFVGFRVQHDNARGPMKGGIRYHPEVDPDEVNALAQLMTWKTAVANIPYGGAKGGIGCSPSDLSISELERLTRVFTQKIHDLIGIHTDVPAPDMGTNPQTMAWILDEYSKFHGYSPAVVTGKPVDLGGSLGRDAATGRGALFATEALLNEHGKSVAGQRFVIQGFGNVGSWAAKLIHEQGGKVVAVSDITGAIKNEKGIDIESLFKHVKETRGVKGFHDAHPIDANSILVEDCDVLIPAALGGVINKDNHKLKIKAKYIIEAANHPTDPEADEILSKKGVTILPDIYANSGGVTVSYFEWVQNIQGFMWDEKKVNDELKTYMTRGFKDVKDMCKTHNCDLRMGAFTLGVNRVARATVLRGWEA

SEQ ID NO: 55456 - protein, 487 aa, Triticum aestivum
MDALAGLSALAAVALLLLLLYSVHRWRNPRCNGRLPPGSMGLPLVGETFQFFSPDASLDIPRFIRDRLTRYGPIFKTSVVGHPVVVSADEELNHMVFQQEGELFQSWYPDSFVEILGRDNVGEQKGTMFKYLKNMVLRYFGPESLKESILRDVQRAVCSSLCTWSTLPAVELKEAVSTMVFELSASKLLGLEPSRSKVLRKSFFDFVRGLISFPLYLPGTAYYACMQGRMSVMEVLQQVLEERTRSAEAAGGREARCHGDFLDYVVQEITKEKPVLTEGMALDLLFVLLFASFHTTSLAITLAVKLLTEHPRVLEELTVEHETILNEREAGGESDGDRVTWKEYKSMTFTSQVINETVRLANIAPGIFRKTLKDVQFRGYTIPAGWGVMVCPLAVHLNPDIYPDPLTFNPSRFKDKLEANRGLRHFMAFGGGLRSCVGADFSKLQMAIFLHFLVTKYRWIQLGGGKIVRCPGLEFPDGYLIQIRQRD

SEQ ID NO: 55457 - protein, 413 aa, Artemisia annua
SSLKAVLKHPDDFYPLLKLKMAAKKAEKQIPSQPHWAFSYSMLHKVSRSFALVIQQLNPQLRDAVCIFYLVLRALDTVEDDTSIAADIKVPILIAFHKHIYNRDWHFACGTKEYKVLMDQFHHVSTAFLELKRGYQEAIEDITMRMGAGMAKFICKEVETVDDYDEYCHYVAGLVGIGLSKLFHSSGTEILFSDSISNSMGLFLQKTNIIRDYLEDINEIPKSRMFWPREIWSKYVNKLEDLKYEENSEKAVQCLNDMVTNALIHIEDCLKYMSQLKDPAIFRFCAIPQIMAIGTLALCYNNIEVFRGVVKLRRGLTAKVIDRTKTMADVYQAFSDFSDMLKSKVDMHDPNAQTTITRLEAAQKICKDSGTLSNRKSYIVKRESSYSAALLALLFTILAILYAYLSANRPIKI

SEQ ID NO: 55458 - protein, 418 aa, Artemisia annua
MSSLKAVLKHPDDFYPLLKLKMAAKKAEKQIPSQPHWAFSYSMLHKVSRSFALVIQQLNPQLRDAVCIFYLVLRALDTVEDDTSIAADIKVPILIAFHKHIYNRDWHFACGTKEYKVLMDQFHHVSTAFLELKRGYQEAIEDITMRMGAGMAKFICKEVETVDDYDEYCHYVAGLVGIGLSKLFHSSGTEILFSDSISNSMGLFLQKTNIIRDYLEDINEIPKSRMFWPREIWSKYVNKLEDLKYEENSEKAVQCLNDMVTNALIHIEDCLKYMSQLKDPAIFRFCAIPQIMAIGTLALCYNNIEVFRGVVKLRRGLTAKVIDRTKTMADVYQAFSDFSDMLKSKVDMHDPNAQTTITRLEAAQKICKDSGTLSNRKSYIVKRESSYSAALLALLFTILAILYAYLSANRPNKIKFTL

SEQ ID NO: 55459 - protein, 501 aa, Ostreococcus tauri
MKTSSHGVVWVKAKSDRGSWWPASEVSDRNAAIERLGELALRHFEKRNDARVFQYFGSGGSYELEKTSTACVAWEEGLEHKYHQMKPLSAKRAKAIENAFAFAERGDLSAEIEANVVWWSEPLPPPIECVEEVAVVSRRKRSREAEVNVEADDVETPVNDGDEFKFPIAASEFRAGVKRTEYTPPLSVLSMGKPAAYERINRSTFVSVPPPVKMHISESATCECKQPLRDGGGTPTLRNGCGPECINRKLRFSCDSRTCPCGDACSNRPLSQLPTPKTKIIRTENRGWGLMLQEPVTAGTFIVEYTGEILNEADVANRLWLDKQEGEENFYLMEISTNYVIDAKFKGSLARFINSGCHPNCETQRWVDASTNETRVGIFAIEDIPAGTELTYDYHFAHFGDASATSFVCMCGHPKCRGTLDAAKREAHFHRRIRVEAMLAPKSAGPKARKKKQYVKGTIVDHDRAKNRYKVEVDASADEAERVCIWVRLEGEGAAKHAWLK

SEQ ID NO: 55460 - protein, 201 aa, Pseudomonas aeruginosa PAO1
MLLMIDNYDSFTYNLVQYFGELKAEVKVVRNDELSVEQIEALAPERIVLSPGPCTPNEAGVSLAVIERFAGKLPLLGVCLGHQSIGQAFGGEVVRARQVMHGKTSPIHHKDLGVFAGLANPLTVTRYHSLVVKRESLPECLEVTAWTQHADGSLDEIMGVRHKTLNVEGVQFHPESILTEQGHELLANFLRQQGGVRGEGN

SEQ ID NO: 55461 - protein, 513 aa, Physcomitrella patens subsp. patens
MRGAAVRKARLVKLLAQQQTQRLLRTNAANQAVPRTESTQASSSGGVLSWLLGERATAPVPALFEPLQGVHMPPALPDDVKPNETKVTTLANGVKIASEMIAGPTSTIGIFIDSGSKNETPYCTGASHLLERMAFKSTANRSHFRLVREVEAIGGNVMANASREQMCYTGDTIKTFMPEMVELLVDTVRNPLFNEWEVQEQLAKAKAEIAELANNPQVAIYEAIHSAGYVGGLGQPLMAPESSLGRLNGGVLHDFVKENYTAPRIVLAASGVDHEDLLSVAEPLLADLPSSDQSIPVETHYVGGDWRQSVDSPKTHVAIAFEVPGGWRNEKDSYAVTVLQTLLGGGGSFSAGGPGKGMYSRLYTGILNKWEQVQSFTAFNSVYNDTGLFGIHATSTGDFVPKLVDLACEQLELVATPGKVTEAELQRAKNSTISAVLMNLESRVVVTEDIGRQILTYGHRKPVAEFIQSVQALTLQDIADVSSKIISTPLTMASWGDVVRVPRFDAVASRFQE

SEQ ID NO: 55462 - protein, 482 aa, Thermoactinomyces vulgaris
MKKGALLSGLVCLLSAVLMFASTAPTAVALSPADWQEKSIYFIMTDRFDNGDPSNDNYGGFNADKSDPRKYHGGDFQGIINRLDYIKNMGFTAIWITPVTMQKSANAYHGYWTYDFYSVDGHLGSMAKLQELVRAAHAKGISVMLDVVANHTGDFQPSSFAKAPFDKADWYHHYGDTQDWNDQWWVENGDIAGLDDLNQDNPAVATELKNWIAWLVQTTGVDGLRVDTVKHVPKWFWREFDGAANTFTLGEVFHGDPAYVGDYTNYLDAVLDFPMYYTIKNVFGQDQSMRTIADRYAQDYRYKNPMTNGLFIDNHDVPRFLNEASGKPGASWDKWPQLKAALGFMFTTRGIPILYQGTEQGFSGGADPYNRDDMVFNDKHELYGYIAKLNYIRNTHVALRKGTQAEKWVDDTFYAFQRSYNGDEVVVMINNSWNSQTRTVPNIDRVANGQTLYNRMGTDKVTVNNGSITATLGPKEVKIFTK

SEQ ID NO: 55463 - protein, 524 aa, Arabidopsis thaliana
METASSNFSLSQILNIEEPYSSVMLGVAALLAVVCYFWIQGKSKSKNGPPLPPGPWPLPIVGNLPFLNSDVLHTQFQALTLKHGPLMKIHLGSKLAIVVSSPDMAREVLKTHDITFANHDLPEVGKINTYGGEDILWSPYGTHWRRLRKLCVMKMFTTPTLEASYSTRREETRQTIVHMSEMAREGSPVNLGEQIFLSIFNVVTRMMWGATVEGDERTSLGNELKTLISDISDIEGIQNYSDFFPLFSRFDFQGLVKQMKGHVKKLDLLFDRVMESHVKMVGKKSEEEEDFLQYLLRVKDDDEKAPLSMTHVKSLLMDMVLGGVDTSVNASEFAMAEIVSRPEVLNKIRLELDQVVGKDNIVEESHLPKLPYLQAVMKETLRLHPTLPLLVPHRNSETSVVAGYTVPKDSKIFINVWAIHRDPKNWDEPNEFKPERFLENSLDFNGGDFKYLPFGSGRRICAAINMAERLVLFNIASLLHSFDWKAPQGQKFEVEEKFGLVLKLKSPLVAIPVPRLSDPKLYTA

SEQ ID NO: 55464 - protein, 647 aa, Kineococcus radiotolerans SRS30216
MTLLESIRSPQDLKRLSPAQTVELAAEIRRFLVAEVAKTGGHLGPNLGVVELTLALHRVFDSPKDPIVFDTGHQSYVHKLVTGRQDFSHLRERGGLAGYPQRSESEHDIVESSHASSSLSWADGISRGFQLNGQAHRTVVAVVGDGALTGGMTWEALNNMSHDNDRRLVIVVNDNGRSYEATIGGMARFLSSVRTRREYRTLHEKSQAVADRFGAPGRAVYRGLRGGTRGFLARFTGNEALYSNLDIKYVGPVDGHDQQALEEALRQARDYGTPVIVHAITEKGHGFEPALRDQADQFHAVGRIDPTTGESLDTAAGQGWTSVFAEEIADLGDRDPKLVAITAAMLRPTGLHLFQQRHPDRVYDVGIAEQHAVTSAAGLAYAGLHPVVAVYATFVNRAFDQVLMDVALHRAGVTFVLDRAGVTGPDGPSHHGMWDLALLQVVPGIRIAAPRDAATLREELAEAVAVDDAPTVLRWPRGSVGPAIPAVERRPDGVDVLREAAGGSRDVLLVAVGAMAGTALEAAALLESQGIGTTVVDPRWVVPIAPSLVELSREHRLVVTIEDGVRVGGIGTRLRQDLRAADVDTGVTELGLPDRFLEHASRAEVLQDAGLTARAIARDVIDQVIGTKLPQARPVREHSSLWDGLDH

SEQ ID NO: 55465 - protein, 504 aa, Physcomitrella patens subsp. patens
MASDGLSRIGLAGLAVMGQNLALNIAEKGFPISVYNRSASKVDETVERAKEEGNLPVKGFKDPCEFVKSIQKPRCIIILVKAGSPVDQTIELLSKYLEKGDCIIDGGNEWYENTERRAEKVKEKGLLYLGMGVSGGEEGARHGPSLMPGGTLEAYKYIEDIVQKVAAQVDSGPCVTYVGPGGAGNFVKMVHNGIEYGDMELIAEAYDVLKSVGGLSNKELHETFYEWNKGELESFLIEITADIFSVPDDKGEGELVDKVLDKTGMKGTGKWTVQQAAELSVAAPTIATSLDLRYLSGLKEERVEAAKVFKSLGVSDLLAEVKVDKQELIDNVRKALYASKICSYAQGMNLIRAKSIEKGWNLDLGELARIWKGGCIIRAKFLDRIKQAYDRDPKLASLLIDPEFAKEMVERQGAWRKVVSLAIEVGVSTPGMSASLGYFDTYRRARLPANLVQAQRDYFGSHTYERVDMKDSFHTEWYKIAKKLLGDRAATEGDLKIGSKEQKH

SEQ ID NO: 55466 - protein, 384 aa, Zea mays
  misc_feature (150)..(150): Xaa can be any naturally occurring amino acid
  misc_feature (234)..(234): Xaa can be any naturally occurring amino acid
MAQKDKAVAGLTKGIEGLFKKNKVTYVKGFGKLSSPSEVSVDLIDGGSTIVKGKNIIIATGSDVKSLPGITIDEKKVVSSTGALCLSEIPKKLVVIGAGYIGLEMGSVWNRLGSEVTVVEFAPDIVPSMDGEVRKQFQRMLEKQKFKFMXLKTKVVGCDTSGDGVKLTLEPAAGGEQTILEADVVLVSAGRSPFTSGIGLETLGVETDKAGRILVDKRFMTNVKGVSPLGPPVXGPLLAHKAEEDGVACVEFIAGKEGHVDYGTVPGVVYTHPEVASVGKTEEQVKALGIAYNVGKFPLLANSRAKAIDDAEGVVKVIAEKETDKILGVHIMAPNAGEIIHEAVVALQYGASSEDVARTCHAHPTVSEALKEACLQTFDKAIHI

SEQ ID NO: 55467 - protein, 256 aa, Kineococcus radiotolerans SRS30216
MSVLDKFSLQGKVALVTGGYKGLGRGFAQALAEAGADVVVAARDEAASVAAAAEIAASTGRRTLGLRLDVTSRPEVEAAVARVTAELGRFDVLVNNAGTCVHRPALEVTDEEYDDVITTNLKGVWLPSVVTAAWMAEHGGGSIVNVGSISAQIVNRPQMQPVYNASKAAVHQLTKSLAAEWAPLGIRVNAIAPGYVKTEMAPVDRPEFRRMWIEDAPMQRYSSPEEIAATVVYLASDASSFSTGAVVVTDGGYTLF

SEQ ID NO: 55468 - protein, 665 aa, Ashbya gossypii ATCC 10895
MTEARGIITSAAGLRDIHSVRYLRPDYAVPSVAKAVALHKGTEPGAAEAFHRPRLVRNGDGVPHFAFVVPEERGEYRTLVQSERALKDLGLRADQELEAHCQGSRVYHDEQRGIFPYALAYAGHQFGVFAGQLGDGRVANLYDIRDSRGRYQTLQLKGSGMTPFSRFADGKAVLRSSVREFIVSEALAAIGIPSTRALQLTLLPKTRARRTMFEPCAVVARFAPSWIRLGNFDMFRWRGDDHGLLQLVDYCIQHVFAAGREFPTEISVNAFQEDFFPDPLEKIPATDELPKAVAGVTTYDLFFRHVVNLNAECVAYWQAYGFCNGVLNTDNTSLMGLSMDFGPFSFMDKYRPEYTPNHDDIEGRYSFSNQPYVIWWNLTKFAEALVLLLGSGEQHIGFVKTIPERSVIPENIADELGQRVNALVNCAANEYRFRYHVKYAEIMAKRLGIQLNIPLIQSDNLSLIAERVRGFMDSVVNPLLDILSKSMVDYNSFFVALQEYQGPFHSTAGVRGVDPAFLQIFFTEEDFQLLTKHANGVSSLDPGTATQFFDLVEKIDSWLINYLQSIPEREERYRLQKLVNPLFIPRSYVFDEVLEELEKMHRNVTDANSADIDTTILTQLYTIATNPYDRTKWYGILDDAKIKAWTEGTTNMPNDDYLKQCSCSS

SEQ ID NO: 55469 - protein, 235 aa, Kineococcus radiotolerans SRS30216
MTPPRVALVTGGAGGIGAAVVAALEAEGTRVAVLDRTETSLGELQVGADTTDPAQVRAAVDEVVARAGRLDVLVNCAGVATIAPALEIDLAGWERTVAVNLTGAFVVAQTVARHLAAHGGGRIVTIASQAATVGLAGHVAYAASKAGLLGMTRTLALEWGPLGITVNTVSPTVVLTPLARPNWENPAGEALRAQIPVGRFAEPEEVAAAVVFLTGPGAAMVNGHDLVVDGGYTVR

SEQ ID NO: 55470 - protein, 299 aa, Thermoplasma acidophilum DSM 1728
MIGSNARSQIDDLIDSMHSIGIGNTPFIEVDDGIYAKIEWMNRFGSIKDRPAFFIIYSLKESGDLDGKTLIEASSGNTGLAVSGIAKMLGVRSIIVLPENASPFTKRSIMENGSRVIETPASLGTEGSINRLKEMVSTDDFIWLNQHSNTKNSDSHYYTTAREMVDSMGVPSAIVAGIGTGGTITGIARYFKEIDPGVRVIGVQPAAGSHIHGLRNVSASKYRGIIDRYGHLIDEIVYVNEDQAISEIRRYYEKSGQLIGISAGANLYASRLFHERYRKIFTVFPDSGEKYREEIGPLI

SEQ ID NO: 55471 - protein, 409 aa, Thermoplasma acidophilum DSM 1728
MQILTLISWDFKRNNNFFNQAVLNPYEYWADILEKNGISRYVILLTCNRVEIYLRAGFPEDLEAMKPNVLHDEEAIKHLMEVSSGLDSMSLGENEILKQVKEAYELSVRNGKVDKVLSLIFQKAIFVGKKVRSETEISRGKVSVPSIVYDILSSRVVQKVLIIGNGMIAGEIAPYLSGKFEVTIAGRNIDHVKDLASKYNYSYTTINDLHELIMRNDAIISATSSKTPIIRREEMVEGKLYIDLGNPRNIEDKPGADIITIDDIYSVSNRNGSARMESVDEARRIIEIEMASLMNKIKDVMIDEIFADFYKFAVVVQKMEIEKFSRMHPEIPASDVEAFAHSMINKVMNIPVMTLKSVARSQSNQDFSRIFSKFYDNFSDLVSAALQSYEGRQDTQSLRDRTRRLLQRS

SEQ ID NO: 55472 - protein, 266 aa, Triticum aestivum
HSRTSFYKKAGWYRSGIPGISSTHASGERRDRERRERERARRERERARERDRGGERTESLILINSNNEAIILQGTFGPSDNQENSSNTSTGVSLGDYFLGPGLDMLLQRLADSDLNRSGTPPAKKESVAALPTVNIQEVLGCTVCLEEFEMGTEAKEMPCQHKFHSNCILPWLELHSSCPICRFQLPTEESKNPCESGSGGGTVSADGDHAESSNSDIEGANHDGGSLLDESSINDRDVTSALNAIFGDGSSSSSSDENGPCASES

SEQ ID NO: 55473 - protein, 206 aa, Methanococcoides burtonii DSM 6242
MSESNIKIENVVASTELAEESKNMSEYNIKIENVVASTKLAEEFDLIKIEAEFEGAEYNKQKFPGLVYRVTDPKAAFLVFTSGKVVCTGAKNVADVHIVIGNMAKKLNGIGIETIADPEITVQNIVASADLHATLNLNAIAIGLGLENIEYEPEQFPGLVYRIADPKVVVLIFSSGKLVVTGGKSPAHCDQGVEVVRQQLDNMGLL

SEQ ID NO: 55474 - protein, 355 aa, Rhodococcus sp. RHA1
MEDESPMDSCRPDTAEQRVRNALTAIAAGRPVVVIDAADREGEGDLIFAAALATTELVAFTVRHTSGFVCVALPGDECDRLGLPAMHHSNDDRFDTAYRITVDMRGTGTGISAASRAATIAALASPDSLASDFVRPGHVVPLMARPGGVLDRPGLTEAAVDLTRLAGVPAAGALCEIVSQDRPVDMARGPELERFAKEHDLVLLSIADLIHYRQRTEPQVRRGAVTSLPTDFGRFRAVGYVGAHDGAEHMALVVDPTGGRQFEEVPVHVHTECLSGDVFRSTACGCRQELEKAMFQFCAEGCGVVLYLRPPGGPRACGIFATERNEGVNSSAMQAVADWILADLASTFPAADVSA

SEQ ID NO: 55475 - protein, 580 aa, Salmonella enterica subsp. enterica serovar Typhi str. CT18
MKPTFMRWVAIAALLAGGTFSAVANPPVAPPVSYGVEEDVFHPVRATQGMVASVDAMATQVGVDILKQGGNAVDAAVAVGYALAVTHPQAGNLGGGGFMLLRTKDGATTAIDFREMAPAAATRDMFLDDQGNADAKKSLTSHLASGTPGTVAGFSLALEKYGTMPLNKVVRPAMKLAEEGFVVNDALADDLKTYGSEVIPNHENSKAIFWKDGEPLKKGDKLIQKNLAKSLEMIAENGPAAFYKGAIADQIAGEMQKNGGLMTKEDLASYKAVERTPISGDYRGYQVFSMPPPSSGGIHIVQILNILENFDMKKYGFGSADAMQIMAEAEKYAYADRSEYLGDPDFVKVPWQALTNKAYAKTLADQIDINKAKPSSQIKPGKLAPYESNQTTHFSVVDKDGNAVAVTYTLNTTFGTGIVAGNTGILLNNQMDDFSAKPGVPNVYGLVGGDANAVEPKKRPLSSMSPTIVVKDGKTWLVTGSPGGSRIITTVLQMVVNSIDFGMNVAEATNAPRFHHQWLPDELRVEKGFSPDTLKLLEQKGQKVALKEAMGSTQSIMVGPDGELYGASDPRSVDDLTAGY

SEQ ID NO: 55476 - protein, 426 aa, Hordeum vulgare subsp. vulgare
MAAADTSRVFLILIIALVMVIVVLLGICWRFLGPGIMRRLLRPRRCPSEVPEYFSGNMSGNLRTITYFDYVTLKKATKDFHQKNQLGRGGFGPVYLGKLDDGRKVAVKQLSVGKSGQGESEFFMEVNMITSIQHKNLVRLVGCCSEGTERLLVYEYMKNKSLDKILFAAADAPAPASAPPFLNWRTRHQIIIGIGRGLQYLHEESNLRIVHRDIKASNILLDDKFQPKISDFGLARFFPEDQTYLSTAFAGTLGYTAPEYAIRGELTVKADTYSFGVLVLEIISSRKNTDLNLPNEMQYLPEHAWRLYEQSKILELVDGRVQGGEGFEEKEVMLVCQIALLCVQPYPNSRPAMSEVVRMLTMKTDQSIPAPAKPAFLDRKNLNGDRDAASSDTATMEMMRSPAGYWMMTPSPMLEVDRPYDMSFGK

SEQ ID NO: 55477 - protein, 476 aa, Burkholderia pseudomallei K96243
MSKEFDVVVIGAGPGGYIAAIRAAQLGKTVACIEKWKNPAGALKLGGTCLNVGCIPSKALLASSEEFENAQHHLADHGISVDGVKMDVAKMLARKDGIVEKMTGGIEFLFKKNKITWLKGHGKFTGKSDAGVQIEVSGEGETQVVTAKNVIIATGSKARHLPNVPVDNKIVADNEGALAFDSVPKKLAVIGAGVIGLELGSVWRRLGAEVTVLEALPAFLGAADEALAKEAAKLFKKQGLDIHLGVKIDGVKTGANGVSIAYTDKDGNAKTLDADRLIVSVGRVPNTDNLGLEAIGLKANERGFIDVDDHCRTAVPNVYAIGDVVRGPMLAHKAEDEGVLVAEVIDGQKPHIDYNCIPWVIYTYPEIAWVGKTEQQLKAEGREIKSGKFPFSINGRALGMNAPDGFVKMIADAKTDELLGVHVIGANASDLIAEAVVAMEFKAASEDIARICHPHPSMSEVMREAALAVDKRSLNS

SEQ ID NO: 55478 - protein, 276 aa, Oryza sativa
  misc_feature (120)..(120): Xaa can be any naturally occurring amino acid
MHSSTRARLLLAAAVLLLSAAPAARAQETDDERKFGYVPGTENGPGNWSRLDPRWAKCNTGNMQSPIDLSHERLMRNLGYLDYSYLPAEASMVNRGHDIEVKFMGNAGRVVINGKAYKLXKQLHWHTPSEHTVNGRRYDMELHLVHHDGNSNTAVIGNLYQIGNPDPFLLMLEPFIRRIADTKDKSEPIGVVDPQLAKSPDAVYYRYMGSLTTPPCTEGVIWTVFKRVFLLAQTVAQYQLDLLREAVADGYENNARPLQKVNNRNISIFIPDPKKD

SEQ ID NO: 55479 - protein, 197 aa, Prochlorococcus marinus subsp. marinus str. CCMP1375
MTEGCLRVGQMAPNFTAEAVVDQEFKQISLTDYRGKWVVLFFYPLDFTFVCPTEITAFSDRFSDFSSKSTEILGVSVDSKHCHLAWIQTPRNRGGIGDITYPLVSDLKREIATAYNVLNDDGEADRGLFLINPEGIIMHCTINKAPVGRNVDETLRILQGYQYVASNPDKVCPANWNPGDKTMLEDPKGSKEYFASL

SEQ ID NO: 55480 - protein, 170 aa, Synechococcus sp. WH 7805
MDLRALTPSPSPGLVNLLVEIPAGSRNKYEYYEACGVMALDRVLHSSVRYPFDYGFIPNTLAADGSPLDAMVIMEEPTFAGCLIQARPIGVLDMHDMGHYDGKILCVPVADPRQRKIHSIHQIAPSQLEDVAEFFRTYKNMEGRVTEIGGWRDSEAVAPLLQACIEAAER

SEQ ID NO: 55481 - protein, 331 aa, Xanthobacter autotrophicus Py2
MAAAYRRIGVMGAGAWGTALANAAARAGRQGGREVVLWGRDAAAMAEMAQLRENRPDLPGIALDPAVTPTADLAAVAATDALLLVVPAQACRTALARLAPLARDGLPVISCAKGIERGTRAFMSEVIGEAMPGARPAVLSGPSFATDVAAGLPTAVTLAAHDEQLAMELAAALGSSTLRLYHSADVRGAEIGGATKNVLAIAAGIVSGRRLGASAAAALVARGFAELMRFGRAYGAKAETITGLSGLGDLILTTSGPQSRNFAFGQALGAGAATGDKLAEGAFTASVLVEMARAKDVDVPVSAAVDGVLQGRLSIDGAIEALMARPQRAEG

SEQ ID NO: 55482 - protein, 425 aa, Burkholderia pseudomallei K96243
MAIVEVKVPQLSESVSEATMLQWKKKPGEAVAQDEILIELETDKVVLEVPAPAAGVLAQVLQNDGDTVVADQVIATIDTEAKAGAAAAAAGAADVQPAAAPVAAPAPAAQPAAAAASSTAAASPAASKLMAEKGIGAGDVAGSGRDGRITKGDVLSAGSAPKAAPAAAPAKAAAKPALPEVKVPASATTWLNDRPEQRVPMSRLRARIAERLLESQQTNAILTTFNEVNMQPVMDLRAKYKDKFEKEHGVKLGFMSFFVKAAVHALKKFPLVNASIDGNDIVYHGYFDIGIAVGSPRGLVVPILRNADQLSLAEIEKKIAEFGQKAKDGKLSIEEMTGGTFSISNGGVFGSMLSTPIINPPQSAILGVHATKERPVVENGQIVIRPINYLALSYDHRIIDGREAVLSLVAMKDALEDPARLLLDL

SEQ ID NO: 55483 - protein, 404 aa, Salmonella enterica subsp. enterica serovar Typhi str. CT18
MKFERHHRILKELSISGVVKVSNLAKSLKVTKETIRSDLNELAGQGYLTRCHGGAFITLDSLDNVAKNEIAYVLEKYESAQKIKKGLSAMKNNVCVIGSFNVDIISYLPRLPSTGESLLADKFIFSPGGKGCNQALAASYADSDVHFITKVGSDHFSDYAINFINSSKIHKSVIYQTKETQTGTATIMVNGDTGDNVIAIYPGANMTISPDEITIQKEAIVHSDIVLVQLETNYEALQQTIRLAQKNDIPVIINPAPYNDMVNTIIDNIDYITPNETEAGLLANMAVNDIESAKCAAKIIHQKGVKNTIITLGSKGSLAYDGTQFIYSPAFPAVVKNTAGAGDAFNGALSSGLAKGKSLASALCYASAFASLAVETPNASDMPENDSVLHRIQGSHYKQTISTH

SEQ ID NO: 55484 - protein, 194 aa, Hordeum vulgare subsp. vulgare
MMLSSAYSTPAADELGGPPPLPPPPGADVSVIVGALTGVLLGLFLFLIYAKHCRQRGRGGARGAAGGLGLGFRASSTCDRCRSGVSLSVVDALPVVRFGDMGGAAAAAQPECAVCLGTFDPAADELLRVLPKCRHAFHADCVDTWLEAHSTCPVCRRRVGKEDAFAVIPELEAADADWYPAREAEMQIVVRRPA

SEQ ID NO: 55485 - protein, 386 aa, Ustilago maydis 521
MWVDEAKRVRGVAFERRELLKTRWSKRSTALLSGVAQPLGRVRAITSNAIVNQVKRFSVPEFTIGQNHEYEAPNTHDEFRIRDLIVDSTGNFYRPNRYTLRKSHTRDSRLTTRDWDYENREPFTIHDSRLFMISLTSRTHRHTRARIVAEFKRASWRQSQKVLDAGFDRLDSCPRTWLAHQATPLYTLSQTHLVLRCTLHPPNRGCQNVANMGQQGSQLLSDIEATSNFNSKEIQRLKKRFMKLDRDGSGSIDKDEFLQIPQIANNPLALRLIAIFDEDGGGTVDFQEFVAGLSAFSNQGSREEKLKFAFKVYDMDRDGLISNGELFLVLKMMVGNNLKDQQLQQIVDKTIMEADTNGDGKLDFDEFQAMVANTDVAKQLTLEDLF

SEQ ID NO: 55486 - protein, 170 aa, Bacillus cereus ATCC 14579
MDFKQHIAIVPDYPKEGIVFKDITPLMNDGKAYKAATDAIVEYAKERDIDVVVGPEARGFIIGCPVSYALEVGFAPVRKLGKLPREVITVDYGKEYGKDVLTIHKDAIKPGQRVLITDDLLATGGTIEATIKLVEELGGVVAGIAFLVELTYLDGRKMLDGYDVLVLEKY

SEQ ID NO: 55487 - protein, 172 aa, Glycine max
  misc_feature (95)..(95): Xaa can be any naturally occurring amino acid
PFDFDSEKLASLFEQAGTVEVAEVIYNRATDRSRGFGFVTMSTIEELEKAVKMFSGYELNGRVLTVNKAAPKGAQPERPPRPPQSFRVYVGNLPXWDVDNSRLEQIFSEHGKVEDARVVYDRETGRSRGFGFVTMSSETDMNDAIAALDGQSLDGRAIRVNVAAQRPKPSSF

SEQ ID NO: 55488 - protein, 521 aa, Zea mays
MVVADSTSRRAKQADGGDGVLGAPVLGGLGMEGLGDQLSVVMKFGGSSVSSAARMAEVAGLILTFPEERPVVVLSAMGKTTNNLLLAGEKAVGCGVIHVSEIEEWNMVKSLHIKTVDELGLPRSVIQDMLDELEQLLKGIAMMKELTPRTSDYLVSFGECMSTRIFSAYLNKIRVKARQGPCNQPSCKSPYDAFDIGFITTDEFGNADILEATYPAVAKRLHGDWIQDPAIPVVTGFLGKGWKSGAVTTLGRGGSDLTATTIGKALGLREIQVWKDVDGVLTCDPNIYPHAKTVPYLTFEEATELAYFGAQVLHPQSMRPAREGDIPVRVKNSYNPKAPGTLITRQRDMDKVVLTSIVLKSNVTMLDIVSTRMLGQYGFLARVFAIFEDLCISVDCVATSEVSVSVSLDPSKIWSRELIQQELDHVVEELEKIAIVRLLQQRAIISLIGNVEQSSLILEKTGRVLRKSGVNVQMISQGASKVNMSLIVHDSDAKALVEALHQAFFEDDVLSQVEAENLLVG

SEQ ID NO: 55489 - protein, 440 aa, Cytophaga hutchinsonii ATCC 33406
MKIVIVGTGYVGLVTGTCFAEVGIEVVCVDIDQKKIDNLKNGILPIYEPGLEEMVERNVKKGRLKFSTDLSQSIVDAEVAFIAVGTPPGEDGSADLKYVLAVATAIGQSMKNDIVVVTKSTVPVGTSLKVKKALQEELGKRNASLTAYVSSNPEFLKEGAAIDDFMKPDRIVVGIDAPQAEETMRKLYKPFLLNGHPIFFMDIPSAEMTKYAANSMLATKISFMNDIANLCEIVGADVNLVRKGIGSDARIGNKFIYPGVGYGGSCFPKDVKALIKTAKQNGYDMRVLSAVEDVNDDQKYVLVKKVNKYFNNDLKGKKFGVWGLSFKPKTDDMREAPSLVIIPELLKAGASVIAYDPVAMHEASHTLKDTITYAQDPLEVLEGIDGLLIVTEWSEFRSPDFDVVKSKMKGKAIFDGRNIYDPKEMKTLGFDYYCIGLKAE

SEQ ID NO: 55490 - protein, 69 aa, Zea mays
LAQRGGGHLVNLPTKRGRKARPNLKGGLCGKPGGNPSFVAFFGKGGGDYVSCPPFRVPIVRLTPAQGLV

SEQ ID NO: 55491 - protein, 105 aa, Glycine max
MAKGNSPLERPSLASLDQKLAFAKRCSHEGVLAGAKAAVVASVASAIPTLASVRMLPWARANLNHTAQALIISTATAAAYFIVADKTVLATARKNSFNQPSNSEA

SEQ ID NO: 55492 - protein, 336 aa, Methanosarcina acetivorans C2A
MKINTWFGSLEVGSGGEILAFDLFPKGIRELALRSLSLRSSRENLPPEGFDLKAAALECGFVASLSEYYSLLHEVTLEAAKLQVSEAITPDQRIVQAVEALDDINETTNSLSERLFEWYGGYFPESGLVGEALALFIVKYGSRENVPPDDPLYLKARDSMGAKLETADEALLKGFAESVCSLYSRRKQLEAYIESSMEALAPNLTTIAGPMLGARLISIAGSLEKLAAFPSSTIQVIGANKALFKHLRARAPSPKHGVIYSHPFINTSPWWVRGKVARALAAKISLAARIDFYSATKDLSLMGELEEKVRKIRAANPKPPQKRQEGRGKPKKKRRK

SEQ ID NO: 55493 - protein, 245 aa, Polaromonas sp. JS666
MNGSLAANAALLEALGEGLKDLSLPLTCEVAVCVPAPYLAQVQGLKSSRSSLSALAVGAQDVSAQASGAYTGEVSAAMLQDFGCRYVIVGHSERRQYHGESDALVADKAKAALAAGITPIVCIGETLAEREGGHTEEVVKRQLAAVIHVNGHCISEIVVAYEPVWAIGTGKTASPEEAQAVHAVLRAQLRAATDHPMRVKILYGGSMNAANAAALLSQPDIDGGLIGGASLKAPDFLKIIAAAQI

SEQ ID NO: 55494 - protein, 487 aa, Escherichia coli K12
MKPSTEWWRYLAPLAVIAIIALLPVPAGLENHTWLYFAVFTGVIVGLILEPVPGAVVAMVGISIIAILSPWLLFSPEQLAQPGFKFTAKSLSWAVSGFSNSVIWLIFAAFMFGTGYEKTGLGRRIALILVKKMGHRTLFLGYAVMFSELILAPVTPSNSARGAGIIYPIIRNLPPLYQSQPNDSSSRSIGSYIMWMGIVADCVTSAIFLTAMAPNLLLIGLMKSASHATLSWGDWFLGMLPLSILLVLLVPWLAYVLYPPVLKSGDQVPRWAETELQAMGPLCSREKRMLGLMVGALVLWIFGGDYIDAAMVGYSVVALMLLLRIISWDDIVSNKAAWNVFFWLASLITLATGLNNTGFISWFGKLLAGSLSGYSPTMVMVALIVVFYLLRYFFASATAYTSALAPMMIAAALAMPEIPLPVFCLMVGAAIGLGSILTPYATGPSPIYYGSGYLPTADYWRLGAIFGLIFLVLLVITGLLWMPVVLL

SEQ ID NO: 55495 - protein, 188 aa, Staphylococcus aureus subsp. aureus Mu50
MILVVDNYDSFTYNLVDIVAQHTDVIVQYPDDDNVLNQSVDAVIISPGPGHPLDDQQLMKIISTYQHKPILGICLGAQALTCYYGGEVIKGDKVMHGKVDTLKVISHHQHLLYQDIPEQFSIMRYHSLISNPDNFPEELKITGRTEDCIQSFEHKERPHYGIQYHPESFATDYGVKIITNFINLVKEG

SEQ ID NO: 55496 - protein, 350 aa, Penicillium marneffei
MGCGMSTEDKEGKARNEEIENQLKRDKMMQRNEIKMLLLGAGESGKSTILKQMKLINEGGYSRDERESFKEIIYSNTVQSMRVILEAMESLELPLEDPRAEYHVQTIFMQPSQIEGDSLPPEVGGAIQALWHDAGVQECFRRSREYQLNDSAKYYFDSIERIAQPDYLPSDQDVLRSRVKTTGITETTFIIGDLTYRMFDVGGQRSERKKWIHCFENVTTILFLVAISEYDQLLFEDETVNRMQEALTLFDSICNSRWFIKTSIILFLNKIDRFKEKLPVSPMKNYFPDYEGGADYAAACDYILNRFVSLNQAEQKQIYTHFTCATDTNQIRFVMAAVNGTFDLSLLDQI

SEQ ID NO: 55497 - protein, 359 aa, Azoarcus sp. BH72
MTTPHRIAVIAGDGIGQEVMPEGLRAVQAAAAKFDIALEFTHFDWAHCDYYLQHGKMMPDDWFEQLKGFDAIFFGAVGWPDKVPDHISLWGSLLKFRRDFDQYVNLRPVRLMPGVPCPLANKKVGDIDFYVVRENTEGEYSSVGGKMYEGTERETVLQESIFTRKGVDRILKYAFELAQKRPKKHLTSATKSNGIAISMPYWDGRVKEMGKAYPEVKWDQYHIDILTARFVLSPERFDVVVASNLFGDILSDLGPACAGTIGIAPSANLNPDRTFPSLFEPVHGSAPDIYGRNIANPVAMIWSGAMMLDFLGNGDARYTAAHDAIVKAIETVLVEGPRTPDMGGTANTTEVGKAVAAAI

SEQ ID NO: 55498 - protein, 561 aa, Kineococcus radiotolerans SRS30216
MNAGPVDPTTTAAWSSLSEHRSATTPDLRGWFAADPARARDLTLDVADLHVDLSKNLVTADTVALLLQLAEQTGVLARRDAMLAGEHVNVTEDRAVLHTALRRPAGASPALEVDGQDVDGDVQAELAKVFTFADAVRSGEWRGVTGKAITTVVNIGIGGSDLGPVMAYEALKPSVRAGLECRFVSNIDPTDVAETTKDLDPETTLFIVASKTFGTLETLTNARLARAWLWRGLAAAGVLADSDEARQEAVAKHFVAVSTALDKVAAFGIDPANAFGFWDWVGGRYSVDSAIGTSLAVAIGPEAFREFLAGFHAVDEHFRTTAPERNVPLLMGLLNVWYVNFLDAHTHAVLPYSQYLHRFPAYLQQLTMESNGKSVRYDGEPVTTHTGEVFWGEPGTNGQHAFYQLIHQGTRIVPSDFIAFATPAHPLVDGDADVHALFMANFFAQTKALAFGKTAEEVRAEGTAEDVVAARVFSGNRPTTSIMAPSLTPAVLGQLIALYEHVTFVEGAVWGIDSFDQWGVELGKKLALEIAPALTGDTAALEAQDPSTGALIRYYLEHRRD

SEQ ID NO: 55499 - protein, 217 aa, Oryza sativa
DEQLIFTGTSIEKVGENGGLLCFFDRRKLELVSRVGISPHYSVIRCLWHPRINQVFATVGDKKEGGTHILYDPSISQRGALVCVGRAPRKKSVDDFEVQPVIHNPHALPLFRDQPSRNRQREKILKDPLKSHKPEAPVNGPGFGGRVGTTKGSLLTQYLLKEGGLIKETWMDEDPREAILKYADAAEKDPKFIAPAYSQTQPKPVFAESDSEGEEKK

SEQ ID NO: 55500 - protein, 389 aa, Rubrobacter xylanophilus DSM 9941
MKAVVWHGRQDVRVESVPDPELREPTDAIVRVTSTAICGSDLHLYGKLAPIMREGDILGHEPMGVVEEVGSGVEHIKPGDRVVVPFNISCGSCYFCNMQLYSQCERTRDRGRLAEAASLLGRGKGASLFGYTHVYGAVPGGQAEYLRVPQAHFGPIKVPEGPPDERFLYLSDVLPTSWQAVAYADVPEGGTLAVWGLGPIGQMCCRIALHRGAGRVIGVDAVPERLDLASRYGVETLDYSAVDRAGLAVVEMTGGRGVDAAIDAVGMEAGGSLVDAVLQATRVQLDRARALRECAASVRRGGTLSIVGVYAGPIQMFPLGDLFDMQVQLRMGQANVRRWTDEILPLLADEDPLGVEELATHRLPLEEAPRAYETFQRKQDGCIKCVLRP

SEQ ID NO: 55501 - protein, 457 aa, Kineococcus radiotolerans SRS30216
MSPILPGNPVELPVEAAGGVPATTVLSTADGAVVTRTVLPCGARVLTEAMPGQRSASVGCWVGVGSRDETKGHFGSTHFLEHLLFKGTERRDAMDIASAFDAVGGEANAATGKEHTTYYARVLDADLPMAIDVVTDMVTSAVLDDDDFTSEREVILEELAMNDDDPGDVAHERFAELVLGRHPLARPIGGTPDTIRAVGRDDVWAHYREHYQPSSLVFTAAGGLDHDEVVACVQRELDRAAGDLAQAAPRPRRTSGEVSGGLEAGAALVVDRQTEQAHVLLGMTGITATDERRFTLSVLNAVLGGGMSSRLFQEVREKRGLAYSVYSFNANYADSGYVGLYAGCSPAKAAQVAELMLAELEKLATSPLEAEELGRGVGQLTGGLVLGLEDSGSRMNRLGKSELTHGQFLDVDGVLANVRAVTAEDVQTLAADLLSRPRSVTVVGPFADDTAFRGVVR

SEQ ID NO: 55502 - protein, 638 aa, Triticum aestivum
MSKLLAIALLLLPLINQGIYLATAWDDQDFFKYCPPSQCSQDGPEVRFPFCLESSNTSAAAAASCGCAGRSIRKLACSGRDTILFHPVLGPYNVSAIDYGRSSMKLIPLVDPCFVLQQKPVISRSSSSPRADVINYEMPRLYLWNSILVRCSREFAPGAADGIAGPVSCLSNTTNFFYLVNGYEDMSILPLDCKVVPLSDGVGGGLIPMYMFYNLMSDTLPVSFKESIERILSFAEMTVYWFNGYTCRQCEPSGGRCAFSSQRDRQFCMPGPHGSRIKVIAATSSVAAFVVLLLTVATVLYLTLKTRYNAEIHMKVEMFLKTYGTSKPTRYTFSEVKKMARRFKEKVGQGGFGSVYKGELPNGVPVAVKMLENSTGEGESFINEVATIGLIHHANIVRLLGFCSEGMRRALIYEFMPNESLEKYIFSRDSANFQHLLVPDKLVDIALGIARGMEYLHQGCNQRILHFDIKPHNILLDYNFNPKISDFGLAKLCARDQSIVTLTAARGTMGYIAPELYSRNFGGVSYKSDVYSFGMLVLEMVSGRRNADPRIGSQDDVYLPEWIYEKVINGEELALTLEATQEEKEKVRKLALVALWCIQWNPRNRPSMTKVVNMLTGRLQNLQMPPKPFVSSENEPMP

SEQ ID NO: 55503 - protein, 708 aa, Triticum aestivum
MGNPGAFHHSITLQSFTVFFLLAVFVADYHVQGGDDGCSLFSCGHLRDISYPFRRRGDPHECGVEEYELGCTSSKATIHINTGTYYVTAINYTGSYFWVMDTNFNTSSSCPLPLWNHLPYVGRYFGGYFGRYLGGIDSVSPPGFRYLATRSYDRACFANCSRAVMNKSAYKPVACQSAKNSHVYVWVSNYTYCAVEDLEPYCGYLGEIPFGNDTDEYSSDWGQLQNASYADITQFISKGFTVQFPVDTIYRRPSTSVMLRKNINLCLNNSISYFKEQISGTSIVNCTHAIFWSEVHFLECMIGSSNDDYYYTTKLFLITATLVSAIAIHQFFFVLCRFLLAPLAVWIFLAYKYMKTRIIIDAVEKFLRIQQMIGPARYSYTDIVAVTSHFRDKLGQGGYGSVYKGVLLPGGVHVAVKMLEGNSNCNGEDFISEVSTIGRIHHVNVVRLVGFCSEEMLRALVYEYMPNGSLDKYIFSTEKSFSWEKLNEIALGIARGINYLHQGCDMQILHFDIKPHNILLDSNFVPKVADFGLAKLYPRGDSFVPLSAMRGTVGYIAPEMISRSFGVISSKSDVYSFGMLLLEMAGGRRNADPNMGSSSQAYYPSWVYDRLTQEEAGEISDVAADMHELEKKLCVVGLWCIQMRSRDRPTMSEVIEILEAGVDGLQMPSRPFFCDEGHIHVEDSYQFTSELSAVSEEELSVVSEEDNV

SEQ ID NO: 55504 - protein, 172 aa, Thermoplasma acidophilum DSM 1728
MKPYLIMKIGKNVYIAETAVIIGDVEIGDNVSIFDGAVIRADMDSIKIGDNTNVQDNVTIHTDTGFPTKIGSNVSIGHNAVVHGCTVDDYVLIGMGAILMNGSHIRTGSIVGAGALVTQNFESEEYSLILGVPAKVTRINKEQMAYVKANAEDYLKLKDLHMSGRLERYRPK

SEQ ID NO: 55505 - protein, 627 aa, Triticum aestivum
  misc_feature (613)..(613): Xaa can be any naturally occurring amino acid
MSKLLVIALLLLPLINHGNDLAVAWDDKDFFRYCAPSQCSQHGPEIRYPFCLKSSNTSSSCGCRESWTKLACSGQDTILLHPVLGPYSVSAMDYRRSSMKIIPLVDPCQLLQQELMISGSLSSQKVDVANDDPLGPNQLFSWSLSATLVHCSREFTPGAADSIAGPVSCLSNATHFLYLVAGYEDMSLLPLDCKVIPVSDGRSVLIQIPKYDNRQLYEDYKPQFFKESAERILSFTEMTVYWNEYSCIDCELHCGRCAFSSQRSLPFCMPGSHIKVIAATSSVAAFVVLLLTVTTALYLSLKTRYNKEIHLKVEMFLKTYGTSKPTRYTFSEVKKIARRFKEKVGQGGFGSVYKGELPNGVPVAVKMLENATGEGEVFINEVATIGLIHHANIVRLLGFCSEGMRRALIYEFMPNESLEKYIFSRDLNIFQHLLVPDKLLDIALGIARGMEYLHQGCNQRILHFDIKPHNILLDHNFNPKISDFGLAKLCARDQSIVTLTAARGTMGYIAPELYSRNFGGVSYKSDVYSFGMLVLEMVSGRRNADPSIESQNDVYLPEWIYEKVVNGEELALTLETTQEEKEKVRQLAIVALWCIQWNPRNRPSMTKVVNMLXGRFQNLQMPPKPFI

SEQ ID NO: 55506 - protein, 119 aa, Prochlorococcus marinus subsp. marinus str. CCMP1375
MARPLKWSCIEQCGACCKLSPESRTEAMEVLNNEEQELYLSLVGIDGWCKFYDKARRKCTVYKTRPSFCDVKNLCTTFKISESNTESFAIKCCKEQIKHIHGARSREMKRFISNIKQVK

SEQ ID NO: 55507 - protein, 689 aa, Triticum aestivum
MGNPGAIHRSITLQVFTVFSLVAFFVADHVQGGDDGCPPFSCGHLRDILPPFRRRGDPLECGVEAYELGCTSSKATIQINTGTYYVTAINYPGSYFLVIDTNSDTSSSCPLPLWNHVPYSGPYEKSYLYSNGFNNLQTRSLYRACFANCSQAVMDNSSYKPVACLSAKDSHVYVWVSESVCGVEDLKPYCGYVALTPFLVTYSVDLQQLRNASYVDLTKLISKGFTVYFPVEAGDIRSVSRTINICLNRTTSYFKEQISGTSIVNWTHAIFWSEVHFLECVTDTNFGSTYTTESLLLVVTILSAIGISKFLFVLCRFLLAPLAVWIFLGYKYWKTMIIIDAVEKFLRIQQMIGPTRYSYTDIVAITSHFRDKLGQGGYGTVYKGVLLPGDVHVAVKMLEGNSNCNGEDFISEVSTIGRIHHVNVVRLVGFCSEEMRRALVYEYMPHGSLDKYIFSAEKSFSWDKLNEIALGIARGINYLHQGCDMQILHFDIKPHNILLDSNFVPKVADFGLAKLYPRGDSFVPLSAMRGTVGYIAPEMISRSFGVISSKSDVYSFGMLLLEMAGGRRNADPNAGSSSQAYYPSWVYDQLTREEAGEEISPVAADMHELEKKLCVVGLWCIQMRSSDRPTMGEVIEILEAGAGGLQMPSRPFFCDEGHIHVEDSYHFTSELTAVSEEELSAVSEEEDDV

SEQ ID NO: 55508 - protein, 331 aa, Xanthobacter autotrophicus Py2
MPDVSSIPENERVYGLKGVLEHSFERTRHDASGALADYIPELAKADPDRFGIAMASVSGEVVGVGDVDLPFTIQSISKALAYCLALEALGRDKVLAHVGVEPSGDAFNAIVFDALSNRPFNPMVNAGAITVSGLLSEAFGAEAFEVVLDRFSAAAGRRLVMDETVFRSEAQTGHRNRGIAHLLKCAGALGADVDDAVDLYFRQCSILVTATDLAVMGATLANIGENPLTGSAAFAVEAVRNTLSVMFTCGMYDFAGNWAFDVGVPAKSGVGGGILGVVNRQLGIGTYSPRLDAKGNSVRGISAFRDLAEEMGLHVFDPTNRGSSLLSAYRR

SEQ ID NO: 55509 - protein, 233 aa, Oryza sativa Japonica Group
MAAVSEVEVDGVVFPPVARPPGSGHAHFLAGAGVRGVEIAGNFIKFTAIGVYLEEGAAVPALAKKWAGKSADELAADAAFFRDVVTGDFEKFTRVTMILPLTGEQYSDKVTENCVAAWKAAGVYTDAEGAAADKLKEAFKPHSFPPGASILFTHSPPGVLTVAFSKDSSVPEGAVAAAAIENRALCEAVLDSIIGEHGVSPAAKRSIAARVSQLLKAESTGDVAAAEPAPVSA

SEQ ID NO: 55510 - protein, 494 aa, Xanthobacter autotrophicus Py2
MSAPFPFDNSYARDLPGFYAPATPTPVTAPGLVKVNAPLAEELGLDPEALATPHAVEMFAGQHVPEGADPIALAYAGHQFGQFTPQLGDGRAILLGEVVDRAGRRRDIQLKGSGPTPFSRRGDGRAALGPVLREYIVSEAMAALGIPTTRALAAVTTGEPVLRDRPLPGAVLARVAASHIRIGTFQFFAARKATDAVRQLADYTIARHYPELAGTPEPYLALLNGVIGRQAALVARWLLVGFIHGVMNTDNMSVSGETIDYGPCAFMDAYDPETVFSSIDQMGRYAYGNQPDIAHWNLARLAECLIPLLGEDKEAAVAAANGALKEFPARFRAAYHSGLVAKIGLAGPDGEASEEDTTLALELLSVMAESKADFTLTFRRLGALAADPEAGGPVRDLFLDRDAFDAWTTRWRERLAATGRDGAATRAAMDRVNPLFIPRNHLVEQVIASATEGDFAPFETLNTVLAHPFEEQPAFAAYAGLPPSMEGYQTFCGT

SEQ ID NO: 55511 - protein, 431 aa, Salmonella enterica subsp. enterica serovar Typhi str. CT18
MVSLEKNDRVMLARQLPLKSVALILAGGRGTRLKDLTNKRAKPAVHFGGKFRIIDFALSNCLNSGIRRIGVITQYQSHTLVQHIQRGWSLFSEEMNEFVDLLPAQQRMKGENWYRGTADAVTQNLDIIRCYKAEYVVILAGDHIYKQDYSRMLIDHVEKGARCTVACMPVPIKEATAFGVMAVDENDKIIDFVEKPANPPAMPGDASKSLASMGIYVFDADYLYELLAADDKDDASSHDFGKDIIPKITREGMAYAHPFPLSCVQSDPQAEPYWRDVGTLEAYWKANLDLASVTPELDMYDQNWPIRTHMESLPPAKFVQDRSGSHGMTLNSLVSGGCIISGSVVVQSVLFPRVRINSFCNIDSAVLLPEVWVGRSCRLRRCVIDRACIIPEGMVIGENAEEDARRFYRSEEGIVLVTREMLRKLQVKQER

SEQ ID NO: 55512 - protein, 659 aa, Ustilago maydis 521
MVGVSTASISAMGSKEHQLVGEARIRAPQPLQLPLLTLGLLGAQTVWSIDMAFAPPYLLDLGLSKSAMAAVFVAGPLSGLIVQPLIGSLADNSTSKYGRRRPFLATATIICAISILFLGFASEVAACFAVPGGNTHQNLAIFIGVVSVYLVDFSVNAVTALDRALMVDIAETEHQAEANAWAARLTGVGSVLSFLIGNLDLPKLAPGFLGTTQIQIISVLVSVILIATHAVVVLCVEEQVLAQTRSYGSRKAKGFGLTAIMHDLYIQARGLPPPIIEIFKVQFFAQIGWFPILFYSTVWVGEIYKADVRLNGGKQSDHELFEQATRAGSRAFFWHAVLSLLTSIVLPLAVPNPVHESSARPVWFANSSMLRKLGKVRERCPKLSFWWPFANFVFFISMMGTYFAGLTKSVFLATWVVTSVGFCFAIANWIPIALLGILIHTQHVQTNPDSAHLVVGGRTLPSNAAANADREGDEVAMALLGDRTHDDEWRRGSMARMSLYDASLDQRSQPQSRVCDDTDSDDEDQLPRALSFGASSLYEEAHARDANAEADDVERGRDSDKGANSTLSHAGTVLGLHNVAIVVPQFLVTAASALIFAIMEPSPKQKDQEGDVGVGNSTESGKSSDALGFIFRLGGCCALVAGILAVRLVRRHGHELRGY

SEQ ID NO: 55513 - protein, 502 aa, Salmonella enterica subsp. enterica serovar Typhi str. CT18
METKDLIVIGGGINGAGIAADAAGRGLSVLMLEAQDLACATSSASSKLIHGGLRYLEHYEFRLVSEALAEREVLLKMAPHIAFPMRFRLPHRPHLRPAWMIRIGLFMYDHLGKRTSLPGSTGVRFGADSVLKPEIVRGFEYSDCWVDDARLVLANAQMVVRKGGEVLTRTRATAARRENGLWIVEAEDIDTGKKYVWQARGLVNATGPWVKQFFDEGMHLPSPYGIRLIKGSHIVVPRVHNQKQAYILQNEDKRIVFVIPWMEEFSIIGTTDVEYKGDPKAVKIEESEINYLLKVYNAHFQKQLGRDDIVWTYSGVRPLCDDESDSPQAITRDYTLDIHDENGKAPLLSVFGGKLTTYRKLAEHAMEKLASYYPGIGPAWTKTCVLPGGDIDGSREDYAAKLRRRYPFLTESLARHYSRTYGSNTEWILGEATSLLDLGEDFGHEFYEAELKYLVDHEWVRRTEDAIWRRTKEGMWLTAEQQSRITQWLAAYVEKHQLSLAS

SEQ ID NO: 55514 - protein, 516 aa, Clostridium thermocellum ATCC 27405
MDKVDKIGLLREKLAQVEQGGGAEKIAKQHDAGKMTARERIQALFDENSFVEIDTFVETRSIDFDMQKKKVPGDGVVTGYGSIDGRLVFVAAQDFTVIGGSLGEMHAAKITKVMDMAMKMGAPFISINDSGGARIEEGIDALKGFGDIFYRNTLASGVIPQISVIMGPCAGGAVYSPAITDFIFMVDKTSQMFITGPQVIKSVTGEDVTFEKLGGAETHNSISGVAHFRSSSEKECIEQIKKLISYLPDNNLSDVPIVPTQDDINRITDNLVDIIPQDSNKPYDMMEIITSVVDNGDFFEIQKDFAKNIIIGFGRMNGGTVGIVANQPKVAAGVLDVNSSDKAARFVRFCDAFNIPIITFTDVPGYLPGVGQEHSGVIRHGAKLLYAFSEATVPKINVIVRKAYGGAYIAMNSKHLGADMVFAWPSAEIAVMGPEGAANIIFKKDIAAADDPMETRKRLIEEYREKFSNPYVAASRGYVDDVIDPATTRIRLISALEMLASKRENRPAKKHGNIPL

SEQ ID NO: 55515 - protein, 615 aa, Oryza sativa Japonica Group
MASISGAAAAAPSSSGASCGLRLRRDHLPRSSHFRLARPSSITDVSRLCSSSSSSPPRSLSSKQSGHADVLAHGAVDKDPIRLWNRYVEWLYQHKQLGLFVDVSRIGFTEEFLRRMEAPMGRAFAAMRELEKGAIANPDEGRMVGHYWLRNPALAPNSFLRDKIETTLERILAFASDVISAKIRPPSSPAGRFTQILSIGIGGSSLGPQFVAEALAPDNPPLMIRFIDNTDPAGIDHQIAQLGPELASTLVIVISKSGGTPETRNGLLEVQKAFRDAGLEFSKQGVAITQENSLLDNTARIEGWLARFPMFDWVGGRTSEMSAVGLLPAALQGIDIKEMLVGAAQMDEETRNTEIKENPAALLALCWYWASDGIGSKDSLLLLSRYLQQLVMESLGKEFDLDGNRVNQGLTVYGNKGSTDQHAYIQQLREGVHNFFVTFIEVLRDRPPGHEWELEPSVTCGDYLFGMLHGTRSALYANDRESITVTVQEVNPRAVGALVALYERAVGLYAYLININAYHQPGVEAGKKAAGEVLALQKRILLVLNEASCKDPAEPLTLDQIADRCHCPEEIEMIYKIIQHMAANDRALIAEGNCGSPRSIKVYLGECNVDDDMNS

SEQ ID NO: 55516 - protein, 586 aa, Colwellia psychrerythraea 34H
MSDVIRFFGGQYIYGVGGDFAANLIAALSVNEHGEGIQINPSSNEMHAGFSACAQAEVDGMGFCLTTYMVGSLPCTSAAALAVTEGLPVVFISGAPAESEVNQVAIHHTIHPNASWKAEYDNALEAFSALGMRVERLQGQRVEGHPNLAGQRFYQIVSEAYKNKQPVFIEVPRDQVFAKTQPIKLPSTLDDICCGSNILAGTELIVDNILDKLAQAKAPMLYLGDRLKHNEKLKHLIISFADKFNIPYATTWFAKGLFDEYAPLCLGAYNGIFTQTTGREYIEQQVDYVIDIATSIFPQDSNIAFGTGTHKIERFDNKTLLKGGSLLEKDLIAIFERLMEQNISPFEFTAPSQRGLTALSLQLESNELARGDDDIDFNNLAQTLNDLQAQDASTYVYLPEVGNSYFASYSLKVRQSILGRSWLTNPWYGAMGTALPYARVVAQRIKSQQIAERAVVIIGDGGFHFQLNELIHFLKDKSDVTIVYMRNNVFHLGKSGDGAIYHCNDSEFDVHSLVKAYQGDSKTCTSVGEFKAYFKACSQQTGISLIEVPAKPIEARQSNELKLLNLYIKSQNGQAEAVKAWQALTQ

SEQ ID NO: 55517 - protein, 300 aa, Colwellia psychrerythraea 34H
MTTLISYAHYQERINDFLAAKLEGLTINDPKLIEAMRYGLLIGGKRMRPYLAYITGEAVSADLNDIDAVAGALECIHAYSLLHDDLPAMDDDDLRRGKPTCHKAFDEATAILAGDALQTLAFDILANHTFSMNQSTAGMPIQVKLIQQLVKASGYQGMCGGQALDLAATGKNISLGELEVLHSLKTGALLEASVLMPAMCSGQVTREYKIILSEYAQLIGLAYQVQDDIIDLTSTEEELGKPVGSDIAANKSTYPALLGLQGAQDKAENLLQQALQALSRLPYNTQSLADFATFIVKRSH

SEQ ID NO: 55518 - protein, 96 aa, Glycine max
MAANFWTSSHYKHLLDQEDVDVVNTLDKEKGITLEDFKLIKMHMANYILKLAQQVKVRQRVVATAVTYMRRVYTRKSMAEYDPRLVAPTCLYLASK

SEQ ID NO: 55519 - protein, 237 aa, Azoarcus sp. BH72
MAASVAAETASPAAAPERRTVPLTGLRGAIARNMGQGWQVPRVAHSVDVDLTRVEALRAERAAAGDKLSVNAFVLHAVAQALRAHPRLNALMREKEVELVDDINIGVAVALDDGLMVPVIRQADTKPVAALAAETRQLAEGARAGALTGGAYQRGTFTVTNLGSTPVDRFSPIINPPQVAILGVGRTRQQAVVKDGAIVAAPVVNLTLVFDHRAVDGYPAALFLGEIARRLEQAEFD

SEQ ID NO: 55520 - protein, 380 aa, Kineococcus radiotolerans SRS30216
MKAVVYQGPKDVVVKEVPDARVEEPTDAVVRITTTNICGSDLHMYEGRTSVEEGKVLGHENTGVVEAVGSGVSRVKVGDRVSVPFNIACGSCRNCVHGWTSFCLRMNPTEGMDGAAYGYANMGPYDGGQAEFLRVPHADFNLLDLPAGTEHENDFTMLSDIFPTGWHGVELSGMVPGDDVAVFGAGPVGLMAAHSALIKGASRVFVVDKAPDRLRLAASIGAVPVDFSAGDPVEQITEQTRGRGVDRGVEAVGYQAHDPSGEEHPELVLDNLVKVVRATGGIGVVGVYMPEDPGAANEGAKQGRIGWDYGTFFTKGQSMGTGQAPVMRYNRQLRDLIVAGRATPGFIVSHELPLEQAPEGYRNFDDRVEGWTKVLLHPGS

SEQ ID NO: 55521 - protein, 231 aa, Rubrobacter xylanophilus DSM 9941
MSPDGMERLKRAAAREAVDRYVESGMVVGLGTGTTASWAVRRIGERLLEGSLSGVRGVPTSEYTAALARECGVPLVSLSERRPELTIDGADEIAPDLSVIKGRGGALLREKIVAAASRRGVVIVADGSKQVSLLGNGPLPVEVEPFGWEATAEALAALGCEPELRRVKTQPFVTDGGHYTLDCRFPGIPDPPGLACKIKRVPGALECGLFVGLARAAVIARPEGVEVLEAA

SEQ ID NO: 55522 - protein, 551 aa, Rhodococcus sp. RHA1
MTHIVTDTPLWKKLSDHHWEVVGTHLRELFDTDPDRGVDLIVTAADLYIDYSKHRVTRETMGLLVDLARAAGVERHREAMFTGAHINTSEDRAVLHTALRANPERELIVDGQDVVGDVHTVLRRMGEFTDRVRSGAWRGATGERIRTVVNIGIGGSDLGPAMAYRALRHYVDGPEVRFVSNIDPADLLSNLTDLDPRTTLFVVVSKTFSTLETMTNASAARRWITEALGEHAVPRHFVAVSTDEERVTAFGITARNIFGFWEWVGGRYSVGSAAGLSVMIAIGRERFTEFLGGMRAIDEHFRTTPLESNAPVILGMLGVWYSSFFGADARAVLPYAHDLARFPAYLQQLTMESNGKSVRTDGTPVGTFTGEIFWGEPGTNGQHAFHQLLHQGTHLIPVDFLGFAEPIEDLPTLDGIGSVHDVLTANLFAQSKVLAFGKNADEVAADGTPSALVPHKVMSGNRPSTTILGAKLTPSTLGQLIALYEHQVFVQGIVWGIDSFDQWGVELGKTSALELGPALWDLDGAAYVGDSSTTGLIRTYRLARGERRCLP

SEQ ID NO: 55523 - protein, 260 aa, Triticum aestivum
  misc_feature (155)..(155): Xaa can be any naturally occurring amino acid
  misc_feature (200)..(200): Xaa can be any naturally occurring amino acid
NKFVQKSRLVPVRNSRDIVDPRVRTRIGLAGLAVMGQNLALNIAEKGFPISVYNRTTSKVDETVQRAKLEGNLPLYGFHDPASFVNSIQKPRVVIMLVKAGAPVDQTIATLAAHLEQGDCIVDGGNEWYENTERREKAMEERGLLYLGMGVSGGXEEGARHGPSMMPGGSLEAYQYIEDILLKVSAQVPDSGPCVTYIGXGGSGNFVKMVHNGIEYGDMQLIAEAYDVLKSVGKLTNGELQQVFAEWNKGELLSFLVQIT

SEQ ID NO: 55524 - protein, 295 aa, Psychrobacter arcticus 273-4
MNKSYIQNSFYEKTARNRIASIVDKNSFVEILKPGSMPTSPNLASLDITGSFDDGVIIGKATIKDNFVYIIAQEGQFMGGAVGEMHGAKIVGMLLKAIEEKPKAIVFFVDSGGVRLHEANAGLIAISEIMRAMLKVRNAGIPIITVIGGTNGAFGGMGISACLSTHIIMTEEGRLALSGPEVIETLKGVEEFDSKDRALVWRVTGGKTRYLLGHVQVLVEDDIDDITQEIIAALQLPVANVDLSYLQQQQDGLQQQYDQWFGKKDSLSIWQSMNINNPDSISMLSAEQVKAIKKG

SEQ ID NO: 55525 - protein, 368 aa, Oryza sativa
MMDWTDNHYRTLARLISKHAWLYTEMVVAETIVHQKDNLDRFLAFPAEQHPIVLQIGGSNLDNLAKATELANAYSYDEINLNCGCPSGKVAGHGCFGARLMFDPEFVGDAMSAIAANCNVPVSVKCRIGVDDRDSYEELCEFVDKVVSKSPTRHFIIHARKALLSGLSPAENRKVPPLKYEYYFALLRDFPDVQFTLNGGITTIDQVTASIRQGAHRVMVGRAAYNNPWNMLGHVDSEVYGMPTRRSSRRQILESYQVYGDSIMGQYGPSRPNVRQLVKPLLNLFHSEPGNGLWKRKADSTLRHCKTLESFLEETLDAIPNSVLDAPIGKEAYIEEGHFADMDSLLPPRYSSLTNGSCEIPALVTAST

SEQ ID NO: 55526 - protein, 235 aa, Brassica napus
  misc_feature (19)..(19): Xaa can be any naturally occurring amino acid
  misc_feature (192)..(192): Xaa can be any naturally occurring amino acid
  misc_feature (213)..(213): Xaa can be any naturally occurring amino acid
  misc_feature (227)..(227): Xaa can be any naturally occurring amino acid
MASLNLRCDSTHLLPSASXVTRTRPFRKTWMCPKIIPRRLNNVRMGVMMSEEGDVFSSSSSKSNNGSMGIELQPDLVSFGTLAAEMIPTTMVSSEVEDEEFDLDRPTEGFASIPQAIEDIRQGKLVIVVDDEDRENEGDLIMAASLVTPEAMAFVVKHGTGIVCVSMKGEDLERLELPLMVTRKDNEEKLRXTAFTVSVDAKNGTSTGVSASXDGPQTILALASKDXKPQDFNRP

SEQ ID NO: 55527 - protein, 209 aa, Clostridium thermocellum ATCC 27405
MTVLYLVRHGQTDWNKENRCQGRIDTELNSEGILQAEAIAQRLAGENIDVIYSSALKRAYTTAEIINRKLSRELVRNEALNEIDFGEWEGLTFEEMRKRPDYSYEQWRLMPHLVTFPGGEKSLKNVQDRAMKFVNEIIEKHNGNNILIVSHGGVIKLIILGMLGIGLEAYNKFFIANASLSIVVIESDRAFLRTLNDTCHIKNLITAKS

SEQ ID NO: 55528 - protein, 505 aa, Populus sieboldii x Populus grandidentata
MDLLLLEKTLLGSFVAVLVAILVSKLRGKRFKLPPGPLPVPVFGNWLQVGDDLNHRNLTDLAKKFGDIFLLRMGQRNLVVVSSPDLSKEVLHTQGVEFGSRTRNVVFDIFTGKGQDMVFTVYGEHWRKMRRIMTVPFFTNKVVQQYRYGWEEEAAQVVEDVKKNPEAATNGIVLRRRLQLMMYNNMYRIMFDRRFESEDDPLFNKLKALNGERSRLAQSFDYNYGDFIPILRPFLRGYLKICQEVKERRLQLFKDYFVDERKKLASTKNMSNEGLKCAIDHILDAQKKGEINEDNVLYIVENINVAAIETTLWSIEWGIAELVNHPEIQKKLRHELDTLLGPGHQITEPDTYKLPYLNAVVKETLRLRMAIPLLVPHMNLHDAKLGGFDIPAESKILVNAWWLANNPAHWKNPEEFRPERFLEEGAKVEANGNDFRYLPFGVGRRSCPGIILALPILGITLGRLVQNFELLPPPGQSKIDTSEKGGQFSLHILKHSTIVAKPRSF

SEQ ID NO: 55529 - protein, 403 aa, Polaromonas sp. JS666
MAGFRTFLKSGHAPTLFAAFLYFDFCFAVWVLNGAMAPFISETFHLTAAQKGFMISVPILAGALMRFPLGILAQYIGRKNAALVEMGMIILALAYGYFFISAYDHVLAMGVLLGIAGASFGVALSLGSGWFPPKYKGLAMGIAGAGNSGTVLAVLFAPPLAMVYGWQTVYGLAAFFMLIPMVVMVVFAKEPPDIEHQTFRQHIACLFEKDGWAFSLIYIITFGGFIGLASFLPTYFYDQFGVTKVQAGQLTMLAALMGSAVRVVGGYISDRVGGINTLSGVLVVVAFTLVLCGLAGNSLTVTTLLFMVCFAALGAGNGALFQLVPLRWPLATAVAGSMIGEVGALGGGFIPNAMGLSKQYTNTYLWGFVAFAILAVVMLVMLRVMQIRWTRTWAEKGGRARSA

SEQ ID NO: 55530 - protein, 269 aa, Hyphomonas neptunium ATCC 15444
MENPDIGAPPPPWKRLRFEAQAAAAEEPTLASYLNAAILSHATLGQALSFHLAEKLSGPGMGPQQVRHILSAVYDSAPGLIEFAESDMQAVLERDPAARGMLQPFLFFKGFLALQTHRIAHELWRQGRETLAFHFQSRASELFDVDIHPAARIGRAVMLDHASGITIGETAIVGDGCSLLHGVTLGGTGKEVGDRHPKIGRGVLLSVGAKILGNISIGDEAKVAAGSVVLKDVPARCTVAGVPAKIVAGPACCQPAQSMDQAIPETSAE

SEQ ID NO: 55531 - protein, 410 aa, Synechocystis sp. PCC 6803
MDTNTLLLILANIIVIIGLARLIGLLFARFQQPPVIGEIIAGIMLGPSLLGLLSPALEKSFFPATTQPFLYLLSEIGLIFYMFLVGLELNPQYLRQKLKVAILTSNVSIFFPFVLGIVLSFFVLYSLNQPNKTSFIPFALFIGAAMSITAFPVLARILKDTGLDKTPLGTLGLTCASVDDISAWCLLAIAIAVTRTDNIFGAFPTLLGIIVYTVFMVTLGRKFFKYILRNYGQKNYLSQGLLTFIYIMVILSAMLTEWIGIDVIFGGFILGAILPKNTNLSTELATKTEDFVSTFLLPIFFAYSGLSTDLGLLNKPYLWAVCALVVAAAIAGKYCGVYVTTRALGVEKQEAKALGWLMNTRGLTELIILNVGLKLGVISPVIFTMFVIMAIITTIITSPLVVKIYPAPAH

SEQ ID NO: 55532 - protein, 589 aa, Oryza sativa Japonica Group
MGGEAGERRLGRAMSFGIPDVALGLVMGFVEDPWDRDAISLVCRHWCRVDALSRKHVTVAMAYSTTPDRLFRRFPCLESLKLKAKPRAAMFNLIPEDWGGSASPWIRQLSASFHFLKALHLRRMIVSDDDLDVLVRAKAHMLSSFKLDRCSGFSTSSLALVARTCKKLETLFLEDSIIAEKENDEWIRELATNNSVLETLNFFLTDLRASPAYLTLLVRNCRRLKVLKISECFMLDLVDLFRTAEILQDFAGGSFDDQGQVEESRNYENYYFPPSLLRLSLLYMGTKEMQVLFPYGAALKKLDLQFTFLSTEDHCQLVQRCPNLEILEVRDVIGDRGLEVVAQTCKKLQRLRVERGDDDQGGLEDEHGMVTQVGLMAVAQGCPHLEYWAVHVTDITNAALEAIGTYSSSLNDFRLVLLDREANITESPLDNGVRALLRGCTKLRRFAFYVRPGALSDVGLGYIGEFSKTIRYMLLGNVGESDQGLLQLSTGCPSLQKLELRGCFFSERALAVAVLQLKSLRYLWVQGYKASPNGTDLMAMVRPFWNIEIIAPNQDEVCPDGQAQILAYYSLAGMRSDYPHSVIPLYPSV

SEQ ID NO: 55533 - protein, 157 aa, Triticum aestivum
  misc_feature (7)..(7): Xaa can be any naturally occurring amino acid
  misc_feature (16)..(16): Xaa can be any naturally occurring amino acid
  misc_feature (55)..(55): Xaa can be any naturally occurring amino acid
  misc_feature (76)..(76): Xaa can be any naturally occurring amino acid
LYLKWKXEWNCNSEYXYHCMMEREQEREELGLGPVKYHGKWPLKRASVFQIPLAXEPLSAALSALTLLVQFNGWLXFFLLLSYKLPLSPETHVTYYEYTGLWHINVLLAMNLWFWCAMYSTWTASSSTQRGSTRRCRRRSREVRQGVRLVPQGQYDG

SEQ ID NO: 55534 - protein, 535 aa, Alkaliphilus metalliredigens QYMF
MQYDALHYPYPSKRNVVYGKKGMVATSQPLAAQAGLEILKKGGNAIDAAIATAACLTVVEPTSNGIGGDAFALVWTKGKLHGLNASGPAPRKLSVEALKKDGYEEIPKYGWIPVTVPGAPSAWGELSRRFGKLSLCEVLAPAIQYAREGYAVSPTTSEAWQRAYDIYKEQLRGVQFNHWFETFAPKGQAPNPGEIWSSEGHARTLESIAQTNGESFYKGELAEAIVTFSKAYGGYLRREDLEAYHPEWVDPIKVNYRGYDVWEMPPNGHGIVALMALNIAKGFDYLEKECVDTYHKQIEALKLAYADGEQYIADASNMNVKAEALLSEGYGQGRRALIGEKAILPQAGKPAQGGTVYLATADDEGNMVSFIQSNYMGFGSGLVVPGTGIALHNRGHNFVLDKAHVNCLEGGKKPYHTIIPGFLTQGEKPIGPFGVMGGFMQPQGHMQVIMNTIDFHLNPQQALDAPRWQWIQGKRVDIEPHFPNHIAQQLAKRGHEINIQLNTGSFGRGQIIWRTEEETLCGGTEARTDGAVVAW

SEQ ID NO: 55535 - protein, 364 aa, Mycobacterium smegmatis str. MC2 155
MAKGRLRRRLAAIDSNLTSQPDAALVDVLRIPEPFISPSRKIAMRLLYATGALFAAVLIVYLDRHGYRDINATPDENDPLSFLDCLYYATVSLSTTGYGDITPYTESARLVNVLVITPLRVAFLIVLIGTTVETLTTQSRQALKIQRWRSKVRNHTVVIGYGTKGRTAVAAMVGDDVAPADIVVVDENASALERARSAGLVTVHGDATKSDILRLASAQHAKAIIVATDDDASAVLVTLTARELAPKAKIIAAAREAENQHLLRQSGADSTVVSSETAGRLLGIATQTPSVVEMMEDLLTPDAGFAIAEREVSPKEEGGSPRHLHDIVLGVVRGGRLVRVDDPEVDALEAGDRLLYIRSADAER

SEQ ID NO: 55536 - protein, 241 aa, Brassica napus
MAGEDNNREARRGDDHEESSPLLQVNDTKINSKVDTKTAPIVPPPAAEEYGWTADGLPVSDGSVIGEPIGRNQWNSGLFSCFGRNDEFCSSDLEVCLLGSVAPCVLYGTNAERLGSAPGTFSNHCLTYSGLYFIGNSLFGWNCLAPWFSYSSRSAIRRKFNLEGSFEAMNRSCGCCGSCIEDEMQREHMETTCDFVTHVLCHTCALCQEGRELRRKVLHPGFNAQSTVVVLPPSEQTMGRK

SEQ ID NO: 55537 - protein, 411 aa, Alkaliphilus metalliredigens QYMF
MSKHVVDEAQRCLQCKKPACRKGCPIDTPIPEFINSLLGGDIRASGEMLFRNNPLSVICSLVCPHEKQCEGNCILGKKSNPVHISAIENYISDYSLDIMDLKPKEKLEGNIGIIGAGPAGITIAFILALKGYNITIFEANDRIGGVLRYGIPEFRLPKDILERLKYKLVRLGVTIRPNTLIGPVLTVEDLFRDGFDALFIGTGVWKPKKINIKGESLGHVHYAIDYLKNPEVYDLGEKVCIVGAGNVAMDVARTALRKGAKEVSIMYRKGTEDMPAREYEIQYAKIDGVKFELFKTPVEFTKQGVRYVKTEENNDEGEINNTHNPRGIFECDSVIVSISQGPKANVVSNTKGIEISHYGLVITDEHGRTTREGVFASGDVVTGAKTVVEAVRFSKEVAEVIHQYVAKKYDL

SEQ ID NO: 55538 - protein, 195 aa, Kineococcus radiotolerans SRS30216
MSRTSAEGQVGTTQGWHKLHLPNALTVLRIVFVPVFVWFLAMDGGTNWRWRAAAAAVFVAASITDRYDGHLARRWQVVSDFGKIADPIADKALIGAGLVVLSLQGRLWWWMTVVILVRELLVTLLRFMVIRRGVIPAAKGGKIKTVVQTVAVGLFVVPLPAALDPLCLAVMGVAVVLTLWSAWAYVVAGAKLLRP

SEQ ID NO: 55539 - protein, 334 aa, Alkaliphilus metalliredigens QYMF
MKAMVIREFGGPEVFKLEEVSKPTLKPGHVLIRVEAACMNPIDVKIRGGLVKAATETLPAILHGDVAGVVEAVADDVEMLTVGDKVYGLGGGVKGTGGALAEYMLVDADLLAIKPKNLFMDEAACCPVVALTAWDALVNRGKVQVGHRVLIHGATGGVGHMAIQIAKHLGAEVYATASSDEKIKIANKLGAHHVINYKETSVEEYVNQYTEGKGFDLVFDTVGGENLDRSFEAAAMTGTVISTNTRSTHDLSMLHAKGLNLHVVFLLLPLLHGSGRKEMGYTLRRISQLIEQEIIKPLLDEKTYGFSEVSLAHRQLESGQAIGKIALFNDLASK

SEQ ID NO: 55540 - protein, 315 aa, Musa acuminata AAA Group
MDCSFPVINMEKLQGGEREKAMELLRDACENWGFFELLNHGISPELMDEVERLTKEHYRKCREQKFKEFASKALENGSEVTDVDWESTFFLADLPVSNMSELVDMGADYRKVMKEFAAKLEMLADGLLDLLCENLGLEKGYLKKAFCGSKGPSFGTKVSAYPPCPRPELIKGLRAHTDAGGIILLFQDDRVSGLQLLKDGQWVDGPPMRHSIVVNLGDQLEVITNGKYKSVLHRVVALTDGNRMSIASFYNPGSDAVVFPAPTLVQKEAEKDDAAAVYPRFVFEDYMKLYVIQKFQAKEPRFEAMKATALPIPTS

SEQ ID NO: 55541 - protein, 305 aa, Rubrobacter xylanophilus DSM 9941
MITRIKPGTGITELVGNTPLVELSKISAETPGVRIYGKAEWYNPGGSVKDRPALWMIRDGERSGALTPEKTILDATSGNTGIAYAWIGAALGYRVKLCMPSNASEERKKILRAYGVDIVLTDPGEGSDGAIREARRLYAEDPERYFYPDQYSNPANPRAHYESTGPEIWEQTGGEITHFVAGLGTSGTFVGTARRLKEFNPEIRAISFEPDSPFHGIEGMKHMESAIVPAIYDPGVADENRRASTEEAYAMVKRVAREEGILIGISAGAAVATALRVAREIESGTIVTILCDGADKYLSESFWEE

SEQ ID NO: 55542 - protein, 409 aa, Porphyra yezoensis
MAAFVASAGCSRVGAPAARLSTARHASPVPVRVPAARRLSTGLRMVAPSPSKEEQFVCADESPMTLTRYFMGKANEQLDEEHVQDLQNLMASIQMACKKIASLVSRAGITNLTGYEASGSINVQGEEQKKLDVLSNDVLKHALKWRGGKLGIIASEEEDEPIMVDELASGNYIAVFDPLDGSSNIDAGIATGTIFGIFAESAGCLASDWEAKVDQEVLTCLQNVLQPGSNLVASGYCMYSSSCMMVLTTGSGVQGFTLDPQIGEFVLTHPSITIPSRGKIYSVNEANEPAWDPVLRSYIASLKDGSNSSGMTYSSRYIGSMVADVHRTLMYGGLFAYPADKRNANGKLRLLYECSPMSYLIEQAGGIATTGRERVLDVIPSSVHQRVPLVLGSPEDVQELLDKYYEASL

SEQ ID NO: 55543 - protein, 220 aa, Vibrio vulnificus YJ016
MELTVSVKIHYQNTHFITSAPDIRHLPADEGIEIAFAGRSNAGKSSALNRLTNQKNLAKTSKTPGRTQLINLFKVTEGCHIVDLPGYGFAQVPLEMKNKWQKSLGEYLQKRECLKGLVVLMDIRHPMKDLDQQMIFWAIESRIPVQVLLTKADKLKSGARKAELLKVRKLAETFGGDVQVDVYSSLKGLGVDQLRAKLDTWFAPALAHLQEDEEGSNSAE

SEQ ID NO: 55544 - protein, 184 aa, Glycine max
MATTRIEAEKKPKTKIVCTLGPASRSVPMIEKLLRAGMNVARFNFSHGSHEYHQETLDNLRAAMENTGILCAVMLDTKGPEIRTGFLKDGKPIQLIQGNEITISTDYDLKGDEKTICMSYKKLPEDVKPGMVILCADGTISFTVLSCDKQAGLVQCRCENSATLGERKNVNLPGVIVDLPTLTD

SEQ ID NO: 55545 - protein, 769 aa, Zea mays
MEDVKETLDGVEDRITNWKEQSRDYVKISLDSTMDKVNELFNSHRDELSERNDAREAMMMALREGTMATTRALSTRIEELEGELALCRAAVGNGVANAALSNEDVPKPKEFVGTRSACDVDNFLWRMENYFRAKGIMDDPVKVNTASMFLTDITLLWWRGRTTDKRQGGIGTWQEFQCQLKGQFYPEFTEKEAREKLQGITQRGTVGEYVREFKELMLQVLEVTEREALLAFQNGLKLWVRQEVEQRGVQKLSEAMMVTKSVVKLGLGKDLGLLSPRKGADNGGNENPRVGKKKPKRKRDRLKCFLCDGPHILKKCPKKSTLKEKPVGKALVLGSSAMGVEAKEAKSEKKPVECFLCHGQHRLRKCPRKSVIEGNNGADKEPKKLGLSKGKAETKRAKRSKKKRVKCFLCRGPHELRNCPKQAGVKRKATSELGESSEGLPPKEDVSLSSDLEERVAMKTVKLRPMRLKLSEASELAESSTRLPPMGEVGGASDFKEREVMHVGQLTRVNAKVEQPVQIHQDVDSKSKRWHFQSYNLTISNIWSPFLVKAATFEDINGVSTAEVQLHLDKLDKKWLDIYPSLDYMIISTGKWFLKAAVYHENDVIVGCHLCPGKNLIELGFEYAYKKTLHHVMDFIKTSKHKGLIFFRTSTPDHFKNGEWHNGGTCPKTIPAKEGEVKIKDLNRILRNIELEEFEKASAKVANNELNLKLLDFTNLLLSRPDGHPGPYRQFQPYSKNKTAVVQNDCLHWCIPGPIDFWNDVIMEIVANG

SEQ ID NO: 55546 - protein, 552 aa, Oryza sativa Japonica Group
MGRSMLPEQQEDVSRKSKKEKKSKKDKKRKLEAEAEVVVVEAAAATSTDEATKSSKKKRAKGDLGQGEEAENGGGKVVAVTGKGSADAKYAPLSSFAATALPPQVLDCCKGFERPSPIQAYAWPYLLDGRDFIGIAATGSGKTIAFGVPALMHVRRKMGEKSAKKGVPRVLVLSPTRELAQQIADVLCEAGAPCGISSVCLYGGTSKGPQISALKSGVDIVIGTPGRMKDLIEMGICRLNDVSFVIADVLCEAGAPCGISSVCLYGGTSKGPQISALKSGVDIVIGTPGRMKDLIEMGICRLNDVSFVVLDEADRMLDMGFEPEVRAILSQTASVRQTVMFSATWPPAVHQLAQEFMDPNPIKVVIGSEDLAANHDVMQIVEVLDDRSRDSRLVALLDKYHKAQRGWSAVSVHGDKAQHDRTKALSLFKEGSCPLMIATDVASRGLDIPDVEVVINYSYPLTTEDYVHRIGRTGRAGKKGVAHTFFTQENKGLAGELVNVLREAGQVVPPALTKFGTHVKKKESQIYGSHFKEIKADAPKSTKITFGDSDED

SEQ ID NO: 55547 - protein, 136 aa, Clostridium thermocellum ATCC 27405
MERTLVILKPDSVKRKLVGEIISRFEKRNFTILHLKMMNIDRELACEHYSHVKDKPFFNDMIDYITSGPVVVMVLSGYRVIEAVRSMVGATSNFDSKPGTIRGDYGYHRFENLIHASDSCESAEIEIKRFFPELDS

SEQ ID NO: 55548 - protein, 405 aa, Cytophaga hutchinsonii ATCC 33406
MEQIKLDSIADAIEAIRKGEVIIVVDDEDRENEGDFICAAECVTPEIINFMSKEGRGLICAPISEARCTELKLDLMVGSNTATHETPFTVSVDLLGNGCTTGISASDRSKTIRALVDPDTKPEDLGRPGHIFPLKAKDEGVLRRVGHTEAAVDLARLAGFKPAGVLIEIMSEDGSMARLPELKQIATKFNLKLISIKDLIEYRLTHESLVKREIGVDMPTNLGDFDLIAFRQISTGEVHLALIKGTWEKDEPVMVRVHSSCVTGDIFGSCRCDCGPQLHKAMEMIQQEGKGVILYMNQEGRGIGLLNKLKAYKLQEQGRDTVEANLELGFKMDQRDYGTGAQILRDLNISKLRLITNNPVKRAALAGYGLEITEAVPIEIPSNPHNLEYLKTKRDKMGHTILKKD

SEQ ID NO: 55549 - protein, 399 aa, Vibrio sp. Ex25
MKIMFEKVVAAPADPILGLTEEFKKDTRADKINLGVGIYKNEQGETPVLATVKKAEAALVETEKTKSYLTIEGTAEYGIAVQKLLFGSDAEIVNEKRAKTAQAPGGTGALRVAGEFIKRQLGDVKIWISNPTWANHNGVFTAAGIETAQYSYYNAETKDKDFDAMLNDLQSASEGDIVLLHGCCHNPTGIDPTAEEWETLAKLVAEKKLLPLFDFAYQGFAKGVEEDAAGLRTFAKYNKEILVASSFSKNFGLYNERVGAFTLVAESEEVATTAFSQVKAIIRSIYSNPPAHGSAVVTHILGNAEMRAEWEAEVAEMRDRIQEMRELFVATLKSEGVDADFSFIERQNGMFSFSGLSKEQVNRLKEEFGIYIVGSGRISVAGMTKSNMGPLCKGIAAVL

SEQ ID NO: 55550 - protein, 1404 aa, Oryza sativa Japonica Group
MRLGKQRVFIFTASTEISGVSTREHGEGYGFLYCKSHVTAEQHLQPTQDFWIAASPSKVVQADAAALGTIAADMAPVVDGFSADDDELDLDSPTEGFSSIPEAIEDIRQGKYVIVVDDEDRENEGDLIMAASKVTPEAMAFIVRHGTGIVCVSMKEDDLERLELPLMVTTKENEEKLRTAFTVSVDAKEGTTTGVSAKDRANTVLALASPNSKPEDFNRPGHIFPLKYREGGVLKRAGHTEASVDLAMLAGLPPAAVLCEIVDDDDGSMALLPKLQDFARRENLKIISIADLIRYRRKRDRLVERVCVTPLQLQWGSFQSYCYRSLIDGMEHIAMVKGDVGDGQDILVRVHSECLTGDIFGSARCDCGNQLALAMTMIEKTGRGVVVYLRGHEGRGIGLGHKLRAYNLQDDGRDTVEANEDLGLPVDSREYGIGAQILRDLGVRTMRLMTNNPAKYTGLKGYGLSVLGRVPLLTPITNENRRYMETKRLKMGHVYGTRPSGNTSTLADGGIKKEQDQIDSASEQDTSKIYTLEKVYGFRLVCRSVVDLRSQKFHTRVYKRKSYFRSSASECEKIIHSARWLEFRRQRVAFQRTRRTIHLIPLASQDDSSGLSVNGSPQVDSASEMDDIRVKLVKALQSEDISTGLVQSIHDAARSIELAFLDHSKSSKNSWFPKEWLGVDNNEWIKPLSYQAAVGSLLQAVIDVSSRGNGRDRDINVFVQRSLSRLLSSLEGAIQNELSKREPTLYQWYSSDQNPLVVRTFVNSFENDPRFNSATAICHERQQMNTSESDLSLLMLGLTCLAAITKLGSTKVSCQQFFSMVPDIIGRFMDMLLEFVPLSKAYTLTKDIGLQREFLCNFGPRAADPKFSSDREVEISFWIDLVQKQLLRALDREKIWSRLTTSESIEVLEKDLAIFGFFIALGRSTQTYLSSNHLTNLDDSINDIVSSHLNKLTIIQVVCEELEWLPFYSGDVPAATIEGREDVHKGEIISRVLNVCSYWMTSFIKYSSWLENPSNVKAARFLSKGHSMLSDCMKELDLTKYDMPKDQTFPEAKEHLVARTELASFDKSLESVEEALVKLEDLLQELHLSSSNSGKEDLRAACSDLEMIRRLKKEAEFLEASFRAKTEFLEADASSRPLSPAVEEGRGKTASNANESSTPQKPANRVENKRRPIWDLFGRPSGRRVQLVQQTSDQNVSVANVDNKDTQSNDILRFEQLRRELIELEKRVQKSADNAQKEETYVANETLDSSVSSSPVSMPSGPASKKENVITKSVEKVKETTTTVVQGTQLLAIDTGAAMGLLRRALIGDELTHKEKQALQRTLTDLASVVPIGILMLLPLVNFNVQCKYLHGYSIVNKFIMFPERLDLLRQLEKVKEMGVAEGSSEEMVEACFGTRQKMVSFRL

SEQ ID NO: 55551 - protein, 509 aa, Cytophaga hutchinsonii ATCC 33406
MTEKILILDFGSQYTQLIARRVRELNVYCEIHPYNKAPQIDGTVKGVILSGSPCSVREENAPDIDLSLYREKLPLLGVCYGAQLIAHKSGGTVQPSSIREYGRARLNNVHTSDDLFKEIVPDSQVWMSHGDTIVEIPSNFEILSSTETVRVAAYKVKGEDTFGIQFHPEVTHSLQGKELLRNFVVHICGCSQDWTPDAFVETTISELKAKIGTDKVVLGLSGGVDSSVAAVLIHKAIGPNLTCIFVDNGLLRKNEYEEVLNSYKHMGLNVIGVDAKKQFYKSLEGLSDPEAKRKAIGKEFIEVFDQESHKIADVKWLGQGTIYPDIIESVSVKGPSATIKSHHNVGGLPEKMKLKIVEPLNTLFKDEVRRVGKTLGIDDIILKRHPFPGPGLAIRILGDITAEKVAVLQEVDYIFISRLKEKGLYDQVWQAGAILLPVKSVGVMGDERTYENVVALRAVSSMDGMTADWIHLPYDFLADISNEIINRVKGVNRVVYDISSKPPATIEWE

SEQ ID NO: 55552 - protein, 149 aa, Clostridium thermocellum ATCC 27405
MMYSEKVMDHFMNPRNVGEIENADGVGEVGNAKCGDIMKMYLKIENDVIVDAKFKTFGCGAAVATSSMATELVKGKTIEEALKITNKAVAEALDGLPPVKMHCSNLAEEAIRAAIDDYRRKNGLLPEGSENNACGRRCDDIHHGIDDED

SEQ ID NO: 55553 - protein, 229 aa, Glycine max
MVETEMDAETVANVVPPKETPNSVSISHHSSHPPLNERIISSMTRRSVAAHPWHDLEIGPGAPIIFNCVIEIGKGSKVKYELDKKSGLIKIDRVLYSSVVYPHNYGFIPRTICEDSDPLDVLIIMQEPVLPGCFLRAKAIGLMPMIDQGEKDDKIIAVCADDPEYRHYNDIKELPPHRLAEIRRFFEDYKKNENKEVAVNDFLPASAAFEAVKRSMSLYADYIVESLRR

SEQ ID NO: 55554 - protein, 533 aa, Staphylococcus aureus subsp. aureus Mu50
MLQVTDVSLRFGDRKLFEDVNIKFTEGNCYGLIGANGAGKSTFLKILSGELDSQTGHVSLGKNERLAVLKQDHYAYEDERVLDVVIKGHERLYEVMKEKDEIYMKPDFSDEDGIRAAELEGEFAEMNGWNAEADAANLLSGLGIDPTLHDKKMAELENNQKIKVLLAQSLFGEPDVLLLDEPTNGLDIPAISWLEDFLINFDNTVIVVSHDRHFLNNVCTHIADLDFGKIKVYVGNYDFWYQSSQLAQKMAQEQNKKKEEKMKELQDFIARFSANASKSKQATSRKKQLEKIELDDIQPSSRRYPFVKFTPEREIGNDLLIVQNLSKTIDGEKVLDNVSFTMNPNDKAILIGDSEIAKTTLLKILAGEMEPDEGSFKWGVTTSLSYFPKDNSEFFEGVNMNLVDWLRQYAPEDEQTETFLRGFLGRMLFSGEEVKKKASVLSGGEKVRCMLSKMMLSSANVLLLDEPTNHLDLESITAVNDGLKSFKGSIIFTSYDFEFINTIANRVIDLNKQGGVSKEIPYEEYLQEIGVLK

SEQ ID NO: 55555 - protein, 401 aa, Staphylococcus aureus subsp. aureus Mu50
MVTRSVLKFGGSSVSDFTKIKRIAEMLKERVNQDEQLIVVVSAMGNTTDQLMTNVSTLTKAPKQQELALLLTTGEQQTVSYLSMVLNDIGVNAKAMTGYQAGIKTIGHHLKSKIAQINPQTFEQAFQENDILVVAGFQGINEHQELTTLGRGGSDTTAVALAVSNQIPCEIYTDVDGVYATDPRLLPKAKRLDIVSYEEMMEMSALGAGVLETRSVELAKNYNIPLYLGKTLSNVKGTWIMSNEEILEKKAVTGVALDKHMMHVTISYPLPDNQLLTQLFTELEEGAVNVDMISQIVNLDGLQLSFTIKDSDFHQISMILETLKNQYEALAYKINEHYVKISLIGSGMRDMSGVASKAFLTLIENNIPFYQTTTSEISISYVIDDFNGQQAVEKLYDAFNI

SEQ ID NO: 55556 - protein, 268 aa, Cytophaga hutchinsonii ATCC 33406
MKIAILGGGNMGMTYAKAFVSRKIVSKDELLIIEKHDEKREQLKQEGVASLSADIDDSIKNYDILIVAVKPQDFRVLSETLKKYLTENQMILSIMAGIQIAQIQTLLEHKNVVRAMPNTPAQLGFGITAFTVAKDASFENISVVDMLLETTGKAIFMKDETMLDAVTALSGSGPAYFYYIVQNMIEAGKQMGVDENVAGMLVKETMMGAFQILNHSKSSIDELIAMVASKGGTTEAALNTLKQREVGAHIIEALKNAEKRAKELSGNA

SEQ ID NO: 55557 - protein, 507 aa, Zea mays
MSGGSSPSSRRNSFNSLSKDLDLPSEQGCLSIVVLGASGDLAKKKTFPALYHLFEQGFIQSGEVHIFGYARSNLSDDGLRERIRGYLKGAPEDLSEFLQLIKYVSGSYDTGEGFEKLNRAISEYEVSKSSGSYRRLFYLALPPSVYPSVCKMIRTYCMNPSSHPGWTRVIVEKPFGKDLDSAEELSAQLGELFEEHQLYRIDHYLGKELVQNLLVLRFANRLFLPLWNRDNIDNIQIVFREDFGTEGRGGYFDQYGIIRDIIQNHLLQVFCLVAMEKPVSLKPEHIRDEKVKVLQSVNPIKPEEVVLGQYDGYKDDPTVPDDSNTPTFASVVLRVHNERWEGVPFILKAGKALSSKKAEVRVQFKDVPGDIFRSKKQGRNEFVIRLQPSEAMYMKLTVKKPGLEMATEQSELDLSYGMRYQNVKIPEAYERLILDTIRGDQQHFVRRDELQAAWKIFTPLLHDIDDGKLKALPYEPGSRGPKEADELSARVGYVQTHGYIWVPPTLA

SEQ ID NO: 55558 - protein, 97 aa, Picea abies
TGGGPGLDQKTIDSYPKILFSRHQKLPLTCQDTWCSICLGEYEYKEVLRLMPDCRHCFHASCIDAWLKLNASCPLCRTSPLPSPLPTPLSGLIPLAR

SEQ ID NO: 55559 - protein, 107 aa, Glycine max
FLGASGGSYTDPTGRTDIEMMRFCQNFMSQMYPFLGPDTDLFYEEMSISTREMVYLPAQYGLVARHAQGCYTRPRIFWSVSTLLPQATGYGLVINVKLMLADMTKEL

SEQ ID NO: 55560 - protein, 180 aa, Pseudanabaena sp. PCC 6903
MDLSRIPPQPKAGILNVLIEIPAGSKNKYEFDKDLNAFALDRVLYSSVQYPYDYGFVPITNNLADDGDPLDGMVIMVPPTFPGVATARPIGMLQMVDGGDRDEKFLCVPAKDPRYTYVKSANDLAGHRLDEIFEFFRSYKNLFKKPTEFFGWKGDVAGLPLVEECVKNYYKTYCKNDHGK

SEQ ID NO: 55561 - protein, 393 aa, Prochlorococcus marinus subsp. marinus str. CCMP1375
MSNLDVISERALSLKPSLTLEISSLAQSLKQKGRDICSLSAGEPDFDTPNFIVEAAKKALDDGITKYGPAGGDPSLREEVAKKLTEINDVPTSPENVLITNGGKQAIFNLLQVIINPGDEVLIPSPYWLSYPEITKIAGGIPITINSSKGNSFSLDIEEIEKNINHKTKLLILNSPCNPTGRIIQESELQSIANLLRKHPNIYVMSDEIYEFLITDKEVHISLASIAPDLKDKIFIVNGFAKAWAMTGWRVGYLQGSSKIIKKAIALQSQSTSNVCSFAQRGALAAIKGAPKGIDYMIQSYNERRKLLTEELRQISSLSLEAQSGAFYAFPKLSDELPDSLSFCKIALEKEGLAIVPGIAFGNDRCIRLSCSVNTETLNDGITRLNRIIKDIT

SEQ ID NO: 55562 - protein, 81 aa, Zea mays
  misc_feature (41)..(41): Xaa can be any naturally occurring amino acid
  misc_feature (50)..(50): Xaa can be any naturally occurring amino acid
VIFDFPKPGIMFQDITTLLLDPKASRDTMDLFVERYMHQRXTVVAGVEAXGGIFGSPIALAIGAKYVPLREPRWLPGEVIY

SEQ ID NO: 55563 - protein, 382 aa, Oryza sativa Japonica Group
MAFFVKISAPCSLAGHGTTSSSSGSSRSKRGLLLPVGAGAGAGAYGGRQYSDVVPVPALSQAQASSSGGRLRIFSGTANPRLAQEVACYLGMELGRVKIKRFADGELYVQLQESVRGCDVFLVQPTCPPANENLMELLIMIDACRRASAKTITAVVPYFGYARADRKMRGGRESIAAKLVANLITEAGAHRVLACDLHSGQSIGYFDIPVDHVYGQPVILDYLASKTICPDEVVVVSPDVGGVARARTFAKKLSDAPLAIVDKRRQGHNQSEVVHLIGDVRGKVAVMVDDMIDTAGTVSQGAELLHREGARAVYACSTHAVLSPPAVDRLSSGLFQEVIVTNTVPVLHHRTFPQLTVLSVANLLGETIWRVHDDCSVSSIFQ

SEQ ID NO: 55564 - protein, 259 aa, Polaromonas sp. JS666
MFSRLRSDIQCILLRDPAARTAWEVLTCYPGLHALVLHRRAHWCWNHGFKWLGRFISHLSRWFTGIEIHPGAKIGERVFFDHAMGVVVGETAEIGDGCTIYQGVTLGGTSLYKGAKRHPTLGRDVVVGAGAQVLGGFTVGDGARIGSNAVVVKPVPAGATAVGNPARVIQADADVKREMAASQMGFSAYGVTQNDDPLSQAMRGLIDSAAGQEHQISMLWQAIEKLSGPQATSTRECVPKDAALHETFEADKLNQLVGK

SEQ ID NO: 55565 - protein, 419 aa, Vibrio sp. Ex25
MSVNFADLGIEQKLIETLSNLNIVTPTPVQEKSIPHVLEGKNLLAAAQTGTGKTAAFGLPIIQTVQQKKLNGTPQALVLVPTRELAQQVFDNLNQYSAQTELRIVCVYGGTSIGVQKRKLEEGADILIATPGRLLDHLFNGNVNISKTSMLVLDEADRMLDMGFWPDLQRIFRRLPAEKQILLFSATFEKRIKTIAYKLMESPVEVEVSPANTTAETVKQMVYPVDKKRKRELLAYLIGSRNWQQVLVFTKTKQGSDELAKELKLDGIKAVSINGDKSQGARQRALDEFKQGKVRALIATDVAARGLDIQELEQVVNFDMPFKAEDYVHRIGRTGRAGKSGLAVSLMSRDEEYLLHAIENLLDQRLPQEWLAGFEPTLIEEVEPEKNGSGRRRSRSSEKRKLKAKLAIHKNRGKSRNSR

SEQ ID NO: 55566 - protein, 328 aa, Polaromonas sp. JS666
MPSNLHPMLNVAIKAARAAGAIINRAALDVEAVRVSVKQTNDFVTEIDQAAEAAIIETLLTAYPGHGILAEESGSEHGAKDSEFVWIIDPLDGTTNFIHGFPVYCVSIALAVKGKIEQAVVYDPTRNDLFCATRGRGAYLNDRRIRVAKRTRLQECLISTGFPYRPGDRLKPYLNMLGEIMSQCAGVRRPGAAALDLAYVAAGYSDGFFEIGLKPWDVAAGSLLVTEAGGLIGNLTGEADFMDHGECLAGNPRIYGQMVTTLAKYSKFAGAAQKMQVAHAVERSGDRPVVDGAEEEAEPAPAADTSAASPPARTLTRARKIPAAGPKL

SEQ ID NO: 55567 - protein, 328 aa, Escherichia coli K12
MGQLIDGVWHDTWYDTKSTGGKFQRSASAFRNWLTADGAPGPTGTGGFIAEKDRYHLYVSLACPWAHRTLIMRKLKGLEPFISVSVVNPLMLENGWTFDDSFPGATGDTLYQNEFLYQLYLHADPHYSGRVTVPVLWDKKNHTIVSNESAEIIRMFNTAFDALGAKAGDYYPPALQTKIDELNGWIYDTVNNGVYKAGFATSQEAYDEAVAKVFESLARLEQILGQHRYLTGNQLTEADIRLWTTLVRFDPVYVTHFKCDKHRISDYLNLYGFLRDIYQMPGIAETVNFDHIRNHYFRSHKTINPTGIISIGPWQDLDEPHGRDVRFG

SEQ ID NO: 55568 - protein, 560 aa, Arabidopsis thaliana
MASSPALICDTEAWKDLKGHVEDIKKTHLRDLMSDANRCQSMMMEFDGLLLDYSRQRATVETMDKLLNLAKASQLTEKISRMFNGEHINSTENRSVLHVALRAPKDAVIKADGMNVVPEVWNVLDKIKEFSDKIRSGSWVGATGKPLKDVIAIGIGGSFLGPLFVHTALQTDPEALESAKGRQLRFLANIDPVDVARNISGLNPETTLVVVVSKTFTTAETMLNARTLREWITAALGASAVAKHMVAVSTNLALVEKFGIDPNNAFAFWDWVGGRYSVCSAVGVLPLSLQYGFSMVEKFLKGASSIDQHFQSTPFEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLPELTAYNVGQLLAIYEHRVAVQGFVWGINSFDQWGVELGKVLATQVRKQLHSSRTQGTAPEGFNYSTTTLLKRYLETSSEPQM

SEQ ID NO: 55569 - protein, 560 aa, Arabidopsis thaliana
MASSTALICDTEAWKDLKGHVEDIKKTHLRDLMSDANRCQSMMMEFDGLLLDYSRQRATVETMDKLLNLAKAAQLTEKISRMFNGEHINSTENRAVLHVALRAPKDAVIKADGKNVVPEVWNVLDKIKEFSDKIRSGSWVGATGKPLKDVIAIGIGGSFLGPLFVHTALQTDPEALESAKGRQLRFLANIDPVDVARNISGLNPETTLVVVVSKTFTTAETMLNARTLREWITAALGASAVAKHMVAVSTNLALVEKFGIDPNNAFAFWDWVGGRYSVCSAVGVLPLSLQYGFSMVEKFLKGASSIDQHFQSTPFEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLPELTAYNVGQLLAIYEHRVAVQGFVWGINSFDQWGVELGKVLATQVRKQLHSSRTQGTAPEGFNYSTTTLLKRYLETSSEPQM

SEQ ID NO: 55570 - protein, 486 aa, Alkaliphilus metalliredigens QYMF
MLSKEINRADIRQKSKQRHLTEETKKLIIFIVIMVGVFLSSFITPPEGLESQGLRMLFIALAAAILWMTEAIPIGVTALVIILLQALYGITPLTNGLALIAHPVNAVVLVGYLLAGALVSSGMDKRLSLTIISKMGEKTSRLMLGIMFVTAFLSMWMSNTATTAIMVPIAAGILTMAGAKPLKSNLGKALFIGIAFSANIGGMGTPTGTPANPIAIALLHSLAGIQLSFLDWMVRALPLVIVLLPVSWLVLLKVYPLEIKVVEGGLDAVKKQLKDMGPLKNTEKKVMILFSSAIFLWLLDSFIPLPKDWIYIVAVFLTIILVTPKIGFMTWKHAQGLIGWEVLFLVGGGLSMGAGLKATGTIDWIAGLLSSSLGQMPEGLAMAVITAATGLGITVFCSLSGTATTFVPIAIVLALNFGWDPIAFAVAAGLASSFAFLLPANAAPNAVAYGSGYFKTLDMFKAGAIMIIFSIVIQGVLSGFVLPFIF

SEQ ID NO: 55571 - protein, 441 aa, Alkaliphilus metalliredigens QYMF
MSGLIKPGAKSQELMALREKYVARGPYNVTPLFAESAKGARLNDVDGNELIDFAGGIGVINVGHCPEKLVNALKDQLDKFIHTCFHVAPYESYIRLAEKLAQLTPGEAPQKVMLANSGAEAVENAVKIARKYTGKQGIISFDSAFHGRTLMTMSLTSKVRPYKHGFGPFAPETYKVPYANCYRCPYNTSYPECGFACVESIEKFFASEVDPDNVAGIIAEPVQGEGGFVIPPMDYFKEIKGLCDKHGILLIADEIQTGFGRTGKLFAMEHFDVKPDLTTMSKSMAAGIPLSGVVGKAEIMDAPGAGEIGGTFAGTPLGCVASLKVLEIIEEENLLERATYIGGMIEKRFEEMKERYDIIGDVRCLGAMCAMELVKDRVTKEPAKEATGQVVTKCWQNGVIALGAGVLGNVVRILPPLVISEEDLHRGLDIMDRVIGEVNKG

SEQ ID NO: 55572 - protein, 560 aa, Arabidopsis thaliana
MAPSPALICDTEAWKDLKGHVEDIKKTHLRDLMSDVNRCQSMMMEFDGLLLDYSRQRATVETMDKLLNLAKASQLTEKISRMFNGEHINSTENRSVLHIALRAPKDAVIKADGMNVVPEVWNVLDKIKEFSDKIRSGSWVGATGKPLKDVIAIGIGGSFLGPLFVHTALQTDPEALESAKGRQLRFLANIDPVDVARSISGLNPETTLVVVVSKTFTTAETMLNARTLREWITAALGASAVAKHMVAVSTNLALVEKFGIDPNNAFAFWDWVGGRYSVCSAVGVLPLSLQYGFSMVEKFLKGASSIDQHFQSTPFEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLPELTAYNVGQLLAIYEHRVAVQGFVWGINSFDQWGVELGKVLATQVRKQLHSSRTQGTAPEGFNYSTTTLLKRYLETSSEPQM

SEQ ID NO: 55573 - protein, 351 aa, Lachancea kluyveri
MSASQIPETQKAVIFYENGGELQYKDIPVPKPKSNEILINVKYSGVCHTDLHAWKGDWPLPTKLPLVGGHEGAGVVVAIGENVKGWKIGDYAGIKWLNGSCMACEYCELSNESNCPEADLSGYTHDGSFQQYATADAVQAARIPAGTDLAEVAPVLCAGITVYKALKSANLRAGEWVAISGACGGLGSLAIQYAKAMGYRVLGIDGGDEKAALFNELGGEVFIDFTKTKDVTKAVIDATNGGAHGVINVSVSEAAIEASTVYCRANGTVVLVGLPGGAKCKSDVFNQVVKSTTIVGSYVGNRADTREALDFFARGLVKSPIKVVGLSELPSIYEKMQKGAIVGRYVVDTSK

SEQ ID NO: 55574 - protein, 475 aa, Alkaliphilus metalliredigens QYMF
MGQQDFSKSLSKKDVIALAFGAMIGWGWVVLAGQWIQAAGSLGAMLAFMLGGVMVVFVGLVYSELTCAMPQVGGEHVFAFRGIGTGASFIATWAIILGYVSVVAFEAVALPTVIEYLVPNYKMGYLWTISGYDVYLTWVLVGMMGTIFVGYINYLGVQPVAFMQSVFTALIAIVGILFMGGALFNGSTELMDPLFIDGSKGIFAVLVMTPLMFVGFNVIPQAVEEINLPYNEIGKVLILSVVMAVAWYVLIIWGVGRSLTPAQMANSTLSTADAMTAVFRTDWGGKILVLGGIGGILTSWNAFYVGGSRAIYAMAKSKMLPGFLGQLHPKYKTPTNAIILIGIVSCFAPLLGRPMLVWLVDAGGLAIVVAYLLVSIAFVSLRKNEPDMPRPFKVNSGMFVGYTSIVLSIGFLILFLPGMPAALVWPYEWIMVGGWAALGAIFYYKAKKDYGQDAAHKYMTNSLDTLIGKKGESKI

SEQ ID NO: 55575 - protein, 155 aa, Nocardia farcinica IFM 10152
MRVGIGSDVHPIEPGRPCWMAGLLFEGEDGCSGHSDGDVAAHALCDALLSAAGLGDVGAVFGTGRPEWADVSGAAMLTEVRRLLGEAGFEVVNAAVQVIGNRPKIGPRRAEAQRVLGDLLDAPVSVSGTTTDGLGLTGRGEGIAAVATALLRPRV

SEQ ID NO: 55576 - protein, 190 aa, Vitis vinifera
MESGAAPTEAAKQPHRLERKWTFWFDNQSKPKQGAAWGTSLRKAYTFETVEEFWCLYDQIFKPSKLPANADFHLFKAGVEPKWEDPECANGGKWTVASSRKGNLDTMWLETLMALIGEQFDEADEICGVVASVRQRQDKLALWTKTATNEAAQMSIGRKWKEVIDVTDKITYSFHDDSRRERSVKVRYNV

SEQ ID NO: 55577 - protein, 373 aa, Lachancea kluyveri
MLRLSTRASLTARPFFQGSFRTMATASIPEKQKGIIFYENGGELKYEDIPVPKPKPNELLINVKYSGVCHTDLHAWKGDWPLPTKLPLVGGHEGAGVVVAMGENVKGWKIGDLAGIKWLNGSCLSCEYCEKSNESNCPHADLSGYTHDGSFQQYATADYVQAARIPEGTDLAEVSPILCAGVTVYKALKSANLKAGDWVAISGAAGGLGSLAVQYAKAMGYRVLGIDGGAEKGELVKKLGGEVFIDFTKHKNLVEAVQEATNGGPHGVINVSVSEAAMTASTQFVRPTGTVVLVGLPAGAVIKSEVFSHVVKSINIKGSYVGNRADTREAVDFFVRGMVKSPIHVVGLSELPKVYELMEKGKILGRYVVDTAK

SEQ ID NO: 55578 - protein, 377 aa, Lachancea kluyveri
MFRLARLQNTATSARSLASSFIRFNSTVAPAIPTTQKGVIFYESGGKLEYKDIPVPKPKPNEILINVKYSGVCHTDLHAWKGDWPLPTKLPLVGGHEGAGVVVAKGENVMNFEIGDLAGIKWLNGSCMACELCEQGHESNCLHADLSGYTHDGSFQQYATADAVQAAQIPKGTDLAEVAPILCAGVTVYKALKTADLRPGQWVAISGAAGGLGSLAVQYAKAMGLRILGIDGGPGKEELFKSLGGEVFIDFTKTKDIVSAIQEATKGGPHGVINVSVSEAAISTSTQYVRPTGTVVLVGLPANAYVKSEVFSHVVKSINIKGSYVGNRADTREALDFFTRGLVKSPIKIVGLSELPEVYGLMEKGKILGRYVVDTAK

SEQ ID NO: 55579 - protein, 560 aa, Vitis vinifera
MVLQLKTYSNLLANASGEDQANGVSDSSQFDIASSPNGEVKISLILNTSQQSGCHIPNLDAVSKALEDKCRGTYGITEPSFSVMKLMQEFCEYFLAIGADSTDDEKLKTMETSSTLDILKEPAAQDVLGRGDHKGKFCIPSSSSNGSVKCQNLVEVGQKIPRPIYMNGLDILRCTLTSNKVNKSCYIERDENLKVLRGPESLNSCGIVAVQKHCFSVDTVKPLQYFDDITKGEEMVKISLVNGTSSQLPPNFFYIPQNIVFQKAYVNFALARISDEDCCSNCFGDCTSLAIPCACARETGGEFAYQQGGLVKEKFLEECISMNRDPQNHRLFYCKNCPLERSRNENTSNPCKGHLVRKFIKECWCKCGCSKKCGNRVVQRGITVNLQVFLTPEGKGWGLRTLENLPKGAFVCEYVGEIVTNTELYERNLRSTGKERHTYPVLLDADWGSEGVLKDEEALCLDATFYGNVARFINHRCFDANLVEIPVEVETPDHHYYHLAFFTTRKVDALEELTWDYGIDFDDHNHPVKAFRCCCESKGCRDTRNSKRHGVKRRKMEMKA

SEQ ID NO: 55580 - protein, 249 aa, Legionella pneumophila str. Lens
MRQKIVAGNWKMNGQIQQVTELVSQIEKLIGFDCAAQVAVMPPSIYIPKVRDCLRTGKIVVGAQNVYPKDYGAYTGELSAPMLKDFDCRYVLVGHSERRQFFHEDENFVAQKFHHVKDHGMIPVLCVGETLSERENGKTEQVIAQQVLAVSAKGKDCFRDCVVAYEPVWAIGTGKTATPEQAQKIHQFIRDLVGEINDSDAKHLTLIYGGSVNENNAKALFSMPDIDGGLVGGASLNAKQFVEIVKCIN

SEQ ID NO: 55581 - protein, 333 aa, Nitrosospira sp. KAN8
MTIKVGINGFGRIGRMVFRAAVQNFPDIEVVAINDLLEPDYLAYVLQHDSVHGRFKGDVSIEDSTLIVNGKRIRLTAIKDPAELKWGEVGAEVVVESTGLFLTKESCQKHIAAGARKVIMSAPSKDDTPMFVYGVNNDTYDGEAIISNASCTTNCLAPVAKVLNDTFGVKRGLMTTVHAATATQKTVDGPSNKDWRGGRGILENIIPSSTGAAKAVGKVIPELNTKLTGMAFRVPTSDVSVVDLTVELEKEASYDEICDAMKKASEGSMKGVLAYTDQKVVSTDFRGESATSIFDAEAGMALDGNFVKVVSWYDNEWGYSSKILEMVRVVAGK

SEQ ID NO: 55582 - protein, 335 aa, Nitrosomonas sp. CNS332
MAIRVGINGFGRIGRMVFRASIEEFDDIEVVAINDLLEPDYLAYMLLHDSVHGRFKGDVSVDGNNLIVNGKKIRLTATKDPEELNWGEVKVDVVVESTGLFLTKELCEKHIKAGAPKVVMTAPSKDDTPMYVYGVNDKTYQGEAIISNASYTTNCLAPIAKVLNDTWGIKRGLMTTVHAATATQKTVDGPSNKDWRGGRGILENTIPSSTGAAKAVGVVIPELNKKLTGMAFRVPTSDVSVVDLTVELEKDASYDEIRKAMKTASEGSMKGVLGYTDQKVVSTDFRGETHTSVFDAEAGIQLDKNFVKVVAWYDNEWGYSCKVLEMVRVIAGRNN

SEQ ID NO: 55583 - protein, 335 aa, Nitrosomonas sp. OZK11
MTIRVGINGFGRIGRMVFRASIEEFDDIEVVAINDLLEPDYLAYMLVHDSVHGRFRGDVSVSGNNLVVNGKPIRLTAVKDPAELKWDEVNVDVVVESTGLFLTKQDCEKHIKAGARKVVMSAPSKDDTPMYVYGVNDKTYQGEAIISNASCTTNCLAPIAKVLNDTWGIKRGLMTTVHAATATQKTVVAPSNKDWRGGRGILENIIPSSTGAAKAVGVVIPELNKKLTGMAFRVPTSDVSVVDLTVELEKDASYEDICNAMKAASGGSMKGVLGYTNQKVVSTDFRGETCTSVFDAEAGIQLDKNFVKVVAWYDNEWGYSCKVLEMVRVIAGHGR

SEQ ID NO: 55584 - protein, 175 aa, Triticum aestivum
  misc_feature (90)..(90): Xaa can be any naturally occurring amino acid
MGPTVMASSVTSVAPFQGFKSTAGLPVSRRSNGASLGSVSNGGRIRCMQVWPIKGIKKFEILSYLPPVSTEALLKQVDYLIRSKWVPCLXFSKVGFIFREHNASPGYYDGRYWTMWKLPMFGCTDATQVINEVEEVKKEYPDAYVRIIGFDNMRQVQCVRFIAFKPPGCKESGKA

SEQ ID NO: 55585 - protein, 194 aa, Streptomyces viridosporus
MGASSLQGEPVLTVGDKFPEFELTACVSLEKGKEFETINHKTYEGKWKIVFAWPKDFTFVCPTEIAAFGKLNDEFADRDAQILGFSGDSEFVHHAWRKDHDDLRDLPFPMMADSKHELMRALGIEGEDGFAKRAVFIVDQNNEIQFTMVTAGSVGRNPKEVLRVLDALQTDELCPCNWTKGDETLDPVALLAGE

SEQ ID NO: 55586 - protein, 645 aa, Psychrobacter arcticus 273-4
MSAPYSYSHQTQAPTYKTLKSAALVISSTLLLSVSAHAVDTNTAVAPKTINSTSINTSAINLAVMTENPTVLSETKRITRAKTNTLTPKTTQAKTDQAIYSVDAIHHPVWAKNGMVATQEALASDIGLKILKDGGNAVDAAVAVGFALAVTLPRAGNIGGGGFMMVYDAKQGKTVALDYREKAPSSASRDMYLDKDGNAVSDLSRYHGLAVGVPGTVAGLLKALEDHGTMSRGQVMAPAIALAENGIEVTAGLSESLEALSDRLQKWPSTKKIFFKADGSAYQPGEHLKQPELAHSLKLIAAKGADGFYKGETARKLVKAINEAGGKMSLQDLANYQAIARTPVKGDYRGYEIVSMPPPSSGGIHIVQILNILEGYPLRDYGQNSAQTIHLMAEAMQLAYADRSEYLGDSDFIDVPASGLTAKPYADKLRALINPNKATPAATIKANNPLPYESDQTTHFSIVDKDGNAVANTYTLNFSYGTGLVADGTGILLNNEMDDFSAKPGVPNGYGLIGGDANAIEANKRPLSSMSPTLVFKDSKPYIVTGSPGGSRIITTVTQVISNVIDHDMNIAEATHAPRIHDQWLPDEIRIEKALNIDTIKKLESMGHKVSSQSAMGSTQSIMITPNGIYGASDPRIVDAAVVGY

SEQ ID NO: 55587 - protein, 130 aa, Brassica napus
  misc_feature (3)..(5): Xaa can be any naturally occurring amino acid
  misc_feature (9)..(9): Xaa can be any naturally occurring amino acid
  misc_feature (12)..(12): Xaa can be any naturally occurring amino acid
  misc_feature (14)..(15): Xaa can be any naturally occurring amino acid
  misc_feature (17)..(17): Xaa can be any naturally occurring amino acid
  misc_feature (20)..(20): Xaa can be any naturally occurring amino acid
  misc_feature (27)..(29): Xaa can be any naturally occurring amino acid
  misc_feature (33)..(34): Xaa can be any naturally occurring amino acid
  misc_feature (48)..(48): Xaa can be any naturally occurring amino acid
  misc_feature (55)..(55): Xaa can be any naturally occurring amino acid
  misc_feature (64)..(64): Xaa can be any naturally occurring amino acid
  misc_feature (76)..(76): Xaa can be any naturally occurring amino acid
  misc_feature (78)..(78): Xaa can be any naturally occurring amino acid
  misc_feature (80)..(80): Xaa can be any naturally occurring amino acid
  misc_feature (83)..(83): Xaa can be any naturally occurring amino acid
  misc_feature (85)..(85): Xaa can be any naturally occurring amino acid
  misc_feature (89)..(89): Xaa can be any naturally occurring amino acid
  misc_feature (91)..(92): Xaa can be any naturally occurring amino acid
  misc_feature (94)..(94): Xaa can be any naturally occurring amino acid
  misc_feature (96)..(97): Xaa can be any naturally occurring amino acid
  misc_feature (100)..(100): Xaa can be any naturally occurring amino acid
  misc_feature (102)..(102): Xaa can be any naturally occurring amino acid
  misc_feature (107)..(109): Xaa can be any naturally occurring amino acid
  misc_feature (111)..(111): Xaa can be any naturally occurring amino acid
  misc_feature (113)..(113): Xaa can be any naturally occurring amino acid
  misc_feature (119)..(119): Xaa can be any naturally occurring amino acid
  misc_feature (122)..(122): Xaa can be any naturally occurring amino acid
  misc_feature (124)..(124): Xaa can be any naturally occurring amino acid
MTXXXVNPXAYXLXXSXVAXTILDLVXXXTNYXXVKKAANEATKTCEXWRSLKFXVMDADVEPXEILLHLPLLAEXDXNXPYXYXPSKXAXXIXCXXTRXVXACSCXXXEXSXLKSQIXQLXDXIEKLLI

SEQ ID NO: 55588 - protein, 154 aa, Burkholderia pseudomallei K96243
MRVSDILKVKGNTLFTVTPDTPLRSAVDTMAEHDIGSLVVMEYGDLVGILTFREIILRLKANGGSIGEVLVRTVMDEPLTCTPETDIDEVRRMMLERHARYMPVLDKKVLMGVISFYDVAKTVVEAQSFENRMLKAYIRDWPEPDSEERKPLAS

SEQ ID NO: 55589 - protein, 159 aa, Streptococcus thermophilus LMG 18311
MKNDRKARLILSIFRYGKNHMEKETFYHKVNYGIYKILNAVFVIGFFGTELQASQSISNNIILFHPYGIVVSGEATLGDEVVIRQQVTIGNKGTGEGADDCPIIGDRVDIGAGAKIIGGITIGENSKIGANAVVTKSFPANSILVGVPARNIASKAMNG

SEQ ID NO: 55590 - protein, 303 aa, Psychrobacter arcticus 273-4
MSLPTALFKSLVRIKKDLKEDIDAVFNRDPAARNSLEVILTYPGIHALILHRGAHCLWQNEQKLAARVISYGSRIITGIEIHPAAKIGRRFFIDHGMGIVIGETAEIGNDVTLYHGVTLGGVSWNNGKRHPTLEDGVIVGAGAKVLGPFTVGKGAKIGSNAVVVKAVPAGATMVGSAARMISEHHDEKGNPITTKVNDTKQQEKLVPAASTENPSDKKPTNHTARETTFQAYGIDPMSQDPVAEAFAKMLEHIQQSENRLDQLQTAMCKIDPNFCKKEYDKLCLEDLDVIGRSDMNEIGAESQ

SEQ ID NO: 55591 - protein, 405 aa, Vibrio sp. Ex25
MEDALAVILAGGMGSRLSPLTDDRTKPAVPFGGKYRIIDFTLTNCLHSGLRKILVLTQYKSHSLQKHLRDGWSIFNPELGEYITAVPPQMRKGGAWYEGTADAIYHNMWLLSRNDAKYVVVLSGDHIYRMDYAAMLEEHKEKGAKLTVACMDVPVEDASAFGVMGTAENGLVTSFIEKPECPPTLPGSKTRSLVSMGIYIFDMDVLKEALEDDSKLDSSSHDFGKDIIPKLIDTESVYAYQFCGSKGRVDKDCYWRDVGTIDSFYEANMDLLEPVPPMNLYQSNWAIRTYEPQFPPARTVSSATGNEGIFINSIIATGVINSGGSVQHSIISSNVRIQDSATVVDSIIFDDVEVGEGSQLVNCIVDKHVRIPPHTQIGINKLEDAKRFKISDKGIVVIPESYQFD

SEQ ID NO: 55592 - protein, 220 aa, Hyphomonas neptunium ATCC 15444
MDAAAAPEFTEEALEAGRLLFAGKAEFVMGVVSLSGLPPADRSEVCFAGRSNVGKSSLINALTGRAKLARSSAEPGRTRELNYFDIGDEGKLYLVDLPGFGYAKVSKTQTAAWTKLIKSYLRGRPSLRRVFLLVDARRGDLMDTDEEVMDLMDGAAVTYQVVLTKVDKVPKGEVEKIVVKIADKLKKRGAAHPVVRMTSAEKGFGIPELRAEIAALAMLG

SEQ ID NO: 55593 - protein, 319 aa, Avena fatua
MASAKAMGQGEQDRFVLKSGHAIPAVGLGTWRAGSDTAHSVQTAITEAGYRHVDTAAQYGIEKEVDKGLKAAMEAGIDRKDLFVTSKIWRTNLAPERARPALENTLKDLQLDYIDLYLIHWPFRLKDGAHQPPEAGEVLEFDMEGVWKEMEKLVKDGLVKDIDVCNFTVTKLNRLLRSANIPPAVCQMEMHPGWKNDKIFEACKKHGIHVTAYSPLGSSEKNLVHDPVVEKVANKLNKTPGQVLIKWALQRGTSVIPKSSKDERIKENIQAFGWEIPEDDFQVLCSIKDEKRVLTGEELFVNKTHGPYKSASEVWDHEN

SEQ ID NO: 55594 - protein, 315 aa, Hyphomonas neptunium ATCC 15444
MKLDLLCVGLTTLDVVGRPITEIPQNEGGRLIEQIACAPAGTAAGAACVAARLGLKAGVAGAIGSDLTGKFVRFALEDGGVDTSLLQTLEGYPTSTTILPIDHQGRRPTLHAPGAGSVPPLTDALVAAASHVRCLHYAAIGAPTFDGGSGEKLLEAAKAGGAVVTCDLIAPRPDAKEELKRILSHVDWFLPSADEARFLTGIDDLQSAADAFVAMGAKNCVIKDGGRGAVMAAGKLRGRVAAFKVDVVDTTTCGDSFCAGFITAHLKGWDDLDALTFAAATAAMVAQGLATYGKLESFDQVEAAMKTLPIQEAGA

SEQ ID NO: 55595 - protein, 613 aa, Acinetobacter sp. ADP1
MSEEAHSISLLAPVVLLTAAVIAVPLFKRIGLGSVLGYLIAGLVIGPFGLAFFSDSASILHIAELGIVMYLFIIGLEMQPSHLWGLRREIFGLGTFQIVVCALGLTATGMLFGFSWQIAFIAAAGFVLTSTAIVMQLLGDRGDITQPRGQKIVAILLFEDLLIVPLLAIVAFMAPNQVVESTTSRFENIGIGLLAIAGLIAAGFWLLNPLFRLLAASKAREVMTAAALLVVLGAALLMQVSGLSMAMGAFLAGVLLSESTFRHQIEADIEPFRGILLGLFFLGVGMSLDLKVVAQNWPLILSSVVAFMFVKALMIYIVARTTKSSHQEALDRALLMAQGGEFAFVLFAAATSAQVIDSTIKSNLTAIVVLSMVLTPIIGILFGRFTKSSKQVSLENVDIAENLKGNVLLIGFGRFGQVASQLLLARGVDVTIIDTDIDMIQNAEKFGFKIYYGDGSRLDILHASGADQAEAILVCVDQKEMTNKIVDLVQHEFPLAKLLVRSYDREHSLYLVKQNVDYIMRETFESAIKFGGAVLEELGVDEQEIRQITREIRERDEERYETEIAADDVYAGGGLQYTNQHPRPTAPLIQPKQSAKILNDKDTQDLLDKDEQP

SEQ ID NO: 55596 - protein, 170 aa, Helicobacter pylori
GSGMHTHVSIWKNNENLFSGETYKGLSELALHFLGGVLRHARGLAAFTNASTNSYKRLIPGYEAPSILTYSANNRSASVRIPYGISKNSARFEFRFPDSSSNPYLAFGAILMAGMDGVKNKMDPGEAMDINLFKLTLDEIREKGIKQMPHTLRRSLEEMLADKQYLKEGQ

SEQ ID NO: 55597 - protein, 185 aa, Hyphomonas neptunium ATCC 15444
MLGIGQKLPDFQITGVKPKFMQHEQNGESAFEPLNQDSFPGLWKVIFFYPKDFTFVCPTEIAEFARLAPEFADRDAVILGGSTDNEFVKLAWRREHADLRELPIWQFADTNGSLVDGLGVREEGAGVAYRATYIVDPHNVIQHVYVTNLNVGRNPQDTLRVLDALQTDELCPCNRPVGGKTLELA

SEQ ID NO: 55598 - protein, 559 aa, Arabidopsis thaliana
MASSTALICDTEAWKDLKGHVEDIKKTHLRDLMSDANRCQSMMMEFDGLLLDYSRQRATVETMDKLLNLAKASQLTEKISRMFNGEHINSTENRSVLHVALRAPKDAVIKADGMNVVPEVWNVLDKIKEFSDKIRSGSWVGATGKPLKDVIAIGIGGSFLGPLFVHTALQTDPEALESAKGRQLRFLANIDPVDVARNISGLNPETTLVVVVSKTFTTAETMLNARTLREWITAALGASAVAKHMVAVSTNLALVEKFGIDPNNAFAFWDWVGGRYSVCSAVGVLPLSLQYGFSTVEKFLKGASSIDQHFQSTPFEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGIVKSQQPVYLKGEVSNHDELMSNFFAQPDALAYGKTPEQLQKENVSENLIPHKTFSGNRPSLSLLLPELTAYNVGQLLAIYEHRVAVQGFVWGINSFDQWGVELGKVLATQVRKQLHSSRTQGTAPEGFNYSTTTLLKRYLETSSEPQM

SEQ ID NO: 55599 - protein, 208 aa, Glycine max
RCCVREREMATSEEVVAAAPEAAAPEAGLKHKLERKWTFWCDNQSKPKQGAAWGTSLRKVYTFDTVEEFWCLYDQVFKPSKLQINADFHLFKTGIDPKWEDPECANGGKWSITSNSGRKANLDNMWLETMMALIGEQFEDAEDICGVVASVRQWQDKLSLWTKTAANEAAQMSIGRKWKEIIDVNDKITYNFHDDSRSKGATKGRYTV

SEQ ID NO: 55600 - protein, 482 aa, Acinetobacter sp. ADP1
MIQESLQYLLKHPDISFTAPTSGAVIEVNDAAKGTPLAWVKSHDRSGVEAAIQRSAQAQAKWKTQTALQRADVLWAWFHLINEHKENLAQILTAEQGKPLAEARGEIGYAASFIRWFAEQARRIDGEILPPTMAHQRLLVIKQAIGVTAAITPWNFPAAMITRKAAPAIAAGCSMLVKPAELTPLTAYALEVLALQAGLPQDILINISGDSVEVGKTLCESDVVRKLSFTGSTPVGRILMQQSAPSIKKLSLELGGNAPVLVFDDANLDQAVQGIMASKFRNSGQTCVCANRIYVQSGIYDALTTKLVDAVKALKVGDGREEGVTQGPLIDARAVAKVQSHIEDATSKGATLQTGGQLAAQGGTFFEPTVLSGVTQEMRVAKEETFGPLAALFRFETEEQAIAMANDTEFGLAAYLFTQSTARQWRVGEALEYGMVGVNTGAISNEVAPFGGVKQSGLGREGSQHGIEEYLEMKYLCVDLSE

SEQ ID NO: 55601 - protein, 183 aa, Salmonella enterica subsp. arizonae serovar 62:z4,z23:--
MTATAQQLEFLKNSIKSIQDYPKPGILFRDVTSLLEDPKAYTLSIELLVERYKKAGITKVVGTEARGFLFGAPVALGLGVGFVPVRKPRKLPRETIAETYELEYGTDQLEIHVDAIKPGDNVLVVDDLLATGGTIEATVKLIRRLGGKVTDAAFIINLFDLGGEQRLEKQGITCYSLVPFPGH

SEQ ID NO: 55602 - protein, 170 aa, Helicobacter pylori
GSGMHTHVSIWKNNENLFGGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKEGQ

SEQ ID NO: 55603 - protein, 348 aa, Saccharomyces pastorianus
MSIPKTQKGVIFYESHGKLEYKDIPVPKPKANELLINVKYSGVCHTDLHAWHGDWPLPTKLPLVGGHEGAGVVVAMGENVKGWNIGDFAGIKWLNGSCMACEYCELGNESNCPHADLSGYTHDGSFQQYATADAVQAAHVAPGTDLAEVAPVLCAGITVYKALKSANLMAGHWVAISGAAGGLGSLAVQYAKAMGYRVIGIDGGEGKEELFRSIGGEVFVDFTKEKDIVGAVLKATNGGAHGVINVSVSEAAIEASTRYVRANGTTVLVGMPANAKCCSDVFNQVVKSISIVGSYVGNRADTREALDFFSRGLVKSPIKVVGLSTLPEIYEKMEKGQIVGRYVVDTSK

SEQ ID NO: 55604 - protein, 633 aa, Vitis vinifera
MENKFVNGPKDGQVKEDMLNSLGEDRESAQGNDLDFSESKSKRLARKGRSEQAVILNVKKLQSRGSVKVESFTHGLNNRMPKHIMSLDERYLRRCLELIHISASKAAPCNISLNLSSLKMGIFSDTLNLPKFRGRNTCDMSKLVIECPVATGTGDVVVSPAGQWVVGTLMGSKSMMKILKSPLFRQFGALEDDVKFGGTSLIDAKGAMCTDFISSPGGLSIRSPQNLPKGNISQGNHRYGPEAVHKRLISTSSTNSTCSDQSPSSGFATVSQGMLQCTWKGGIPHFVFSVDDQREVYVANQWKAELPDDKALDCMYLFHSRTGGQKEHKIPDNKADLVGKMKVSSSFTLCPNDSKIMETEFVFFGGRENYASKMQTSSSIIRKNKGLSKKVVEVFRTSHSSKQRTTSKFGGTTAILENDSWEQCQDTCNNPSALGRTNLLENDLPPNLELAAIVVKDHLPGKRQEAEVGGWGLKFLKKVGLKQNSASLEASLPSECCLRSTGDCSTSMDILVPAGIHGGPRTRNGGPSSLIERWRSGGHCDCGGWDIGCPLTVLKTRATKEEFSHHTDIQEEYKSFDLFAQGSELSAPILRVVNVHDGLYFIHFRSMLSALQSFSIAVAIIHTRSPILRPKTV

SEQ ID NO: 55605 - protein, 170 aa, Helicobacter pylori
GSGMHTHVSVWKNNENLFGGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKESQ

SEQ ID NO: 55606 - protein, 476 aa, Azoarcus sp. BH72
MNVPRRLGKYEILGVLGKGGMGTVYKAHDPVIDRTVALKTIRRELLDGGSGESMVERFRNEARAAGRLNHPGIVAIYDFGEDADVAYIAMEYVDGCGLGQFMKQDARMPVGDVVSIMVQLLEALEYVHLRGVIHRDIKAANLLITAAGKLKITDFGIARIDTANLTQVGAIVGTPTAMAPEQFLGLGIDHRADLFASGVVFYELLTGRRPFSGPIEAMAYQVCNVVQAPPSAQVAGLAPAFDAIAAKALAKRADDRYADAACFRLALSEAYEQAFRAPPRAAVSEETVVMTAEAVRASLAALQAKADTPTSTALPATGATATPTQWQEDTLKTVERQLAAYIGPLARVIVRKAATDAADLGELYTRLADKLDTDEARKGFRAGLTRLGLQAVPAPAAPATTATPAPTATVPREIGAADLERAGKALARALGPIASVLVKKAARDAADLAALHAALAAQIDDPAARARFLAELGPAR

SEQ ID NO: 55607 - protein, 170 aa, Helicobacter pylori
GSGMHTHVSIWKNNENLFGGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKEGQ

SEQ ID NO: 55608 - protein, 463 aa, Zea mays
ARSFQHHKLHTALLSPLPAPPPSMPSASLRLAVVGAGAAGLVAARELRREGHAPVVFERAAAVGGTWLYTPPATSSDPLGAAATHSSLYASLRTNLPRETMGFLDFPFAAGAAGSRDPRRFPGHEEVLRYLEAFARRFDLLRLVRFETEVLSVRREDGGRWAVTSRKLGDKGSGEEEFYDAVVVCNGHYTEPRLAVIPGVDAWPGKQMHSHNYRVPEPFLDQVVIIIGASASAVDISRDIASMAEEVHIADRSAPASTCNKQPGYDNLWLHSMIDHAQEDGTVVFQDGSSIKADVIMHCTGYLYDFPFLGDDSTITVDDNRVDPLYKHIFPPEVAPHLSFIGLPWKVIPFPLFELQSKWVARVLSGRINLPSEDRMMEDVKAFYLKLEAHGWPKRYTHNFANYQFEYDDWLAEQCGHPPVEEWRKQMYAVTSMNKAARPESYRDEWDDEHLVAEANEYFKKFL

SEQ ID NO: 55609 - protein, 348 aa, Saccharomyces pastorianus
MSIPETQKAIIFYESNGKLEYKDIPVPKPKANELLINVKYSGVCHTDLHAWHGDWPLPVKLPLVGGHEGAGVVVGMGENVKGWKIGDYAGIKWLNGSCMACEYCELGNESNCPHADLSGYTHDGSFQEYATADAVQAAHIPQGTDLAEVAPVLCAGITVYKALKSANLRAGHWVAISGAAGGLGSLAVQYAKAMGYRVLGIDGGPGKEELFTSLGGEVFIDFTKEKDIVSAVVKATNGGAHGIINVSVSEAAIEASTRYCRANGTVVLVGLPAGAKCSSDVFNHVVKSISIVGSYVGNRADTREALDFFARGLVKSPIKVVGLSSLPEIYEKMEKGQIAGRYVVDTSK

SEQ ID NO: 55610 - protein, 538 aa, Caragana korshinskii
MAFEIVSKLQNLSTSDHASVVSMNLFVALLCACIVVGHLLEENRWMNESITALLIGLCTGIIILLFSGGKSSHILVFSEDLFFIYLLPPIIFNAGFQVKKKQFFVNFITIVSFGAIGTLVSCVIITLGVMYAFKRMDIGPLELGDYLAIGAIFAATDSVCTLQVLNQDETPLLYSLVFGEGVVNDATSVVLFNAIQSFDLNRLNSLIALHFLGNFLYLFIASTLLGVLTGLFSAYVIKKLYIGRHSTDREVALMMLMAYLSYMLAELSYLSGILTVFFCGIVMSHYTWHNVTESSRITTKHAFATLSFVAEIFIFLYVGMDALDIEKWKFVSDSPGTSVAASSVLLGLVLLGRAAFVFPLSFLSNLTKKSPYEKISFRQQVIIWWAGLMRGAVSMALAYNQFTMSGHTQLRCNAIMITSTITVVLFSTVVFGLMTKPLIRLLLPHPKATNSMTTTESSTPKSAIVPLLGSAQDSEADLDGHEIHRPSSIRALLSTPTHTVHRLWRRFDDSFMRPVFGGRGFVPVEPGSPSERNGHQWR

SEQ ID NO: 55611 - protein, 375 aa, Saccharomyces pastorianus
MLRTSTLLTRRVHPSLFSRNILRLQSTAAIPKTQKGVIFYENNGKLHYKDIPVPQPKPNEILINVKYSGVCHTDLHAWHGDWPLAVKLPLVGGHEGAGVVVKLGSNVKGWKVGDLAGIKWLNGSCMTCEFCESGHESNCPEADLSGYTHDGSFQQFATADAIQAAKIQPGTDLAEVAPILCAGVTVYKALKEANLKAGDWVAISGAAGGLGSLAVQYATAMGYRVLGIDAGEEKEKLFKRLGGEVFIDFTKTKDMVSDIQEATKGGPHGVINVSVSEAAISLSTEYVRPTGTVVLVGLPANSYVKSEVFSHVVKSINIKGSYVGNRADTREALDFFTRGLIKSPIKIVGLSELPKVYDLMEQGKILGRYVVDTNK

SEQ ID NO: 55612 - protein, 799 aa, Oryza sativa Japonica Group
MPRKVVSGPDYDDEYDDDYDEYDEDYDDYGETGHSDDIQHPVKEEKESSKKSSSTVPVLWRCSMCMFDNHESMVYCEMCGVFRESFMKSAKDGSIKVHGIPSDFGTPSMPKSDCTKMPVNTRTTDFDGDPEIKNASISHEKVGSTQYTSAGSSSGAGKKVKHIALPEDVPVERTAQLISDHFQLKEDQSSRASSSAQNEDVAQKLSSDIQKLGLEKNEVDTAKPYLPEEYKPEKWMFANEESGVLSQLNLAIVGHVDSGKSTLSGRLLHLLGRISKKDMHKNEKEAKEKGKGSFAYAWAMDESSEERERGVTMTVAVAYLETKKYRVVLLDSPGHKDFVPNMISGATQADAAILVVDACTGSFEAGMDGEGGKSVGQTKEHAQLIRSFGVEQLIVAVNKMDAIGYSKERFEFIKVQLGSFLRSCNFKDSSVTWIPLSAVENQNLIKIPSDVRLTSWYQGFCLLDAIDSLQLPSRDVSKPLILPICDVIKSQSTGQFAAFGKLETGAIRIGSKVLISPCGEVAAVKSIERDSNSCDIARAGDNVAVSLQGIDGSKLILGGILCNPGFPVPVSNFLELRVLVLDVTIPILIGYQVEFHIHHVKEAARVTKIVALLDKAGKPSKTAPRFLKSKQNAVVQVTLDAPVCVQEFSKCRALGRAFLRSSGSTIAVGVVTRPCFGAHIVADSKRDIKDPEHPYSLEELNVVTEDSVEINDELSHVRVTFTPTVERCSMATVIGLCLRVKLMRSLPPRYKVDIRVAPGSHATETAVNKQLNDKERVAAALENPNLLDIVEECLSPTFA

SEQ ID NO: 55613 - protein, 333 aa, Nitrosospira sp. GS832
MTIKVGINGFGRIGRMVFRAAVQNFPDIEVVAINDLPEPDYLAYMLQHDSVHGRFKGDVSIDGDTLVVNGKRIRLTAIKDPSELRWGEVGAEVVIESTGLFLTEETCQKHIAAGAGKVIMSAPSKDDTPMFVYGVNDNTYDGQSIISNASCTTNCLAPIAKVLNDTWGIKRGLMTTVHAATATQKTVDGPSNKDWRGGRGILENIIPSSTGAAKAVGKVIPELNTKLTGMAFRVPTSDVSVVDLTVELEKEASYEEICDAMKKASEGSMKGVLAYTDQKVVSTDFRGESATSIFDAEAGMALDGNFVKVVSWYDNEWGYSSKILEMVRVVASK

SEQ ID NO: 55614 - protein, 375 aa, Torenia fournieri
MVSPASPSPARVELLSNSGIKAIPKEYVRTEEELRSITDIFSKEDGAKNIDSPDLPIIDLSKIDSSDEETRKKGHEELKEAAIEWGVMHLINHGISDELINRVKKAGGEFFDLPVEEKEKYANDQSSGNVQGYGSKLANNAGGILEWEDYFFHCVYPEEKRDMAIWPKDPQDYIPATTEYAKEIRSLTTKILSVLSLGLGLDQDRLEKEVGGKDDLTLQMKINYYPKCPQPELALGVEAHTDVSALTFILHNMVPGLQVLYKGEWVTASCVPDSIILHVGDTIEILSNGMYKSVLHRGLVNRERVRVSWAVFCEPPKEKIVLKPLPETVGEDRPALFPPRTFAQHMKHKLFKKSDDEVHDEEGVVVVEHDDKSVE

SEQ ID NO: 55615 - protein, 333 aa, Nitrosospira sp. NRS527
MTIKVGINGFGRIGRMVFRAAVQNFPDIEVVAINDLLEPVYLAYMLQHDSVHGRFKGDVAIDGDTLVVNGKRIRLTAIKDPAELKWGEVGAEVVIESTGLFLTKETWQKHIAAGAGKVIMSAPSKDDTPMFVYGVNDNTYDGQSIISNASCTTNCLAPIAKVLNDTWGIKRGLMTTVHAATATQKTVDGPSNKDWRGGRGILENIIPSSTGAAKAVGKVIPELNTKLTGMAFRVPTSDVSVVDLTVELDKDATYEEICAAMKQASEGAMKGVLGYTDEKVVSTDFRGESCTSIFDAEAGMALDGSFIKVVSWYDNEWGYSSKILEMTRVVAGK

SEQ ID NO: 55616 - protein, 333 aa, Nitrosospira sp. TYM9
MTIKVGINGFGRIGRMVFRAAVQNFPDIEVVAINDLLEPDYLAYMLQHDSVHGRFKGDVSIDGDTLVVNGKRIRLTAIKDPAELRWGEVGAEVVIESTGLFLTKETCQKHITAGAGKVIMSAPSKDDTPMFVYGVNDNTYDGQSIISNASCTTNCLAPIAKVLNDTWGIKRGLMTTVHAATATQKIVDGPSNKDWRGGRGILENIIPSSTGAAKAVGKVIPELNTKLTGMAFRVPTSDVSVVDLTVELDKDATYEEICAAMKQASEGAMKGVLGYTDEKVVSTDFRGESCTSIFDAEAGMALDGSFIKVVSWYDSEWGYSSKILEMARVVAGK

SEQ ID NO: 55617 - protein, 333 aa, Nitrosovibrio sp. FJI82
MAIRVGINGFGRIGRMVFRASIEEFDDIEVVAINDLLEPDYLAYMLLHDSVHGRFKGDVSVDGNNLIVNGKKIRLTATKDPEELNWGEVKVDVVVESTGLFLTKELCEKHIKAGAPKVVMTAPSKDDTPMYVYGVNDKTYQGEAIISNASCTTNCLAPIAKVLNDTWGIKRGLMTTVHAATATQKTVDGPSNKDWRGGRGILENIIPSSTGAAKAVGKVIPELNTKLTGMAFRVPTSDVSVVDLTVELEKEASYDEICDAMKKASEGSMKGVLAYTDQKVVPTDFRGESATSIFDAEAGMALDGNFVKVVSWYDNEWGYSSKILEMVRVVAGK

SEQ ID NO: 55618 - protein, 344 aa, Oryza sativa
  misc_feature (265)..(265): Xaa can be any naturally occurring amino acid
MEDSKNEESIKQSPTKEPKDKSPKPPSPPAFVPSTNDTIKPTTQPPELPSYNASPSSNKRGPPPSEESSDNESQQISQADYDDDSDYIEEKEEIQIVEDPLTEEEYKRHCQHRTISSNCGPRRQLHDIRGCRSVDVFKKLNLISEGTYGRVWRAQQILRNGRPKINALKQVKMEKEKEGFPVTALREITLLLTLQHVNIVDVEEVVVGHHADNIFLVMEYVEHDLKYLMETMKARFSQSEVKCLLVQLLKACEYMHDNWVIHRDXKTSNLLYANNGIMKVCDFGLARLYGEPIKKMTSRVVTSGYQSPEILWGEESFPSSGVLGAGGLFFFQTFSKKTKFSGEN

SEQ ID NO: 55619 - protein, 388 aa, Prochlorococcus marinus subsp. marinus str. CCMP1375
MATTTANSSMLGTSGATFAPLTVPKRLLLGPGPSNSHPSVLNALSQQPVGHLDPFYIQLMAEVQGLLRDVWQTSNRLTLPMSGTGSAAMEATIANVVEPGDTFLVAIKGYFGNRLADMASRYKANVQTIDKKWGEAFSLQELEEAIIKYKPAFLALVHAETSTGVCQPMEGIGDLCRKHNCLLILDTVTSLGSIPLYLDDWKVDLAYSCSQKGLSCPPGLGPFTMNERAEEKLNKRTGKVPNWYLDVSLLNKYWGSDRVYHHTAPVNMNFGIREALRLILEEGLEATWTRHKLNALELWNGLEDLGLSLHVPSDIRLPTLTTVSIPSNVDGKAFSLHLLNNHGVEIGGGLGELAGKVWRIGLMGYNSNKTNVDKILNLFDSELPKFKS

SEQ ID NO: 55620 - protein, 333 aa, Nitrosovibrio sp. RY3C
MAIRVGINGFGRIGRMVFRASIEEFNDIEVVAINDLLEPDYLAYMLLHDSVHGRFKGDVSVDGNNLIVNGKKIRLTATKDPEELNWGEVKVDVVVESTGLFLTKELCEKHIKAGAPKVVMTAPSKDDTPMYVYGVNDKTYQGEAIISIVSCTTNCLAPIAKVLNDTWGIKRGLMTTVHAATATQKTVDGPSNKDWRGGRGILENIIPSSTGAAKAVGKVIPELNTKLTGMAFRVPTSDVSVVDLTVELEKEASYDEICDAMKKASEGSMKGVLAYTDQKVVSTDFRGESATSIFDAEAGMALDGNFVKVVSWYDNEWGYSSKILEMVRVVAGK

SEQ ID NO: 55621 - protein, 341 aa, Burkholderia thailandensis E264
MAQYMKAAVVHAFGEPLRIEEVPVPTPGPGQILVNIKASGVCHTDLHAADGDWPVKPTLPFIPGHEGVGFVTAVGGGVKHVKEGDRVGVPWLYTACGHCEYCQTGWETLCHEQQNTGYSVNGSYAEYVLADPNYVGHLPSNVAFDEIAPILCAGVTVYKGIRVTDTRPGQWIAISGIGGLGHVAVQYAKAMGLHVVAVDVAHEKLELARKLGAAFVVDASRDDPAAVIQKEIGGVHGVLVTAVSRSAFAQALGMVRRGGTVSLNGLPPGDFPLPIFSTVLNGITVRGSIVGTRRDLQESLDFAAEGLVRAHIHRDKLENINSVFTALREGKVDGRIVLTGE

SEQ ID NO: 55622 - protein, 393 aa, Psychrobacter arcticus 273-4
MSEQSPEQKNDNLNQTTASNSATATDKEFLNTLRGSIDAVDCEIQTLINNRAKLAQQVATVKKNHIANDPAAENTNPIFYRPEREAQVLKAVMERNTGPIADEKMARLFREIMSVCLDLEAPQRIAFLGPVGTFTHAAALKHFGKAADTVPLNTITDVFREVEAGTAMYGVVPVENSSEGVVNHTLDGFLSSTLKIIGEVELPIHQNFLVAEHTKIDGLSRIYSHQQSLAQCRHWLDVNFPNVERVAVSSNGEAARRLKNEWHSAAIAGDVAAAEYDLHKLYSNIEDNPSNTTRFLIIGHEAIEPSGQDKTSIMVSAHDKAGALIEILKPLSYHGVSMTSIETRPERPNKWAYVFFIDINGHIADPNVSAAIADIRPLVKDLRVLGSYPKAVL

SEQ ID NO: 55623 - protein, 402 aa, Xanthobacter autotrophicus Py2
MITAVLPTYARIDLEFERGEGCWLVTTDGRRFLDFTGGIAVNVLGHAHPYLAEALSEQAKKLWHTSNLFRIPGGERLADRIKAVTFADTMFFTNSGAEALECAIKMARKYQFASGHPEKNRIITFEGAFHGRTLATIAAGGNAKYLEGFGPAMPGFDQVPFGDLDAARAAVTPETAAILVEPVQGEGGVRVPPSGFLKGLRALCDEKGLLLVLDEVQCGVGRTGKLFAHEWVGVTPDIMAVAKGIGGGFPMGACLATEEAAKGMTLGTHGSTYGGNPLAMAVGNAVLDLVLADGFLDHVNAMSTRLVQRLAEVRDRHPSVIAEVRGQGLLLGLRCAVPAADLVTALREEGMLAPGASDNVVRLLPPLIVSEEEVGIAVEKIEAACRRIEDRLVAAPVQGAAE

SEQ ID NO: 55624 - protein, 309 aa, Xanthobacter autotrophicus Py2
MKGNGVRHFLDLSEIPAEELRRVLDFSKDLKARRKAGEVDRPLAGKTLAMVFDKPSTRTRVSFDLAMRQLGGETIMLTGQEMQLGRGETIADTARVLSRFVDAIMIRILDHDDLTELAKHATVPVINGLTRISHPCQVMADVLTFEEHRGNITGRSVAWTGDANNVLASWVHAAQRFDFSLKVATPKELSPRQALKDFVKRTKAKVKFMRDPEEAVEGVDCVVTDTWVSMGDKEAERRHNLLKPYQVNRSLMARADKEAIFMHCLPAHRGEEVSDEVMDGPQSVVFDEAENRLHAQKGILAWCFNAAGD

SEQ ID NO: 55625 - protein, 189 aa, Psychrobacter arcticus 273-4
MSANTAVTAADTATESSNTLNSDHPFWQIIRTVPDFPKIGIDFYDITPLLRSHINEVIDALLAVLPKGIMDEVDCLGAVEARGFVFASLLAGRLGKGMILLRKPGKLPPPVANKAYVLEYGKDTLEMQNNLPPERVLLVDDILATGGTLTTAYELCQSVNHTVVGALVLLDLVNLHGDFPVPVYTVLKA

SEQ ID NO: 55626 - protein, 554 aa, Thiobacillus denitrificans ATCC 25259
MRTGDTRTSGLSTRPVHRLLQAHHSRMADVHMRELFDTDPQRFERFSLQVGDLLLDYSKNRITDETMDLLVRMAEESDVAGWRERMFRGDKINTTENRAVLHVALRNRSNRPVNVDGEDVMPKVNAVIERMGAFAEQVRGGVWRGYSGALITDVVNIGIGGSDLGPQMVVQALKPYRHPRLKLHFISNVDGAHVKETLEALDPETTLFIVSSKTFTTQETMTNAHYARDWFLARAGDVAHVARHFVAVSTNRDAVTAFGIDAANMFEFWDWVGGRYSLWSAIGLSIVLAVGAERFLELLEGAHEMDEHFRHAPLRQNMPVILALLGIWYNNFFGAESHAILPYDHYLRSLPAYLEQADMESNGKSVDRDGRVVDYPTGQIIWGATGINGQHAFYQLLHQGTKMIPADFIVSITPHTELQEHHDILIANFLAQTEALMRGRTREETLEEMGRSPGDPSVQHRVFEGNHPSNAILLKKLTPHTLGMLIALYEHKIFVEGVIWNLNSYDQWGVELGKQLAGRILPELHADAPVAGHDASTNALINHYRRMTQPHPGL

SEQ ID NO: 55627 - protein, 264 aa, Triticum aestivum
  misc_feature (136)..(136): Xaa can be any naturally occurring amino acid
MGRRHRTFWIPDLLETLTPRTSRTSMDGLAAPSPSHSGATSGGGASHRKRKLPPPSLSDATADEDDDTTAPSSPATSLSSPSRPSSPSSSHSDEDDDDSLTTFTAARLDAAPASSSGRPPKPDSSSASAVTAGGLXAPMPASAAAGDGKEDSKGLFTDNIQTSGAYSAREEGLKREEDTGKLKFLCYSNDGVDEHMIWLVGLKNIFARQLPNMPKEYIVRLVMDRTHKSMMVIRNNNVVGGITYRPYASQRFGEIAFCAITADE

SEQ ID NO: 55628 - protein, 428 aa, Acinetobacter sp. ADP1
MDTKHSALNQRKQQATPRGVGVMCQWYADKAENATIWDAEGNTYIDFAGGIAVLNTGHRHPKVLAAVKAQLERFTHTAYQVTPYESYVALAERINELAPIAGPAKTTFFTTGAEAVENAVKIARCYTGRQGIITFGNGFHGRSFMTMAMTGKTAPYKRDFGLMPGGVFHARYPVESRGISVDDALESIENIFSEDVAPHDVAAIVLEPVQGEGGFNVVPADFLKRLRALCDKHGILLVADEVQTGFARTGKLYAMDHYETKADLITMAKSLGGGFPISGVVGRAEVMDAPNPGGLGGTYAGNPVAVAAAHAVIDAIQEEKLCERANELGAELVHVLKGLQQSTDQVITDIRALGSMVAAEFETAEQAKAVQNYAMQNGLLLLTCGKYGNVIRFLYPLTIPVEQFRSGLDILKQGVASLATDHTTQAIG

SEQ ID NO: 55629 - protein, 432 aa, Saccharomyces cerevisiae YJM789
MTVNDKKRLAIIGGGPGGLAAARVFSQSLPNFEIEIFVKDYDIGGVWHYPEQESDGRVMYDHLETNISKKLMQFSGFPFEENVPLYPSRRNIWEYLKAYYKTFIANKDAISIHFNTEVTYLKKKNSQWEITSKDELRTTKSDFDFVIVASGHYSVPKLPTNITGLDLWFDNKGTFHSKDFKNCEFAREKVVIVVGNGSSGQDIANQLTTVAKKVYNSIKEPASNQLKAKLIETVQTIDSADWKNRSVTLSDGKVLQNIDYIVFATGYYYSFPFIEPSVRLEVLGEGVTGDKHSSVNLHNLWEHMIYVKDPTLSFILTPQLVIPFPLSELQAAIMVEVFCKSLPITTTFDSNACGTHNFPKGKDLEYYAELQELLNSIPRRVGHFEPVVWDDRLIDLRNSSYTDKEERNVLLAEHAQTLKKKKAPYFLPAPHT

SEQ ID NO: 55630 - protein, 479 aa, Acinetobacter sp. ADP1
MAAPKNVSESGHSEGLKSGLQSRHLTMISIAGVIGGALFVGSGSVIYSAGPAAILAYTLGGLLVLLIMRMLGEMAVMNPDSGSFSTYADRAIGRWAGFSIGWLYWCFWTLLMGWEAYVAGKILNSWFPFIPIWGYMLLVIVGLVWVNLQDVKNYGEFEFWFALIKVVAIVMFLVVGSLAIMHLWPWGDPSAAGFTNLTAQGFMPGGFSSVITALLGVMFAYMGAEIVTVAAAESKDPAKEIRKASNSIVWRIILFYVGSMFITVCLIPHNNPLLKDPTWGTYSVTLSTLGIPEARHIVNFVVLTSVCSCFNSALYTCSRMMFSLSKRGDAPKIFAKTNRNSSPWAGVIFSSIFSIVAVYLTATESMNVYDVLMLATGTVALYVYLAVAFSQLRMRKKIEAEGKAVDFKMWLFPWLTYAVIITIIGAIITMLIEGTYFKEVTYTTGLALVIVILGILTHKFNWGKDAREKMLEQSKKSMT

SEQ ID NO: 55631 - protein, 192 aa, Acinetobacter sp. ADP1
MRGVNKVILVGTLGRDPETKTFPNGGSLTQFSIATSEAWTDKSTGERKEQTEWHRIVLHNRLGEIAQQYLRKGSKVYIEGSLRTRQWTDQNGQERYTTEIRGDQMQMLDTRSQGDQPMSGGNDFNQPRFNNNAPQQNTGYNQGGGYNNSGNNNFNQGSGYGNGGSNNSNQGGYVPKAPQQPAPADLDDDLPF

SEQ ID NO: 55632 - protein, 190 aa, Vitis vinifera
MGYWKSKVLPKIKKIFEKSGTKKTAAAEACKSFDDSKEEINKDFEAKKDELQPKVIEIYEASSTEIKTLVKEPKEAGLKNSTAVQKFLDELVKIEFPGSKAVCEASSKYGPGLVSGPVLFLFEKVSTFIVTEENEEELPPPTTNTTGEEEASGKEKEIVIEEEKKEEVAVMVEEREATEAVAAAAEPAKP

SEQ ID NO: 55633 - protein, 540 aa, Burkholderia sp. 383
MTLNSLPAWTALQSHFEQIRHARLRDWFAPENDHTPTRAERFTIPGGGIAADFSKNRINDDTLRLLVQLARDAGVEARRDAMFAGEIVNPTEGRAALHTALRATDPQAPFHAQISAERAKMATFARAVRSGTWTGYTGKRIRHVINIGIGGSDLGPKMVVHALHHVATPEITTHFVSNVDGADLARVLEQVDPEETLAIIVSKTFTTLETMTNARSLRDWFVARGCPEDALAKHFVGVSANPAEVVKFGIAADNVFEMWDWVGGRYSLWSAVGLSIMIAIGPEQFDELLAGANDMDRHFREAPLERNLPVLLGLIGIWYRNFFGSQSYLVAPYSEALHYLPSYLQQLEMESNGKSARLDGTFVDYPTSAVTWGEPGTNGQHAFFQMLHQGPTIVPIDFIAVLTPEHPLASHHPKLLANCFAQSEALMLGRTLDEARKVAGPGKEALAPHLTFPGNRPTTTLLVDALTPRTLGALIALYEHKVLVQATVWDINPFDQWGVELGKILGKVVEADLSAESIDPAKHDSSTTALIERARAALKR

SEQ ID NO: 55634 - protein, 334 aa, Colwellia psychrerythraea 34H
MSLAAKITVLGAGSYGTALAICLARNGHKTLLWGRDDNHVAAMEQDRENNKYLADCPFPENLALEADLEKAVQASDNLLVVVPSHAFADMLKQIKPMLTENAKIAWATKGLDPQTGDLLQNVARTVLGDRVSLAVLSGPTFAKEMASGLPTAISLSSEDDEFVAELSDLLHCEKRFRVYSNKDFIGVQLGGAVKNVIAIAAGIADGIGFGANARTALITRGLAEMTRLGLALNAEPATFMGMAGLGDLVLTCTDNQSRNRRFGLALGQGKEVEQAITDIGQVVEGYRNTKEVYMLAQRHDVEMPIVEQVYQVLYRGKDAKLAAADLLSRDKKFE

SEQ ID NO: 55635 - protein, 170 aa, Helicobacter pylori
GSGMHTHVSVWKNNENLFSGETYKGLSELALHFLGGVLCHARGLAAFTNASTNSYKRLIPGYEAPSILTYSANNRSASVRIPYGISKNSTRFEFRFPDSSSNPYLAFAAILMAGMDGVKNKIDPGEAMDINLFKLTLDEIREKGIKQMPHTLRRSLEEMLADKQYLKEGQ

SEQ ID NO: 55636 - protein, 560 aa, Arabidopsis thaliana
MASSPALICDTEAWKDLKGHVEDIKKTHLRDLMSDANRCQSMMMEFDGLLLDYSRQRATVETMDKLLNLAKASQLTEKISRMFNGEHINSTENRSVLHVALRAPEDAVIKADGMNVVPEVWNVLDKIKEFSDKIRSGSWVGATGKPLKDVIAIGIGGSFLGPLFVHTALQTDPEALESAKGRQLRFLANIDPVDVARNISGLNPETTLVVVVSKTFTTAETMLNARTLREWITAALGASAVAKHMVAVSTNLALVEKFGIDPNNAFAFWDWVGGRYSVCSAVGVLPLSLQYGFSMVEKFLKGASSIDQHFQSTPFEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLPELTAYNVGQLLAIYEHRVAVQGFVWGINSFDQWGVELGKVLATQVRKQLHSSRTQGTAPEGFNYSTTTLLKRYLETSSEPQM

SEQ ID NO: 55637 - protein, 375 aa, Methanosarcina acetivorans C2A
MRKLRIRIEVKSYKVNKRCINMAENIQSKGYAGKDESGKLVPWSFERRPVGNNDILIDIKYCGVCHSDIHQIKGHWGPQQYPQVPGHEIVGVVAAVGKNVTNFKVGDRAGVGCMVSSCMECESCKNGEEHHCDNNATIMTYGYLEESSPTGISQGGYSQNIVVAEHFAIKIPDSIDLQEAAPLLCAGITIYSPLMKANIKKGDKVGVAGIGGLGHMAIKLAVSKGAEVYAFTTTESKKEDCLAFGATEVIVVNSPSDLQPWKGKMDYMISTIPYAYEMSSYIDCVKPYGYFTQVGQPIGGELTINNFNMIFNRVNFNGSLIGGIPETQEVVDYCAENKIYPQIRMIEPEMINETWDKVVNKEARYRYVIDMSSLK

SEQ ID NO: 55638 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKHDLKEGQ

SEQ ID NO: 55639 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKEGH

SEQ ID NO: 55640 - protein, 170 aa, Helicobacter pylori
GSGMHTHVSVWKNNENLFSGETYKGLSEFALHFLGGVLRHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKEGQ

SEQ ID NO: 55641 - protein, 365 aa, Deinococcus radiodurans R1
MGLAIGIVGLPNVGKSTLFNAITRAGALAANYPFATIEPNVGRVTVPDERLSALSQVFTKGERVPPIIPTFVEFVDIAGLVKGASQGEGLGNQFLANIREVDAIAHVVRCFEDPNVVHVAGRVDPLDDIETINTELILADLAGLEKRAQNLQKKAKGGDKDAKEQLELAEQIIQVLGEGKPARAGSYEGKIPKDFGLITIKPVIYVANVGEDDLTGDNEYVQKVREYAAAEGAQVVKISAQIEGELAEMPEDEAAAFLHDLGVEESGLDQLVKVGYETLGLITFITSGEKEVRAWTIRKGEKAPEAAGEIHSDLERGFIRAEVIEWQKMVEAGGWAPAKAKGWVRTEGKDYVMQDGDIMNVLHNM

SEQ ID NO: 55642 - protein, 391 aa, Picea sitchensis
MATETTTPSESTMNESIEKKMEDLSIEKIEDAQKEVDFSMPEAEEKEILKEEKTHEVGENDSPEDQQTREVSLSETEIPEDQDSLKVAETENPKEQDSHEIADSSTGETLKAQEMPKAKEEDTFEDALEAIENETLKAVETPEVAEKEGSNEQVVYKDQVPADENASDLVAEDKWKKEASESAEADKEKEVNVAEVREVLIPTVDHRSGAGDESKTEDVPTTVVHETTDGEKPSPQSAEADKEKEVNVAEVREVLIPTVDHRSGAGDESKREDVPTTVVHETTDGEKPSPQSAEADKEKEVNVAEVREVLIPTVDHRSGAGDESKTEDVPTTVVHETTDGEKPSPDGEKPSPRRSGDIFQNVGSKMIQSVQKLKNVISGKSSNGKSSKSTD

SEQ ID NO: 55643 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFGAILMAGIDGIKNKMDPGEAMDINLFKLTLDEIREKGIKQMPHTLRRSLEEMLADKQYLKEDQ

SEQ ID NO: 55644 - protein, 560 aa, Arabidopsis thaliana
MASSTALICDTEAWKDLKGHVEDIKKTHLRDLMSDANRCQSMMMEFDGLLLDYSRQRATVETMDKLLNLAKAAQLTEKISRMFNGEHINSTENRAVLHVALRAPKDAVIKADGKNVVPEVWNVLDKIKEFSDKIRSGSWVGATGKPLKDVIAIGIGGSFLGPLFVHTALQTDPEALESAKGRQLRFLANIDPVDVARNISGLNPETTLVVVVSKTFTTAETMLNARTLREWITAALGASAVAKHMVAVSTNLALVEKFGIDPNNAFAFWDWVGGRYSVCSAVGVLPLSLQYGFSMVEKFLKGASSIDQHFQSTPFEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGIVKSQQPVYLKGEVVSNHDELISNFFAQPDALAYGKTPEQLQKENVSENLIPHKTFSGNRPSLSLLLPELTAYNVGQLLAIYEHRVAVQGFVWGINSFDQWGVELGKVLATQVRKQLHSSRTQGTAPEGFNYSTTTLLKRYLETSSEPQM

SEQ ID NO: 55645 - protein, 588 aa, Nicotiana rustica
MGSYRVCVCFTRKFRVTEAEPPSDVKEAFKKYAENGNQMNSEQLLKFLIEVQGETLFTVGDADVIVRQILQKRHPITKLTRQTLALEDFHHFLFNTDLNPPINYKVHHDMNAPLSHYFIFTGHNSYLTGNQLTSDCSDIPIIKALKKGVRVIELDIWPNSDKDDIHVLHGRTVTTPVELIRCLKSIKEHAFVASPYPVVITLEDHLTPDLQAKVAQMLTETFGEMLFVPESDSLKECPTPEELKHRIIISTKPPKEYLEASASTTASKERRNSSQRSNCSEDDVWGAEPSSLTANQEENEKSDSDNFEDDDDSSHRPQLASAYKRLIAIHAGKPKGGLKEALKVDPDKVRRLSLSEQALEKAAESHGTEIVRFTQRNILRVYPKGTRFNSSNYKPLIGWMHGAQMVAFNMQGYGRALWLMHGMFSSNGGCGYVKKPDFLLNVGPNNEVFDPKAKLPVKKTLKVKVYMGDGWHLDFKQTHFDLYSPPDFYTRVGIAGVPADEIMKKTKTKEDKWTPVWDEEFTFPLTVPELALLRIEVHEYDMSEKDDFAGQTCIPVSELKPGIHAVPLCDRKGEKYSSARLLMRFEFI

SEQ ID NO: 55646 - protein, 490 aa, Kineococcus radiotolerans SRS30216
MTETTTQKAQIGVTGLATMGRNLARNIARHGYVTAVHNRSDAKTKALVEEFGHEGTFVPGYTSQEFVDSLESPRTIIVMVKAGPATDAVIEELAPLLSEGDIVVDAGNAHFADTRRREAALRERGVHFAGVGVSGGEEGALLGPSIMPGGSEHAYAKLGPIFADIAVSVDGTPCSTHVGPDGAGHFVKMVHNGIEYADMQLIAEAYDLLRHGLGRTPKQLAEVFTSWNEGDLESFLIEITARVLDKDDPTQEGTPLVDVILDEAEQKGTGRWTVQTALDLGTPVSGIAEAVFARALSGHAEQRKAAQGVLPGPAAGAEGTGGFVAEADAEAFVDDVRAALYASKVVAYAQGFDMIRAGSTEYGWGVDPGAMATIWRGGCIIRAKFLDRIKDAYANQPDLPSLLLDPYFADAVAKGQEAWRRVVTHSVQAGIPAPGFSSALAYYDALRRDRSSAALIQGLRDLFGAHTYKRTDRAGDFHVDWSGDGTESQG

SEQ ID NO: 55647 - protein, 450 aa, Mycobacterium smegmatis str. MC2 155
MVNAASPRTTTNGFVNTATDPFSAVVVATPDLAGRLLGRRHSWPHYQASASKAVNTCEVVFGWGLGHELLDGFSGVGWDHGYGDLRFVTDPDTLRPMGWQDGVGIAFADVVTGDGTPFFASPRNILRKQIERAHSAGYQPLVTSELEFFALQHTSETLAQQGFTGLKPIRETLQPELACAISTDETIMAELFGALQRTGIEVETAKTEYCPGQYEVTLVPTDPMRMADQHALYKMATRQIFRRHGMSATFMAKVDDHWAGSSSHLHISLTDENGSNLFATDENLLRHFGAGLQAFARDFFLLWAPYPNSYKRFRDGTFAPTALTWGDDNRTVALRVTGHGSARHLENRIPGADINPYLGYAALLAAGLEGIERGLLPADEVGQRNAYTEKIGRPLPESLGEALDAFYDSPVTRQTLGEAAVEHITTFLSSELRASQLAVTDWDRRRLFDL

SEQ ID NO: 55648 - protein, 212 aa, Zea mays
KLDVSSSMEKPSGQGPEESILESDVIKQGMSSDDMTKEKDLNTGEATESEKCISDVPIESDKHGDSEPLSREGKIISGNVNVKNQISREDLKEAFKKFGAVRYVDFSIGDNSGYLRFEDSKAAEKARMSAVLADGGLIIKDHIVTLEPVTGEAEKDYWDTIRSIQGKYKDSRSYKGRASNNQRGGKRFNAKRDRNPDSEKNSNKARKVEAIA

SEQ ID NO: 55649 - protein, 517 aa, Mycobacterium smegmatis str. MC2 155
MVNGDRLHGDRRFERETDMTHAPEWKESLEDLDRRRQNSYGMGGPERLAKHHAKGKLDARARIGHLLDPGTFQEFGTLVGGDIPSDGIVTGTGLVNGTPVMVGAEDFTTYAGSIGPGGNAKRYRLAELALRSKIPLVMLLEGAGFRAAAGEHYGRTPTDLLAQARCSGKVPTVSAIMGASAGHGALVAPVCDFTIMSPHGAIFTAGPPVVKESIGEEISKEDLGGPDVALASGVIHNLADSDEAVLDDIRRYLSYFPASAWSYPPAAEIDESVEPRATPELLDIVSRDNRRIYDMRKVLDVVFDRTDWFEVQPKFGRAIICALAHLGGHPVAVVANQPQVLAGSIDADAADKAAHFITVADSFHLPIVFLADNPGMLPGSRSERAGVLRSGARMFAAQTAATTLKMHVTLRKAFGFGSMVMSLLGFDDQVATFAYPGATMGAMGAAALSRAAHAGEDVAEVLKTMELEASYRSAGHLGFDELIAPEETRNALLVALHQGLYSRQAPAEPVSRTMIMP

SEQ ID NO: 55650 - protein, 333 aa, Nitrosovibrio sp. RY6A
MAIRVGINGFGRIGRMVFRASIEEFDDIEVVAINDLLEPDYLAYMLLHDSVHGRFKGDVSVDGNNLIVNGKKIHLTATKDPEVLNWGEVKVDVVVESTGLFLTKELCEKHIKAGAPKVVMTAPSKDDTPMYVYGVNDKTYQGEAIISNASCTTNCLAPIAKVLNDIWGIKRGLMTTVHAATATQKTVDGPSNKDWRGGRGILENIIPSSTGAAKAVGKVIPELNTKLTGMAFRVPTSDVSVVDLTVELEKEASYDEICDAMKKASEGSMKGVLAYTDQKVVSTDFRGESATSIFDAEAGMALDGNFVKVVSWYDNEWGYSSKILEMVRVVAGK

SEQ ID NO: 55651 - protein, 512 aa, Lentisphaera araneosa HTCC2155
MHLQSQKSTMESSQLIKEILSAKIYDLAIETPLNKALKLSTKLKNEIYLKREDLQSVFSFKIRGAYNKMRKLDQNSLQRGVIAASAGNHAQGVAQAANHLHIPATIVMPTTTPQIKVDSVVEKNAEVILHGDNFDQACQRAFEIEKERGLTFIHPYDDWDVIAGQGTIGVEILKQLNEEPDYIFVPVGGGGIAAGVANFAKYLSPNTKIITVECEDSACFKEAFQLGEPTQLAEVGIFADGIAVGKIGENTFKALKDNVDEAITVSTDEICAAVKSIFEETRVVAEPAGATALAGVVKYIKENKLQNKRITTIISGANTSFGRLRHISERTELGAEKEALFAISIPEKKGSFRHFCQLLDGSSITEFNYRYNNPDQAQIFVGIELKDGDKSRLSIINNLQQSHIDHLDLSHNEIAKLHLRHMLGGQSAVKDEHFYRVQFPEKPGALLKFLNDLGSEFNITLFHYRNHASAHGRVLLGIQHPDSSLIEAQLKKIDYPYFPEDDNPACSLFSGN

SEQ ID NO: 55652 - protein, 472 aa, Wolbachia endosymbiont of Drosophila melanogaster
MSTLITVAYGDGIGPEIMEAVLSILREAEAEISIDIIEIGERVYSKEWSHGISPSGWESIERTKILLKSPTTTPQGKGNKSLNVALRKNLGLYANIRPCISYHHVIENKFDKFDIVVIRENEEDVYTGIEHRLTGDSYQCTKIITRSGSEKICRYAFEYAKKHNRKKVTCLTKDNIMKMTDGTFHAAFDRIAKEYPDIKAEHYIVDIGMARVATEPENFDVIVTENLYGDILSDIVAQTSGSVGLAGSSNIGNEYAMFEAVHGSAPDIAGKNIANPSGLLNAAVHMLIYIGQVGTAKLIYDAWLKTLEDGIHTADLYKEKRSKQKVGTKEFAEAVIDNLGKKPKTLSELIIGSDPNSKVDKIQDNYEQDYKIKKLVGSDITLAWSKPADFDQIVKLFETSNPQIIAIYSKGLAIWPGSSKSSSDQITCRFIANNEITNSDVNNLLIKFEEHNFDVVRMDKLYLYDGKEGFFS

SEQ ID NO: 55653 - protein, 395 aa, Nitrosospira sp. HBN8222A
MSVIRVTDLDLKGKRVFIRADLNVPVKDGKVTSDARISASMGTIDYCLKQGGKVMVTSHLGRPEEGVWSEENSLKPVADNISERLGKSVRLVKDWVEGNFDVAEGELVILENCRFNKGEKKNVDETAQKYARLCDVFVMDAFGTAHRAEASTYGIARYAPVACAGILLTEELDALTKALLDPARPMVAIVGGSKVSTKLTVLESLSEKVDQLVVGGGIANTFLKAAGKNIGKSLCEDDLVPTAKMLMEKMAKRNATIPIAVDVVVGKKFDASEPAVLKDAGAVTNDDMIFDIGPKSARELSDIIMKAGTVVWNGPVGVFEFDQFGEGTKTIAMAIADTDAFTLAGGGDTIAAIQKYDIYDKVSYISTAGGAFLEFLEGKKLPAVEILEQRAAGSR

SEQ ID NO: 55654 - protein, 449 aa, Oryza sativa Japonica Group
GEAAAAAAEVAAAVCGREKELSSHGHRGEVGCGGGEALPAPSAGRARQHPRRLAPAAAARAASSSATGGGGHLPPLFSVAPMMDWTDNHYRTLARLISKHAWLYTEMVVAETIVHQKDNLDRFLAFPAEQHPIVLQIGGSNLDNLAKATELANAYSYDEINLNCGCPSGKVAGHGCFGARLMFDPEFVGDAMSAIAANCNVPVSVKCRIGVDDRDSYEELCEFVDKVVSKSPTRHFIIHARKALLSGLSPAENRNVPPLKYEYYFALLRDFPDVQFTLNGGITTIDQVTASIRQGAHRVMVGRAAYNNPWNMLGHVDSEVYGMPTRRSSRRQILESYQVYGDSIMGQYGPSRPNVRQLVKPLLNLFHSEPGNGLWKRKADSTLRHCKTLESFLEETLDAIPNSVLDAPIGKEAYIEEGHFADMDSLLPPRYSSLTNGSCEIPALVTAST

SEQ ID NO: 55655 - protein, 395 aa, Nitrosospira sp. KAN8
MSVIRVTDLDLKGKRVFIRADLNVPVKDGKVTSDARISASMGTIDYCLKQGGKVMVTSHLGRPEEGVWSGENSLKPEADNISERLGKPVRLVKDWVDGNFDVAEGELVILENCRFNKGEKKNADETAQKYARLCDVFVMDAFSTAHRAEASTYGIARYAPVACAGVLLTGELDALTKALLDPARPMVAIVGGSKVSTKLTVLESLSEKVDQLVVGGGIANTFLKAAGKNVGKSLCEDDLVPTAKMLMEKMAKRNATIPIAVDVVVGKKFDASELAVLKDAGAVTDDDMIFDIGPKSARELSDIIMKAGTVVWNGPVGVFEFDQFGEGTKTIAMAIADTDAFTLAGGGDTIAAIQKYDIYDKVSYISTAGGAFLEFLEGKKLPAVEILEQRAAGSR

SEQ ID NO: 55656 - protein, 395 aa, Nitrosospira sp. PJA1
MSVIRVTDLDLKGKRVFIRADLNVPVKDSKVTSDARISASMGTIDYCLKQGGKVMVTSHLGRPEEGVWSEENSLKPVADNISERLGKSVRLVKDWVDGNFDVAEGELVILENCRFNKGEKKNVDETAQKYARLCDVFVMDAFGTAHRAEASTYGIARYAPVACAGILLTEELDALTKALLDPARPMVAIVGGSKVSTKLTVLESLSEKVDQLVVGGGIANTFLKAAGKNIGKSLCEDDLVPTAKMLMEKMAKRNATIPIAVDVVVGKKFDASEPAVLKDAGAVTDDDMIFDIGPESARELSDIIMKAGTVEWNSPVGVFEFDQFGEGTKTIAMAIADTDAFTLAGGGDTIAAIQKYDIYDKVSYISTAGGAFLEFLEGKKLPAVEILEQRAAGSR

SEQ ID NO: 55657 - protein, 482 aa, Pseudomonas fluorescens
MLDVPLLIGGQSCPARDGRTFERRNPVTGELVSRVAAATLEDADAAVAAAQQAFPAWAALAPNERRSRLLKAAEQLQARSGEFIEAAGETGAMANWYGFNVRLAANMLREAASMTTQVNGEVIPSDVPGSFAMALRQPCGVVLGIAPWNAPVILATRAIAMPLACGNTVVLKASELSPAVHRLIGQVLQDAGLGDGVVNVISNAPADAAQIVERLIANPAVRRVNFTGSTHVGRIVGELSARHLKPALLELGGKAPLLVLDDADLEAAVQAAAFGAYFNQGQICMSTERLIVDAKVADAFVAQLAAKVETLRAGDPADPESVLGSLVDASAGTRIKALIDDAVAKGARLVIGGQLEGSILQPTLLDGVDASMRLYREESFGPVAVVLRGEGEEALLQLANDSEFGLSAAIFSRDTGRALALAQRVESGICHINGPTVHDEAQMPFGGVKSSGYGSFGGKASIEHFTQLRWVTLQNGPRHYPI

SEQ ID NO: 55658 - protein, 293 aa, Burkholderia pseudomallei K96243
MLKVTKAVFPVAGLGTRFLPATKASPKEMLPVVDKPLIQYAVEEAIAAGITEMIFVTGRSKRAIEDHFDKSYEIEAELEARGKEKLLDLVRSIKPSHVDCFYVRQPEALGLGHAVLCAEKLVADNPFAVILADDLLDGDPPVMKQMVDVFDHYHSSVIGVEEIPPEDTKSYGIVDGKEWEDSIIKMSAIVEKPAPEVAPSNLGVVGRYVLKPRIFDHLRALKPGAGGELQLTDAIQALLADEQVLAYKYRGTRFDCGSKLGYLKATVEFALRHPEVKTEFETYLRSRSETQHG

SEQ ID NO: 55659 - protein, 226 aa, Streptococcus thermophilus LMG 18311
MDELKKLAGVYAAGFVEDGMVVGLGTGSTAYFFVEEIGRRIKEEGLSVVGVTTSTQTTKQAEGLGIPLKSVDDIDSIDVTVDGADEVDPQLNGIKGGGGALLMEKIVATPTKKYIWVVDESKMVDQLGAFKLPVEVVQYGADRLYLDFESKGYKPSFRVTEQGDRFVTDMKNFIIDLDLGKINNPVALGDELKAMTGVVEHGLFNGMVNKVIVAGKDGVKIVEVKD

SEQ ID NO: 55660 - protein, 395 aa, Clostridium thermocellum ATCC 27405
MVVSKKALSISPSSTLAIDAKAKKMRSEGIDIIGFGAGEPDFDTPDHIKKAAIDAINAGFTKYTPASGTLELKQAICRKFKRDNGLDYNPSNIVISNGAKHSLVNALQAICNPGDEVIIPTPAWVSYPEMVKLADGVPVYIHCSEEEGFKFTIDKLEKAITDKTRAIIINSPSNPTGMIYSEEELRAVADLAVSKGIYIISDEIYEKLIYDGYKHVSIASFNDKIKDLTIVVNGVSKSYAMTGWRIGYTASNEQIAKIMANVQSHATSNPNSIAQKAALAALEGPQEIIDEMSAEFVKRRDYMVDRINSMNGVSCIKPNGAFYVMMNISKLIGKEIAGMKITGSDSFAEALLEKANVALVPGSGFGTDIHVRLSYATSMENIVEGLNRIEKFLSM

SEQ ID NO: 55661 - protein, 732 aa, Emericella nidulans
MSAETSTTPAPAENTNGTPDNAPAPEVTAVEAPATTSQPHSASLYVGELDPSVTEAMLYELFSSIGQVASIRVCRDAVTRRSLGYAYVNYNDTAHGERALDELNYTLIKGKPCRIMWSQRDPALRKTGQGNVFIKNLDSAIDNKALHDTFAAFGNILSCKVAQDEFGVSKGYGFVHYETAEAANNAIKHVNGMLLNDKKVFVGHHISKKDRQSKFEEMKANFTNIYIKNIDPEVEDEEFRKLFEKFGEITSATLSRDSEGKSRGFGFVNFSTHESAQAAVEEMNDKEVRSQKLYVGRAQKKHEREEELRKQYEAARMEKASKYQGVNLYVKNLTDDVDDDKLRELFGPYGTITSAKVMRDTAPVETATPESETKESANKENEKAAEGEKEPAAEEKEKEEKKEAEQKPEKKPLGKSKGFGFVCFSSPDEASKAVTEMNQRMVNGKPLYVALAQRKDVRRSQLEASIQARNNIRQQQAAAAAGMGQAYMAPAVFYGPGQQGFIPGAQRGGMFPPQPGMMMGMPGRPGQYPGPFPGQQGGRGVGPNQQIPPNFQGLPMGAMQGPGIPNGMGYPMVQGQFGGGRGRGQVPGMGGPMRGGYGGGRGGVPLGGQMRPGQGGRGQAVGQPGPETPVGVLTAQALSAAPPQQQKQMLGEALYPKIQATQPELAGKITGMLLEMDNTELLGLLEDDEALRAKVDEALSVYDEYMKNKSDEPAAEKPKEAAQEAPAEENKA

SEQ ID NO: 55662 - protein, 730 aa, Streptococcus pneumoniae
MFASKSERKVHYSIRKFSIGVASVAVASLVMGSVVHATEKEVTTQVATSSNRANESQAGHRKAAEQFDEYIKTMIQLDRRKHTQNFALNIKLSRIKTEYLRKLNVLEEKSKAELPSETKKEIDAAFEQFKKDTNRTKKTVAEAEKKVEEAKKKAKAQKEEDHRNYPTNTYKTLELEIAESDVEVKKAELELVKEEAKESRDDEKIKQAEAKVESKKAEATRLENIKTDREKAEEEAKRRAEAKLKEAVEKNVATSEQGKPKGRAKRGVPGEQATPDKKENDAKSSDSSVGEEALPSPSLKPEKKVAEAEKKVAEAEKKAKAQKEEDRRNYPTNTYKTLELEIAESDVKVKEAELELVKEEAKESRNEEKVNQAKAKVESKKAEATRLEKIKTDRKKAEEEAKRKAAEEDKVKEKPAEQPQPAPAPQPEKPTEEPENPAPAPKPEKPAEQPKAEKPDDQQAEEDYARRSEEEYNRLTQQQPQKPEQPAPAPKIGWKQENGMWYFYNTDGSMATGWLQNNGSWYYLNSNGAMATGWLQNNGSWYYLNANGSMATGWLQNNGSWYYLNANGSMATGWLQNNGSWYYLNSNGAMATGWLQNNGSWYYLNANGSMATGWLQNNGSWYYLNANGSMATGWLQNNGSWYYLNANGDMATGWLQNNGSWYYLNANGDMATGWVKDGDTWYYLEASGAMKASQWFKVSDKWYYVNGSGALAVNTTVDGYGVNANGEWVN

SEQ ID NO: 55663 - protein, 419 aa, Cytophaga hutchinsonii ATCC 33406
MIDTINTDLITADGTLNIDRIREDFPILHQEVNGKPLVYFDNAATTQKPIQVVEALTAYYLNDNANIHRGIHTLAERATAAFEASRDAVKTSINAKEREEVIFTRGTTEGINLVASTWGLANLKAGDEIVVSAMEHHSNMVPWHMLAQRTKAVVKILPMNDAGELLVEAFDTIITSKTKMLACTHVSNTLGSINPIKELIAKAHAVGAITLIDGAQAVSHLDIDVQDLDADFYAFSAHKLYGPTGVGILYGKRAILEAMPPYQGGGEMISEVTYESCTYNELPYKFEAGTPNIADVIALKAAIDYINSIGKAAIRSYEHELLDYAVSKLKDIEGIRLIGTAKDKVSVQSFVFSDIHHQDLGIILDQEGVAIRTGHHCTQPLMGRLGVTGTSRASFAFYNTKEEIDQFIAAIYKAIKLFR

SEQ ID NO: 55664 - protein, 175 aa, Triticum aestivum
GLSYLHSKKIVHRDVKTENMLLDKTRTVKIADFGVARHEAANPSDMTGETGTLGYMAPEVLNGNAYNRKCDVYSYGICLWEVYCCDMPYADLSFSEVTSAVVCQNLRPEIPRCCPSAFANVMKRCWDANPDKRPEMAEVVTMLDAIDTSKGGGMIPVDQARGIGCLSCLRPRRGP

SEQ ID NO: 55665 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFGAILMAGIDGVKNKMDPGEAMDINLFKLTLDEIREKGIKQMPHTLRRSLEEMLADKQYLKEGQ

SEQ ID NO: 55666 - protein, 560 aa, Arabidopsis thaliana
MASSPALICDTEAWKDLKGHVEDIKKTHLRDLMSDANRCQSMMMEFDGLLLDYSRQRATVETMDKLLNLAKASQLTEKISRMFNGEHINSTENRSVLHIALRAPKDAVIKADGMNVVPEVWNVLDKIKEFSDKIRSGSWVGATGKPLKDVIAIGIGGSFLGPLFVHTALQTDPEALESAKGRQLRFLANIDPVDVARNISGLNPETTLVVVVSKTFTTAETMLNARTLREWITAALGASAVAKHMVAVSTNLALVEKFGIDPNNAFAFWDWVGGRYSVCSAVGVLPLSLQYGFSMVEKFLKGASSIDQHFQSTPFEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLPELTAYNVGQLLAIYEHRVAVQGFVWGINSFDQWGVELGKVLATQVRKQLHSSRTQGTAPEGFNYSTTTLLKRYLETSSEPQM

SEQ ID NO: 55667 - protein, 1087 aa, Candida albicans SC5314
MLLKQIFLPFFVLFNAINAIDIYQNQVSRGTIDLSIGAITIHSGAYWSIIDNAISALVGTLTVQQDAGFYITGLNPLLGLQVELLGVLNSIKNDGIVSFNGLNSLVGPIYNLVGLSFQNNGEFYLSASGVAPPVFSITAADWHNNGLLVLAQAKRTSALANLGFPTGSIENQGSICLFGTAYQQLTSITGSGCISADRDSTIYIFSSLLPIATTQTLYLADRASSIVIQPVTLPATYTVRGFGNGNKVGISLPLLSVPLLGQPAYSYDPSSGVLTLRGLGVGLLSQRFQIGTGYDSSLLEIVTDDGAGLPTTLLGSVRYNGPVPNNAVPASCNCKYVPPSPGTDESSSLSSSTSEQSSSSATSVSASETSDTSSTQESSLSSEVSSTQEPSSSTPEPSSSSETSSTQESSSTEGPSSSTDSSTEASSSESSTAPSSSAEASSSTESSTEEPSSSTEGPSSSQESSSSEESSTQEPSSSTKESSSTEGPSSTEESSSTEGPSSSTDSSTDITSASSTDEQSSSGTGQSSTEDEPIDSTESDTSSATDSSTATDSSATNTDTNSESTDSSTATDTSSTDSNTASSTETNTDVTDSSTDSNTGATESSTATDTNTDATDSSTVSETGATDSSTATDTNTGATESSTDSNTGATDSSTATDTNTSATNTDTNTGSNTATNTDDNTATDTSSTETNTATNTDGTETNTGTTETNTDTSASNTDDNTGSNTATNTGGTDTNTDTNTGGTDTNTGTNTGGTDTKTGTNTATGTNTGATETNTATNTNGNGTNTNTGATDTATNTATGTNTNTGATDTNTNTNTGATVTNTATNTGDVSATKDIPSPTSTDEGSNNGGGSNNGSGSNNGSGNGSGSGSGSGDGSNNGSGNGSGSGNGSDNGSGSGSGSGNGSDNGSGSGSGSDNGSGSGNGSGSGSDNGSGSGNGSGSGSGSGSGSDNGSGSGSNNGSGNGSGNGAGSGSGNGSGSGSDNGSGNGSGSGSGSGSGSGSGSGSGSGSGNGSGSNNNNGSGSGSGSGNGQDNGIITSSIGQPGSSTSTQGPSSSNSATIPEQANSGNHIKFTLFNGLLIGLVPIVFM

SEQ ID NO: 55668 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSTRFEFRFPDSSSNPYLAFAAILMAGMDGVKNKMDPGEAMDINLFKLTLDEIREKGIKQMPHTLRRSLEEMLADKQYLKEGQ

SEQ ID NO: 55669 - protein, 450 aa, Oryza sativa Indica Group
MPPHEDALDAGAVDVLTFRLHPLAVLKLSHRIREFVHLHDDQYQQARMSGCVIGVRRGGTVDISDTFDILHDPDPGTFDRALLEKDQEICNVPQVLSPSFLAKLMDANGTAFYLLLNPAINFSHKDIPVTIYERGAERISLDHADFLYPSPCVVFDVLAPPLGEKKNAFRTMLFETPSGFAMFRVSDVLFRYPEDIWSSFTDPHTAHQVVRTIGFIEVGDKSVVWDNDIGPGEDIEHFILKFPIKSLVVPDAQLKFIIEKNLNISCWFNGRIVPELIWGLNYALDEFVPREKGNLSNERHFPLSKQLHEQLKAYGFSISPQLINREFITSFGYLNYLERTSNCISGDLHQKFDRFFCGLEMSEGEFVRGVAHRLHSMEEVASTPGRREALSNAEFLLAVPKKKCNTISRLKRMEAEDRGTGLGHPWVCAAAVAVGFGVMAGLCIAMKRAN

SEQ ID NO: 55670 - protein, 170 aa, Helicobacter pylori
GSGMHTHVSVWKNNENLFSGETYKGLSGLALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKEGQ

SEQ ID NO: 55671 - protein, 560 aa, Arabidopsis thaliana
MASSTALICDTEAWKDLKGHVEDIKKTHLRDLMSDANRCQSMMMEFDGLLLDYSRQRATVETMDKLLNLAKASQLTEKISRMFNGEHINSTENRSVLHVALRAPKDAVIKADGMNVVPDVWNVLDKIKEFSDKIRSGSWVGATGKPLKDVIAIGIGGSFLGPLFVHTALQTDPEALESAKGRQLRFLANIDPVDVARNISGLNPETTLVVVVSKTFTTAETMLNARTLREWITAALGASAVAKHMVAVSTNLALVEKFGIDPNNAFAFWDWVGGRYSVCSAVGVLPLSLQYGFSMVEKFLKGASSIDQHFQSTPFEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLPELTAYNVGQLLAIYEHRVAVQGFVWGINSFDQWGVELGKVLATQVRKQLHSSRTQGTAPEGFNYSTTTLLKRYLETSSEPQM

SEQ ID NO: 55672 - protein, 560 aa, Arabidopsis thaliana
MASSTALICDTEAWKDLKGHVEDIKKTHLRDLMSDANRCQSMMMEFDGLLLDYSRQRATVETMDKLLNLAKASQLTEKISRMFNGEHINSTENRSVLHVALRAPKDAVIKADGMNVVPEVWNVLDKIKEFSDKIRSGSWVGATGKPLKDVIAIGIGGSFLGPLFVHTALQTDPEALESAKGRQLRFLANIDPVDVARNISGLNPETTLVVVVSKTFTTAETMLNARTLREWITAALGASAVAKHMVAVSTNLALVEKFGIDPNNAFAFWDWVGGRYSVCSAVGVLPLSLQYGFSMVEKFLKGASSIDQHFQSTPFEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLPELTAYNVGQLLAIYEHRVAVQGFVWGINSFDQWGVELGKVLATQVRKQLQSSRTQGTAPEGFNYSTTTLLKRYLETSSEPQM

SEQ ID NO: 55673 - protein, 170 aa, Helicobacter pylori
GSGMHTHVSIWKNNENLFGGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKESQ

SEQ ID NO: 55674 - protein, 560 aa, Arabidopsis thaliana
MASSTALICDTEAWKDLKGHVEDIKKTHLRDLMSDANRCQSMMMEFDGLLLDYSRQRATVETMDKLLNLAKASQLTEKISRMFNGEHINSTENRSVLHVALRAPKDAVIKADGMNVVPEVWNVLDKIKEFSDKIRSGSWVGATGKPLKDVIAIGIGGSFLGPLFVHTALQTDPEALESAKGRQLRFLANIDPVDVARNISGLNPETTLVVVVSKTFTTAETMLNARTLREWITAALGASAVAKHMVAVSTNLALVEKFGIDPNNAFAFWDWVGGRYSVCSAVGVLPLSLQYGFSMVEKFLKGASSIDQHFQSTPFEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGIVKSQQPVYLKGEVVSNHDEFMSNFFAQPDALAYGKTPEQLQKENVSENLIPHKTFSGNRPSLSLLLPELTAYNVGQLLAIYEHRVAVQGFVWGINSFDQWGVELGKVLATQVRKQLHSSRTQGTAPEGFNYSTTTLLKRYLETSSEPQM

SEQ ID NO: 55675 - protein, 171 aa, Oryza sativa
MPNPQVFFDMTVGGVPTGRITFELFADKVPKTAENFRALCTGEKGIGRSGKPLHFKGSSFHRVIPNFMCQGGDFTRGNGTGGESIYGEKFADENFLLKHKGEGILSMANAGPNTNGSQFFICTVETAWLDGKHVVFGRVVDGMDVVKKIEAVGSQSGTTKKPVVIADCGEL

SEQ ID NO: 55676 - protein, 376 aa, Physcomitrella patens subsp. patens
MKSTNAVTFGKRSDDLATIVSAQSAVAASSGATRAVTEAKIKVAINGFGRIGRNFVRCWHGRKDSPLDIVVINDTGGVKQASHLLKYDSMLGTFDADVKVEGNDAISVDGKVIKVVSDRNPLNLPWGDMDIDLVIEGTGVFVDEAGAGKHIQAGAKKVLITAPGKGPIPTYVVGVNEQDYKHSDTIISNASCTTNCLAPFVKVLDEKFGIIKGTMTTTHSYTGDQRLLDASHRDLRRARAAALNIVPTSTGAAKAVALVLPNLKGKINGIALRVPTPNVSVVDLVVQVEKKTSAEEVNQAFRDACNTDQLKGVLAVCDEPLVSVDFRCTDVSSTVDSSLTMVMGEDMVKVVAWYDNEWGYSQRVVDLANLVAEKWQ

SEQ ID NO: 55677 - protein, 163 aa, Physcomitrella patens subsp. patens
MAPALINANPIVHEKKKRTSKPQANYNDAIPDVIDELEIFDILFHLLSSVDITDPEHPYSLEQLNVVTEDSIFVDDAKNYVKITFTPTVQHCSMATIIGLSLRLKLLRCLPPRFKVDIFLAPGSHSTEAAINKQLNDKERVAAAFENPNLVDLVEKCLVSTEE

SEQ ID NO: 55678 - protein, 561 aa, Oryza sativa
  misc_feature (69)..(69): Xaa can be any naturally occurring amino acid
  misc_feature (517)..(517): Xaa can be any naturally occurring amino acid
SLAWSIDHSLSKTATSCTKQAEHERLIDSGGDTTCSICWPWVFEWTVATAAAAVASWAFIAVVVKLVWXPRAITRRLGAQGVAGPGYRFFSGNLSEIRRLRAEGANLVLDVSSHDFVPIVQPHIRKWIPLYGKTFLYWFGTRPNICLADMNMVRQVLSDRTGMFPKYIDNMQFARLLGKGLVLTDDDEWKRHYKVVHPAFDMDKLKMMTETISDYAQSMMFEWESELGMKGGSTEIELSRWFEELTADVISRTAFGSSYREGKQVFLAQRKLQFLAFSVFLTIQIPGFSYLLTKKNLKTWSLDKKVRSMLMNIIKSRLTNKETMGYGNDLLGLMLEACVPEHGGSQPQLSMDDIIAECKTFFFAGHDTTSQLLTWTMFLLSTHQHWMEKLRKEVRMVCNDEVPTGDMLNKLKLVNMFLLETLRLYGPVSLVTRRAGTDVKLGSIKVPKGTILTIPIATIHRDKEVWGEDADEFKPERSENGVLNAAKHPSALLSFSIGLRSCIGQNFAMIEARTIIXAMILQRFSFTLSPKYVHTPISVITLRPKYGLPMILRSLKVKRDR

SEQ ID NO: 55679 - protein, 299 aa, Deinococcus radiodurans R1
MPCGATAPAENWRRAGRLLEQFSELRVRRKSTATRSILCFAALQVRPALCFVLALLAQKLCHLFVKCSRLDPVSHSSASPAPARAVKLAPSILSCDFSRLGEELQAIAGADWAHVDVMDGAFVPNISFGLPILAAARRASNLPMDVHLMIERPERYLRDFAEAGADSITVHVEATQHIHRAVQQIKELGKKAGVTLNPGTPLEAVRPLLADVDLVLVMSVNPGFGGQKFIPASTERVRTLRGWLDEVNPQAELQVDGGVTPANARLLAEAGATCLVAGSAVYGADGGAAGVQRLRDALA

SEQ ID NO: 55680 - protein, 379 aa, Oryza sativa Japonica Group
EAGSEAAARHSPPPSARANPSLGGGDDQGGGGGARGRGSPMAPLVPSSQPWVEKYRPRQVKDVAHQEEVVRVLTTTLQTADLPHMLFYGPPGTGKTTTALAIAYQLYGPELYKSRVLELNASDDRGINVVRTKIKDFAAVAVGSARKGGYPCPPYKIIILDEADSMTEDAQNALRRTMETYSKVTRFFFICNYISRIIEPLASRCAKFRFKPLSEEVMSNRILHICNEEGLSLDAQALATLSTISNGDLRRAITYLQSAARLFGSSISSTDLISVSGAIPEDVVKSLLASCKSGEFDVANKEVNNIIADGYPVSQLISQFLDVIVNADDIPDEQKARICKKLGEADKCLVDGADEYLQLLDVASETIRALFDMPQTLVF

SEQ ID NO: 55681 - protein, 222 aa, Brassica napus
  misc_feature (31)..(31): Xaa can be any naturally occurring amino acid
  misc_feature (208)..(208): Xaa can be any naturally occurring amino acid
MYKNQLQELAQRSCFNLPSYTCIREGPDHAXPRFKATVNFNGEIFESPQYCSTLRQAEHSAAEVALGALSNRGPSHSLAARILDETGVYKNLLQEIAQRVGAPLPRYTTFRSGLGHQPVFTGTVELAGITFTGDQAKNKKQAEKNAAMAAWSSLKLLAKETSSSMPESENSDELEQVIIARALINYRIMENIGSGSSSSAPVPFAKKXFMQSLRPTSPQPSH

SEQ ID NO: 55682 - protein, 395 aa, Nitrosospira sp. PM2
MSVIKVTDLDLKGKRVFIRADLNVPVKDGKVTSDARISASMGTIDYCLKQGGKVMVTSHLGRPEEGVWSEENSLKPVADNISERLGKPVRLVKDWVDGNFDVAEGELVILENCRFNKGEKKNADETAQKYAKLCDVFVMDAFGTAHRAEASTYGIAKYAPVACAGILLTEELDALTKALLNPARPMVAIVGGSKVSTKLTVLESLSEKVDQLVVGGGIANTFLKAAGKNVGKSLCEDDLVPTAKMLMEKMAKRNATIPIAVDVVVGKKFDASEPAVLKNADAVTDDDMIFDIGPKSARELSDIIMKAGTVVWNGPVGVFEFDQFGEGTKTIAMAIADTDAFTLAGGGDTIAAIQKYDIYDKVSYISTAGGAFLEFLEGKKLPAVEILEQRAAGSR

SEQ ID NO: 55683 - protein, 395 aa, Nitrosospira sp. TCH711
MSVIRVTDLDLKGKRVFIRADLNVPVKDSKVTSDARISASMGTIDYCLKQGGKVMVTSHLGRPEEGVWSEENSLKPVADNISERLGKSVRLVKDWVDGNFDVAEGELVILENCRFNKGEKKNVDETAQKYARLCDVFVMDAFGTAHRAEASTYGIARYAPVACAGILLTEELDALTKALLDPARPMVAIVGGSKVSTKLTVLESLSEKVDQLVVGGGIANTFLKAAGKNIGKSLCEDDLVPTAKMLMEKMAKRNATIPIAVDVVVGKKFDASEPAVLKDAGAVTDDDMIFDIGPESARELSDIIMKAGTVVWNGPVGVFEFDQFGEGTKTIAMAIADTDAFTLAGGGDTIAAIQKYDIYDKVSYISTAGGAFLEFLEGKKLPAVEILEQRAAGSR

SEQ ID NO: 55684 - protein, 392 aa, Nitrosomonas sp. CNS332
MSVIKLVDLDLKNKRVFIRSDLNVPVKEGKVTSDARITASMATINHCLKQGARVMVTSHLGRPEEGVWTMENSLQPVANDISRRLGTTVRLIKDWVDGGFEVAPGELVILENCRINKGEKKNLEETAKKYANLCDVFVMDAFGTAHRAEASTHGVAKYAPVACAGILLTEELDALTKALHQPARPLVAIVGGSKVSTKLTVLESLTEKVDQLVVGGGIANTFLKAAGNNVGKSLCEDELVPIAKSLMDKMNQRNATIPIAIDVVVGKKFAADEPAVLKEANAVSDDDMIFDIGPKSTQELVNIIMKAGTVVWNGPVGVFEFDQFGEGTHAIAKAIAETDAFTLAGGGDTIAAIQKYDIYDKVSYISTAGGAFLEFLEGKKLPAVEILELRAQ

SEQ ID NO: 55685 - protein, 453 aa, Pseudomonas fluorescens
MTRNNPQTREWQALSNDHHLAPFSDFKQLKEKGPRIITHAKGVYLWDSEGNKILDGMAGLWCVAVGYGREELADAASQQMRELPYYNLFFQTAHPPVLELSKAIADIAPEGMNHVFFTGSGSEGNDTMLRMVRHYWAIKGQPNKKVIISRKNGYHGSTVAGASLGGMTYMHEQGDLPIPGIVHIAQPYWFGEGGDMSPEEFGVWAANQLEEKILELGVDNVGAFIAEPIQGAGGVIVPPDSYWPRMKEILAKYDILFVADEVICGFGRTGEWFGTDYYGLKPHMMTIAKGLTSGYIPMGGLIVRDDVVAVLNEGGDFNHGFTYSGHPVAAAVALENIRILRDEKIIERVHAETAPYLQKRLRELNDHPLVGEVRGVGLLGAIELVQDKATKRYEGKGVGMICRQFCFDNGLIMRAVGDTMIIAPPLVISKAEIDELVTKARQCLDLTLSALQG

SEQ ID NO: 55686 - protein, 174 aa, Neurospora crassa
MGNTTSSVLDNIVQGSNFDREEVDRLRKRFMKLDKDNSGTIEREEFLSLPQISTNPLATRMIAIFDEDGGGDVDFQEFVSGLSAFSSKGNKEQKLRFAFKVYDIDRDGYISNGELFIVLKMMVGSNLKDQQLQQIVDKTIMEADLDKDGKISFEEFTKMVENTDVSMSMTLDQF

SEQ ID NO: 55687 - protein, 524 aa, Prochlorococcus marinus str. NATL2A
MNNNDKWARYCDLLYSDDSLGFWLDISRMDVAINDFEDFNEIYSKAFDALESLENGSIANIDEGRQVGHYWLRNPKVAPSPEISDSITKEIQDISKFGSSILNGEITNSDGEKYTDVFWIGIGGSGLGPLLIKESFKRESIGLDLHFLDNVDPEGISHKLNSILPNLNSTLFVVVSKSGGTPEPLIGMEQAMKFVRDNNQNWSSRAIAITSKGSKLDLLAHNENWLDIFDLPDWVGGRTSITGAVGLLPAALIGADINKFLNGASQMDALTRVKDIKNNPAALLSLAWFKSGNGKGLRDMVVLPYRDRLEVFSRYLQQLVMESLGKKFDRDENQVNQGIAVYGNKGSTDQHAYVQQLRDGIDNFFVNFIEILHDPLEIVEVKNKRPGDYLSGFLQGTRSALTEGGRQNLTITFKSFDESSLGALIALFERAVSLYAELINVNAYNQPGVEAGKKAATKIIKLQKEIEELLDDGKQRTLNEINDALSSDSTESIYLILRKLSENSDHYSMIGNQSNPDKLIISKT

SEQ ID NO: 55688 - protein, 204 aa, Candida albicans
MTNIFTPIEEALEAYKNGEFLIVMDDEDRENEGDLIMAAELITQEKMAFLVRYSSGYVCVPLSEERANQLELPPMLANRSDRHGTAYTITCDFAEGTTTGISAHDRALTTRSLANPNSKPQDFIKPGHILPLRAVPGLLKKRRGHTEAAVQLSTLAGLQPAGVICELVRDEDGLMMRLDDCIQFGKKHGIKIININQLVEYISK

SEQ ID NO: 55689 - protein, 548 aa, Mycobacterium bovis AF2122/97
MSDARVPRIPAALSAPSLNRGVGFTHAQRRRLGLTGRLPSAVLTLDQQAERVWHQLQSLATDLGRNLLLEQLHYRHEVLYFKVLADHLPELMPVVYTPTVGEAIQRFSDEYRGQRGLFLSIDEPDEIEEAFNTLGLGPEDVDLIVCTDAEAILGIGDWGVGGIQIAVGKLALYTAGGGVDPRRCLAVSLDVGTDNEQLLADPFYLGNRHARRRGREYDEFVSRYIETAQRLFPRAILHFEDFGPANARKILDTYGTDYCVFNDDMQGTGAVVLAAVYSGLKVTGIPLRDQTIVVFGAGTAGMGIADQIRDAMVADGATLEQAVSQIWPLDRPGLLFDDMDDLRDFQVPYAKNRHQLGVAVGDRVGLSDAIKIASPTILLGCSTVYGAFTKEVVEAMTASCKHPMIFPLSNPTSRMEAIPADVLAWSNGRALLATGSPVAPVEFDETTYVIGQANNVLAFPGIGLGVIVAGARLITRRMLHAAAKAIAHQANPTNPGDSLLPDVQNLRAISTTVAEAVYRAAVQDGVASRTHDDVRQAIVDTMWLPAYD

SEQ ID NO: 55690 - protein, 263 aa, Cytophaga hutchinsonii ATCC 33406
MSLPIYIVNAFSFGPFTGNPAAVCPLESWPADGLLQSVAAQNNLSETAFFVKDQDTYTIRWFTPQVEVPLCGHATLAAAHILFNELNYPKNEIRFRSKSGELKVIKEKDILVLNFPSDTFKELPASKTYGSDLGLNPVAVATGKSFILIEVATEQEVIEANPDLQVLKKLDAAIGVIITAKGNTADFVSRFFAPQSGIDEDPVTGSAHCLLIPYWAQKLNKDNLFAKQLSKRGGILHCTYGGTRVFIGGKAELYSKGVINYEL

SEQ ID NO: 55691 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFGAILMAGMDGVKNKIDPGEAMDINLFKLTLDEIREKGIKQMPHTLRRSLEEMLADKQYLKEGQ

SEQ ID NO: 55692 - protein, 60 aa, Phaseolus vulgaris
DCNGACGARCRLSSRPNLCKRACGTCCQRCNCVPPGTSGNQEMCPCYASLTTRGGKRKCP

SEQ ID NO: 55693 - protein, 128 aa, Lilium longiflorum
MISSANNKGAGTSRRKLRSEKAALQFSVSRVEYSLKKGRYCRRLGATAPVYLAAVLENLVAEVLEMAANVTEKHKRIVIKPRHIMLAVRNDVEVNKLFHGVTISASGVVPKTRKELDRRKRRSTSQAD

SEQ ID NO: 55694 - protein, 294 aa, Zea mays
MSHFAAAAVKSPLAVAAPAAGDAKSPLFCPKPRRPAAPLRCHQGGDAGMDLLDLLLSKAVGFDGDVRKQEDAARVIAATVEHFGKLDILVNGAAGNFLASPEDLKPKGFRTVLDIDTVGTYTMCYEALKYLKKGGPGRGPSSGGLIINISATLQYTAAWYQIHVSAAKAGVDGITRSLALEWGTDYDIRVNGIAPGPIQDTPGMRKLAPEEMGNKGKRETMPLFKLGEKWDIAMAALYLAFDAGKYVNGAIIIVDGGLWLSRPRHIPKEEVKALSKVVEKKVRASGVGVPSSKL

SEQ ID NO: 55695 - protein, 560 aa, Arabidopsis thaliana
MASSTALICDTEAWKDLKGHVEDIKKTHLRDLMSDANRCQSMMMEFDGLLLDYSRQRATVETMDKLLNLAKASQLTEKISRMFNGEHINSTENRSVLHVALRAPKDAVIKADGMNVVPEVWNVLDKIKEFSDKIRSGSWVGATGKPLKDVIAIGIGGSFLGPLFVHTALQTDPEALESAKGRQLRFLANIDPVDVARNISGLNPETTLVVVVSKTFTTAETMLNARTLREWITAALGASAVAKHMVAVSTNLALVEKFGIDPNNAFAFWDWVGGRYSVCSAVGVLPLSLQYGFSMVEKFLKGASSIDQHFQSTPFEKNIPVLLGLLSVWNVSFLGYPARAILPYSQALEKFAPHTQQVSMESNGKGVSIDGLPLPFETGEIDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLPELTAYNVGQLLAIYEHRVAVQGFVWGINSFDQWGVELGKVLATQVRKQLHSSRTQGTAPEGFNYSTTTLLKRYLETSSEPQM

SEQ ID NO: 55696 - protein, 243 aa, Salmonella enterica subsp. arizonae serovar 62:z4,z23:--
MNYGDAVPITEGLADNPSIRLQSVQQVFSIFIQETEMSYSGERDNFAPHMALVPMVIEQTSRGERSFDIYSRLLKERVIFLTGQVEDHMANLIVAQMLFLEAENPEKDIYLYINSPGGVITAGMSIYDTMQFIKPDVSTICMGQAASMGAFLLTAGAKGKRFCLPNSRVMIHQPLGGYQGQATDIEIHAREILKVKGRMNELMAHHTGQSLEQIERDTERDRFLSAPEAVEYGLVDSILTHRN

SEQ ID NO: 55697 - protein, 170 aa, Helicobacter pylori
GSGMHTHVSVWKNNENLFSGETYKGLSEFALHFLGGVLRHARGLAAFTNASTNSYKRLIPGYEAPSILTYSANNRSASVRIPYGISKNSARFEFRFPDSSSNPYLAFGAILMAGIDGIKNKMDPGEAMDINLFKLTLNEIREKGIKQMPHTLRRSLEEMLADKQYLKEGQ

SEQ ID NO: 55698 - protein, 552 aa, Arabidopsis halleri subsp. gemmifera
MASSTALFCDTEAWKDLKGHVEDIKKTHLRDLMSDANRCQSMMMEFDGLLLDYSRQRAPVETMDKLLNLAKAAQLTEKISRMFNGEHINSTENRSVLHVALRAPKDAVIKADGKNVVPEVWNVLDKIKEFSEKIRSGSWVGATGKPLKDVIAIGIGGSFLGPLFVHTALQTDPEALESAKGRQLRFLANIDPVDVARNIKGLNPETTLVVVVSKTFTTAETMLNARTLREWITAALGASAVAKHMVAVSTNLALVEKFGIDPNNAFAFWDWVGGRYSVCSAVGVLPLSLQYGFSVVEKFLKGASSIDQHFQSTPFEKNIPVLLGLLSVWNVSFLGYPARAILPYSQALEKFAPHIQQVSMESNGKGVSIDGLPLPFETGEVDFGEPGTNGQHSFYQLIHQGRVIPCDFIGIVKREVVSNHDELMSNFFAQPDALAYGKTPEQLQKENVSENLIPHKTFSGNRPSLSLLLPELTAYNVGQLLAIYEHRVAVQGFVWGINSFDQWGVELGKVLATQVRKQLHSSRTQGTALEGFNYSTTTLLKRYLETSSEPQM

SEQ ID NO: 55699 - protein, 336 aa, Triticum aestivum
  misc_feature (316)..(316): Xaa can be any naturally occurring amino acid
MIEQVCTKKQAGTGPEFPGYRRPTRPPTTPSPTPNSIRSPAAAPLSYSPMAAAPPQPAAPAPGPANGGDAFRLGFVGAGNLAESIARGVAASGVLPASAVRTAPHRRPERGAAFASLGATILASNAQVVDGSDVIVISVKPQIVKQVLVELKPLLSEEKLLVSIAAGIKMKDLQDWSGQRRIIRVMPNTPSAVGQAASVMCLGETATEKDENRVKSLFSAIGKVWTAEEKYFDAVTGLSGSGPAYIFLAIEAMADGGVAAGLPRDLALGLAAQTVLGAATMVSETGKHPGQLKDQVTSPAGTTIAGVHELEKGSFXGTLINAVVAATTRCRELSKN

SEQ ID NO: 55700 - protein, 438 aa, Actinobacillus pleuropneumoniae serovar 1 str. 4074
MLTQEKNDLNKSGLDITNDTLVLILAGGRGSRLYELTDRRAKPAVYFGGCRRIIDFALSNCINSNLLKIGVITQYAAHSLLRHLQRGWSFLPYERNQYIDMLPARQQLDENTWYRGTADAVYQNMSMMKSHYRPKYVVILAGDHIYKMDYTQMLRDHVESGAKCTVGCIEVPREQAVEFGVMAVNDKLKVKEFVEKPADPPAMPGRPDSSLASMGIYVFDADYLYKMLEQEAAVPGTSHDFGKDIIPKAVEEGVLYAHPFERSCKGRNATGAIYWRDVGTIDSYWAAHMDLVSEEPQLDLYDESWPIHGRPQQTAPARFYYNKQRQRTLDNSLIAGGCVITDAEISNSVLFNRVHVAEETIIEHTVILPQVSIGKNCVIKRAVIDRHCVIPDGLQIGVNPEEDAKHFRVSKGGIVLVTQGMLDKLQGITSNIKLHHTI

SEQ ID NO: 55701 - protein, 691 aa, Burkholderia sp. 383
MGLSNALPAHRGGRRQRDVHRNDLQEHRQTMNRTAIFPYASALLAAALLTACGGDVENEAARTPTPSTDASCLAVDNSGATVVVGSNQPGDPSLPEASSGYRTGMKPVYAKTYLVATSNAYASAAGCAVLKKGGTAADAAVAVQAVLGLTVPEATGLGSGGVLLYYDARGKTLQAYDGRETAPAAATENYLRYVDDATDQSAPLPNARASGRSIGTIGVPRLIEALQQDHGRLPWQNLFGDAITLATNGFPIGGRLADAIAANAANLKRDPEAAAYFLNADGSPKTLGTVLKNPAYAHTLTLMAQSGANALYTGQIAQDIVAKIATTKGADGSTLTPGKTTVADLAAYQAKRRTPVCTTYRSYWVCGMPPPSSGGIAVASALGILENYDLKSLKPTAIDLEGGKPTVAGVHLVTEAERLAYADRDKYVADTDFVPLPGGTWDTLLNKPYLKSRAALIDPTKSMGTAQPGNLGAVPLGVDTTLIEHGTNQFTIVDGDGNVLSATTTVESSMGSFHMTNGFLLNNQLTDFSANPVDSAGNPVANRLQPGKRPRSSMAPTIVFGQAADGSRGDFVMATGSPGGGTIPQYVVKTLVGALDWGLDAQQSAGLVDFGASNSPTTTIGGEHPNVNTANNGANDPLITGLLALGHKVSTSAQASGVNTVMRVTVGQSPALQGGTDPRREGVVLGDTFRP

SEQ ID NO: 55702 - protein, 271 aa, Haemophilus somnus 2336
MQHKLISFIGGGNMAQAIVLGLLKQGYPAHYIRVCDPNQSRRDLFIAQGTQVSSNNVEAIQDADVVLLAVKPQIMAEVCVPLSAVDFSDKLVISIAAGISTVRLTALLPSAKNIIRVMPNTPALVSAGMAGLFATPQVSVNLKQFAQDLLSAMGEICWLEQEQDMHAVTAGSGSSPAYFFLFMEAMQQALIEMNLDPKTARLLVQQSALGAAKMVIENPQIALSELREDVTSKGGTTASALAVFNEQNVTQIIKQAMLACVKRSQEMESLF

SEQ ID NO: 55703 - protein, 129 aa, Solibacter usitatus Ellin6076
MESDILVVDDSAAIRKILQRVLRQTGMAIRAIHEAGDGQEALALLAEHRVDLVLTDINMPKMDGLQLLASLKASAQWHNTPVVMITTEGGETKVAEAVKLGAAGYVRKPFTADQIKEKLVGILEPALPL

SEQ ID NO: 55704 - protein, 392 aa, Nitrosomonas sp. OZK11
MSVIKLVDLDLKNKRVFIRADLNVPVKEGKVTSDARITASMATINHCLKQGAKVMVTSHLGRPEEGVWTEENSLQPVADDISRRLGKPVRLIKDWIDGGFEVAPGELVILENCRINKGEKKNLEDTAKKYASLCDIFVMDAFGTAHRAEASTHGIAKYAPVACAGILLTEELEALTKALQQPARPLVAIVGGSKVSTKLTVLESLAEKVDQLVVGGGIANTFLKAAGNNIGKSLCEDDLVPVAKSLMEKMSKRNATIPIAVDVVVGKKFAADEPAVLKTADAVSDDDMIFDIGPKSAQELVHIIMKAGTVLWNGPVGVFEFDQFGEGTHAIAKAIAETSAFTLAGGGDTIAAIQKYDIYDKVSYISTAGGAFLEFLEGKKLPAVEILELRAQ

SEQ ID NO: 55705 - protein, 392 aa, Nitrosospira sp. GS832
MSVIRVTDLDLKGKRVFIRADLNVPVKDGKVTSDARISASMGTIDYCLKQGGKVMVTSHLGRPEEGVWSGENSLKPVADNISERLGKPVRLVKDWVDGNFDVAEGELVILENCRFNKGEKKNADETAQKYARLCDVFVMDAFGTAHRAEASTYGIARYAPVACAGILLTEELDALTRALLDPARPMVAIVGGSKVSTKLTVLESLSEKVDQLVVGGGIANTFLKAAGKNVGKSLCEDDLVPTAKMLMEKMAKRNATIPIAVDVVVGKKFDASEPAVLKDAGAVTDDDMIFDVGPKSARELSDIIMNSGTVVWNGPVGVFEFDQFGAGTRTIAMAIAHTKAFTLAGGGDTIAAIQKYDIYDKVSYISTAGGAFLEFLEGKKLPAVEILEQRAQ

SEQ ID NO: 55706 - protein, 524 aa, Pisum sativum
MEPLSSTKQINNNNNNLAKPSSLHVETQPLEPSPLRKIMVVASIAAGVQFGWALQLSLLTPYVQLLGIHHTWAAYIWLCGPISGMLVQPVVGYHSDRCTSRFGRRRPFIAAGSIAVAIAVFLIGYAADLGHSFGDNLDKKVRPRAIGIFVVGFWILDVANNMLQGPCRALLGDLCAGNQRKTRNANAFFSFFMAVGNVLGYAAGAYSKLYHVFPFTKTEACNVYCANLKSCFFLSIALLTVLATAALIYVKETPLIAEKAVVTAEDGGSNGGMPCFGQLSGAFKELKRPMWILLLVTCLNWIAWFPFLLFDTDWMGKEVYGGTVGEGHAYDMGVRAGALGLMLNSVVLGATSLGVDILARGVGGVKRLWGIVNFLLAICLGLTVLVTKLAQHSRQYAPGTGGLQDPLPPSGGIKAGALTLFSVLGIPLAITYSIPFALASIFSSTSGAGQGLSLGVLNLAIVIPQMFVSVLSGPWDALFGGGNLPAFVVGAVAALASGILSMILLPSPPPDMAKSVSATGGGFH

SEQ ID NO: 55707 - protein, 255 aa, Lentisphaera araneosa HTCC2155
MFRPCIDLHNGQVKQIVGGTLDDSESPDTNFVSENDSAYYAELYRKDSLSGGHVIKLGPGNDEAAKNALKAWPGGLQIGGGINDQNARFWLDQGASHLIVTSHVFSNGQFDQGKLDELVKITGKGKLILDLSCRIRDGKYWIVTDRWTKFTETELNEKSLDFFSQYCDEFLIHAVDVEGMCKGVDMNLVELLTDKSPLISTYAGGAKSLDDLEKITNLSQNRVHLTIGSALDIFGGKDIKYTEALAFNNQYESSL

SEQ ID NO: 55708 - protein, 392 aa, Nitrosospira sp. NRS527
MSVIRVTDLDLKGKRVFIRADLNVPVKDGKVTSDARISASMGTIDYCLKQGGKVMVTSHLGRPEEGVWSGENSLKPVADNISERLGKPVRLVNDWVDDNFDVAEGELVILENCRFNKGEKKNADETAQKYARLCDVFVMDAFGTAHRAEASTYGIARYAPVACAGILLTEELDALTRALLDPARPMVAIVGGSKVSTKLTVLESLSEKVDQLVVGGGIANTFLKAAGKNVGKSLCEDDLVPTAKMLMEKMAKRNATIPIAVDVVVGKKFDASEPAVLKDAGAVTDDDMIFDVGPKSARELSDIIMKAGTVVWNGPVGVFEFDQFGAGTRTIAMAIAHTKAFTLAGGGDTIAAIQKYDIYDKVSYISTAGGAFLEFLEGKKLPAVEILEQRAQ

SEQ ID NO: 55709 - protein, 289 aa, Salmonella enterica subsp. enterica serovar Paratyphi B str.
MEYSILSNNLKMPMVGFGVFKVTDKEECQLSVLSAIRSGYRLIDTAAVYGNEDAVGDAVREAIATGLCTREELFITSKLWVQDMANYDLAKAGIEASLKKSGLDYFDLYLLHQAMGDYFSAWRALEDAYEAGKLKAIGVSNFYAHVLANFCETVRITPMVNQVELHPYFAQPAALETMKHYNVQPEAWAPLGGGRHKPYENVMLQGIADAHQKTIAQVVLRWNVQRGVTVIPKSTRQERIEENFAIWDFSLTDNEMAQINALDLGYVGEAVKHFNPEFVRGCLGVKIHD

SEQ ID NO: 55710 - protein, 411 aa, Xanthobacter autotrophicus Py2
MTNEQDHAPTAPAEGRDVRPSAEGWSEPKPTAVLVLADGTVLEGFGIGAEARLAGEVCFNTAITGYEEILTDPSYAGQIITFTFPHIGNVGTNEEDIETVSMAAASGVRGVVLRTAVTEPSNYRATRHLNEWLKARGIPGITGIDTRALTALIREAGMPNAVIAHSADGVFDIEALKAEARAWPGLVGMDLVPGVTSAQRFGWDETTWEWEKGYGHQDAPRHHVVAVDYGVKRNILRLLARAGCKVTVVPATTSADDILALKPDGVFLSNGPGDPAATGEYAVPVIRRIIETGVPTFGICLGHQMIGLAVGGRTVKMHQGHHGANHPVKDLTTGKVEITSMNHGFAVDRETLPKNAVETHVSLFDGSNAGIALADRPVFSVQYHPEASPGPQDSHYLFDRFIEMIGKHKAA

SEQ ID NO: 55711 - protein, 392 aa, Nitrosospira sp. TYM9
MSVIRVTDLDLKGKRVLIRADLNVPVKDGKVTSDARISASMGTIDYCLKQGGKVMVTSHLGRPEEGVWTGENSLKPVADNISERLGKPVRLVKDWVDGNFDVAEGELVILENCRFNKGEKKNADETAQKYARLCDVFVMDAFGTAHRAEASTYGIARYAPVACASILLTEELDALTRALLDPARPMVAIVGGSKVSTKLTVLESLSEKVDQLVVGGGIASTFLKAAGKNVGKSLCEDDLVPTAKMLMEKMAKRNATIPIAVDVVVGKKFDASEPAVLKDAGAVTDDDMIFDVGPKSARELSDIIMKAGTVVWNGPVGVFEFDQFGAGTKTIAMAIAHTKAFTLAGGGDTIAAIQKYDIYDKVSYISTAGGAFLEFLEGKKLPAVEILEQRAQ

SEQ ID NO: 55712 - protein, 155 aa, Xanthobacter autotrophicus Py2
MMTVDDMLRAKRDTRIITLRMHETVADAVLVMKRENISSVIVKDVCRTEGNTVVGVFSERDVTRAVLEHGANTPKMVLASLLKREVISCSLADSIETVLRLMVEHQVRHLPVIENHSLVGVISATDLMRHYLKEEEAALREPVTAGMEAGLAALR

SEQ ID NO: 55713 - protein, 468 aa, Bacillus cereus ATCC 10987
MKRENNVKKRMGYVMNTKKFAKVNEQIPGPKAASLLERRQNIVPKGVSNGIPTFVQSANGALVTDVDGNQYIDFAGAIGTINVGHCHPAVKEALHKQVDQYIHTGFNVMMYEPYIELAEKLAALAPGSFDKQVLFLNSGAEAVENAVKIARKYTKRPGIIAFSKGFHGRTLMTMTMTSKVKPYKFGFGPFAPEVYKAPFPYEYRRPEGLTEEQYDNFMIEEFKNFFISEVAPETIAAVVMEPVQGEGGFIVPSKKFVQEVRNICSEHGILFVADEIQTGFSRTGKYFAIDHYDVVPDLITVSKSLGAGVPISGVIGRKEIMNESAPGELGGTYAGSPLGCAAALAVLDVIEKENLNDRAIELGKVVINRFEEMKNKYNCIGDVRGLGAMCAFELVQDRKTKAPDKTLTANLCAEANKRGLLLLSAGTYGNVIRVLMPLVITDEQLEEGLTIIEESLQVCYEKANIARV

SEQ ID NO: 55714 - protein, 284 aa, Zea mays
MAPLGDGGAAAAAASNNLVVSFGEMLIDFVPDVAGLSLAESGGFVKAPGGAPANVACAIAKLGGAGPGPGAAARVFHYGSISLISEPCRSAHMAAMRAAKAAGVLCSYDPNVRLPLWPSPDAAREGILSIWKEADFIKVSDDEVAFLTRGDANDEKNVLSLWFDGLKLLVVTDGDKGCRYFTKDFKGSVPGFKVDTVDTTGAGDAFVGSLLVNVAKDDSIFHNEEKLREALKFSNACVAICTTKKGAIPALPTVATAQDLIAVPPRHCPPPPRPSSSTSSVSVH

SEQ ID NO: 55715 - protein, 393 aa, Nitrosovibrio sp. FJI82
MPVIKLIDLDLKDKRVFIRADLNVPVKDGKVTSDARISASMATINHCLRQGARVMVTSHLGRPEEGVWSEENSLKPVADNIAARLGKPVRLIRDWVDGGFEVAAGELVVLENCRINKGEKKNLDETAQKYARLCDVFVMDAFGTAHRAEASTHGIAKYAPVACAGILLTEELDALTKALLNPARPMVAIVGGSKVSTKLTVLESLSEKVDQLVVGGGIANTFLKAAGNNVGKSLCENDLVPTAKMLMEKMEQRNASIPIAVDVVVGKKFDANEPAVLKDAAGVADDEMIFDIGPKSAQALADIIMQAGTVVWNGPVGVFEFDQFGAGTKAVALAIVNTKAFTLAGGGDTIAAIQKYDIYDKVSYISTAGGAFLEFLEGKKQPAVEILEQRALA

SEQ ID NO: 55716 - protein, 483 aa, Bacillus cereus ATCC 10987
MDKKATFVNVEKKAMYINGEWITLQEQIEVNNPATKEIFATVPKGGVTEAKQAVDAAHEAFKSWSKLTAADRAVKLKKWFTLIDENKEEIAAIMTREQGKPFAEALGEVNYANSFVEWYAEEGKRVYGEMIPASHPNKRILVMKQPVGVMAAITPWNFPAAMITRKVAPALAAGCTAVVKPASQTPLTALKLAELAHEADIPKGVINIVTGSAKAIADTWMEDGRVRKVSFTGSTEIGKELMASAAQTMKKVSLELGGHAPFIVMNDADLDKVVEAVIGSKFRNAGQTCICTNRVFVQEEVYEVFAEKFQKSVGQLKVGDGFGDGTTVGPLIDENAVSKVQEHIADAIQKGGTVLYGGQKVAELDGHFMQPTVIGLANDTMLCMNEETFGPVAPVAKFKTVEEVIERANNTPYGLAAYIFTKDISQAFQISEALEYGIIGLNDGLPSVAQAPFGGFKESGIGREGGHFGIEEYLEIKYISLGL

SEQ ID NO: 55717 - protein, 333 aa, Streptococcus thermophilus
MAILVLGGAGYIGSHMVDRLVEKGQEKVVVVDSLVTGHRAAVHPDAIFYQGDLSDQDFMRKVFKENPDVDAVIHFAAYSLVGESMEKPLKYFDNNTAGMVKLLEVMNECGVKYIVFSSTAATYGIPEEIPILETTPQNPINPYGESKLMMETIMRWSDQAYGIKYVPLRYFNVAGAKPDGSIGEDHGPETHLLPIILQVAQGVREKIMIFGDDYNTPDGTNVRDYVHPFDLADAHLLAVEYLREGNESTAFNLGSSTGFSNLQILEAARKVTGKEIPSEKADRRPGDPDILIASSEKARTVLGWKPQFDNIEKIIASAWAWHSSHPKGYDDRG

SEQ ID NO: 55718 - protein, 538 aa, Burkholderia thailandensis E264
MPVFDSRLDTASAAFRDNAEHMRALIAHWQALNARAAHESAKAGPRFDKRGQLLPRERLALLVDAGAPFLELASLAGYLVGESDPDQSVPGAGLIGGIGYVSGTRCMIVVADSGIDAGALQPMGLEKFQRLQRIALEHRLPFVHLVESAGANLMQYRVEEFIHGGRHFFQLAKLSAAGIPVFTLVHGSSTAGGAYMPGLSDYVVMVRDRAKAFLAGPPLLKAATGEIATDEELGGATMHASVSGLADYVADDDADGIRILRELVDKLGWREREAALPAGGEPALDPEGLLGILPRDGKKPVDMREVIARIVDASDFLEFQPSYGPATVCAHARLHGMPVGVVTNNGPLDPAGATKATHFIQACCQSDVPLVYLQNTTGFIVGRESERAGMIKHGAKMIQAVSNATVPQITILCGASFGAGNYGMCGRGFDPAFVFSWPNARTAVMGAEQAALTMAIVTEGAARAKGIEPDRARIDAMREKIVANFERQTHAFYTSGRMLDDGVIDPRDTRRVLAMTLAVCRDGRRKSVQPLTFGVARP

SEQ ID NO: 55719 - protein, 242 aa, Oryza sativa Japonica Group
KDQVHMEADRKAMANQANVPADPQFQSRTTYRVKNKVIYCLDGARIGIQYETYFAGEPCEIYHCVLESKSFLEKMTVIEHTLPFFLPIREVESEFLSSNAIKFIDHLEEILQSYVDRREQVRLIKELYGNQIGELFHSLSYNLIEFVMEDFECKVTVSIRYSDLLFTLPSQARVLAWPLRSSRGISVTERRASRSASAQLVPFRLPYAEDALKTLSLPEAFAEIVLSLPRALKRILSSQESD

SEQ ID NO: 55720 - protein, 547 aa, Xanthobacter autotrophicus Py2
MTSNAHATDAAFKALAIAWTTREGRILDLFAQPDRFERFSVAYGDLLIDFSKTAITDDILSQLLELARAGGVEAQRDAMFAGDHINLTEDRAVLHTALRDQASDTIQVDGIDVKPGVVETLARLGDFATGVREGRIAGARGGVITDVVNIGIGGSDLGPAMVTLALAPYHDGPRCHFVSNVDSAHITDVLKGLDPATTLFIVASKTFTTVETMTNAATARAFIVNALGEDAVGAHFAAVSTALDKVGAFGIPADRIFGFWDWVGGRYSVWSAIGLPLMLAIGPDRFREFLAGAAAMDEHFRSAVLDQNLPVLLGLIGLWHRNACGFPSRAIIPYDQRLARLPAYLQQLDMESNGKSVTRDGAAVSRPTGPIVWGEPGTNAQHAFFQLLHQGTDIVPVEFLVGAQSHEPALKDHQDLLVANCLAQSEALMRGRTLEEATAQLRAKGISEDKVAEIAPHRVFPGDRPSLTIAYATLDPFTLGRIIALYEHRVFVEAAVWGINGFDQWGVELGKELATQFLPAVTGGALPPSASASTSGLIAHLDAVAGG

SEQ ID NO: 55721 - protein, 709 aa, Streptococcus pneumoniae
MFASKNERKVHYSIRKFSIGVASVAVASLFMGSVVHATAEGGNYPSSPCSSSEANKSQTEHMKAAEQGKQHREIDLDRNKAKKAIDEYIEKMLSEIQLDKRKHTQNFALNLKLSRIKTEYLYGLSVLKEKSEAELPSKAELPSKIKEKLTAAFEHFKKDTLRPGEKVAEAKKKVEEAEKKAKDQKEEDYRNYPTITYKTLELEIAESDVEVKKAELELVKEEANKPRNEQKVKQAKAKVESKQAEATRLEKIKTDREEAEEEAKRRAEAKLKEAVEKNTATSEQGKPKGRAKRGALGEPATPDKKENDAKSSDSSVGEETLPSPSLKPEKKVAEAEKKVEEAEKKAKDQKEEDRRNYPTNTYKTLDLEIAESDVKVKEAELELVKEEAKEPRDEEKIKQAKEKVESKKAEPTRLEKIKTDRKKAEEAKRKAAEEDKVKEKPAEQPQPAPAPQPEKPAPKPEKPAEHPKAENRADQQAEEDYARRSEEEYNRLTQQQPPKTEKPAQPSTPKTGWKQENGMWYFYNTDGSMATGWLQNNGSWYYLNANGAMATGWLQNNGSWYYLNANGSMATGWLQNNGSWYYLNANGAMATGWLQYSGSWYYLNRNGAMATGWLQYNGSWYYLNANGDMATGWLQYNGSWYYLNANGDMATGWVKDGDTWYYLEASGAMKASQWFKVSDKWYYVNGSGALAVNTTVDGYGVNANGEWVN

SEQ ID NO: 55722 - protein, 333 aa, Streptococcus thermophilus
MAILVLGGAGYIGSHMVDRLVEKGQEKVVVVDSLVTGHRAAVHPDAIFYQGDLSDQDFMRKVFKENPDVDAVIHFAAYSLVGESMEKPLKYFDNNTAGMVKLLEVMNECGVKYIVFSSTAATYGIPEEIPILETTPQNPINPYGESKLMMETIMKWSDKAYGIKYVPLRYFNVAGAKPDGSIGEDHGPETHLLPIILQVAQGVREKIMIFGDDYNTPDGTNVRDYVHPFDLADAHLLAVEYLRKGNESTAFNLGSSTGFSNLQILEAARKVTGKEIPAEKVDRRPGDPDILIASSEKARTVLGWKPQFDNIEKIIASAWAWHSSHPKGYDDRG

SEQ ID NO: 55723 - protein, 291 aa, Saccharomyces cerevisiae YJM789
MPKTSYLNKNFESAHYNNVRPSYPLSLVNEIMKFHKGTRKSLVDIGCGTGKATFVVELYFKEVIGIDPSSAMLSIAEKETNERRLDKKIRFINAPGEDLSSIRPESVDMVISAEAIHWCNLERLFQQVSSILRSDGTFAFWFYIQPEFVDFPEALNVYYKYGWSKDYMGKYLNDNQREILLNYGGEKLRSLLSDRFGDIEVTIYSPSDPNASTVTAENSQFLWRAAITLNQFKEFVKSWSIYTSWARDNPSKPDIADIFINELKEICHCEDLNVPLKIEWSTFYYLCRKRE

SEQ ID NO: 55724 - protein, 425 aa, Glycine max
MEMERIVEFPHTYMDRPPRKRARLGWDIAEVPKAQVGLFCGQEVENISSFAPSEHPPSSLFKGVARNGSPPWRDDDKDGHYMFELGDNLTSRYKIHGKMGEGTFGQVLECWDRERKEMVAIKIVRGIKKYREAAMVEIEVLQQLGKHDKGSNRCVQIRNWFDYRNHICIVFEKLGPSLYDFLRKNSYRSFPIDLVREIGWQLLECVAFMHDLHMIHTDLKPENILLVSPEYLKIPDYKSTTRSPSSFFKRVPKSSAIKVIDFGSTTYEREDQTYIVSTRHYRAPEVILGLGWSYPCDIWSVGCILVELCTGEALFQTHENLEHLAMMERVLGPIPQQMLKRVDRHAEKYVRRGRLDWPEGAASRESIKAVMKLPRLQNIIMQHVDHSAGDLIHLLQGLLRYDPFERLTARDALRHSFFTRDQLRR

SEQ ID NO: 55725 - protein, 170 aa, Helicobacter pylori
GSGMHTHVSIWKNNENLFSGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKESQ

SEQ ID NO: 55726 - protein, 201 aa, Bacteroides fragilis NCTC 9343
MEITNAEFVISNTDVKKCPAGTFPEYAFIGRSNVGKSSLINMLTGRKGLAMTSATPGKTMLINHFLINNSWYLVDLPGYGYARRGQKGQKQIRTIIEDYILEREQMTNLFVLIDSRLEPQKIDLEFMEWLGENGIPFAIIFTKADKLKGGRLKINISAYLRELRKQWEELPPYFITSSEERLGRTEVLNYIESINKELNSK

SEQ ID NO: 55727 - protein, 170 aa, Helicobacter pylori
GSGMHTHVSVWKNNENLFSGETYKGLSGFALHFLGGVLHHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKEGQ

SEQ ID NO: 55728 - protein, 388 aa, Oryza sativa Japonica Group
MTFPSTARVAAEPLGVVLVISAWNYPFLLSIDPIIGAIAAGNAVVLKPSEVAPATSSLLAELLPRYVDGSCIKVVEGGVAETTTLLEQKWDKIFYTGNGKVGRIVMASAAKHLTPVVLELGGKCPVVVDSNVNLHVTAKRIAAGKWGCNNGQACISPDFIITTKSFAPKLLEALEKVLEKFYGRDPLRSSDLSRIVNSNHFNRLKKLMDDENVSDKIVFGGQRDEHQLKIAPTIFMDVPLDSGIMKEEIFGPLLPIITVDKIHESFALINSMTKALAAYLFTKDSKLQEQYEAAISAGGMLVNDTAVHLTNQYLPFGGVGESGMGAYHGRFSFEAFSHKKAVLVRRFAGEAAARYPPYSPAKLKILRGVLKGNLGAMIKAILGFPRGK

SEQ ID NO: 55729 - protein, 493 aa, Mycobacterium smegmatis str. MC2 155
MAVKVASSWINGASVETSGETHQIIDPATGKSVSEYNLATAADVDTAVAAARAAFPAWAGATPAERSAVLAKLAKLADEHAEQFVAEEVSQTGKPVRLATEFDVPGSVDNIDFFAGAARHLEGKATAEYSGDHTSSIRREAVGVVATITPWNYPLQMAVWKVIPALAAGCAVVIKPAEITPLTTLTLARLASEAGLPDGVFNVVTGSGAEVGTALAGHRDVDVVTFTGSTAVGRKVMASAAVHGHRTQLELGGKAPFVVFSDADLDAAVQGAVAGALINTGQDCTAATRAIVARELYDDFVAGVAEVMGKIVVGDPHDPDTDLGPLISYAHRDKVAGMVARAPQQGGRVVTGGEAPDLPGAFYRPTLIADVDESSEVYRDEIFGPVLTVRSFTDDDDALRQANDTEYGLAASAWTRDVYRAQRASREINAGCVWINDHIPIISEMPHGGVGASGFGKDMSDYSFEEYLTIKHVMSDITGVAEKEWHRTIFNKR

SEQ ID NO: 55730 - protein, 387 aa, Mycobacterium smegmatis str. MC2 155
MDLFEYQAKELFAKHNVPTSPGRVTDSAEDAKTIAEEIGRPVMVKAQVKTGGRGKAGGVKYAATPDDAFTHANNILGLDIKGHVVKKLLVAEASDIAEEYYISFLLDRANRTYLAMCSVEGGMEIEEVAATKPERLAKVPVDAVKGVDLAFARSIAEQGHLPAEVLDAAAVTIQKLWEVFVKEDATLVEVNPLVRTPDDQILALDGKVTLDENAGFRQPGHAEFEDRDATDPLELKAKENDLNYVKLDGQVGIIGNGAGLVMSTLDVVAYAGENHGGVKPANFLDIGGGASAAVMAAGLDVILGDSQVKSVFVNVFGGITACDAVANGIVQALQILGDEANKPLVVRLDGNNVEEGRRILAEANHPLVIQAETMDAGADKAAELANK

SEQ ID NO: 55731 - protein, 429 aa, Physcomitrella patens subsp. patens
MTLQEDLAVALVVVALLFGEVAALGGVSTSETWLHCSRMKESMNSTQLSSVCTTDTDCGPGLSCFACKTAAPVCIVNQALSVSSFPKTYSLPYNKYAWITTHNAYAIEGEQSILGTTIISPKNQEDSVTSQLNRNVRGLMLDVYEFRGDLWLCHSIGQCFDATAFRPLNSTLLEVASFLDTNPNEVVTIFIEDYVTTPNVLKNHFLSTGLMKYMFPLSLMPRDGSDWPTIASMIASNQRLIVFTSDKTKEGTEGIAYQWNFVVENQYGTLTETCSNRAESAALTDTTKSLILENYFPNDPNIDDACVINSASLAEAISVCHTAAGNRWSNFLAVDFYKRSTAGGVFSAINKLNGQHHCGCNDIHQCQASSTQGGCSAVTAHAVLTPAQISRKSEGPAPSPESSSTYVTMSKIIFCTHFLISCLSLFLQF

SEQ ID NO: 55732 - protein, 292 aa, Deinococcus radiodurans R1
MLSRDQHCFTFAKRFSFLVCIRIVNMIVVKVGGSDGIDYDAVCADLAERWQAGEKLILVHGGSGETNRVAEALGHPPKFVTSPSGYTSRFTDRQTLEIFEMVYCGKMNKGLVERLQRLGVNAVGLSGLDGRIFEGKHKDSVRSVENGKVKVLRGDHTGTVEKVNTGLIELLLGAGYLPVLTPPAASYEGVAINVDGDRAAAQLAAALRAEALLLLSNVPGLLRDYPDEASLIREIPANDVESYLEFAQDRMKKKVLGAAEAVAGGVGRVVFGDARAGKPISAALAGEGTVVS

SEQ ID NO: 55733 - protein, 498 aa, Glycine max
  misc_feature (475)..(475): Xaa can be any naturally occurring amino acid
MTPFYFLLFAFILFLSINFLIQTRRFKNLPPGPFSFPIIGNLHQLKQPLHRTFHALSQKYGPIFSLWFGSRFVVVVSSPLAVQECFTKNDIVLANRPHFLTGKYIGYNNTTVAVSPYGDHWRNLRRIMALEVLSTHRINSFLENRRDEIMRLVQKLARDSRNGFTKVELKSRFSEMTFNTIMRMVSGKRYYGEDCDVSDVQEARQFREIIKELVTLGGANNPGDFLALLRWFDFDGLEKRLKRISKRTDAFLQGLIDQHRNGKHRANTMIDHLLAQQQSQPEYYTDQIIKGLALVMLLAGTDTSAVTLEWAMSNLLNHPEILKKAKNELDTHIGQDRLVDEPDIPKLPYLQSIVYETLRLHPAAPMLVPHLSSEDCTIGEYNIPQNTILLVNAWAIHRDPKLWSDPTHFKPERFENESEANKLLPFGLGRRACPGANLAQRTLSLTLALLIQCFEWKRTTKKEIDMTEGKGLTVXKKYPLEAMCQVCQSLTVKDIYNF

SEQ ID NO: 55734 - protein, 245 aa, Variovorax paradoxus
GGNKLRKLEYLIPEALEGGYDTLVSIGGVQSNQTRQVAAVAAHLGLKCVLVQENWVNYSDAVYDRVGNIEMSRIMGADVRLDAAGFDIGIRQSWEQAMADVRAAGGKPFPIPAGCSEHPRGGLGFVGFAEEVRQQEAELGFKFDYIVVCSVTGSTQAGMVVGSAADGRADRVIGIDASAKPQQTFEQILRIAKNTAELVELGRDITEKDVVLDRRFGGPEYGLPNEGTLEAIRLSARFEGMLTDP

SEQ ID NO: 55735 - protein, 361 aa, Lentisphaera araneosa HTCC2155
MNQLKDRLEKKLDHLRRGELLYYKAEKSEDVYAFCFLNKSAELKIADLMTYGGPLSLLVSDQSEICQSREIIEDCTVLPCEFTPQGLINVFNNQSETEDRVLLRVVKNHDILENLSVEGRIVEFASNVEGDEHCLIYTKIYNKVNVDSSLLLNEEDVSLSRFFNPRLIEMTGMTELDLQQGSFKLYSFYSEIDARYHWAFVCDEKKEEKKTPLVRIESECLTGHVFGSLLCDCGDQLSKGLEEIKEYGYGALVYLRQEGRGIGLKAKLDAYYLQQFHGMDTVDANIAVGMPEDARDYLIGAQIINYLKFEPLKLLTNNPAKITGLNRYGLSVEQQVSHIIPPSKHNKRYLDTKRDRMGHRI

SEQ ID NO: 55736 - protein, 360 aa, Lentisphaera araneosa HTCC2155
MSLDRDTEKVLDKLKSGDRVVVADDDKYYLVFAAAACTSAYVTFMMNDCRGQVQIALKKSSPLNSVLSRQTFELNNTLKTGINANDRCHCILRMIDEHVQAGDFISPGFLKVNWISHGAALVKPGIAEAAYDLARLSEHSEGSVFCQLLDEEANGLSEEQVKYFASDNDLAITDLNDVIEYRLNKEPLVEALNIVNMPTDYGDFRLHVYNVIYDPARGIDLVLTCGKDKFDEDETVLVRVHSEWSIGNIVNRLKNEEGSSLNRAMKQVADEGSGIIVFLRNTPEQAANSGLFSDSKRPTDIWMENGEIKTLRPKDGMAYGLGAQILRDLGVRKMRLMSNSPSSFIGINNYGLEIVEQVKY

SEQ ID NO: 55737 - protein, 368 aa, Triticum aestivum
KITPSPPLPSPQPQRTSAMAAASAADEAWCRETVPRVMELVSPRLPQRDACALLSVSPWCHRALAANPKLWEVLDLHEMKKAGERLISALTLARYRHLKVVNLEFAQDIEDRHFLHLKETGAILLEELELLNLNACQKISDTGIGSATSLCPNLRALSIYWIVGLTDASIEHAVKNCKQIIDLNLSGCKNISDRGIQLVADNYQGLQKLDITRCIKLTDDALQKVLEKCSALESLNMYALSSFTDKAYTKIGYLANLTFLDLCGAQNLTDDGLSSISRCGSLTYLNLSWCVRVTDVGVVAIAQGCRSLELLSLFGILGVTDACLEALSKSCPNSLTTLDVNGCTGIKRRSRDDLIQLFPRLSCFKVHS

SEQ ID NO: 55738 - protein, 311 aa, Desulfitobacterium hafniense Y51
MAKQATRDAYGKTLVALGAENKDIVVLDADLSKSTKTADFAKHYPERFFNMGIAEANLMGTAAGLAAAGKIPFASTFAIFATGRAFEQIRNSIAYPKLNVKIAATHAGVTVGEDGGSHQAVEDVAIMRAVPNMTVLVPADGVETQQAIRAAAAYEGPVYIRMGRLDVPLLFDDQYQFEIGKANVLREGSDCVVFANGVMVAAALEAAQDLEQENIRVAVVNVASVKPLDVQTIVACAQKTGAAVTAEEHNIIGGLGSAVAEALSEQAPTPLVRVGIKDTFGESGRPLELLEKYGLTKKEVMAAVKAAIARK

SEQ ID NO: 55739 - protein, 484 aa, Agrobacterium tumefaciens str. C58
MIKLKNAALLRDACLVNGRWLKAADGKTIAVENPANSMIIGHVPSLSADEVKAAVESAGKAFSEWSRRSAKDRAAILRRWFDLMVANADDLGALMTAEQGKPFAEAKGEALYAASFVEWFAEEAKRVYGDTIPSPTTDKRITILKQPIGVCAAITPWNFPAAMITRKAAPALAAGCAMIVKPAEQTPLTALALGVLAEEAGVPAGVFQVVTGAARDIGKVFTESDTVRKISFTGSTEVGRLLMAQSAPTIKKLSLELGGNAPFIVFDDADLDAAVEGAIVSKYRNAGQTCVCSNRIYVQDGVYDAFAEKLVKRVESLSVGEGTEPVVLIGPLIDQEAVPKVEDHVADALGKGAKIVIGGKRHALGGTFYEPTVLTGATQAMKVAREETFGPVAPLFRFGTEDEAVAMANDTEFGLAAYFYTENVRRTWRVAEALEYGMVGHNTGLISNEVAPFGGVKQSDLGREGSHYGIDEYLEIKYLCSAIG

SEQ ID NO: 55740 - protein, 393 aa, Nitrosovibrio sp. RY3C
MPVIKLIDLDLKDKRVFIRANLNVPVKDGKVTSDARISASMATINHCLRQGARVMVTSHLGRPEEGVWSEENSLKPVADNIAARLGKPVRLIRDWVDGGFEVAAGELVVLENCRINKGEKKNLDETAQKYARLCDVFVMDAFGTAHRAEASTHGIAKYAPVACAGILLTEELDALTKALLNPARPMVAIVGGSKVSTKLTVLESLSEKVDQLVVGGGIANTFLKAAGNNVGKSLCENDLVPTAKMLMEKMEQRNASIPIAVDVVVGKKFDANEPAVLKDAAGVADDEMIFDIGPKSAQALADIIMQAGTVVWNGPVGVFEFDQFGAGTKAVALAIANTKAFTLAGGGDTIAAIQKYDIYDKVSYISTAGGAFLEFLEGRKLPAVEILEQRALA

SEQ ID NO: 55741 - protein, 397 aa, Solibacter usitatus Ellin6076
MPDSSDEFYRIQKLPPYVFAVINEMRAKARAAQIDVIDLGMGNPDGATPRVIVNKMIEATRNPRNHRYSQSRGIPKLREEITRRYLANYGVELDPDKEAIVTIGAKDALAHLLFATVGPGDTVVSPNPAYPIHQYGVLMAEGHACMLPMPDAATFLERLKELYRNNSKKPKLLLISFPHNPTTTCVDLDFFREIVALAREHGTLIVHDFAYADLGFDGYQPPSILQVEGAKDVAVEIFSLSKSYNMAGWRVGFCVGNQKMISALARIKSYLDYGVFQPIQIASIIALRECEEDTKKICAVYQKRRDVLVNGLKRAGWPVEKPRGSMFLWAPVPEKYRAAGSLEFCKLLLEKAQVAVSPGIGFGPLGEGHVRFALVENEQRIRQATRAIGQFFKSDAQ

SEQ ID NO: 55742 - protein, 223 aa, Triticum aestivum
MALTRIGLAGLAVMGQNLALNIAEKGFPISVYNRTTSKVDETVQRAKLEGNLPLYGFHDPASFVNSIQKPRVVIMLVKAGAPVDQTIATLAAHLEQGDCIVDGGNEWYENTERREKAMEERGLLYLGMGVSGGEEGARHGPSMMPGGSLEAYQYIEDILLKVSAQVPDSGPCVTYIGKGGSGNFVKMVHNGIEYGDMQLIAEAYDVLKSVGKLTNGELQQVFA

SEQ ID NO: 55743 - protein, 393 aa, Nitrosovibrio sp. RY6A
MPVIKLIDLDLKDKRVFIRADLNVPVKDGKVTSDARISASMATINHCLRQGARVMVTSHLGRPEEGVWSEENSLKPVADNIAARLGKPVRLIRDWVDGGFEVAAGELVVLENCRINKGEKKNLDETAQKYARLCDVFVMDAFGTAHRAEASTHGIAKYAPVACAGILLTEELDALAKALLNPARPMVAIVGGSKVSTKLTVLESLSEKVDQLVVGGGIANTFLKAAGNNVGKSLCENDLVPTAKMLMEKMEQRNASIPIAVDVVVGKKFDANEPAVLKDAAGVADDEMIFDIGPKSAQALADIIMQAGTVVWNGPVGVFEFDQFGAGTKAVALAIANTKAFTLAGGGDTIAAIQKYDIYDKVSYISTAGGAFLESLEGKKLPAVEILEQRALA

SEQ ID NO: 55744 - protein, 587 aa, Lentisphaera araneosa HTCC2155
MFELTFEFSCPSCAGHVPFVNNTKEAHCSSCGLNIIFENPDQFLDALDPDSDIEMFQTNSVKQVDKSTGSLRETITVSFSRQDLLKQAMAASSPPPVKNTSTSNNLSAINTPVAAAKKLGKLKVAQPVNNDLLNPGNSSSTPAAGAPNFGSTAAKKPAPMGAPNFAPQTTAKNLSSAETITGAPAFNKAPAPSFSTPTEASAPKFSTTPPSELSPLEQQRAELEEKKRHIEEERARVEAEFERIQAETEAAEEEARMAAEKAKAEDEARIAAEKARAEEEARMAAEKARAEDEARIAAEKARAEEEARMAAEKAKAEEEARMAAEKARAEEVSIAAEKAESEDKKVDEKAEDKKVDEKAEDKKEDEKSEDKKVDEKAEDKKVDEKAEDKKEDEKAEDKKEDEKSEDKKEDEKAEDKKEDEKAEDKKEDEKSEDKKVDEKAEDKKVDEKSEDKKEDEKAESEDKKLAPKKRPAGSKPSSKTGAKKRPAGSKPTSKTGAKKRPAGSKPGAKKAPEKPTLDKDGNVIDKPKRKKPQTKSDRPRTQTGLTPDMRRKLDEETRVKSKAIKTKIVIFNILLLIGVGVYFFMSK

SEQ ID NO: 55745 - protein, 720 aa, Pseudoalteromonas tunicata D2
MLFKSDSFEVSFIKESIAEFKFCVPGPVNKLSQQTLQECGQALTELANNSDIKGMVFTSDKDHFIIGADIFEFLPTFDKPEAELVEWIKNATDVFDQLEDLPFPTISAVNGMALGGGCEWVLATDYRVAAPDLKLGLPEVKLGIMPGFGGTVRLPRIIGADNAMTWITTGKEHRAEEALKIGAIDSVVAPDKLLTSAVKMLEQAIEGKLDWQTKRQEKLQPLKMNRVEQGMSFAMAEGMVYAQTKGHYPSPMMAVKTIKAAANHGRAEAMAIENANFAKLAKTPEAAAQVGIFLADQFIKSKARKLAKANNTEIKQAAVLGAGIMGGGIAYQSAYKGVPIIMKDIQPSALDLGMNEASKILGKQLERGRLTLDKMVKTLGAIKPTLNDNDLQTADIVVEAVVENPKIKQAVLAKLEADMPENTVLTSNTSTICIDVLASALKKPENFCGMHFFNPVHRMPLVEIIRGSKTSDATINAVVDYALKLGKSPIVVNDCPGFFVNRVLFPYFAGFNQLVVEGVNFAKADKVMENVFGWPMGPAYLLDVVGLDTAHHCTDVMADGFPTRMARQEKDPVAVLAAANRFGQKNGKGFYQYQMDKKGRPQKKADADALELLSSVCASEKEFSKEEIIDRCMIPMLNEVLLCLQENIVASPQEADMALIYGLGFPPFRGGAFRYLDQIGLANFVAKADQYAHLGAIFQVSEQTRQWAQAGRKFYQVEGQ

SEQ ID NO: 55746 - protein, 752 aa, Streptococcus pneumoniae
MFASKKERKVHYSIRKFSIGVASVVVASLFMGSVVHATERGGSTPVATSSNKANKSQTEHMKAAEQVDEYVNKMIQLDKRKHTQNLALNIKLSAIKTKYLRELNVLEKKSKKEELTSKTKKEIDAAFEQFKKDTLKPGEKVEEAQKKVEEAEKKAKDQKEEDRRNYPTITYKTLELEIAESDVEVKKAELELVKVKAKGSRNEEKIKKAKAEVESKKAEATKLEEIKTERKKAEEEAKRKAEAEEEVKDKLKKRTKRGALGEPATPDKKENDAKSSDSSVGEETLPSPSLKPEKKVAEAEKKVAEAEKKAKDQKEEDRRNYPTNTYKTLELEIAESDVKVKEAELELVKEEAKEPQNEEKIKQAKAKVESKKAEATRLEKIKTDRKKAEEAKRKVAEEDKVKEKPAEQPQPAPAEKPAPAPQPEKPAEQPKAEKPADQQAEEDYARRSEEEYNRLTQQQPPKTEKPAQPSTPKTGWKQENGMWYFYNTDGSMATGWLQNNGSWYYLNSNGAMATGWLQNNGSWYYLNANGSMATGWLQNNGSWYYLNANGSMATGWLQYNGSWYYLNANGSMATGWLQNNGSWYYLNANGSMATGWLQYNGSWYYLNANGDMATGWLQYNGSWYYLNANGDMATGWLQNNGSWYYLNANGDMATGWLQYNGSWYYLNANGDMATGWLQYNGSWYYLNANGSMATDWVKDGDTWYYLEASGAMKASQWFKVSDKWYYVNGSGALAVNTTVDSYRVNANGEWVN

SEQ ID NO: 55747 - protein, 435 aa, Burkholderia thailandensis E264
MILSALRNLELDSVPVARMTGRLTGVTGLLLKASGCRLETGERCVIESADGDRIDAQVVGFNREETFLMPFKKPVGLVAGAQVLSCDRQGSLRIGRSWLGRIVNGLGEAIDGRGPLGGDVALRAHPAPVNPLRKRPVRDTLDVGVRAIDGLLTLGRGQRVGLMAGSGVGKSMLLGMITRATQADVVVVGLIGERGREVREFVDHALGEAGLAKSVLVAAPADESPLMRLKAAELCHAIAAHFRDTGANVLLLVDSLTRYAMAQREIALSVGEPPATRGYPPSVFGMLPQLVETAGNGEGAGSMSAIYTVLAEGDDQNDPVVDTARAILDGHIVLTRELAERGHYPAIDVPRSVSRCMSQVAGAEHEALARKVKEMIGRHEQVRDLIPLGGYVQGADPATDEAVAKAARIDAFLRQDMRDVARRDATLAALRELIA

SEQ ID NO: 55748 - protein, 282 aa, Arabidopsis thaliana
MGYAQLVIGPAGSGKSTYCSSLYEHCETIGRTMHVVNLDPAAEIFNYPVAMDIRELISLEDVMEDLKLGPNGALMYCMEYPLFWLHWQLENVTSFVKSGLEKLLTLYLEDSLHDWVDEELENYRDDDYLIFDCPGQIELFTHVPVLKNFVEHLKQKNFNVCVVYLLDSQFITDVTKFISGCMSSLAAMIQLELPHVNILSKMDLLQDKSNIDEYGFLFFPLFFSVAVSVGEYGMVNFIPINLRKEKSIQYVLSQIDVCIQFGEDADVNIKDDDDFSDDGPDL

SEQ ID NO: 55749 - protein, 546 aa, Saccharomyces cerevisiae YJM789
MEPLLFNSGKANPSQDVFIDVEVGDITTKYGSTNTGSFSSMDTVEAQAIKAETARFMEVPQGRHLGVFSTVVLFVSRIMGSGIFAVPSVILLNTGGNKLIYFAIWVFSAAIAFAGLYLFLEFGSWIPKSGGRKNFLERSFERPRLLISVVFSCYSVLTGYALTGSIVFGKYVLSAFGVTDDSWSKYVSISFIIFAVLIHGVSVRHGVFIQNALGGLKLIMIVLMCFAGLYTLFFYKSTGQVAWDLPVTQVEKDSLLSVSSIATAFISSFFCFSGWDTVHTVTSEIKNPVKTLKVSGPLSLIICFVCYTMMNVAYLKVLTYEEIVSAGPLVGSVLFTKLFGPRVGGKFIAFSIAISAASNILVVIYSISRVNQEIFKEGYLPFSIHMSKNWPFDAPLPSISLCGFITIAWILILPKEGESFNYLVSMDGYGNQFFLLLVAIGLFIWRFKHKNEVPEIRASTFGVLAIITLSLYMLMAPFFADPSLNRVGFLPPYQIMSSLVIVACFFFWLVKFVLLPKFFHYKLLPKITYLHDGLIVTEWVKKPCLC

SEQ ID NO: 55750 - protein, 730 aa, Streptococcus pneumoniae
MFASKSERKVHYSIRKFSIGVASVAVASLVMGSVVHATEKEVTTQVATSSNRANESQAGHRKAAEQFDEYIKTMIQLDRRKHTQNFALNIKLSRIKTEYLRKLNVLEEKSKAELPSETKKEIDAAFEQFKKDTNRTKKTVAEAEKKVEEAKKKAKAQKEEDHRNYPTNTYKTLELEIAESDVEVKKAELELVKEEAKESRDDEKIKQAEAKVESKKAEATRLENIKTDREKAEEEAKRRAEAKLKESVEKNVATSEQDKPKGRRKRGVPGEQATPDKKENDAKSSDSSVGEEALPSPSLKPEKKVAEAEKKVAEAEKKAKAQKEEDRRNYPTNTYKTLELEIAESDVKVKEAELELVKEEAKESRNEEKVNQAKAKVESKKAEATRLEKIKTDRKKAEEEAKRKAAEEDKVKEKPAEQPQPAPAPQPEKPTEEPENPAPAPKPEKPAEQPKAEKPDDQQAEEDYARRSEEEYNRLTQQQPQKPEQPAPAPKIGWKQENGMWYFYNTDGSMATGWLQNNGSWYYLNSNGAMATGWLQNNGSWYYLNANGSMATGWLQNNGSWYYLNANGSMATGWLQNNGSWYYLNANGDMATGWLQYNGSWYYLNANGDMATGWLQNNGSWYYLNANGSMATGWLQYNGSWYYLNANGAMATGWLQYNGSWYYLNANGDMATDWVKDGDTWYYLEASGAMKASQWFKVSDKWYYVNGSGALAVNTTVDSYRVNANGEWVN

SEQ ID NO: 55751 - protein, 170 aa, Helicobacter pylori
GSGMHTHVSIWKNNENLFSGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKEGQ

SEQ ID NO: 55752 - protein, 170 aa, Helicobacter pylori
GSGMHTHVSVWKNNENLFSGETYKGLSELALHFLGGVLHHARGLAAFTNASTNSYKRLIPGYEAPSILTYSANNRSASVRIPYGISKNSTRFEFRFPDSSSNPYLAFAAILMAGMDGVKNKMDPGEAMDINLFKLTLDEIREKGIKQMPHTLRRSLEEMLADKQYLKEGQ

SEQ ID NO: 55753 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKEDQ

SEQ ID NO: 55754 - protein, 299 aa, Salmonella enterica subsp. arizonae serovar 62:z4,z23:--
MDFMQQLQACVSQANQALSRFIAPLPFQNTPVVEAMQYGALLGGKRLRPFLVYATGQMFGVSTATLDVPAAAVECIHAYSLIHDDLPAMDDDDLRRGLPTCHIKFGEANAILAGDALQTLAFAIISDAPMPEVADRDRIAMIAELANASGIAGMCGGQALDLAAEGHQISLDALERIHRHKTGALIRAAVRLGALSAGDKGRNTLPILDRYAESIGLAFQVQDDILDVVGDTATLGKRQGADQQLGKSTYPALLGLEQARNKAWDLIEDARQSLHQLAAQSLDTSALEALANYIIQRDK

SEQ ID NO: 55755 - protein, 620 aa, Salmonella enterica subsp. arizonae serovar 62:z4,z23:--
MSFDIAKYPTLALVDSTQELRLLPKESLPKLCDELRRYLLDSVSRSSGHFASGLGTVELTVALHYVYNTPFDQLIWDVGHQAYPHKILTGRRDKIGTIRQKGGLHPFPWRGESEYDVLSVGHSSTSISAGIGIAVAAEKEGKDRRTVCVIGDGAITAGMAFEAMNHAGDIRPDMLVILNDNEMSISENVGALNNHLAQLLSGKLYSSLREGGKKVFSGVPPIKELLKRTEEHIKGMVVPGTLFEELGFNYIGPVDGHDVMGLISTLKNMRDLKGPQFLHIMTKKGRGYEPAEKDPITFHAVPKFDPSSGCLPKSSGSLPGYSKIFGDWLCETAAKDSKLMAITPAMREGSGMVEFSRKFPDRYFDVAIAEQHAVTFAAGLAIGGYKPVVAIYSTFLQRAYDQVIHDIAIQKLPVMFAIDRAGIVGADGQTHQGAFDLSYLRCIPDMVIMTPSDENECRQMLFTGYHYNDGPTAVRYPRGNAQGVALTPLEKLPIGKGIVKRHGEKLAILNFGTLMPEAAKVAEALNATLVDMRFVKPLDETLILEMAARHEALATLEENAIMGGAGSGVNEVLMAHRKPVPVLNIGLPDFFIPQGTQEEARAELGLDAAGIEAKIKAWLA

SEQ ID NO: 55756 - protein, 173 aa, Salmonella enterica subsp. arizonae serovar 62:z4,z23:--
MIKSAPLRGQMNPGRENMNIIKANVAAPDARVAITIARFNQFINDSLLDGAVDALTRIGQVKDDNITVVWVPGAYELPLATDALAKSGKYDAVIALGTVIRGGTAHFEYVAGGASNGLANVAQDSGVPVAFGVLTTESIEQAIERAGTKAGNKGAEAALTALEMINVLKAIKA

SEQ ID NO: 55757 - protein, 402 aa, Mycobacterium smegmatis str. MC2 155
MLLSLIAISVVLAVWSLLSREMQRLRLTAPMVLVLTGMAISFTMKDHLGVTLNTDSAEHIAELILAVLLFVDATDVRGGFLGAQPKAALRMLFIAMPVGLALSVLLGLWLLPGLPWAVLLAVACIVVPIDFAPNSALLRDTRIPERVRGLLNVEAGYNDGIVSPVFIFALVLAADSEHASTPMEALGAAVPEAVKALIAGVVVGAGLALAANAAERRDFMTAQAKRMILVAAPLLSFGASLAIGGNGFVAAFVCGIAFNYFRRSEQFHTELELVDDVGFLMTALMWFVFGLTAVLALGSGVPLGLVAFCLLALTVVRIVPVLLALLFSPVSWPERLLLGWLGPRGTTSIVFGLLAFNALDGVAESTVAMVLVVSVLGSVVLHGVGAPAAARAYQRQQTKLSS

SEQ ID NO: 55758 - protein, 638 aa, Actinobacillus pleuropneumoniae serovar 1 str. 4074
MIFFTDLILKRGQSVLLENTSATIHTGQKVGLVGKNGCGKSSLFALVKGELQPEGGDVSLPKNWAISWVNQETPALEISALDYVIQGDREYTGLMNQLEKANQENNGNQIAMIHTQLDTIDAWTIQARAATLLNGLGFSNEQLSLPMKSFSGGWRMRLNLAQALICRSDLLLLDEPTNHLDLDAVIWLEKWLTNYRGTLLLISHDRDFLDPIIDRVIHIENQQLNDYTGNYTSFEIQRATKISQQNAAYAQQQRKVAHLQSFIDRFKAKATKAKQAQSRIKALEKMELIAPAYADSPFEFEFRPPLALPSPLLMMEKAGAGYGNKTILESVKLNLVPGSRIGLLGRNGAGKSTLIKLLAGELAPQTGHIQLAKGVQLGYFAQHQVDTLRFDESPLWHLQKIAPELTEQEVRNYLGGFDFKGDKVKQNVGSFSGGEKARLVLALIVWQRPNLLLLDEPTNHLDLEMRQALTDALTYYEGSLVVVSHDRHLLRSTVNEFYLVHDKKVEEFKGDLDDYQKWLNEQNALEAAKNSGNSTACTEEKADNSAANRKEQKRLEAELRQQTAPLRKKITQLEKDLEKASEKLNQLEALLASSEIYEAENKAQLTETLAKQIEEKKAVEEIEMEWLDCQEQLEALLS

SEQ ID NO: 55759 - protein, 501 aa, Burkholderia sp. 383
MNPTSAENHQHADWRRLAAHVVPRTLAHIGGCSVPARSGRTFAAINPATEAVIAEVASCDAPDVDDAVRAARHAFESGAWSRCAPAERKRVLCRLGELIASHGAELALLDSLNMGKRVADAFSIDVPAAGGLFSWYGEAVDKLHGEVASTDPGNLAVVTREPLGVVGAVVPWNFPLDMVAWKVAPALAAGNSVVLKPAEQSPLSALRLAELALEAGLPPGVLNVVPGYGETAGRALGLHPDVDVLAFTGSTAVGKKFLEYAAQSNMKQVWLECGGKSPNLVFDDTDDLDLAARKACFGIFFNQGEVCSANSRLLVQRSIHDAFVDRLIAHAAAFMPGDPLDPSSGMGAIVDEQQHRRVREWIARGRDSATLAIGGGAPRVDGKGYFIEPTIFIDVKHDDAIAREEIFGPVLSVMAFDTEDEAVRLANDSIYGLAASLWTGSLSRAHRVSGRLRAGTVSVNTVDALSAQTPFGGFRQSGFGRDLSLHAIDKYTGLKTTWISY

SEQ ID NO: 55760 - protein, 463 aa, Burkholderia sp. 383
MNAPNFPHRTTQDYQRSDAAHHLHAFVDQKALNEEGARVMVRGEGVHLWDNDGNRYLDGMSGLWCTNVGYGRPELVDAAARQMKELSYYNMFFHTTHPSVIELSERLFALLGNRFSHVVYTNSGSESNEVLIRTVRRFWDVMGKPEKKVLIGRVNGYHGSTVGSASLGGMAFMHEMGDLPIPNITHVDEPYWYANGGDLSPEAFGKQAALSLERKILEIGADRVAAFVAEPFQGAGGMIFPPDGYWQEIERICRQYDVLLCADEVIGGFGRTGEWFAHRHFGFEPDLICVAKGLTSGYVPMGGLIMSRRVGDALVDKGGVYAHGLTYSGHPVAAAVALANLDVLEREGLVERTKTDTGPYLQKALRDAFGSHPLVGEVQGVGAVGAIQFAKNKATRERFANEADLTWHSRTVGFELGAIVRSTNGRLIVAPPLVIDHAQIDELVDTMRKAVDATAREVLGIDC

SEQ ID NO: 55761 - protein, 480 aa, Arabidopsis thaliana
MVKICCIGAGYVGGPTMAVIALKCPSVEVAVVDISVPRINAWNSDQLPIYEPGLDDVVKQCRGKNLFFSTDVEKHVREADIVFVSVNTPTKTRGLGAGKAADLTYWESAARMIADVSVSDKIVVEKSTVPVKTAEAIEKILTHNSKGIKFQILSNPEFLAEGTAIEDLFMPDRVLIGGRETTEGFAAVKALKDIYAQWVPEERILTTNLWSAELSKLAANAFLAQRISSVNAMSALCEATGANVSEVSYAVGKDSRIGPKFLNSSVGFGGSCFQKDILNLVYICECNGLPEVAEYWKQVIKINDYQKTRFVNRIVSSMFNTVSNKKIAVLGFAFKKDTGDTRETPAIDVCKGLLGDKARLSIYDPQVTEEQIQRDLTMNKFDWDHPLHLQPMSPTTVKQVSVAWDAYTATKDAHGICILTEWDEFKKLDFQRIFENMQKPAFVFDGRNVVDADKLREIGFIVYSIGKPLDQWLKDMPALA

SEQ ID NO: 55762 - protein, 316 aa, Haemophilus influenzae Rd KW20
MAIYADNSYSIGNTPLVRLKHFGHNGNVVVKIEGRNPSYSVKCRIGANMVWQAEKDGTLTKGKEIVDATSGNTGIALAYVAAARGYKITLTMPETMSLERKRLLCGLGVNLVLTEGAKGMKGAIAKAEEIVASDPSRYVMLKQFENPANPQIHRETTGPEIWKDTDGKVDVVVAGVGTGGSITGISRAIKLDFGKQITSVAVEPVESPVISQTLAGEEVKPGPHKIQGIGAGFIPKNLDLSIIDRVETVDSDTALATARRLMAEEGILAGISSGAAVAAADRLAKLPEFADKLIVVILPSASERYLSTALFEGIEG

SEQ ID NO: 55763 - protein, 419 aa, Haloferax volcanii
MSYDQIEVPDDGEKITVDEETGELSVPDNPIIPIIHGDGIGTDVGPAAQKVLDAAAEATGRSVSWMRVYAGSSARDKYDENLPEDTVSAIRNHRVAIKGPLTTPVGAGFRSLNVALRKKLDLYANVRPTYHLDGVPSPVKNPSAMDMVTFRENTEDVYAGIEWEAGTDEVQKVKEFVEEEMGADGVIHDGPVGIGIKPITEFGTKRLVREAIEYALENDRPSVTLVHKGNIMKFTEGAFRDWGYELAEEEFGDVTITEDELWEEYDGKRPEDKVVVKDRIADNMLQQLLTRTANYDVIATMNLNGDYMSDAAGAQIGGLGIAPGANFGEGLCLAEPVHGSAPKYAGKDKVNPTAMILSGRLMFEYMGWKDAGKLIRDTVEKTISDGDVTYDLERQIEGGNKLATSEYADKVVENIKELA

SEQ ID NO: 55764 - protein, 517 aa, Oryza sativa
MGYGWALAAVLATWCLLDALSRLVWRPRAVAAALRRQGVRGPGYRLLVGSLGDINKLRADAAGAGGAAALDVASHDFIPFVQPQFRQWIPLYGRVFLYWFGWTPDMCVADVEVAKQVLSDRTGLFPKNVTTPMLLKLFGRGLVLANGDEWQRHKKVVHPAFNTDKLKMMTATMAGVARSMVSRWEEKVASHGGKVVIELSSQFEELTADVISHTAFGSSYAEGKQVFMAIKELQFIAFSSLLSVQIPGSRKVRSTLMQIISNRLAAAAKEKAGGGGGGYGEDLLGLMLEASAPPELGTKRRQPPVLSMDEIIDECKTFFFAGQETTSHLLSWTMFLLSTHPDWQDKLREEAVRECAGAGAGDDDDQLPTYDMLGKLKLLNQFLLETLRLYSPVPAIRRRTAAAVEMGGVTVPGGTMLTFPIATMHRDEEVWGADAGVFDPMRFDGGGGAMAKLLSFSTGPRACVGQSFAMVEAKAVVAAILRRFRLELSPEYVHAPTDVITLRPKHGLPMVVTRVHA

SEQ ID NO: 55765 - protein, 750 aa, Arabidopsis thaliana
MAPCIDFVFMAFGLLLLLIAVTTSRPITRPKVFDVRSYGAKGDGKMDNTNAFTNAWKDACRWNGPSKMYIPLGTFYLGGVTFVGPCDGKISFVIDGTLLAPPNNDDIKKEIWINFRYINYLTVFGDGTLDGQGKKSWSLIDCQKDNNCPKLAINMGFDFVKNSSMNGITSLNSKAGHFNFLSVDHFSITRVNIIAPSNSPNTDGIKIALSSNMQISNTHISTGDDCIAMLSGNTNFDIYNVKCGPGHGISIGSLGKNKDEKNVNGLMVRNSVFTGTTNGIRIKTWESSASTIRIINLVYENLQMINVENPIGIDQKYCPYPPCSNMGDSHIQIRNVTLKNIWGTSKNKVAVKFQCSKTFPCKDVQLIDINLTHHGVDGPASALCENVDGSATGKMVQISTVNPNPAQSRFSRPRSLRVLSLSADPSANRNPKSAVDAHAPPLVVVGSANADIYVEIERLPKEGETISAKTGQTLAGGKGANQAACGAKLMYPTYFVGRLGEDAHGKLIAEALGDDGCGVHLDYVRSVNNEPTGHAVVMLQSDGQNSIIIVGGANMKAWPEIMSDDDLEIVRNAGIVLLQREIPDSINIQVAKAVKKAGVPVILDVGGMDTPIPNELLDSIDILSPNETELSRLTGMPTETFEQISQAVAKCHKLGVKQVLVKLGSKGSALFIQGEKPIQQSIIPAAQVVDTTGAGDTFTAAFAVAMVEGKSHEECLRFAAAAASLCVQVKGAIPSMPDRKSVLKLLKFSI

SEQ ID NO: 55766 - protein, 470 aa, Vibrio sp. Ex25
MNAIAEVEVDSSLQQSLERLKAAYAAEPYPSLDERKQRLVLLKQALIANKQALVEALSEDFGYRSEFDTAMTDVLPTVSHINYTIKQLKKWCKPSKRESGLLLAPSKVTVQYQPLGVVGIISPWNFPVILSLAPLVTALAAGNRVMMKLSEFTPKTNKVIVNICRELSEYVEVFEGEADVAQSFSQLPFDHLLFTGSTNVGRAVAKAAADNLTPVTLELGGKSPVIIAEDADMKKTVDAILFGKCINAGQICVAPDYAFVPQERVEEFITLFLKRFEKLYLKSNKNQKLTHIINQRQYDRLTALLEDAKAQGASIHTVEAPPQQERLLYPHLITDVSTDMRIMQEEIFGPFLPIKPYKAVDEAIDYINQHQRPLALYVMSDDKSTIRHIVRNTHSGGVGINDTVLHVGAEDAPFGGVGESGIGHYHGVEGFRTFSHAKTVLHTPKWLPRTGALMRRRAMAIKAIQKIFVR

SEQ ID NO: 55767 - protein, 442 aa, Erythrobacter sp. NAP1
MVEPRIFMIAAFGVALVLAVALERKLARFSLSLPMVYVLAGFLITLLPVDLPSLNPASDSFDALTLEYVTEFIVIVSLASAGIAIDRPVSWTNWGQIWPMLAVAMPLTIAGVAFLGWWALALTPASAILLGAALAPTDPVLARSVQVGPPMQDERNDVRFSLTVEAGLNDGLAFPFTYLAIAAIGMTSLGNWTLEWAGFDLVWRIAAGLAIGWAIGRIGGWYVFEFEADTPMDEFEEEGPRYQTREGLVVLGTLLSAYAIAELIEGYGFLAVFVAGVVARQLENRSEYHRISHHFIDQLEHIVLILVLLGFGMMLGSGVLDALTWPAALIGLALIFILRPISGMLGLARCGLHTYGKFAIAFLGVRGMGSIYYLAYGQNAGDFQGLDVLWATVSFAILVSIVVHGLLAGPLVRFVERGGYHVDHTGEDIYREGEVEEAKAAQ

SEQ ID NO: 55768 - protein, 78 aa, Triticum aestivum
GAATPRTPRRRPRRPPSAGPALALVDERMSTEGTGLSLGLSNNLLGWILLGVFGLIWSLYTVYTSGLDQDEESGGLSL

SEQ ID NO: 55769 - protein, 337 aa, Streptococcus thermophilus LMG 18311
MSILITGGAGYIGSHTTVELLNAGFDVVLVDDFSNSSPAVLERLEKITGKKFPFYQGSILDTEFLDKVFTKEDIELVIHFAAFKAVGESVQKPLKYYKNNISGTITLLEKMKEYDVKNIVFSSSATVYGTNNPSPMTEDMPTSAINPYGYTKLMMEQILTDVAASDPSWSVTNLRYFNPIGAHESGLIGELPNGIPNNLMPYITQVAIGKLPELNVFGDDYPTPDGTGVRDYIHVLDLASGHLAAVKYNLSHKGAEIFNLGTGHGYSVLDLVKTFEAENKVTIPYRIQGRRAGDIATCYASPEKAKEVLGWEAKKTLKDMVRDSWRWQTTNPNGYED

SEQ ID NO: 55770 - protein, 235 aa, Erythrobacter sp. NAP1
MIDLFGNSGETHGTQGQFERDPLTGALVPTVVEQSSRGERAFDIFSRLLRERIVFVTGQVEDTMASLIVAQLLFLESENPSKPISMYINSPGGVVTAGMAIHDTMQYIKPRVSTVCIGQAASMGSFLLAAGEPGMRVALPNARIMVHQPSGGARGMASDIEIQAREILRIRSRMNDLYVKYTGQSLDEIEKAMDRDTFLEAEEAMKFGLVDKVFETRPESGDEGEEEKGSGGAPE

SEQ ID NO: 55771 - protein, 156 aa, Triticum aestivum
  misc_feature (89)..(89): Xaa can be any naturally occurring amino acid
  misc_feature (136)..(136): Xaa can be any naturally occurring amino acid
MASEQTFIMIKPDGVQRGLIGEVISRFEKKGFYLKGLKLQNVENSFAEQDYADLSSKPFFAGLVEYIVSGPVVAMVWEGKSVVSTGRKXILAPPNPLASEPGNIRGDFCRSTSGRNVIHGKRTQLRSAKERKIALXWFPEGIAKWRSIQHNWIYEA

SEQ ID NO: 55772 - protein, 661 aa, Acinetobacter sp. ADP1
MQVKTPDIGVDKATVAEILVKVGDTISENDSLILLESDKASVEVPSTASGVVKSILVSLGDEVSEGTTLIELESGDNTDKTESESAPAQTEVKAETPVEQVAPQETKPATSTSAASSVVEVQVPDIGVEKATVAELLVSVGDEIAENDSLVLLESDKASVEVPSTVSGTIESIEVKAGDTIQEGVLLLKVKTAGASNAAPAKQEAVVPTAAPVATKAETQAETPAVQSAPAGAVDVLVPDLGVDKAAVAEILVNVGDKITKDESIVVVESDKATVEVPSTVSGIVKAIHVKAGQDVKEGILLVTVEAEGAVASAPKAPVAKAEAAPAPAAQKAEAPAAKVETAPQAGADKLTKEQEAENSKVYAGPAVRKLARELGVVLAQVKASGEHGRLMKEDIYAYVKQRLTAPVAAPKAAAAAVASGLPTLPDFSAFGGVEEKTLTRLQQVSIPQLSLNNFIPQVTQFDLADITELEAWRNDLKGNFKKEGISLTIMAFIIKAVAHLLKEEREFAGHLSDDGKSVLLRKEIHMGIAVATPDGLTVPVLRNPDQKTIKQIAVELGVIGQKARDKKLSPKDLQGANFTISSLGAIGGTAFTPLVNWPQVAILGISPATMQPVWNGKDFDPRLMLPLSLSYDHRVINGADAARFTNKLTKLLQDIRSLLI

SEQ ID NO: 55773 - protein, 337 aa, Prochlorococcus marinus str. MIT 9313
MAAKGTTMSIPPAIVAAARMGWHWQWIQLMNGLAPADAKGNYQRPPSQHQQARLPAEQELSNRSADQYPRLIIGRSCPWAHRTWLVLQLRNLQSSLTLHLARADHKAGRWQLDPAWLGCNSLLALYQRCGSPPSHRATVPALVDPGTMTSQSPQLLGNESAQLVEVLNLWPAAKDAPDLAPSNLQGEINGWQKLLQPAVNDGVYRCGFARNQAAYDKACNELFDTLAQVDRSLSNKGPWLCGDQLTLADVRLFPTLIRWEMVYAPLFGCSQQPLWAFPHLWHWRQRLLALPGVAKTCDSQAWRQDYFGALFPLHPSNIVPAGPDLAKLVNASAPDQR

SEQ ID NO: 55774 - protein, 651 aa, Triticum aestivum
MSKLLVIALLLLPLINHGIYLATAWDDQDFFKYCPPSNCSQHGPEVRFPFCLESSNTSAVAAAAAASCGCSSTDGLIWKLACFGQDTILVHPVLGSYSVSAIDYRRSSVKLIPLVDPCLMLQQKLAISRRWSSRQVDVIDGMQLPDRQFSILSYKYATLVCCSSEFTPAAADADSIAGPVSCLSNTTLFLYLVAAYKDMSILPLDCKVFPVSDGVSGRLIPMYMLEDPMSGTPFSLSFKERAERMLSFAETTVYWFGGNCRQCELSGQRCAFSSQRDETFCIPDPHGSRIKVIAATSSVAAFVVLLVTVATVLYLSLKTRYNAEIHLKVEMFLKTYGTSKPTRYTFSEVKKMARRFKEKVGQGGFGSVYKGELQNGVPVAVKMLENSTGEGEAFINEVATIGLIHHANIVQLLGFCSEGMRRALIYEFMPNESLEKYIFSRDSANFQHLLVPDKLLDIALGIARGMEYLHQGCNQRILHFDIKPHNILLDYNFNPKISDFGLAKLCARDQSIVTLTAARGKMGYIAPELYSRNFGGVSYKSDVYSFGMLVLEMVSGRRNSDPRIGSQDDVYLPEWIYEKVVNGEELALTLETTEEEKEKVRQLAIVALWCIQWNPRNRPSMTKVVNMLTGRLQSLQMPPKPFVSSENELMP

SEQ ID NO: 55775 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFAAILMAGIDGIKNKMDPGEAMDINLFKLTLDEIREKGIKQMPHTLRRSLEEMLADKQYLKEDQ

SEQ ID NO: 55776 - protein, 652 aa, Prochlorococcus marinus str. MIT 9313
MSLISLIEASKDFGINTLFADLTLHINEGERLGLIGPNGAGKSTLLKVLAGKEPLGEGERRCSARLRVELVGQESAVNPGHTVLQEVLAGCGEKRELLLRFNELSNSMARNPNDATLLAELGQVSQRMDDAQAWSLEQQCQEVLQRLGITDLERPVKELSGGYRKRVGLASALVARPDVLLLDEPTNHLDAAAVEWLQSWLDRFPGALVLVTHDRYVLDRVTRRMVEVDRGKAHNYAGNYSTFLQQKAELEASEASTAQKFKGVLRRELAWLRQGPKARSTKQKARLQRIAEMRAEPLPQLRGSLKMANVSRRIGKLVIEAEALQVTANGKPDSPLLLDNFTYSFSPEDRVGIIGPNGSGKSTLLDLIAGRRQPNGGTLRLGETVHLGYLDQHTEDITKGKGLDRKVIDFVEEAASQIILGEEQITASQLLERFLFPPAQQHSPLGKLSGGERRRLTLCRMLIQAPNVLLLDEPTNDLDVQTLSVLEDFLEDFRGCVVVVSHDRYFLDRTVDRLFNFENGQLKRFEGNYSAFLEQQRRQERGLNEANEPKSIRLLKDSGPSRISTRSSQEAESSSSQATENSKPRRRSFKESRELEALNIDIPLLEAKRSNLEAALSCGDEDLTLLSQQLAELVETLHRAEERWLELSELTA

SEQ ID NO: 55777 - protein, 365 aa, Bacillus cereus G9241
MKRQLILEDGTVLIGTGFGGEIEKSGEVVFTTGMTGYQETLSDPSYCGQIVTFTYPLIGNYGINRDDFESIHPSVNGLIVNEICDHPSNFRNEISLNDYLKERNIPGLAGIDTRKLTRKIRQYGTLRGRLCNMDADVEYIVSQLKATVFTDHVKRVSTKDPYPSPGRGHRVVLVDFGMKHGILRELNKRDCDVIVVPYNTTAEEILRLSPDGIMLSNGPGDPKDVPEAIEMLKDIIGKVPLFGICLGHQLFALASGANTSKLKFGHRGLNHPVKHLATGKVAITSQNHGYAVEEESVKNTELEITHVALNDGTVEGLRHKKFPAFTVQYHPEASAGPEDANDLFEDFLAMIENFKKEGEELCQNA

SEQ ID NO: 55778 - protein, 170 aa, Helicobacter pylori
GSGMHTHVSVWKNNENLFSGETYKGLSGLALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKEDQ

SEQ ID NO: 55779 - protein, 227 aa, Plantago major
VLKCSLRTLPDGGAERLYGLAPVCEFLTKNQDGVSMAPLLLMNQDKILMESWYHVKDAVLDGGIPFNKAYGMTAFDYHGTDPRFNKVFNQGMSNHSTIIMKKILETYDGFEGLNSVVDVGGGTGATLSMILSKYPSIKGINFDLPHVIEDAPSYAGVEHVGGDMFVSVPEGDAIFMKWICHDWSDAHCLKFLKNCYKALPENGKVILAECILPEVPNSELATQNVVH

SEQ ID NO: 55780 - protein, 483 aa, Bradyrhizobium japonicum USDA 110
MGKITGFLEIERHDRKYTPVAERVKHFHEFVVPLTERETRDQAARCMNCGIPYCHGTGSVAPGTPGCPVNNQIPDFNDLVYQGNWEEASRNLHSTNNFPEFTGRICPAPCEASCTLNIDDNPVTIKTIECAIVDRAWDNGWLKPEVASVKTGKKVAVIGSGPAGMACAQQLARAGHDVHLFEKFAKAGGLLRYGIPDFKMEKGIIDRRVKQMEGEGVTFHYNSHVGADGNVDPREMLNEYDAVALTGGAEAPRDLPIPGRDLQGIHYAMDFLPQQNRRVSEEPLNGVTEILAGGKHVVVIGGGDTGSDCIGTSLRQGALSVTQLEIMPAPPERENKGLTWPNWPLKMRTSSSQAEGAIREFAVLTQKFSGENGQVKKLHCVRVDDKFKPIAGTEFELDAELVLLAMGFVHPVHEGLLKLLSVELDPRGNVKANTLDYQTSRPNVFTAGDMRRGQSLVVWAIREGRLCARSIDTFLMGKTDLPR

SEQ ID NO: 55781 - protein, 85 aa, Glycine max
  misc_feature (51)..(51): Xaa can be any naturally occurring amino acid
LRVGTNRVLETTLFAVRVPARLYHERVVDHYYNPRNVGSCYNNDPNVGTFXVGAHDCGYEINLQINVYRPTSNLVSDRVSTVGSS

SEQ ID NO: 55782 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFAAILMAGIDGVKNKMDPGEAMDINLFKLTLDEIREKGIKQMPHTLRRSLEEMLADKQYLKEGQ

SEQ ID NO: 55783 - protein, 170 aa, Helicobacter pylori
GSGMHTHVSVWKNNENLFSGETYKGLSEFALHFLGGVLRHARGLAAFTNASTNSYKRLIPGYEAPSILTYSANNRSASVRIPYGISKNSARFEFRFPDSSSNPYLAFGAILMAGIDGVKNKIDPGEAMDINLFKLTLDEIREKGIKQMPHTLRRSLEEMLADKQYLKEGQ

SEQ ID NO: 55784 - protein, 641 aa, Prochlorococcus marinus str. NATL1A
MLISLVNASTDFGIKNLFKNLDLHVNKKERLGLIGPNGSGKSTLLRVIAGIEPLMEGERRCLSSLRISLVGQETSYNSEKSILEEVLEGCGEKRKLLLNFSQLSRKIAQNPEDEDLLKKLGQASELMDAAGAWNLEQQCQDVLRRLGIKDLDKPVKELSGGYRKRVGLAAALVSKPDVLLLDEPTNHLDASAVEWLQNWLDHYEGALVLITHDRYVLDRITNRMVEINNGETRKYSGNYREFLQQKVEQEQSEASTQKKFQGVLRKELAWLRQGPKARSTKQKARIQRIAEMQAKPKSHVKANLEMNSLSRRIGKIAIEAEGVGLSLNNKENNLDLLCDFTYSFSPEDRVGIIGPNGSGKSTLLDLISGKRLPTSGKIKLGETVHIGYLDQHTNDLNQGSGLNRKVIDFVEEAALRIDHGGKQITASQLLEKFLFPPSQQHSPLLKLSGGEKRRLALCKMLIQAPNVLLLDEPTNDLDIQTLSVLEDFLDDFKGCVVVVSHDRYFLDRTIDRIFNFENGHLRRYEGNYSRFLDHKILEERNNETKKRAKIVNNSQNKRGQEIKLDSKNDSRRLSFKEARELKELDVRLPMLEKKKICLEKKITDSDVDISEISHQLAELIESIQEHEDRWIELSELSESAK

SEQ ID NO: 55785 - protein, 236 aa, Pseudomonas putida
SLIPIPQALEQGCDTLVTIGGIQSNHTRMVAAVAAKLGLACVLVQENWVDYSDAVYDRVGNIMMSRLMGADVRLVDQGFDIGFRRSWEEALEDVKRRGGKPYAIPAGASDHELGGLGYVGFAEEVRRQEAGLGFKFDYIVVCAVTGSTQAGMVVGFAADGRADRVIGIDASATPDQTRAQILRIARRTADMVGLGRAIGDEDVVLDTRYAYPAYGLPSAETNEAIRLCARLEGMMT

SEQ ID NO: 55786 - protein, 476 aa, Campylobacter lari RM2100
MGKFVNNIDEFFSYCQEHEVLFVDFRFTDMIGTWHHITYNIKAIDDKTFENGIPFDASSLHGWQPIEKSDMILKPDVKSAFLDPFTADPTIIVICDVYDIYKDQMYEKCPRSIAKKAMQHLSTSNIADTAYFGPENEFFIFDNVKIVDSSHCAKYEVDTEEGEWNDNKDFADSYNSGHRPRNKGGYFPVSPVDSSVDIRSEMVQVLERVGLKVFVHHHEVAQGQAEIGVEFGNLVEAADNVQIYKYVVKMVAHLNGKTATFMPKPLYGDNGSGMHVHMSLWKDGVNLFYDKEGYGKLSECAINYIGGILANARSVAAFTNPSSNSYKRIVPGFEAPCILTYSCQNRSASCRVPYGINEKSARVEIRFPDSTSNPYLAFTSLLMAGLDGIKNKTIPVGPMDENLFALTLDEIREKGIEQLPHTLRGSLEALIRKNAFLKPVMSDVFIDDYQHMKFETQVWPVEARPTAYEFKTCYSC

SEQ ID NO: 55787 - protein, 475 aa, Oryza sativa Japonica Group
MASGQKVVKPMEVSVEAGNAGEAAWLDDDGRARRTGTFWTASAHIITAVIGSGVLSLAWAIAQLGWVAGPAVMLLFAFVIYYTSTLLAECYRTGDPATGKRNYTYMDAVRANLGGAKVTFCGVIQYANLVGVAIGYTIASSISMRAIRRAGCFHHNGHGDPCRSSSNPYMILFGVVQIVFSQIPDFDQIWWLSIVAAVMSFTYSGIGLSLGIVQTISNGGIQGSLTGISIGVGVSSTQKVWRSLQAFGDIAFAYSFSNILIEIQDTIKAPPPSEAKVMKSATRLSVATTTVFYMLCGCMGYAAFGDAAPDNLLTGFGFYEPFWLLDVANVAIVVHLVGAYQVFVQPIFAFVERWASRRWPDSAFIAKELRVGPFALSLFRLTWRSAFVCLTTVVAMLLPFFGNVVGLLGAVSFWPLTVYFPVEMYIAQRGVPRGSARWVSLKTLSACCLVVSIAAAAGSIADVIDALKVYRPFSG

SEQ ID NO: 55788 - protein, 254 aa, Actinobacillus pleuropneumoniae serovar 1 str. 4074
MARVDNYEQRFGGIGRLYTPEGLAKLRQSHICVIGIGGVGSWAVEALARSGIGKITMIDMDDICVTNINRQIHAMTGTIAQLKTEAMKERIERINPECVIEIIDDFITPENIPEYLNRGYDYVIDAIDSVKTKAALIAYCKRNKIKMVTTGGAGGQTDPTQIQITDLSKTIQDPLASKVRSLLRKEYNFSQNPKRKFGIDCVFSTQPLIFPKMGEGCEVSATMNCANGFGAVTMVTATFSFFAVSRVIDKLLKS

SEQ ID NO: 55789 - protein, 445 aa, Burkholderia sp. 383
MTTKPTGDIAAHRLSSTQLSCEFADIAPLLDPTAAAAAASRCHYCYDAPCVQACPTQIDIPSFIRKIGNGNLKGAATDILSANPLGGMCARVCPTEILCEGACVRNHQDAQPVAIGALQRHATDWAMETGAVRFTRAPDTGRHVVVVGAGPAGLACAHRLALAGHRVTLFDARPKGGGLNEYGIAAYKTVDDFAQREVEWLLSVGGITLKTGVALGHDITLDALREQHDAVFLAMGLGGVRALSIDGEQLGGVMNAVDFIVQVRQADALENVAVGRRVVVIGGGNTAIDAAVQSRKLGAERVTMVYRRGVDAMSATWAEREFAQKSGVTLVTHAKPVRMAGENGQVTGVEFEAASGERFTVDADMVLKAIGQTLVPDAIDAALLTADGARIAVDADGHTAWPDVWAGGDCAATGGVDLTVQAVQDGKRAAASIDATLAQRDAKAA

SEQ ID NO: 55790 - protein, 395 aa, Blastopirellula marina DSM 3645
MAKKSIADVDVAGKTVLMRVDFNVPLDDAGKVTDARRVEMALPSIKSVIDRGGRVILMSHLGRPEPGADNSKYSLKPAAEALAGLLSKPVAFATDTVGSDAVAKAGALTDGDVLVLENLRFEKGEKKGDAEFAGKLAALADIYCNDAFGTCHRTDASMVAVPEAMGDKPKVVGYLVDKEIKYLTDAIKSPQRPFVAILGGAKVSDKIMVIKNLLGICDKVLIGGAMAYTFSLAEGGKVGGSLVEKDKVDLAKELIAAGGDKLVLPVDTHCGDDFKSSCNKVVVKAGEIPDGFEGLDIGPETAKMYAELVKNAKTVVWNGPMGVFEMPPFDEGTKAVAQAIADSDSISIIGGGDSAAAVAQLGFADQVSHVSTGGGASLAMLEGQKFAAVELLDEK

SEQ ID NO: 55791 - protein, 633 aa, Arabidopsis thaliana
MAAPIRFFELNTGAKLPCVGLGTYAMVATAIEQAIKIGYRHIDCASIYGNEKEIGGVLKKLIGDGFVKREELFITSKLWSNDHLPEDVPKALEKTLQDLQIDYVDLYLIHWPASLKKESLMPTPEMLTKPDITSTWKAMEALYDSGKARAIGVSNFSSKKLTDLLNVARVTPAVNQVECHPVWQQQGLHELCKSKGVHLSGYSPLGSQSKGEVRLKVLQNPIVTEVAEKLGKTTAQVALRWGLQTGHSVLPKSSSGARLKENLDVFDWSIPEDLFTKRSFAELLSLRMRHTASIRPLRNCGTLVPSAVCVEQPPPHLIMANAITFFKLNTGAKFPSVGLGTWQASPGLVGDAVAAAVKIGYRHIDCAQIYGNEKEIGAVLKKLFEDRVVKREDLFITSKLWCTDHDPQDVPEALNRTLKDLQLEYVDLYLIHWPARIKKGSVGIKPENLLPVDIPSTWKAMEALYDSGKARAIGVSNFSTKKLADLLELARVPPAVNQVECHPSWRQTKLQEFCKSKGVHLSAYSPLGSPGTTWLKSDVLKNPILNMVAEKLGKSPAQVALRWGLQMGHSVLPKSTNEGRIKENFNVFDWSIPDYMFAKFAEIEQARLVTGSFLVHETLSPYKSIEELWDGEI

SEQ ID NO: 55792 - protein, 478 aa, Vitreoscilla sp. C1
MYKKSTIRIFATTSHKMNIDKEINMTNTTLNATANHLHPFSDNQQLKEKGVRVITKADGIYIYDDAGNKIIDGMAGLWCVNIGYGRKELADIARDQMNELAYYNTFFKTSHPAVINLSAKLASIAPAGFNHVFYTGSGSESVDSMIRMVRHYWDSVGKPSKKTLIGRWNGYHGSTIGGVSMGGMKGMHKQGGFPIEGIVHIEQPWFYGLHEEGETAEQFGIRAANWLEEKILEIGADNVAAFVGEPIQGAGGVIIPPSTYWPRIQEICQKYDILLVADEVICGFGRTGEWFGHETFGFQPDIFTTAKGLSSGYLPIGAVFVGDKVVEGILKGGDFNHGFTYAGHPVAAAVALKNVEILDDEGIIKNVHDKTGPYMQAKWREMLSQFKYVDDVRGVGLIQGFTLVKNKATREMFPNEGETGTMLRDIFFSNNLIMRACGDHIVASPPLTITKEEIDLMLATAEKCLQEFETAMDSKLGA

SEQ ID NO: 55793 - protein, 241 aa, Zea mays
MAKLMNKLVDSFEHDEIPDVGCVRAVLAELVLTFLFVFTGVSASMAAGSGGKPGEAMPMATLAAVAIAHALAAGVLVTAGFHVSGGHLNPAVTVGLLVRGHITKLRALLYVAAQLLASSLACILLRYLSGGMVTPVHALGAGIRPMQGLVMEVILTFSLLFVTYAMILDPRSQVRTIGPLLTGLIVGANSLAGGNFTGASMNPARSFGPAMATGVWTNHWVYWIGPLLGGSLAGFVYESLF

SEQ ID NO: 55794 - protein, 313 aa, Cryptococcus neoformans var. neoformans JEC21
MSEVARKPKDAKAFLTDFLMGGVSAAVSKTAAAPIERIKLLVQNQDEMIKQGRLATPYKGVGDCFARTYKDEGLASLWRGNTANVIRYFPTQALNFAFKDYFKSMFGFKKSEGYWKWFAGNIASGGAAGASSLLFVYSLDYARTRLANDNKSAKKGGSRQFNGLVDVYKKTLASDGIAGLYRGFVPSVVGIIVYRGLYFGLYDSIKPVILVGPLEGNFLASFLLGWTVTTSAGLASYPLDTIRRRMMMTSGGTVHYKSMFDAGSQIVAKEGMKSLFKGAGANILRGVAGAGVLSLYDKAQELMFGKVYSGGSG

SEQ ID NO: 55795 - protein, 241 aa, Vitreoscilla sp. C1
MEINFLHGDALDLADQVFLFKRTVREAAFNHKMYATFMAKPMEGEPGSAMHIHQSLTCNKTGKNAFSNEDGSPSEIFFYFIAGLQKYLPEAMPFFAPYVNSFRRLTKYTAAPTNVEWGYDNRTVGLRVPRSSPQGRRVENRLPGVDCNPYLVLACSLACGLLGIQQKLQPSAPNSSNAYELPFQFPVTPEESIDRLRACTEIQEILGKRFVEMYIGIKESEIAEYFRVISPWERKFLLLYV

SEQ ID NO: 55796 - protein, 764 aa, Legionella pneumophila str. Lens
MLKILKRIVQDVTAASDLKEALGILVQRIDTAINAEAVSVYLIDNKNAEYVLIATEGLNKQAEFRVRIALDCGLIGLIGRREEPINIENAPSHPDFYHNPLIGEDHLNAFLGVPIIQHRKLYGVLVVQQLEQRHFDDAEESFLITLAAQLGGIIAHAEATGELAELTQPKKGIGVDKVEAAYTALTGIGSVPGIGIGTAVVVYPPADIDAVPRNPVEELEDEINAFYEALETTRDDIRRLSKRMKETVAEEEHALFDVYLRILDRDSLGAEVEHVIREEKISAQAALATVIKKHVQQFESMGDDYLRERASDFRDLGRRVLAELQRTQREEIVYPKRTILIGEEITAAALAEVPEGQLAGVVSAKGSNNSHVAILARALGVPTVMGLRGLKVELVSRRALIVDGYYGHVYISPSKSLLAEFKQLAQEEQELNQSLVSLRDKPAETTDNYRVSLQVNTGLAMDAGLSMSVGAEGVGLYRSEVPFMSRDRFPSEDEQTIIYRQTLKAFAPRLVTMRTLDIGGDKILPYFPVEEENPYLGWRGIRITLDHPDVFLIQVRAMMRASEELDNLRIMLPMVTTLSEVEEAVYLIEQAFDELVEEGCEIVKPKIGVMIEVPAAAYLAREMAKRVDFISVGSNDLTQYLLAVDRNNARVAALYDPLHPAMLRTLLKIVEGGHAAGVEVSICGEMASDPLAVILLIAMGFDTLSMNSASLPRVKWVIRNFAIANARKILAEVLEFEHPAEIRFHLQKALEEEGLGGLIRAGKS

SEQ ID NO: 55797 - protein, 266 aa, Brucella suis 1330
MNAGLDQVDPIWHSIRAEAEEATRNDPVLGAFLYATILNQPSLEEAVMHRIAERLGHPDVSADILRQTFDTMLEANPEWSHVLRVDIQAVYDRDPAYSRFMDPVLYLKGFHAIQAHRLAHWLYKQGRKDFAYYLQSRSSSIFQTDIHPAARLGSGLFLDHATGLVVGETAVVEDNVSILHGVTLGGTGKSSGDRHPKIRQGVLIGAGAKILGNIQVGQCSKIAAGSVVLKSVPHNVTVAGVPARIIGETGCTEPSRVMDQMLGDGI

SEQ ID NO: 55798 - protein, 565 aa, Chlamydophila pneumoniae J138
MKVPWAFKNFIPKLYTSIKEGYSFNTFKKDFQAGITVGILAFPFAIAIAIGVGVSPIQGLLASIIGGLLASAMGGSNVLISGPSSAFISILYCLSAKYGAEALFTVTLLAGVFLIAFGLTGLGTFIKYMPYPVVTGLTTGLAIIIFSSQIKDFLGLQMGANIPADFLPKWIAYWDHLWTWDSKSFAVGLFTLLIMIYFRNYKPRYPGVMIAIVTATTLVWLLKIDIPTIGSRYGTLPTAIPLPKIPQLSITKILQLMPDALTIAVLSGLETLLSAVVADGMTGWRHQSNCQLVAQGVANIGTSLFSGIPVTGSLSRTAASIKSEATTPIAGIVHSIFICFILLLLAPLTVKIPLTCLAAVLILIAWNMSEIHHWIHLLTAPKKDIVVLLTVFILTVMTTITAAVQVGMMLAAFLFMKQMSDLSDVISTAKYFDKDSDFLSKAEVPQNTEIYEINGPFFFGIADRLKNLLNDIEKPPKIFILCMTRVPTIDASAMHALEEFFLECDRQGTLLLLAGVKKTPLADLKRYHLDELIGVDHIFSNIKSALLFAQALTNLESKTSTRHLV

SEQ ID NO: 55799 - protein, 615 aa, Oryza sativa
  misc_feature (54)..(54): Xaa can be any naturally occurring amino acid
  misc_feature (87)..(87): Xaa can be any naturally occurring amino acid
MGTYKCCLIFKRRFRWNDAPPPDDVRALFANHSAGGGPHMAADGLRAYLQATGXTATWTWSGWWSRSGSCRGAAGASRGWGGHSHSXTVDDFHRFLFSHELNPPIRHGQGQVHHDMAAPLSHYFIYTGHNSYLTGNQLSSDCSDLPIIRALQRGVRVIELDMWPNSSKDDISILHGRTLTTPVSLLKCLLSIKQHAFEASPYPVIITLEDHLTPDLQDKAAKMVLEVFGDILYYPDKDHLKEFPSPQDLKGRVLLSTKPPREYLQAKDGNAATIKEDAKAAATDDAAWGKEVPDIHSQIHSATKHDQREDDDDTDEDEDDEEEEQKMQQHLAPQYKHLITIKAGKPKGTLLDALQSDPEKVRRLSLSEQQLAKLADHHGTEIVRPSLANSAEMPNLFGQNRFTQRNLLRIYPKGTRVTSSNYNPFLGWVHGAQMVAFNMQGYGRALWLMHGFYKANGGCGYVKKPDFLMQTDPEVFDPKKSLSPKKTLKVKVYMGDGWRMDFTQTHFDQYSPPDFYARVGIAGVPADSVMKRTRAIEDNWVPVWEEDFTFKLTVPEIALLRVEVHEYDMSEKDDFGGQTVLPVSDLIPGIRAVALHDRKGIKLNNVKLLMRFEFE

SEQ ID NO: 55800 - protein, 172 aa, Panax ginseng
MANHKVFFDMAIGGTPAGRIVMELYADTTPKTAENFRALRTGEKGIGKAGKPLHSKGSSFHRVIPPFMCQGGDFTAGNGTGGESIYGAKFADENFIKKHTGPGILSMANAGPGTNGSQFFICTAKTEWLNGKHVVFGQVIEGLDVVKAIEKVGSSSGRTSKPVTVTDCGQLS

SEQ ID NO: 55801 - protein, 412 aa, Erythrobacter sp. NAP1
MAMPKAGRSWEDVREEMIARGAGDAKWRDGKTAVYVFNAGPEIGEVQHEAYTLFMSENGLGPLAFPSLAQMEREVVEMALSVLHGPEGATGAITSGGTDSITMAMKAARDYARAEKGLSGPANIVLPQSAHPAFDKAAHLMDIEVRRVPLKVDGSYEADPAAMGEACDQSTIMMVGSAPNFPHGIIDPIEALGQVAEAKGVWLHTDACVGGYFAPFARMNGVPVPPFDFEVTGVHSMSADLHKYGYAAKGASTVLFRSKALFEHMPFDTKNWNGAPMKTPTLAGTRPGGAISAAWAVMNVLGIEGYREKQGLVCETRERAEKGLAQLRFEVLGKPMLGLIAFRHPEHDSFALYSEMYRKGWFTSITIDPPSLHLMLSPKHAEVIDQYLDDLREACETVEAGKEGAKVEARYN

SEQ ID NO: 55802 - protein, 319 aa, Prochlorococcus marinus str. MIT 9313
MAGSGYRDYFKVLGVERNADSDDIKRAFRKLARQYHPDVNPGDSTAEAKFKEVSEAYEVLSDPDKRSKYEQFGRYWNQASGMGGGGPAGAGFEVDFGRYGNFDDFINDLLGRFGGPQAAAGFGAGFPGGAGFPRGSSRAPVNLDAEATLKVSFAEAFRGTERTLSVNEERVQVRIPQGIKPGSRLRLKGKGNLQPGTGRRGDLFLNIDVQNHPLWRLDGDQLRADLPVALDEFALGGTATVMTPDGEAQVTIPAGTSPGRSLRLKGKGWPSPGGRGDLLLTLNLKLPSEWSADELELLKRLQQSRSTDPRQAWLQMAPL

SEQ ID NO: 55803 - protein, 170 aa, Helicobacter pylori
GSGMHTHVSVWKNNENLFSGETYKGLSEFALHFLGGVLRHARGLAAFTNASTNSYKRLIPGYEAPSILTYSANNRSASVRIPYGISKNSARFEFRFPDSSSNPYLAFGAILMAGIDGVKNKIDPGEAMDINLFKLTLDEIREKGIKQMPHTLRRSLEEMLADKQYLKESQ

SEQ ID NO: 55804 - protein, 170 aa, Helicobacter pylori
GSGMHTHVSVWKNNENLFSGETYKGLSGLALHFLGGVLRHARGLAAFTNASTNSYKRLIPGYEAPSILTYSANNRSASVRIPYGISKNSARFEFRFPDSSSNPYLAFAAILMAGIDGVKNKIDPGEAMDINLFKLTLDEIREKGIKQMPHTLRRSLEEMLADKQYLKEGQ

SEQ ID NO: 55805 - protein, 86 aa, Triticum aestivum
  misc_feature (43)..(43): Xaa can be any naturally occurring amino acid
MAATIQSVKARQIFDSRGIPIVEVDVSCLYGTFVRGAVPSGVXTGVYEALELIDGGSHYLGKGVCNAADNVYLIIVPACIGLDPIA

SEQ ID NO: 55806 - protein, 405 aa, Saccharomyces cerevisiae YJM789
MNIGGGKFLLGRISNNPTSGIVGLANVGKSTFFQAITNSKLGNPANYPFATIDAECAKVNIPSVPLSNLLRIYQSAKCVPGTLTIYDIAGLTRGASQGHGLGNKFLNDIRHVDGIFQVVRGFLKEDITHIEGNVDPVRDLSVVQDELILKDLEFLENIRERLSKKMRMVSKNSKEHQEMKIETELLDALEEHLFNGKKIRHFKDHWNLDEVKILNKHNFLTSKPTLILLNVSPQDYVRNENKFVRNIIEWINEFSPGDKFLLFSAEFESQLMECKGIASEYFDKIKEDTNVSDQQLVSAIPQIILEMRKLLNLISFFTCGPQEVHQWNIREGTTAQEAAGVIHSDLRETFISADVIKYDDLKKMEPPLNESLLKSKGLIKRAGKQYIMQDNDIALFKAAGGKIKK

SEQ ID NO: 55807 - protein, 491 aa, Aspergillus nidulans FGSC A4
MIVASGKEATEGEERGIAIAVISFITLLHVFLPNWGVRGMNVIGVVKVVLLLFIVVTGWVVLSGRLNSIPDPYASFHCSFVGSATSSNLYATALFKVLNSFAGWSNAAYVLNEIRNPVRTLKIAAPTGLGICAAATPEEIANSGTTVASYFMGKVFGTAAERALSVLITISAFGNVMTVTFAQARVNQGLAKEGVIPFPTFWASSWPFGSPSAGLLLHFILSVIVIVAIPFGDAYNFILDLEGYPSPIINLLVVAGLFYLRYSEPRLPRPFKVYWPVAVFFMAGQAFQVVAPFIRLPEGKGDTSLPYWLYPIVGIAVLLAGVVYWGIWQLLLPWLGGYRLVPEHQVLKDGTTVAVYKRENKILARKLARRPFAFKTYPILILSNPIHLLKWVAAEDSRCTFSFNRILQLTPLFTGRTTVRSRVQTYDDQSSTRHSSESIAFEELLFNETYDRPHYILIRDRARTPIAALVWVRRTKAKACLFVAQHRKENT

SEQ ID NO: 55808 - protein, 170 aa, Helicobacter pylori
GSGMHTHVSVWKNNENLFSGETYKGLSELALHFLGGVLHHARGLAAFTNASTNSYKRLIPGYEAPSILTYSANNRSASVRIPYGISKNSTRFEFRFPDSSSNPYLAFAAILMAGMDGVKNKMDPSEAMDINLFKLTLDEIREKGIKQMPHTLRRSLEEMLADKQYLKEGQ

SEQ ID NO: 55809 - protein, 397 aa, Pyrobaculum aerophilum str. IM2
MGGSMRGFSPRIGALRESPTRKIDELREKLRRENRDVILLSTGQPSIPPPREVREALGELLKVDTMELYGYTPSQGIYEVRQAISEDLRRLGGLEVPPEQIVLTAGGQAAMFSTLATLIEPGDEVVVTDPTYFGYKPLLEYFGAVVKPVRTRLEDGFQPNPEALKDSVSRKTKALILVSPDNPTGRALKEEAAKAVVDLAEDYDFWIITDEAYKTLIYEGSHIYLYKLAPDRTISINTFSKDPAIPGWRLGYVYGPPEVMPKIKLVNEEMVYCPPSFAQRLVAIYLRSEARMRYIREVVEIYRQKRDVAVAALRKYVPEARFIVPAGSMFIFVDLSRYISDGESFARELLERYGVAVVPGSYFSEIYRAAVRISFVTEPPHRLEEGIRRIGEALKAT

SEQ ID NO: 55810 - protein, 170 aa, Helicobacter pylori
GSGMHTHVSVWKNNENLFSGETYKGLSELALHFLGGVLCHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKEGQ

SEQ ID NO: 55811 - protein, 94 aa, Glycine max
  misc_feature (70)..(70): Xaa can be any naturally occurring amino acid
  misc_feature (72)..(72): Xaa can be any naturally occurring amino acid
MSIASMRMATIGSIKARQIFYRSGNPTVVEDLTCSDGTFDRAAVPSGAYTGIDEALELREGRSDYLGKGXDXAAGNANTAIGPDLIGGGPTEQT

SEQ ID NO: 55812 - protein, 334 aa, Kluyveromyces lactis NRRL Y-1140
MTIMSAASSSSSGDIRHLISIKDLSDDEFKSLVDRAEYYKKVFKSNDISEFQKQHLKLLGKTIALIFTKRSTRTRISTEGAAAFFGGQPMFLGKDDIQLGVNESFYDTTKVVSSMVSCIFARVNRHADILNLAKDSSVPIINALCDKFHPLQAICDMLTIKEHLDYDNNKLKMAWVGDANNVINDMAIAALKLGIDVAVATPPGIELDSDIQQEGQKLAAQNNCEFVCTHDSMAACTDANILVTDTFVSMGEEFAKEAKLRQFAGFQINSELCSVAAPNYKFMHCLPRHQEEVTEEVFYGKNSIVFEEAENRLYAAMAAIDIFVNHKGDFFSHP

SEQ ID NO: 55813 - protein, 504 aa, Oryza sativa Japonica Group
LPRHPRLLKASPRVAPRRTTPPSPSPPRPTPPPRDLAMAALLHLQSSATAAAAPSFLLLRRRGGGVTAPAGSSRRRRACFRVEAKIREIFMPALSSTMTEGKIVSWTASEGDRLAKGDPVVVVESDKADMDVETFHDGFLAAVLVPAGESAPVGSAIALLAESEDEIPAAQSKAASLSSSSSSSPPPPPPQESTPPPPPPPPPAPVAAAVSAPAPPSPASQGGLRVVASPYARKLAKDLNVDLNSITGSGPGGRIVAKDVEAAAAAPKKAAPVAAARPDVPLGSTVPFTTMQGAVSKNMVESLAVPTFRVGYTFTTDALDALYKKIKPKGVTMSALLAKATAMALVQHPVINSSCRDGKSFTYNSSINIAVAVAIDGGLITPVLPDADKLDIYSLSRKWKELVDKARAKQLQPHEYNSGTFTISNLGMFGVDRFDAILPPGTGAIMAVGSSQPTLVGTKDGSIGIKNQMQVNVTADHRVIYGADLAAFLQTLSKIIEDPKDLTF

SEQ ID NO: 55814 - protein, 606 aa, Haemophilus ducreyi 35000HP
MTNNTLTFSDLGLPQSILDAVNDMSFVTPSPIQQECIPHLLAGSDVLGMAQTGSGKTAAFSLPLLAQIDPNQRHPQMLVMAPTRELAIQVADACEQFTKNMKGIRVVTVYGGQRYDIQLRALKQGSQVVVGTPGRILDHIRRGTLNLSTLKSIVLDEADEMLRMGFIDDVETVMAELPEKHQTALFSATMPEPIRRITRRFMSDPKEVKIQATQRSAPDITQSYWLVNGFRKNEALLRFLEVEEFDAAIIFTRTKTGTIDITELCERNGYRTAALNGDMTQQAREQTLDKLKSGRLDILVATDVAARGLDVERISLVVNYDIPLDSESYVHRIGRTGRAGRSGRALLFVEPRERRLLRNIEQLMKKPIDPVAIPNHQVLMEKRREKFKAKISKQLEHHDLEKYRELLENLFTADQDHEELAAAMMMLQEKQKLILPPDPEVRNLRSERGRRDRNERNDRRNGREHRENNGVAMDLYRIELGREDGVEVRHIVGAIANEGDINSRYIGHIKLHDRYSTIELPKGIPNHIVQHFAHKARVLNKQMQMSLLGPAGGANNQPFEERRGSRRDQRNSGRNSRPNYREDSFNKERKNTGFKEKRFNNKSSRD

SEQ ID NO: 55815 - protein, 275 aa, Shewanella sp. MR-7
MLNTTMFNYQGKNVVVVGGTSGINLAIANAFALAGANVAVASRSQDKIDAAVLQLKQSNPDGIHLGVSFDVRDLAAVERGFDTIASEFGFIDVLVSGAAGNFPATAAKLSANGFKAVMDIDLLGSFQVLKTAYPLLRRPQGNIIQISAPQASIAMPMQAHVCAAKAGVDMLTRTLAIEWGCEGIRINSIIPGPIANTEGFNRLAPSAALQQQVAQSVPLKRNGEGQDIANAAMFLGSEYASYITGVVLPVDGGWSLGGASIAMTALGELATKAQQ

SEQ ID NO: 55816 - protein, 176 aa, Burkholderia sp. 383
MPTRRHLLFAGATGLAVLATLSSVGRRALVGRAFAAPPATPQTAAPFEVTLSDAEWHRRLTPAQYSVLREAGTERPYTSPLNDEHRQGTFACAGCALSLFSSATKFDSHTGWPSFWKPLDHAVATTTDASFGMIRTEVHCRRCGGHLGHVFDDGPQPTGLRYCMNGLALTFHPAAA

SEQ ID NO: 55817 - protein, 332 aa, Alteromonadales bacterium TW-7
MKYLVTGAAGFIGNFVAERLCDDGHEVIGLDNLNDYYDPALKHARLERIKHLTTFRFIKMDLADREGIATLFKNEQFDRVIHLAAQAGVRYSIENPMAYIDSNMVGMATILEGCRHNKVKHLVYASSSSVYGANTKIPFAEEDRVDHPVSLYAATKKSNELMAHTYSHLYSLPTTGLRFFTVYGPWGRPDMAPYLFTDAIANDRPIKVFNNGKMQRDFTYIDDIVEGIVRIQDVIPAANQQAQTEGSPFYKLYNIGNNQPVELEIFINCIENALEKKADKQYLPMQEGDVVRTFADVSGLESEIGFKPNTDLQNGITKFVSWFNLHNTENVK

SEQ ID NO: 55818 - protein, 480 aa, Blastopirellula marina DSM 3645
MEYKREVVPYRDPLLRVHDYDEFQVHVDEQFLKTQGARCMDCGVPFCQSATGCPVDNLIPEWNDLVYKGRWREALDRLHKTNNFPEFTGRVCPAPCENACVLGITNPPVAIKNIEAAIVDRGWEEGWITPNPPTQRTGKKVAVIGSGPAGMAAADQLNKAGHQVTVYERDDRIGGLLMYGIPNMKLEKERVVERRVNLMKAEGIEFVTNAHIGVNVELADLRKDNDAVVLAVGATKPRDLPIPGRELNGAYFAMQFLKANTKSLLDSELKDGNYISAEGKDVIVIGGGDTGTDCLGTSIRHGCKSVVNFELLPQPPAERAPDNPWPQWARIFRVDYGHQEAEAKFGQDPRTYCVLSKEFLGDGKGNLTGIRTVNVEWKNENGRWNMQEVPGSEKEWKADLILLAMGFLGPEETLVEKLGMETDQRSNFKAEYGRFATNIDGVFAAGDCRRGQSLIVWAINEGRGAARECDRYLMGKTELP

SEQ ID NO: 55819 - protein, 205 aa, Haemophilus influenzae Rd KW20
MSEIKLNYHKTHFLTSAPNIRSIPEDTGIEIAFAGRSNAGKSTALNALTNQKNLARTSKTPGRTQLINLFEVEPNCKLVDLPGYGYAAVPEQMKIQWQKSLGEYLQKRECLAGLVVLMDIRHPLKDLDQQMIEWAVSANLPVLLLLTKADKLSQSARSKQVKMVREAILPFQGDIQVEAFSAQNKIGIDKLAVKLDFWFSPLFAE

SEQ ID NO: 55820 - protein, 296 aa, Alteromonadales bacterium TW-7
MKVLKAVLPVAGLGTRMLPATKAIPKEMLPLVDKPLIQYVVNEAVAAGIKEIVLVTHASKNSIENHFDTSFELEATLEARVKRSLLDEVRSIVPKDVTVISVRQSAPLGLGHAVLAAKPIVGHNPFAVMLPDVIIDKYKSNPKTDNLSQMINRFDQTGYNQVMVEPVPQAQVHQYGVVDLAGKSISAGENATIKNMVEKPNNDEAPSNLAITGRYVVSPTIWDLLEYTPPGAGGEIQLTDALLQLRHLETLEAYHLTGKSHDCGSKLGYMLANFEYAMQSSHMGEEFTKQVKELIA

SEQ ID NO: 55821 - protein, 355 aa, Solibacter usitatus Ellin6076
MSIQTRTTKTVLAGILIATGVLSIVLSAQSRGSANRSAVAPRQEFVKRAVDEAYAKFRSDTTGKNADYIPYLAQVDSKLFGVSVVTTDNESYSVGDTSYAFSIQSISKVFTLALAMKELGAAKVFERIGSEPTGRAFNSVIAVVDMPSHTGNPLVNAGAIATTSLISGAGAAEKWSKILEFYGKAAGEKLSLIDEVYKSEAATNQGNRALAALLVKYERIYSDPLEAVDIYTKACSVGANTKQLAQMGATLANNGRNPVTGEQVIREEDIPHILSAMTMAGLYDGSGGWAWHVGLPAKSGVGGAILAIAPGKGAIAVFAPRLDEAGNSVKAQKVITYVADKLDYNLFSPKSVGLK

SEQ ID NO: 55822 - protein, 274 aa, Dechloromonas aromatica RCB
MTGAKGTPIRSEAELAMARRAGKLAADVLSMLAEHVKPGVTTNELDKLCHDYIVNVQRAIPANIGYHGYPKTICASVNHVVCHGIPSDRKLKNGDIINIDVAIIKDGWFGDTSRMYFVGEPGILAKRLVRTTYEAMRAGIEQVRPGATLGDVGHAIQTVAHREGFSVVREYGGHGIGTVYHDDLHVLHFGKPGAGLKLEAGMVFTIEPMINAGKAEIKHLPDGWTVVTKDRSLSAQWEHMVAVTKNGFEVLTPWPDGYGDYAAIVSFPEERSAA

SEQ ID NO: 55823 - protein, 291 aa, Clostridium acetobutylicum ATCC 824
MEKFRTIAITGATSGLGKLVAIELVKRDAHLILTARNKERAEATKKMLESINPKAKIDFFFGDLSVMRDVKRVGEEIKAVHPRIDVLVNNAGLHAFEQRVTSDGLAEMMAVNYLAPWLLTNTLLQSLIASRNARIVNVASEASRNHGELKLPGDLTDISEFTSRESSAIYGKTKLLNIMFTAELARRLSGTGIIVNALNPGFNVTGLGRELWFATALERILKFFHIGDPRKGADIILRLSIDAQYNSVTGGYFNVITGNPISPIYPGGDKVMQNKLWSDTETLLKQRGFIE

SEQ ID NO: 55824 - protein, 474 aa, Aspergillus nidulans FGSC A4
MWSPFLEVAKALREGHVVEFITQKYNEYGWTFEQNVLGRSGISTIEPENLKALLATQFNDFCLGTREREFGPLLGQGIFTLDGAGWSHSRALLRPQFTRDQVADLDLMESHISRLIELVPKDGSAFDIQRLFFLMTLDSSTHFLFGESVHCMDEGNVLARSTVNNAQGFANAFNTALDYLNWRSVAGNFYWMITSKEFRDANKRVHEVVDYYVHQAIEAKRHPEKKEPGRYIFAEALAADNDNPKVLRDNMLNILLAGRDTTASLLSSAFFYLSRHPAVWEKLRRVIIEEFGDVQNPKGEITHAKLKDLPYLRYVLNEVLRLQPPVPLNLRVAVKDTSLPVGGGPDGKSPVFVEKDQPVLYSVYAMHRRKDLWGPDADSFRPERWEENAKHGWEYLPFNGGPRICLGQQYALTEASYTMVRLMQRFSKVENGEPGLDEPLIRATLTMSHENGVKVRFKLQHVRRKPSPLQTCTR

SEQ ID NO: 55825 - protein, 526 aa, Chlamydophila pneumoniae J138
MERKRFIDCDSTKILQELALNPLDLTAPGVLSAERIKKFSLLGGGFTFSFATERLDDAILAALISLAEERGLHESMLAMQQGQVVNYIEGFPSEMRPALHTATRAWVTDSSFTGEAEDIAVRSRVEAQRLKDFLTKVRSQFTTIVQIGIGGSELGPKALYRALRAYCPTDKHVHFISNIDPDNGAEVLDTIDCAKALVVVVSKSGTTIETAVNEAFFADYFAKKGLSFKDHFIAVTCEGSPMDDTGKYLEVFHLWESIGGRFSSTSMVGGVVLGFAYGFEVFLQLLQGASAMDQIALQPNARENLPMLSALISIWNRNFLGYPTEAVIPYSSGLEFFPAHLQQCCMESNGKSIVQDGRRVGFSTSPVIWGEPGTNGQHSFFQCLHQGTDIIPVEFIGFEKSQKGEDISFQGTTSSQKLFANMIAQAIALACGSENTNPNKNFDGNRPSSVLVSSQLNPYSLGELLSYYENKIVFQGFCWGINSFDQEGVSLGKALANRVLELLEGADASNFPEAASLLTLFNIKFR

SEQ ID NO: 55826 - protein, 511 aa, Alcaligenes faecalis
MGEEMKTESKKPDSARSELAMKYFQAEYGHFINGEWVGGSSSEKIAMINPANLEVLSYIQSGNAEDVNRAVEAATQAFPKWSRSTPSERQAALYEMARRLRARANDYAAMLSLDNGKPIMEALHIDIPATIGQFELFAGAAFGLHGQTIDATQGVAIIHREPLGVVAQIIPWNVPLVMMATKIAPALAAGNTIVLKPAESVCLAVMEFIREMADLLPPGVLNVITGYGPNVGEALVTHPNVRKVAFTGSRPTAQKLMQYASVNVIPQTLELGGKSANIICADADMDAAAESAAMSIVVNKGEICFAATRHFVHESVMDAFVEKVQNILRKIRVGDPMIPSTQMGPQASRMQFDKVLGYLDIGRNEGATTAMGGKRATVSGFEQGYFIEPTLFTDVRNKMRIAQEEIFGPVGVVIPWKDEAQVIREANDTEFGLAAGLWTKNITQAHRMAREIEAGTVWVNRYFNMIPNVPFGGYKQSGFGREFSLDVLSHYTQLKSVIVSLQEGPIGLFDH

SEQ ID NO: 55827 - protein, 461 aa, Pseudoalteromonas tunicata D2
MSLGKVVQIIGAVVDIEFPQNSVPAVYDAVNITDGDLAGLTLEVQQQLGGGVVRGIALGTTDGLRRGATVQNTGKAIQVPVGKATLGRIMNVLGEPIDEAGPIGEEERMSIHRAAPSYEEQSSSIELLETGIKVIDLVCPFAKGGKVGLFGGAGVGKTVNMMELIRNIAIEHSGYSVFAGVGERTREGNDFYHEMNESNVLDKVSLVYGQMNEPPGNRLRVALTGLTMAEKFRDEGRDVLFFVDNIYRYTLAGTEVSALLGRMPSAVGYQPTLAEEMGVLQERIASTKTGSITSIQAVYVPADDLTDPSPATTFAHLDATVVLSRDIASLGIYPAVDPLDSSSRQLDPLVIGQEHYDAARGVQTVLQRYKELKDIIAILGMDELSDEDKQLVSRARKIQRFLSQPFFVAEVFTGASGKYVSLKDTIAGFKGILNGDYDALPEQAFYMVGSIDEAIEKAKNM

SEQ ID NO: 55828 - protein, 251 aa, Zea mays
MKFNIANPTTGCQKKLEIDDDQKLRVFFDKRISQEVSGDALGEEFKGYVFKIMGGCDKQGFPMKQGVLTPGRVRLLLHRGTPCFRGYGRRNGERRRKSVRGCIVSQDLSVINLVIVKKGENDLPGLTDTEKPRMRGPKRASKIRKLFNLSKDDDVRKYVNTYRRTFTTKSGKKVSKAPKIQRLVTPQVLQRKRARIAEKKKRIAKKQAEAAEYQKLLAQRLKEQRERRSESLAKRRSKLSAAAKASAATSA

SEQ ID NO: 55829 - protein, 569 aa, Prochlorococcus marinus str. MIT 9313
MLDPEASPPGTHTLCIFLPESTPEITLPTDGKDKYHNRTYRDQKQKKASAIIDYLEKNYFPELKKHILVQEIATPQTIQRYTLKSHGSIGGPQVNMSQSYMSRLAARSDWQGLYCVGDSTSQGIGVVSVTVSAISAVNAILKDLRQPQYLPLKHYPKNYVHFAKASLSQKQHSADLIPDHQKIKTVELDPRSCLSPRCVRAGPDSTHQAHIARLVEAGNWLGAAQSLRAVNPFSESTSYLSQSDDFCGSSCSQSLCPDASIPIKSLNRYVCEKVPNYIPEAAPDNGKRISIVGAGPAGLTCAHYLARLGYQIDIYEKKSEAGGTLKSIALVSRIPLSVLHREISNLLLPSIRIYFGQSLGEDITIAELRHQYDALFLACGLGEKQIQTKDVDHDFNLIHGLKFLDQFTQESTIVRGKTLTIVGATYLAMDISKLAIQNGAKKVYLIDEQSEFQSKSQAKRLNEMQELGIEIHSRIDPSAFSKLCSSSHQVIMAGLEQQRIEAQLREHLSSSLLVDVDALVDLDTLQVLGHVNVFAGGDIIRGSSSIHESIRDGRKAAAEINHAFMIKQS

SEQ ID NO: 55830 - protein, 197 aa, Triticum aestivum
  misc_feature (54)..(54): Xaa can be any naturally occurring amino acid
  misc_feature (73)..(73): Xaa can be any naturally occurring amino acid
  misc_feature (82)..(82): Xaa can be any naturally occurring amino acid
  misc_feature (117)..(117): Xaa can be any naturally occurring amino acid
  misc_feature (126)..(126): Xaa can be any naturally occurring amino acid
  misc_feature (140)..(140): Xaa can be any naturally occurring amino acid
  misc_feature (143)..(143): Xaa can be any naturally occurring amino acid
  misc_feature (153)..(153): Xaa can be any naturally occurring amino acid
MAPTVMASSATSVAPFQGLKSTAGLPVSRRSNGASLGSVSNGGRIRCMQVWPIXEGIKNSETLSYLPPLNTEXLLKQVDYLXFRSKWVPCLQFNKVGLSSRLSTTHPLGYYDGRYWXTMWKLPIFXGCTDPPSVNKVEEXKKXIPDAYFRIIXSTNRKAQIAHGRSGKAKNITRHIKAGFRILGFLHYFCFQKKVSQ

SEQ ID NO: 55831 - protein, 603 aa, Thiobacillus denitrificans ATCC 25259
MSLPAARSFPSWLKPFTSFRLWWPRVNRETTRADLMAGLTGALVALPQGVAFATIAGMPPEYGLYAGMIPAIIAALFGSSWHLVSGPTTAASIVLFSVLSPHAEPGTAQYVSLALTLTFMVGVIQIVMGLAKLGTLVNFISHSVVTGFTAGAAILIATNQVKHFTGQAIPRGASFSDTWSHAFTHVDEIQVAIAATGLVTLLLGIAVKRWLPRLPYMIVAMLGGAVFGNAIARVLGVELPTVGALPASLPPLSAPAFDAESVRAVASGVIAVTLLALTEAVSIARALAARSGQHVDGNQEFVGQGMSNLAGAFFSGYVATGSFNRSGVNFAAGAKTPLAAILAGVFLLILVLFVAPWAQYLPNAAMAGILFLVAWGLIDFDEIAHTFKTSRQETAIMAATFAATLFLTLEEAIIIGVLLSLAIYLSRTSKPQLRVRAPNPHHKKRHFTDAENAPQCPQLRFVRIDGSLFFGATSHIRETLAAQDQTAPDQKHVAIVAQGINFIDLAGAHYLAEEAERRRSQGGGLYFIRVKDTVQEQLAENGALKTIGGANLFDSKTEAIAALYKRLDPAVCSICRARIFRECQGRPAEQAVTPDLVMPVSHA

SEQ ID NO: 55832 - protein, 380 aa, Washingtonia robusta
MSSTAGKVIKCRAAVAWEAGKPLVIEEVEVAPPQAMEVRMKILYTALCHTDVFFWEAKGQNPLFPRILGHEAGGIVESVGEGVTDLAPGDHVLPVFTGECRECAHCLSEESNMCELLRINTDRGVMINDGKSRFSINGKPIYHFVGTSTFSEYTVVHSGCVAKINPLAPLNIVCILSCGISTGLGATLNVAKPTKGSTVAVFGLGAVGLAAAEGARLAGASRIIGVDLNPRRFHEAKKFGVNEFVNPKDYNKPVQEVIAEMTNGGVDRSIECVGNIDAMVSAFECVRDGWGVAVLVGVPHKDAMFKSHPVNFLNERTLKGTFFGNYKPRSDLPAVVEMYMNKELELEKFITHEVPFSEINKAFDYMASRGQLRCIIRMDG

SEQ ID NO: 55833 - protein, 301 aa, Acinetobacter sp. ADP1
MYIMWKQYLTEAVLKTTIRAPSRFSLPPATLRVALNQMCRVFPLNKEVSIRPIRLAGIRAEEIKPQSSSTQLIFHIHGGAFFLGSLNTHRALMTELAARTQMQVLHVDYPLAPEAGFPDALDALYDIYQTLLDQGVLPKDIILSGDSCGANLALALALRLKDDPEQLPSGLILMSPFLDLTLSSESLRLNKKHDALLCIEALEAGIDYYLGDSMPKDDPRVSPIFDNLRGLPPTMIQVGSKEILLDDAKRFRDKAKEADVKVEFKLYTGMWHNFQMFSAWFDEAKQAISDLAVFAHQLDRD

SEQ ID NO: 55834 - protein, 436 aa, Erythrobacter sp. NAP1
MKIAMVGSGYVGLVSGACFADFGHDVVCIDKDQGKIDRLHDGIMPIYEPGLDALVESNVKAGRLSFTTSLAEGIKDAAAVFIAVGTPSRRGDGHADLSFVYAVAKEVGESLANDAVVVTKSTVPVGTGDEVERLLKESGTPHRVSVVSNPEFLREGAAIGDFKRPDRIVIGAEDDFGREVMREVYRPLFLNESPILFTSRRTSELIKYAANAFLATKITFINEMADLCEKVGANVQDVSRGIGMDNRIGAKFLHAGPGYGGSCFPKDTLALLKTAEDYDSPTRIIEAVVKVNDSRKRAMGRKVLDSIGGPENARGKKVALLGLTFKPNTDDMRDSPAIAVAQTLTDAGVKVSAFDPEGMEQARPLMPAVNMCDDPYAAIEDADATVIVTEWDAFRALDLSRVKDLAKAPVLVDLRNIYNPDDVRNAGFTYASIGRD

SEQ ID NO: 55835 - protein, 306 aa, Washingtonia robusta
  misc_feature (10)..(10): Xaa can be any naturally occurring amino acid
  misc_feature (300)..(300): Xaa can be any naturally occurring amino acid
IVESVGEGGXDLSPGDHVLPVFTGECKECAHCKREESNMCDLLRIDTERGVMISDGQSRFSINGKPIYHFVGTSTFSEYTVIHSGCVAKINPLAPLDKVCVLSCGISTGLGATLNVAKPPMGSTVAIFGLGAVGLAAAEGARIAGASRIIGVDRNPARFDEAKNFGITEFVNPKDYDRPVQEVLAEMTGGGVDRSIECTGNINAMISAFECVHDGWGVAVLVGVPHKEAEFKTHPINFLNERTLKGTFFGNYKPRTDLPLVVEKYMNKELELEKFITHSVPFSEINKAFDYMLKGDGLRXIIHMDG

SEQ ID NO: 55836 - protein, 319 aa, Yarrowia lipolytica CLIB122
MSSNSIKLLAGNSHPALFKLVSERLGVPLSNIGVFQFSNLETSVTIGESVRDEDVFVLQTGCGEVNDFLMELLIIIHACKTASARRITAVIPNFPYARQDKKDKSRAPITAKLMANMLQTAGCDHVITMDLHASQIQGFFNVPVDNLYSEPSTLRYIREHVDVSSAVIVSPDAGGAKRAAALADRLDLNFALIHKERQRANEVSRMVLVGDVKGMTCVLVDDMADTCGTLAKAAQTLKENGARDVIAIVTHGILSGPAVQRINDSELLKVVCTNTVPHDHLKAECPKLDTIDVSPTLAEAIRRLHNGESVSYLFRNAPM

SEQ ID NO: 55837 - protein, 489 aa, Bacillus cereus G9241
MPQDRKEEVQNDTYEEKEIMPDNPQYLPRRVQMELPPEFSINPLFARKGESVVPRFNMPDEGMLPETAYQIVHDEITLDGNARLNLAMFVSTWMEPTAERLYAKSFDKNMIDKDEYPQTAEIEERCVRILANLWHSPSPLTTMGVSTTGSSEACMLGGLALKRRWQNARKREGKSVDRPNIVFSSAVQVVWEKFANYWEVEPRYVKVSPEHSLLDPQGVIAAVDENTIGVVPILGETYTGRYEPVAAIAKALDDLQERTGLDIPMHVDAASGGFIAPFLQPDLVWDFQLPRVKSINVSGHKYGLVYPGLGWIIWREADDLPEDLIFRVSYLGGNMPTFALNFSRPGAQVLLQYYNYLRLGKRGYYDVQRASQKVALFLSKAIQKMEPFELLSNGSDIPVFAWRLKNGHTSNWNLYDLSRQLRVFGWQVPAYPLPPDLEAVTIMRVVVRNGFSVDLAHLFLRNLKQAVAFLDSLDGPMPHDTKCDNGFHH

SEQ ID NO: 55838 - protein, 409 aa, Oryza sativa Japonica Group
MLDAGDAVSFGGAQNIVGNPLGPMWRLLRRVCVQEMMSPAGLASVHGLRRREFRSTLRYLHSKPGEPVDVGAQMFLNTMNVITGTMWGGTIGSESERSAVGSEFRGLVAEVTELLGTPNVSDLFPVLKPFDLQGIRRKMERLRSRFDLLFTKIIQQRMRSQQDGGEMTTDFLECLLKMEKEGSDGKTTFTMDNVKGFLLEMVVGGTDTTSNSVEWIMAELLQNPQVLNKVQQELDSIVGRDAVVEESHLPQLHYLRMVIKETLRLHPPVPLLVPHSPSAAATVGGYHVPEGCRVLINVWAIQRNPLVWNKPLDFNPDRFARDGGHKGDFTGSQLDYLPFGSGRRMCAGMAMGEKVMVYSVAMLLQAFDWKLPQGVQLDLSEKFGIVMKKATPLVAIPTPRLSKPELYYS

SEQ ID NO: 55839 - protein, 332 aa, Deinococcus radiodurans R1
MSLPTSTTPESFMNSRRSPLLVFSGQSNRPLAQAICDNLGVPLGRSRTEKFTNDNLIVHYEESLREGDVFIVQTFSTPVSDAIMELMLMIDAAKSASAGRVTAVIPYYSYARSDKKDSPRISIAGRLVADLLQEAGADRVLTMTLHSPQVHGFFKVPVDHLSADVVLSQHFKKCVPDAHNGVVLAPDAGSIKRASQIARRLDSGLAMIDKERLSDTEVRPRALIGDVDGKTVFIVDDEISTAGSLVETVSIARSMGAKDVYVAVTHGVYSGPAIERIAALDVTQVASCNTVLVPQDKLDRAGGKLAVLDVAPLFASAIANIHTGASVSTLFT

SEQ ID NO: 55840 - protein, 486 aa, Medicago sativa
MAPPLTRIGLAGLAVMGQNLALNIADKGFPISVYNRTTSKVDETVERAKQEGNLPLYGFHDPEAFVNSIEKPRVIIMLVKAGAPVEQTTKTLSAYLEKGDCIIDGDNEWYENTERREKEVAELGILYLGMGVSGGEEGARRGPSMMPGGSFEAYKYIEDILLKVAAQVPDSGPCVTYIGNGGSGNFVKMIHNGIEYGDMQLIAEAYDVLKSVGKLTNEELQSAFTEWNKGELLSFLIEITADIFGIKDDKGDGYLVDKVLDKTGMKGTGKWTVQQAAELSVPAPTIEASLDARFLSGLMDERVEAAKVFKSGGFGDILTDQQVDKKQLIDDVRKALYAAKICSYAQGMNLIRAKSAEKGWDLALGELARIWKGGCIIRAIFLDRIKQAYDRNPNLANLLVDPEFAKEIIERQTAWRRVVSLSVNSGISLPGMSASLAYFDSYRRERLPANLVQAQRDYFGAHTYERVDIEGSYHTEWFKLAKQSRI

SEQ ID NO: 55841 - protein, 1050 aa, Aspergillus nidulans FGSC A4
MAWDHLDIDKPHLAYMILGGFTGLFMLCSLFVKEKLYIGEATVATICGIIFGPHAANLFNPIEWGNVDKITLECSRIVLVVQCFAVGVELPKAYMERHWKSVTLLLLPVMTWGWLITSLFIWSLIKPLTWLEALVCAACVTATDPVLASSVVGKGKFAKRVPRHLRDLLSAESGCNDGMAFPFIYLSYYILHYRPDANAVSLHWFCVTILYECVFGAIFGFTIGYAARHAIRFAERKQLIDRESFLVFYFVLALFCAGSGSLLGMDDLLIGFAAGVGFSNDGWFTEKTEESHVSNVIDLLLNLAYFVYLGAILPWADYNNADLGLDAWRLVVIAILVIFFRRIPIMLLLKPIIPDVKTWREALFAGHFGPIGVGAIFACILARAELETGSTQPVVSDDLPKPHTHNYYVVQIIWPLTTFMVVASILVHGSSIAVFTLGKRINTLSITLSYTQANEEGPSWMNRLPRVQSLAKGSMSFRKADDSEGSSPNEPEYPPGTLPPIGLPGNFLRRVQEDDSGSPTGRVSTRRGRRRRRKADGAGGPISQSAIAPQRPSEVESEDAEKTVGDTESTTPSPPPATWRDAIVNVYVEGHDLIYEDKDGNVLKTEHVGHMSAEEQKRHVQAERSKLNLEFQQPPDETKPGSSEEQPTAGERLEKSIGDKAKRRRFGQWLGFGKQRSENQEQKDAKTEKKSAEEAGPKAPKGKGRSAHAYQFGNTIIVEDEDGEVIKKYSIPSVDKSEAKGNAPVRRGLVRMGTWFGKEEEGEPSQAGKKTHENEWLADDGLRFTLANDETVGKHGISHKGRRMTKQEFADQIRNLGPKARQSIVEDSDAPKRVKDAARDDAQQADKRERRASAAGSAHQTGAPHDDLESVSSGSDDEPDSEEGPGPNVAETLARIAAGTATGTAADERRKDLSPGTSSRERSPRSRRDSDDDGTERVPPSKLREAAGLALPQQALDLDDTGETPAERRRRLAALGEYSDSEDDVDSDAVSEGEDDHNNRKGPGKISFADGTNLEAGSTYDREGNGLGSSRMHSRRSRSRISWGGEKGRE

SEQ ID NO: 55842 - protein, 246 aa, Rhizobium sullae
GGNKTRKLEYIIPDAIASNADTLVSIGGVQSNHTRMIAAVAAKIGFKCRLVQESWVPHEDAVYDRVGNILLSRIMGADVQMVDEGFDIGIRQSWEEAIEDVKAKGGKPYPIPAGASVHKYGGLGYVGFAEEVRAQEAELGFKFDYIVVCTVTGSTHAGMTVGFAKDGRERNVIGIDASFTPTQTKAQVLEIAQRTAELVDLGRDLTLDDIILIEDYAYPVYGVPSDETKDAIRLCARLEGMITDQS

SEQ ID NO: 55843 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFGAILMAGIDGVKNKIDPGEAMDINLFKLTLDEIREKGIKQMPHTLRRSLEEMLADKQYLKEGQ

SEQ ID NO: 55844 - protein, 542 aa, Prochlorococcus marinus str. NATL1A
MSGSNPAVSINKRKVAPVVLAILDGWGYREEIEHNAVRQASTPVIDALWHAYPHTLIEASGADVGLPDEQMGNSEVGHLTIGAGRIIQQELVRISNTVKENKLITNPALNQFSQSLKKGGGTLHIMGLCSDGGVHSHINHLCGLIEWAASKGLKSVSLHLFTDGRDTSAKSANKYINTIEAKIKSTGVGEISSLCGRYWAMDRDNRWERTSKAYELLTDPRFALSKLSAAESINKSYQEGITDEFIEPVRLSSSFLKDGDGVVFFNFRPDRARQLVKALKLKDFDGFERKNRADIDVLTFTQYESGLPVSVAFPPEPLNDLLGQVISDHGLNQYRTAETEKYPHVTYFLNGGIEKPLKGEVRHLVPSPRVATYDLQPEMSADELTDSCIKAIDSGIYSLVVINFANPDMVGHSGIMTAAIKANEKVDSCVGKLLNSIGKLGGSLLITADHGNSEMMIGPDGQPWTAHTTNPVPVILIEGEKRKLSGYGNDIKLRQSGGGLADLAPTLLHLLNLPKPKAMTGKTLIEPINLPKKPNLIPQPAY

SEQ ID NO: 55845 - protein, 215 aa, Campylobacter lari RM2100
MYVAPSLLSANFLNLENEIKDVCEAGADLLHIDVMDGHFVPNLTFGPCVIENISKITSVPLDVHLMVHNVSSFVDLFIPIKPKFISFHIEAENHPIRVCEYIRKNGIHPAIVLNPHTPVSSIEHILEFVDMVLLMSVNPGFGGQNFLPLVYDKIRQLREMIDRKNLKVFIEVDGGVNGLNAPDLDEAGADILVAGSYIFSSQDKKTAINSLKLEF

SEQ ID NO: 55846 - protein, 173 aa, Actinobacillus pleuropneumoniae serovar 1 str. 4074
MFRFVLIPLFVIAFYLPAGWYAAEISTLIFFIASITDAFDGYLARKWNQTTQLGAFLDPVADKVLVAVALVCVVEYYHTWWISIPAAIMIAREIIISALREWMAELGERASVAVSMWGKFKTTAQMLALGGMLWRFNFAMEVLAWILLYIAAGLTLWSMMQYLNAAKGSLLKS

SEQ ID NO: 55847 - protein, 396 aa, Shewanella sp. MR-7
MFNSLVAMPADPILGLLTQYREDSHPQKVDLGVGVYKDPAGNTPILNCVKKAEKFRLDTETTKVYIGPTGSPQFNTLITELAFGSDHSAIIANRIRTVSTPGGTGALRVAGDFIKRCNPNAVLWVSDPTWANHIGLFEAAGLAVKTYPYYDYDTKSLKFDEMLSALTQIGPNDVVLFHACCHNPSGMDLTTEQWDKVVALTKEQGFTPLIDMAYQGFGDGVDIDAYGVRKMAAAVDNMILCSSCSKNFGLYRERIGSCSVVAKDANTANIAQSVLLYVVRCLYSMPPAHGAAIVETILGSAELKQEWLDELKVMRDRINGNRAILVEKLKINGVDRDFSFIARQKGMFSFLGVNPEQVARLQKEFSIYMVGSSRISIAGISEDNVDYLAKSIAEVL

SEQ ID NO: 55848 - protein, 258 aa, Lentisphaera araneosa HTCC2155
MGKLDNKLAVVTGGGSGIGRAITEKFAAEGALVALLDFNEEQGTETVDAIKAEGGKAQFYKCDVSDSAGIASTFDSIKSEHGNVDVLVNNAGIAAVGNLETCTEEELDRIYNVNVKGVFNCLKSGIPQMLENGGGSIINLASIASSIGIPDRFAYSMSKGAAYTMTLSVATDYVDQGIRCNSISPARVHTPFVDGFIAKNYPGQEEEVFKKLSATQPIGRMGQPEEIANMALFLASDDAAFITATDFPVDGGFIKIKK

SEQ ID NO: 55849 - protein, 406 aa, Brucella suis 1330
MSEEFHKIRRLPPYVFEQVNRLKASARAAGADIIDLGMGNPDLPTPQNIVDKLCEAVQDPRAHRYSASKGIPGLRRAQAQYYARRFGVKLNPDTQVVATLGSKEGFANMAQAITAPGDVVLCPDPTYPIHSFGFIMSGGVIRSVQAKPDDNFIPTLERGVKHSIPKPIALILNFPSNPTAYVATLDFYKDVVAFARKHDIVILSDLAYSEIYFDGNPPPSVLEVPGAMDVTVEFTSMSKTFSMPGWRMGFAVGNERLIAALTRVKSYLDYGAFTPIQVAATAALNGDGSDIAYVRNVYKQRRDVLVESFGRAGWDVPPPAATMFAWVPIPERFRSLGSLEFSKLLVEQADVAVAPGVGFGEHGDDYVRIALVENEHRIRQAARNIKRFFSAKDENLQNVIPLEGHR

SEQ ID NO: 55850 - protein, 370 aa, Scherffelia dubia
MFGKAVTARPACAPCAPAPSPCAPGKFDEELIKTAKHIASPGKGILAMDESNATCGKRLDSIGVGNTEENRRTYRELLLTAPGLGNYISGAILFEETLYQKASNGKSFVDVMRSTGIAPGIKVDKGLVPCGTATTSWCTGLDGLAGAAEYYKQGARFAKWRSTVAVGAGPSIIHARHAYGLARYAAICQDNGLVPIVKPEILLDGDHTIDETLDVAKATWAETFKYMADNKVMFEGILLKPSMVTPGAECKVRADPQTVASYTLGLSQPRAPPVPGIMFLSGGQSELEASLNLNAMNQSPNPWHVSFSYARALQNTVLKTWKGEPGNVKAAQEALIVRAAANSAAQMGKYDPAKEAESAKAGMFEKGYVY

SEQ ID NO: 55851 - protein, 456 aa, Desulfitobacterium hafniense Y51
MGAVVDVEFASEALPEIYSAVKVTVPEQKIDLTLEVAQHLGNNTVRCVAMSSTDGLQRGMAALNTGAPITVPVGPATLGRIFNVLGKAIDNGEEVHTDTSYPIHRPAPAFVDQDPSTVMLETGIKVIDLLAPYSKGGKIGLFGGAGVGKTVLIQELINNIAMEHGGLSVFAGVGERTREGNDLWNEMRESGVIDKMAMVFGQMNEPPGARLRVGLTGLTMAEYFRDVQNQDVLLFIDNIFRFTQAGSEVSALLGRMPSAVGYQPTLATEMGALQERITSTRNGSITSVQAIYVPADDLTDPAPATAFAHLDATTVLNRAISEKGIYPAVDPLDSNSRILSPQIIGEEHYKVARDVQQILQKYKELQDIIAILGMDELSEDEKLVVSRARRIERFLSQPFHVAEVFTGSPGKYVPIKETIRGFKEIVEGKHDNLPEAAFHMVGTIEEAIEKAKALGA

SEQ ID NO: 55852 - protein, 411 aa, Pseudomonas aeruginosa UCBPP-PA14
MAESRPARRFARIDRLPPYVFNITAELKMAARRRGEDIIDLSMGNPDGPTPPHIVEKLCTVAQREDTHGYSTSRGIPRLRRAISHWYRDRYDVQIDPESEAIVTIGSKEGLAHLMLATLDHGDTILVPNPSYPIHIYGAVIAGAQVRSVPLVPGIDFFNELERAIRESIPKPRMMILGFPSNPTAQCVELDFFERVVALAKQYDVMVVHDLAYADIVYDGWKAPSIMQVPGAKDIAVEFFTLSKSYNMAGWRIGFMVGNPELVSALARIKSYHDYGTFTPLQVAAIAALEGDQQCVRDIARQYQQRRDVLVKGLREAGWMVENPKASMYVWAKIPEPYAHLGSLEFAKKLLQDAKVSVSPGIGFGDYGDDHVRFALIENRDRLRQAVRGIKSMFRADGLLSPQRKVDSLAE

SEQ ID NO: 55853 - protein, 275 aa, Brucella suis 1330
MVTYIEATSAPVKYTGQIRLYGPEAFEAMRKVCNLTARCLDALNDIVKPGVTTNEIDRFVFEFGMDHDAFPATLNYRGYTKSTCTSINHVVCHGIPNDKPLREGDIVNIDVTYLLDGWHGDSSRMYAVGEIKRASERLLEVTYESLLRGIAAVKPGAKTGAIGAAIQTYAESERCSVVRDFCGHGVGRLFHDAPNILHYGTPNEGVEIKEGMIFTIEPMINLGKPHVKVLADGWTAVTRDRSLTAQYEHTVGVTRDGCEIFTLSPANIFGPPSMR

SEQ ID NO: 55854 - protein, 197 aa, Cenchrus ciliaris
MKVKSAVLLCVVLASLLLATQDATYARELTEANGPEGSVKLAGGPGFKDVKWLLGGHKHGGGYGNEGGYGGGYGNNGGYGGGNDPPSYGGGSGPGYGGPGYGTGGRYGGPGFGRSYKHHVHGGGGYGPGYGGGYGPGYGGGNSCPPCGSGNAGPGYGGGYGGGNGGGYGSGSGSGSGNGGGGGGGYGGGYGSSGISP

SEQ ID NO: 55855 - protein, 643 aa, Mycobacterium bovis AF2122/97
MSVWLRAGALVAAVMLSLSGCGGFHAGAPSTAGPCEIVPNGTPAPKTPPATVPSSRNLATNPEIATGYRRDMTVVRTAHYAAATANPLATQVACRVLRDGGTAADAVVAAQAVLGLVEPQSSGIGGGGYLVYFDARTGSVQAYDGREVAPAAATENYLRWVSDVDRSAPRPNARASGRSIGVPGILRMLEMVHNEHGRTPWRDLFGPAVTLADGGFDISARMGAAISDAAPQLRDDPEARKYFLNPDGSPKPAGTRLTNPAYSKTLSAIASAGANAFYSGDIAHDIVAAASDTSNGRTPGLLTIEDLAGYLAKRRQPLCTTYRGREICGMPSSGGVAVAATLGILEHFPMSDYAPSKVDLNGGRPTVMGVHLIAEAERLAYADRDQYIADVDFVQLPGGSLTTLVDPGYLAARAALISPQHSMGSARPGDFGAPTAVAPPVPEHGTSHLSVVDSYGNAATLTTTVESSFGSYHLVDGFILNNQLSDFSAEPHATDGSPVANRVEPGKRPRSSMAPTLVFDHSSAGRGALYAVLGSPGGSMIIQFVVKTLVAMLDWGLNPQQAVSLVDFGAANSPHTNLGGENPEINTSDDGDHDPLVQGLRALGHRVNLAEQSSGLSAITRSEAGWAGGADPRREGAVMGDDA

SEQ ID NO: 55856 - protein, 392 aa, Bacteroides fragilis YCH46
MHKVYLKPGKEDSLKRFHPWIFSGAIAHFDGEPEEGEVVEVYTSKKEFIAKGHFQIGSIAVRVLSFKQEEINHDFWKHKLEVAYDMRRSIGIATNPTNNTYRLVHGEGDNLPGLVIDVYARTAVMQAHSAGMHVDRMAIAEALSEVMGDQIENIYYKSETTLPFKADLFPENGFLKGGSSDNIAQEYGLKFHVDWLKGQKTGFFVDQRENRALLERYAKGRSVLNMFCYTGGFSFYAMRGGAKQVHSVDSSAKAIDLTNKNVELNFPGDTRHAAFAEDAFKYLDRMGDQYDLIILDPPAFAKHKDALRNALQGYRKLNAKAFEKIKPGGILFTFSCSQVVTKDNFRTAVFTAAAMSGRSVRILHQLTQPADHPVNIYHPEGEYLKGLVLYVE

SEQ ID NO: 55857 - protein, 268 aa, Pseudoalteromonas tunicata D2
MKIKINIVDAFTHTRFKGNSAAVIITDTWLTDDQMQQIATENNLSETAYLIPQGLQEFAIRWFSPLTEIDFCGHASLASAYVLFQSHPDFEHLIFHTEKLGSFKVQQCDNGFIEMDFPNCCPQPISDIPAALLVGLSIKPQQVLKSEQAYFAVYANASDVETVQYDSSQLKCLAPFDVVVTAQATQLSPYDFISRYFWPANGGDEDPVTGSIHAGLAPFWAEKLNKTELFAYQASKRGGELHCKIQNDRVLVSGQAVQYLEGVLTLTD

SEQ ID NO: 55858 - protein, 390 aa, Pseudomonas aeruginosa UCBPP-PA14
MATSYSARSRAIEPFHVMALLARANELQAAGHDVIHLEIGEPDFTTAEPIVEAGRAALAAGHTRYTAARGLPALREAIAKFYGERYGVDLDPQRVLVTPGGSGALLLASSLLVDPGRHWLLADPGYPCNRHFLRLVEGAAQLVPVGPDSRYQLTPDLIERHWDSDSVGALVATPANPTGTLLDRDELAGLSGALKARGGHLVVDEIYHGLTYGVDAASVLEVDDDAFVLNSFSKYFGMTGWRLGWLVAPAAAVPELEKLAQNLYISAPSMAQQAALACFEPTTIAILEERREEFARRRDFLLPALRELGFGIAVEPEGAFYLYADISAFGGDAYAFCKHFIETEHVAFTPGLDFGRHQAGHHVRFAYTQNLSRLQEAVERIARGLKNWRP

SEQ ID NO: 55859 - protein, 432 aa, Prochlorococcus marinus str. MIT 9313
MASSDDAKLRPLPNTAALSGVLEAFAFFRDPAFAQKRFERHGNVFETSLLGQPMVFIQGGQAIRDLLAQPNAVEGWWPESVRQLLGSHSLANRNGASHRARRRVIGQLFSASALQRYSAGIISMVQDLADELQAAKTALPLAERMRRFAFSVIATTVLGLEGTDRDELFVDFEIWTRALFSIPIALPGSSFAKALKARERLLRRLQKVLLKASNGNGGLDLLAGGLDEAGIPLTDEDMVEQLLLLLFAGYETTASSLSCLMRELLLNPQVETWLREEINGVDWPPAPEQATTAYDQVNAPKLDAVVSEVMRLTPAVGGFFRRTKCALVIDGVEVPKNRVVQVALAASNRHGAGDLEAFRPQRHLEDGCSATLLPFGGGERVCLGKPLAELEIRLMVVGLFHQLRLHLIPDQDLTLQMLPSPTPRDGLLTKVL

SEQ ID NO: 55860 - protein, 551 aa, Thiobacillus denitrificans ATCC 25259
MIAVLESWRAGLFHRRHFTRNLGAGLVVGVVALPLAMAFAIASGARPEQGIYTGIVAGLLAALFGSSHVSISGPTGAFIVILAGITAEYGFEGLQLATLMAGLILLAMGLVKLGGIIRFIPTPVITGFTAGIAVIIWVGQWKDFFGLQPAASGAHFHEKLGALLAALPELHLPTTLLAVGALAIVVLLPRFLRRIPSPLVAMLAVTAAQAYWQFDGVATIGSAFGGIPSGLPAIHLPQASFARVLELIGPAFTIAMLGAIESLLCAVVADGMTGSRHNPNQELVGQGIANIAAPIFGGFAATGAIARTATNIRNGGDSPLAGIVHALFLLAVIVSLAPLAAHIPLAALAAILFVVAWNMSEARHFSDLLRHAPINDKALLLITFLLTVFADLVIAVNVGVLLAALLFMKRMSETVRIEGETPDSLAALCPVAVPSGVQIYTIDGPLFFGAAATFERTLAGLHDQAEAVIFRLGRVPFADATAMHALDDVVRHFRQRHIEVRVCEANPRVAHKLREFGLLARIGQQDASISVLDALAELAPQPGTQVQAEAS

SEQ ID NO: 55861 - protein, 320 aa, Nostoc punctiforme PCC 73102
MRIARNITELVGRTPLVQLNRIPQTEGCVAEIVVKLESLNPSASVKDRIGVSMINAAEEEALITPEKTILVEPTSGNTGIALAMTAAAKGYRLILTMPETMSGERRAMLRAYGAELELTPGMEGMSGAIRRAQQIVNSTPNTYMLQQFRNPANAKVHRETTALEIWEDTDGQVDIVVAGVGTGGTITGVAEVIKARKPSSKAIAVEPANSPVLSGGQPGPHKIQGIGAGFIPQVLKLKLIDEVITITDEEAITYSRRLAKEEGLLSGISSGAALCAAIRVAQREENKERLIVMIQPSFGERYLSTPLFQDLEARLPASVG

SEQ ID NO: 55862 - protein, 606 aa, Solanum lycopersicum
MEVLRFTAVKSLNSCVRPEFTAMSSVIVPISTVKVSGTRKSKKKALICAKATEILSSPATVTEPLKAEPAEAPVPLLRVSPSSLQCEPGYLLPNSPVLGTGGVTGYEYLTNILSSKVYDVAYETPLQKAPKLSERLGVNVWLKREDLQPVFSFKIRGAYNMMAKLPKEQLEKGVICSSAGNHAQGVALSAQRLGCDAVIVMPVTTPDIKWKSVKRLGATVVLVGDSYDEAQAYAKKRAESEGRTFIPPFDHPDVIVGQGTVGMEINRQLKDNIHAIFVPVGGGGLIAGIAAYLKRVAPDIKIIGVEPLDANALALSLHHGQRVMLDQVGGFADGVAVKVVGEETYRLCEELIDGVVLVGRDAICASIKDMFEEKRSILEPAGALALAGAEAYCKYYGLKGENVVAITSGANMNFDRLRLVTELADVGRQREAVLATFMPEDPGSFKKFAEMVGPMNITEFKYRYNSDKERALVLYSVGLHTILELEGMVERMESADLQTINLTDNDLVKDHLRHLMGGRTNVHNELLCRFTFPEKPGALMKFLDAFSPRWNISLFHYRAQGDTGANVLVGIQVPPDEVVEFEGRADSLGYEYAMESLNEAYQLIMH

SEQ ID NO: 55863 - protein, 97 aa, Brugmansia arborea
ATYKVKLVTPDGPVEFDCPDDVYILDQAEEEGHELPYSCRAGSCSSCAGKVTAGTVDQSDGNFLDDDQMADGFVLTCVAYPQSDVTIETHKEEELTG

SEQ ID NO: 55864 - protein, 170 aa, Helicobacter pylori
GSGMHTHVSIWKNNENLFSGETYKGLSELALHFLGGVLHHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKEGQ

SEQ ID NO: 55865 - protein, 488 aa, Prochlorococcus marinus str. NATL1A
MAASATATVGTKGIVRQVIGPVLDVEFPAGKLPSILNALRIEGKNPAGQDVALTAEVQQLLGDHRVRAVAMSGTDGLVRGMEALDTGAPISVPVGEATLGRIFNVLGEPVDEQGDLKNVTTSPIHRSAPSLTDLETKPKVFETGIKVIDLLAPYRQGGKVGLFGGAGVGKTVLIQELINNIAKEHGGVSVFGGVGERTREGNDLYEEFKESGVINSEDLTKSKVALCFGQMNEPPGARMRVGLSALTMAEHFRDVNKQDVLLFIDNIFRFVQAGSEVSALLGRMPSAVGYQPTLGTDVGELQERITSTLEGSITSIQAVYVPADDLTDPAPATTFAHLDATTVLARALAAKGIYPAVDPLDSTSTMLQPSVVGDEHYRTARAVQSTLQRYKELQDIIAILGLDELSEEDRKTVDRARKIEKFLSQPFFVAEIFTGMSGKYVKLEDTIKGFNMILSGELDQLPEQAFYLVGSIDEVKAKAEKLASEAKA

SEQ ID NO: 55866 - protein, 827 aa, Aspergillus nidulans FGSC A4
MCCWGGSRSGTLNLCVNSRRVYVADASGAEKKEELDTSTAILKKKKKPNSLIVTDAVNDDNSTISLSNNTMDTLGLFRGDTVTVRGKKRKETVLIVLADDDLDDGSARINRVVRHNLRVKHGDIITVHPCPDIKYAKRIAVLPIADTVEGLTGSLFDVYLAPYFRDGYRPVKQGDLFTVRGGMRQVEFKVVEVDPPEFGIVAPDTIIHSEGEPIQREDEENNLNEVGYDDIGGCRKQMAQIRELVELPLRHPQLFKSIGIKPPRGILMYGPPGTGKTLMARAVANETGAFFFLINGPEIMSKMAGESESNLRKAFEEAEKNSPAIIFIDEIDSIAPKREKTNGEVERRVVSQLLTLMDGMKARSNVVVMAATNRPNSIDPALRRFGRFDREVDIGIPDPTGRLEILSIHTKNMKLGEDVDLETIAAETHGYVGSDLASLCSEAAMQQIREKMDLIDLDEDTIDAEVLDSLGVTMENFRYALGVSNPSALREVAVVEVPNVRWEDIGGLEEVKRELIESVQYPVDHPEKFQKFGLSPSRGVLFYGPPGTGKTMLAKAVANECAANFISVKGPELLSMWFGESESNIRDIFDKARAAAPCVVFLDELDSIAKSRGGSVGDAGGASDRVVNQLLTEMDGMTSKKNVFVIGATNRPEQLDAALVRPGRLDTLVYVPLPDQASREGILKAQLRKTPVASDVDIEFIASKTHGFSGADLGFVTQRAVKLAIKESISAEIERQKQREAAGEDVKMEDEEEGEDPVPELTRAHFEEAMKTARRSVSDVEIRRYEAFAQSLKNSGGSSFFRFPSANEAADSGNTFGEAGNDDSLYD

SEQ ID NO: 55867 - protein, 97 aa, Hordeum vulgare
ATYKVKLVTPEGEVELEVPDDVYILDQAEEEGIDLPYSCRAGSCSSCAGKLVSGEIDQSDQSFLDDDQMEEGWVLTCAAYPKSDVVIETHKEEELTA

SEQ ID NO: 55868 - protein, 97 aa, Lycium chinense
ATYKVKLVTPDGPVEFDCPDDVYILDQAEEEGHELPYSCRAGSCSSCAGKVSAGTVDQSDGNFLDDDQIADGFVLTCVAYPQSDVTIETHKEEALTG

SEQ ID NO: 55869 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKEGH

SEQ ID NO: 55870 - protein, 498 aa, delta proteobacterium MLMS-1
ADYRCRGGGVELIYFGQRVNGQVLEALGELAAQAGVLEQYDLMRQGAVLNQIAGYASENRQVLHCSNRDIFAESPRQPEATARTANELAKLREFLEDLEAGRLANPAGKPFEAMLQVGIGGSDLGPRALYLALRAYAKPGRQVRFISNVDPDDAAAVLQELDLSRTLVKVVSKSGTTLETLANEELVRRAYQDAGLDPKDFFIAVTGQGSPMDNPEHYLRSFYMFDYIGGRYSATSMVGLVMLGFALGYEQVLEILRGAYEMDEAATQPDPTRNPPLLLALLGIWNRNFLGSQDVAILPYSQALSRFAAHLQQLDMESNGKGVSRAGEPLGWDSGPVVWGEPGTNGQHAFYQLLHQGTAVVPIEFIGFKESQYRRDLTVKGTTAQEKLLANLLAQSLALAVGQEEENPNRRFPGNRPSSILLADRLTPATMGALLALYEAKVVFQGFLWNINSFDQEGVQLGKRLADGLLAQYEARRRGTTPPEDPLGRALLALAASE

SEQ ID NO: 55871 - protein, 320 aa, Candida glabrata CBS 138
MPGVQNTEGVIEEQRAALESCRHFLRGKSSYDILPVSYRMIVLESGLPVKRALNVLIQNKVLSAPIWDSKRSRFAGILTLMDFIGLVQYFFSNPDQFDTMDKLRLKDLKEIEYSIGMHAPLENCTIHPERSLFEACELMLQSQTRKIALLDKEDFTERELVVGMLTQYRILKFLVLNYKDVHFMHRSINSLQLGTRKNIKSCKMETPLIDTIQLMTTHEVSSVPILDENGVLLNAYEASDILGLVKGGIYNDLSLCVGEALMRRGDDYEGIYTCTGEDKLATIFDIIRKSRVHTFYLVDENGRLIGILTLGDLLRYIIEG

SEQ ID NO: 55872 - protein, 625 aa, Lotus japonicus
MSGPLDFFARPCFEGFSGSDEKRERRSDFENSEDERRTRIGSLKKKALSASTKFKHSLRKKSSRRKSDGRVSSVSIEDVRDVEELQAVDAFRQSLIMDELLPQAFDDYHMMLRFLKARKFDIEKAKHMWAEMLQWRKEFGADTIMQDFEFQELDEVVRYYPHGHHGVDKEGRPVYIERLGKVDPNKLMQVTTMDRYVRYHVQEFEKSFAIKFPACTIAAKRHIDSSTTILDVQGVGLKNFTKSARELITRLQKVDGDNYPETLCQMFIINAGPGFRLLWNTVKSFLDPKTTSKIHVLGNKYHSKLLEVIDASELPEFLGGACTCEDQGGCLRSDKGPWKNPEILKMVLNGEPRRARQVVKVLNSEGKVIAYAKPRYPTVKGSDTSTAESGSEAEDIASPKAMKNYSHLRLTPVREEAKIVGKSSYTNNFSGYDEYVPMVDKPVDAVLKKQASLQRSYTSQGAPSRPATQRTPEGIQARILVAITAFLLTIFTIFRQVACRVTKKLPAISSNHDQSTSEPTFDTTVVEVIPSSSTPAHTEENLLPSMLKRLGELEEKVDTLQSKPSEMPYEKEELLNAAVCRVDALEAELIATKKALYEALMRQEELLAYIDRQAEAKLRKKRFCW

SEQ ID NO: 55873 - protein, 84 aa, Triticum aestivum
NHCLQTLNRLFGYSQLMDQFGNVWHHSRVRKYLTADDWSPIEAKGRPWYGLLGLLRKYPEHFVINTKSKGRAISEFVSLVSLLS

SEQ ID NO: 55874 - protein, 629 aa, Deinococcus radiodurans R1
MNELPGTSDTPLLDQIHGPKDLKRLSREQLPALTEELRGEIVRVCSRGGLHLASSLGAVDIITALHYVLDSPRDRILFDVGHQAYAHKILTGRRDQMADIKKEGGISGFTKVSESEHDAITVGHASTSLANALGMALARDAQGKDFHVAAVIGDGSLTGGMALAALNTIGDMGRKMLIVLNDNEMSISENVGAMNKFMRGLQVQKWFQEGEGAGKKAVEAVSKPLADFMSRAKNSTRHFFDPASVNPFAAMGVRYVGPVDGHNVQELVWLLERLVDLDGPTILHIVTTKGKGLSYAEADPIYWHGPAKFDPATGEYVPSSAYSWSAAFGEAVTEWAKTDPRTFVVTPAMREGSGLVEFSRVHPHRYLDVGIAEEVAVTTAAGMALQGMRPVVAIYSTFLQRAYDQVLHDVAIEHLNVTFCIDRAGIVGADGATHNGVFDLSFLRSIPGVRIGLPKDAAELRGMLKYAQTHDGPFAIRYPRGNTAQVPAGTWPDLKWGEWERLKGGDDVVILAGGKALDYALKAAEDLPGVGVVNARFVKPLDEEMLREVGGRARALITVEDNTVVGGFGGAVLEALNSMNLHPTVRVLGIPDEFQEHATAESVHARAGIDAPAIRTVLAELGVDVPIEV

SEQ ID NO: 55875 - protein, 319 aa, Blastopirellula marina DSM 3645
MNIRTVGVVGLGLMGRGICTSLLANNFQVVAYDINPESFAAARAHVASALEELARHPSVAEAIPENWPSHFQLTADLSPLGDCDFVIESIPEDPVIKQETIAALERLLPNSTPIASNTSALPISLLQAHCQLPQRIIGMHWAEPCHLTRFLEIIRGEHTDDATADSAANLGRQLGKDPTIVQRDVPGFIVNRLAYAMYREAFWLLENNVADVDTIDRAFVNAISVWANVAGPFRWMDLSGLPAYAQAMGRLFPELSQATETPACFQSMIDDGARGAANGRGFYSYTAEEAEAWRAKLVKNVHATRQRSPLPQPTVKDLS

SEQ ID NO: 55876 - protein, 144 aa, Brassica napus
  misc_feature (134)..(134): Xaa can be any naturally occurring amino acid
  misc_feature (140)..(140): Xaa can be any naturally occurring amino acid
MRKRERENPCSLCGHYHKYEEGEVCGICGHRKPDSSDVAAPRVQLSAFPTEILPEFLYLGSYDNASRSEVLKTQGISRVLNTVPMCQNLYRNSFTYHCLSDEKVLQFDDAIQFLDQCEKDKARVLVHCMSGKSXSPAVVXAYLM

SEQ ID NO: 55877 - protein, 197 aa, Oryza sativa Japonica Group
MARDVVEAAAAADGRHHHKAVVAADGGGGGGAGTAALVWDCGSALYDSYELTSFRRQLDAAVLSCGGRSLSMPHLLSSSSTQQQQMPAGRRRRRRRRLPAMLRRLFGKVLLRLRFPVASRAARGGWYDYGAHGDGRPGSPWSGALTSIPEESASPENGPSSSPLVDDDGPSALRKAQSERFVGSKTASSMVQFDVVL

SEQ ID NO: 55878 - protein, 525 aa, Debaryomyces hansenii
GGLLFGYDTGVISGIVTMESFAAKFPRIYMDPDYKGWFVSTFLLCAWFGSLINSPIVDKFGRRDTIRIACVVFVIGSVFQCAGISVSMLFAGRAVAGIGVGQLTMVVPMYMSELAPPSVRGGLVVIQQLSITIGILISFWINYGTQFIGGTKCAPGRNYQGDVFDPYVDVPKQGCNGQQDASWRIPFGLQIAPAFLLGIGMTFFPRSPRWLLSKNREEEAWKSLHYLRRRNNPDMIEAEFNEIRSDVIFEKKYNEKRFPGKEGISLYVSSYWDLFSTKSNFKRVFIGSAVMFFQQFIGCNAIIYYAPTIFSQLGMDSNTTALLGTGVYGIVNCISTIPAIFAIDKFGRKTLLMAGAAGTFVSLVIVGAIVGKYGEKLSKHKVAGRAAIAFIFIYDFNFSYSWAPIGWVLPSEIFSIGMRSKAISITTSSTWMNNFIIGLITPRMLNTMKWGTYIFFAAFAIIAFVFTWYMIPETKGVPLEEMDFVFGDLDALEEKQRFSDTNAISKIHINTGTKVDSFKASTDFL

SEQ ID NO: 55879 - protein, 529 aa, Metroxylon sagu
MAATGISRIPLLKTLIPSTSPSPSSDRGSNDLPLCLKPSLNWRLSSSFHFSGEALFSKAVLGSGKTAAGGRTPVLVSPKAVSDSKSSQTCLDPDASRSVLGIILGGGAGTRLYPLTKKRAKPAVPLGANYRLIDIPVSNCLNSNISKIYVLTQFNSASLNRHLSRAYGSNMGGYKNEGFVEVLAAQQSPENPNWFQGTADAVRQYLWLFEEHNVMEFLVLAGDHLYRMDYERFIQAHRETDADITVAALPVDERRATAFGLMKIDEEGRIIEFSEKPKGEQLKAMKVDTTILGLDEERAKEMPYIASMGIYVISKDIMLQLLRDKFPGANDFGSEVIPGATNIGMRVQAYLYDGYWEDIGTIEAFYNANLGITKKPVPDFSFYDRSSPIYTQPRYLPPSKMLDADVTDSVIGEGCVIKNCKIHHSVVGLRSCISEGAIIEDSLLMGADYYETDQEKRFLAAKGSIPIGIGKNSHIKRAIIDKNARIGENVQIVNNDNVQEAARETDGYFIKSGIVTVIKDALIPSGTLI

SEQ ID NO: 55880 - protein, 127 aa, Triticum aestivum
  misc_feature (31)..(31): Xaa can be any naturally occurring amino acid
  misc_feature (73)..(73): Xaa can be any naturally occurring amino acid
  misc_feature (84)..(84): Xaa can be any naturally occurring amino acid
  misc_feature (87)..(87): Xaa can be any naturally occurring amino acid
  misc_feature (89)..(89): Xaa can be any naturally occurring amino acid
MATSLSVSRLISSSAISVAKPLLSPTSAFTXPISFSRSLAPNLSLKSHTRRASISAVRSFSTTTISASISVGXKLPDSTLSYLXPAXNXVKTVTVSSLTAGKKTILFAVPGAFTPTCSQKHVPGFVS

SEQ ID NO: 55881 - protein, 362 aa, Nostoc punctiforme PCC 73102
MTQNYRITLLPGDGIGPEIMAVAVDVLKVVGKQFDLKFEFQEALIGGAAIDATGEPLPSATLETCRNSDAVLLAAIGGYKWDSLPSNLRPEAGLLGLRAGLGLFANLRPAKILPQLIDASTLKREVVEGVDIMVVRELTGGIYFGKPKGIFATETGEKRGVNTMVYTESEIERIGRVAFEAARKRGGKLCSVDKANVLEVSQLWRDRITQLSQEYPDIELSHLYVDNAAMQLVRAPKQFDTIVTGNLFGDILSDAAAMLTGSIGMLPSASLGASGPGVFEPVHGSAPDIAGQDKANPLAQVLSAAMMLRYALDQPKAADRIEQAVFQVLEQGDRTGDIISPGKNLLGCRAMGDSLIKALEQK

SEQ ID NO: 55882 - protein, 223 aa, Erythrobacter sp. NAP1
MDHLGIEQRGDVTLVTLDNPPFNTVHAEIMREASRRFCEMAASSDVQAVVLTGAGSDYSRGMDRKVAENFTDETREETREAINHMMADMHRLPCPLVSAVNGHSIGAGGIMMLCSDWVVAAEGGYKIGLPEAKAGLPFPAVPQAIIDHWLDPVWRRRLALTSQLFGPEQAAATGLVDEIVSPETLIDIAVQRASELASQPAFRDCKRQLRAKANAEIDAILAK

SEQ ID NO: 55883 - protein, 466 aa, Agaricus bisporus
MSPAAIASSPTHRRFVKQDTVKAKATATAPQLAETTISSDQVVALEERYGAHNYHPLPVVFDSASGAKVYDPEGNEYIDMLSAYSAVNQGHCHPRIVATLVQQAQKLTLSSRAFYNSVFGRFAQKITTMFGYDMVLPMNTGAEAVETCVKLARKWAYMKKGVPEGKAIVFSVSGNFHGRTLGIISMSTDPESRTGFGPYLQNVGPVYEDGGMMKTIRYGVLEDLERALELYGEHTAAFLIEPIQGEAGIVVPEPGYLAQVHQLCKKHNVLLICDEIQTGLCRTGKMLACEYEGIRPDVVLLGKALSGGLYPVSAVLADSDVMLCIRPGEHGSTYGGNPLGCAVAMTALDVLVDEKLADRAMRLGEYFRSAVQSLNSPLVECVRGRGLLNAVVIDEKKSTKGRTAWQLCLLLKSRGVLAKPTHVNIIRFAPPLVIEEEDLKRAVRIIGECLADLDTVERIPGDDAQH

SEQ ID NO: 55884 - protein, 97 aa, Physalis alkekengi var. franchetii
ATYKVKLITPDGPVVFDCPDNEYILDAAEEQGHDLPYSCRAGSCSSCAGKVTAGTVDQSDGNFLDDDQVADGFVLTCVAYPQSDVTIETHKEEELTA

SEQ ID NO: 55885 - protein, 97 aa, Scopolia japonica
ATYKVKLVTPDGPVEFDCPDDVYILDQAEEEGHELPYSCRAGSCSSCAGKVSAGTVDQSDGNFLDDDQMADGFVLTCVAYPQSDVIIETHKEEELTG

SEQ ID NO: 55886 - protein, 97 aa, Nicotiana tabacum
ASYKVKLITPEGAVEFDCPDDVYILDQAEEMGHDLPYSCRAGSCSSCAGKVTAGNVDQSDGNFLDDDQMADGFVLTCVAYPQSDVTIETHKEEELTA

SEQ ID NO: 55887 - protein, 97 aa, Capsicum annuum var. annuum
ASYKVKLITPDGPIEFDCPDDVYILDQAEEAGHDLPYSCRAGSCSSCAGKIAGGAVDQTDGNFLDDDQLEEGWVLTCVAYPQSDVTIETHKEAELVG

SEQ ID NO: 55888 - protein, 377 aa, Yarrowia lipolytica CLIB122
MRQGLYALGSNGHGQLGNGHMDDTAEVHTVVGPQGLITERPIALEFGGTHSILLMQSDPEAYYVTGSNDMGQFGDTQTRRCQEFIRMATPGHTWKRAAAGWTFSLLVDEQDHVYSCGHSNFGGLGRGQATPTSRKLGRIEGLPDKSISAMSCCLEHVVVLYDDGEVWGWGGARKGQLGLLNGPVRCLWIPRKLDLGACAPSTPTDVHCGREFTVVSSRNTGHFAVLGTDKHGIHTLSCERDTYDQLHAKHLSMGYLSVGTTWTSIHFLLPNARILSLGSNRNCQHAPREFNCESAPEKGDRKILQMVPGSEHVVVEVEACSTKQILAWGWAEHGNCGIVDHTTENMSIEEPNEILECDPGTRLTLYAGTASTWLHSC

SEQ ID NO: 55889 - protein, 97 aa, Solanum nigrum
ATYKVKLVTPDGPIEFDCPDDVYILDQAEEEGHELPYSCRAGSCSSCAGKVTAGTVDQSDGNFLDDDQMADGFVLTCVAYPKSDVTIETHKEEDLTG

SEQ ID NO: 55890 - protein, 83 aa, Glycine max
  misc_feature (57)..(57): Xaa can be any naturally occurring amino acid
  misc_feature (73)..(73): Xaa can be any naturally occurring amino acid
LLMWAPVSGISMALCLSTAGGDWDNAKKYTENGAIVDKQSEARKAARTVDTVADPFXYAAGLTIVVSIKIPAXITLVMAAVFI

SEQ ID NO: 55891 - protein, 402 aa, Arabidopsis thaliana
  misc_feature (128)..(128): Xaa can be any naturally occurring amino acid
MRGRSLTLSRVKLELARRSMSATSVPSMADFLTKKPYSPPSWASHLRPLPSHTFSLAHLPTPIHRWNLPGLPNGTELWIKRDDFTGMELSGNKVRKLEFLMAEAVDQHADTVITIGGIQSNHCRATAXTASNYLNLNSHLILRTSKLLADEDPGLVGNLLVERLVGANVHLISKEEYSSIGSEALTNALKEKLEKEGKKPYVIPVGGSNSLGTWGYIEAAREIEEQLNYRPDDLKFDDIVVACGSGGTIAGISLGSWLGALKAKVHAFSVCDDPDYFYDFVQGLLDGLHAGVNSRDIVNIHNAKGKGYAMNTSEELEFVKKVASSTGVILDPVYSGKAAYGLINEITKDPKCWEGRKILFIHTGGLLGLYDKVDQMASLMGNWSRMDVSESVPRKDGVGKMF

SEQ ID NO: 55892 - protein, 705 aa, Actinobacillus pleuropneumoniae serovar 1 str. 4074
MTEQPIQQPMFQVEVDENQIAIIRIHSIDNDENWLPENFAGELREVIGTLIYRQVQGAIFISTRANHFIQGLKPSLFKNKTNEQLLAFSQDAQAIMRELNTLKMPIVAAIDGNCFSVGLELSLACDYRIASDESHTFFAMPQVRSGLLPFAGGTQRLPRLIGLRSALPLMLFGEKITAETAKGLGLVDRLVPKTRLLTDAYQLLLEKKIQKANHKKPLTFFKKWRKQIEGNSFLREKLLDRTENAIWLKTFGNYPAVAKLMELLKEPHFKQGLMLEQQAFVELFNSATSQVLIELKKTERAMKDKYRIRGNVRDVAQVSILGSGYMGAGIAYLTANNAKVPVRIKDIHPSEIRKALRTCFELMQKSTDKNQLNHGEMIQRMNLITGGERLVAAKSTDFVIEAVYEDLKLKQRMLAESESYYSEQTIFATNTSTFAIKDIAACAIRPENVIGLHYFSPVTTQKMVEIIPHSATGEHTIATAIHFAIQQGKIPLLVADKQGFFINRVLTPLLLEAVQCLIDGESIEFIDRSLQEFGFKLGPLAMIDEMGLDVLVKSNSALVSELGSRFSLPQAVDLLFRNERKGCKNKRGFYMYDRFGERLQEDKSIYHVMETIARNDLESEQIVRRCLLRMLNEAAWCLQDKIIASTDEGNVASVLAMGFPEFRGGIYVYIEKIGAKEIVRQLHLHTKQYGKRFEPCEWLIRQAEQ

SEQ ID NO: 55893 - protein, 474 aa, Haemophilus ducreyi 35000HP
MSKEIKTQVVVLGAGPAGYSAAFRCADLGLETVIVERYSTLGGVCLNVGCIPSKALLHVAKVIEEAKHADKNGITFGEPIIDLDKVRKGKEAVVSKLTGGLAGMAKARKVTVVEGLAAFTDSHTLVARDRDGNPTTIKFDNAIIAGGSRPIELPFIPHEDPRIWNSTDALKLKEIPKKLLIMGGGIIGLEMGTVYQSLGSEIEVVEMFDQVIPAADKDVVSIYSKQVEKKFKLMLETKVTAVKAEDDGIYVSMEGKACNDTKRYDAVLVAIGRVPNGKLIDVGKAGVEVDERGFIHTDKQMRTNVPHIFAIGDVVGQPMLAHKGVHEGHVAAEVIAGKKRYFDPKVIPSIAYTEPEVAWVGKTEKECKQEGLNYEVAKFPWAASGRAIASECSEGMTKLIFDKDTHRLLGGAIVGSNGGELLGEIGLAIEMGCDAEDIALTIHAHPTLHESVGLAAEVFEGSITDLPNAKAKKR

SEQ ID NO: 55894 - protein, 523 aa, Haemophilus ducreyi 35000HP
MSKQINVPDIGGDEVTVTEVMVNVGDTITIDQSIINVEGDKASMEVPAPEAGVVKQVLVKVGDKVTTGSAMLVLETADAVPQASAPVAASVASAIVEVNVPDIGGDEVNVTEIMVKVGDAVEVDQSIINVEGDKASMEVPAPFAGVVKEILVRSGDKVSTGSLIMKFEVAGAAPAPASATVAPTAVVAPTTNHTQSAKEQGQSSLSQAQVEASSVFAHATPVIRRLAREFGVNLDKVKGSGRKGRIIKEDLQAYVKTAVQVFEQQGGTTVSASGAGLGLLPWPKVDFSKFGEVEEVELSRINKISGANLHRNWVMIPHVTHFDRTDITALEEFRKEQNKLAEKQKLDVKITPVVFIMKAVAKALEAFPRFNSSLSEDAQRLTLKKYINIGVAVDTPNGLVVPVFKNVNKKGIIELSRELMEVSKKARDGKLTASDMQGGCFTISSLGGIGTTHFTPIVNAPEVAILGVSKSETLPVWNGKEFTPRLMLPLSLSFDHRVIDGADGARFLSYINGVLADIRRLVM

SEQ ID NO: 55895 - protein, 347 aa, Coccidioides immitis RS
MLSERGVRVALILKEPWKFPPSESSLYDKEKNPNGIISLATAENFLVHDTLEEYINRNISIPKAAFTYAYGSPYCAALTVPISRHINTHFKPCTPISSSHIVIANGVTAVNDLLGYVLADPNDAIMINRPIYGKFGLDFGCRGDVGVVYADTEPLEVFSVDVVKKYEEAIVKAEKGGVKVRAMLITNPHNPLGRCYPPETLRELMRFCHRRKIHFISDEIYALSVFDSGETGTIPFTSALAIDPTGLLDENYIHVMYGMAKDFSAPGLKLGFLISKNADVRKGVACASNAGYFVWIDLSAFIPPTTEQKPMSKTDREIALAERFVEAVSGMVVECELELKLKINMVQ

SEQ ID NO: 55896 - protein, 385 aa, Haemophilus influenzae Rd KW20
MALELSDIRQQITQIDRSLLKLLSERHRLAFDVVRSKEISQKSLRDVEREQQLLQELVQFAENENYQLEAQYITSIFQKIIEDSVLTQQVYLQNKLNEQRNQNLHIAFLGKRGSYSNLAARNYAARYQKQFVELGCQSFEQVFEKVQTGEADFGVLPLENTTSGAINEVYDLLQHTDLSLVGELAYPIKHCVLVNDKTDLNQIDTLYSHPQVIQQCSQFIHSLDRVHIEYCESSSHAMQLVASLNKPNIAALGNEDGGKLYGLSVLKTNIANQENNITRFIVVAKEPREVSSQIPTKTLLLMTTSQQAGALVDALLVFKKHQINMTKLESRPIYGKPWEEMFYLEIEANIHHPDTKQALEELKNYSNYLKILGCYPSEIVKPVSV

SEQ ID NO: 55897 - protein, 492 aa, Coprinopsis cinerea okayama7#130
MTTSAAPSNGPHHQNVVPSEVGWQFVPQYYTFVNKEPHRLHCFYNKTSTFIHGTEGEEVKPCFGQQEIHKKITSIGFQDCKVFIHSVDAQSSANGGIIIQVIGEMSNRNEPWRKFVQTFFLAEQPNGYFVLNDIFRFLKEESVEGDELSETGEAAEAAPAAAPEPAPAAAEPVYEPPREPTPPPAPAPEPVAAAPEPPKEAAEPTPAPVAEPPAAAPTVHLPQSNGVPAAEAEKPAAPAVAEKSREPTPAPQQQQQPAAPSPAPPAAPPAASTSAAPPAPAAQPAPAPPAQPAAPPAPKTWASLAASNPKKWGSVAQEARGITETPASPAPSSGTQTPSGQPQNRGPPRHEHPALLAAQSVTTPHCFIKGVTEPITDAALKNTLSRFGPIKEVDIVRTKACAFLEFQSVDSAKRAIIASLNQNQGGEGGVYIETAEGHVRIFVETKKDRGDRPPATGGRGRGGPPVNADGRGSGFRGGRGGPRGGGRGGPAK

SEQ ID NO: 55898 - protein, 406 aa, Dechloromonas aromatica RCB
MALIVQKYGGTSVGNPERIKNVAKRVAKFQAQGHQVVVVVSAMSGETNKLIALAKEVQANPDPRELDAIMSTGEQVTTGLLSMALMDIGCKAKSYTGGQVKVLTDSTHTKARILSIDEANMRRDLDAGYVIVVAGFQGVDANGNITTLGRGGSDTSGVALAAALKADECQIYTDVDGVYTTDPRVVPEAKKLDTITFEEMLEMASLGSKVLQIRSVEFAGKYKVKLRVLSSFQDEGEGTLITVEEDKNMEQPIISGIAFNRDEAKLTMLGVPDTPGIAYQILGAIADANIDVDMIIQNVGHDGTTDFSFTVNRGEFAKAKEILEGVKAKLGAREITGDNKICKVSAVGVGMRSHPGVASQMFKALADEGINIQMISTSEIKISVVLDEKYLELAVRVLHRTFGLDQ

SEQ ID NO: 55899 - protein, 465 aa, Coprinopsis cinerea okayama7#130
MTPIAVQPISTTKASHPIIKTLIEQGIAFVRVQWVDLTNLIRCRVIPISSFDKLLQSERPAISITKAVLGLVGYCVAETFNGTGVWSYLFDLTSLKLCPYAPRHASVMGWFHEASPPPAKDLGISICPRTLLSKVVASIRQTHSVDLLVGFETEFVLMNPGSPGPVGYRAYSTTSALYTGLSEAVILEEIADALQSSGIEVQMYHAECSQGQYEVVTGPLPPLQAADALVHTRETIYNVANKHGLRATLAPRPFKESAGSASHLHFSVHSSETNLQKTVSIDGVQLRQCEASFIAAVLDHLPSLALLTCPTISSYGRMEDGIWSGGTYACWGVEHRETPIRVCHPTSPAARNFELKMIDGTSNPYLATAALIAAGSEGIRNHQNLSQRPLQGASSAIEMTASQRESYGISKRLPLNLQEARQVFQSNTYLRRVLGEGFVNPYLHVNDSWNAHISSQGDDITTKIY

SEQ ID NO: 55900 - protein, 465 aa, Coprinopsis cinerea okayama7#130
MTPIADHQTLSSPHTSHPIVKSLREQGISFVRIQWVDLTNVVRCRVIPMSSFDKLLRSERPAISISKAVLGLVGHHLAETFNGTGVWSYLLDLTSLKLCPYARRHASVMGWFHEASPSPARDLGISICPRTLLSNVVASIQQTHSVDLLVGFETEFVLMNPGSLGSVGYHAYSTTSALYTGCSEAVVLEEIVHALQSSGIEVEMYHAECSQGQYEVITGPLPPMQAADALVHTRETIYNIANKHGLRASLSPRPFQESAGSASHLHFSVRSSEPALEETVSIDGVQLRRCEASFIASLLDHLPSLVFLTCPTIPSYGRMKDGIWSGGTYACWGVEHRETAIRVCHPTSPAARNFELKMVDGTSNPYLAVAALVAAGSEGIRNQQALTQRPLQGASSAIEMTASQREAYGISKRLPLTLQEARQMFQSNTLLRKALGDGFVDSYLHVNDAWNVYLTSHDDVLARIF

SEQ ID NO: 55901 - protein, 257 aa, Picea sitchensis
MLGINLDLVLVPTGILFMVGYHIYLVYRIIKHPNSTVIGFENGNRRVWVQQMMENMPSNTGLALQVVASNISAAVYLVSLSITLSSLIGTLVGASTSSGSTATNKGLVNVIIFGDKSAVTASIKYVSLLICFLIAFMSHVQCIRYYIHVSFLISTPRSSVPADYIENSVIRGSNFWSLGLRAYYFAFPLLLWIFGPIPMFVCVLGLISTLYFLDSTVNPIPPFAVKSSSKGMADIGRGIESNAGRNQCSLGGLLEFQ

SEQ ID NO: 55902 - protein, 369 aa, Prochlorococcus marinus str. MIT 9313
MTTNPSLNDPLDKVPSDRLWLRSELMGTHVITRDTGRRLGVVGEVVVDIDRREVVALGLRDNPLTRYLPGLPRWMPLDRIRQVGDVILVDSSDSLKEGFTPDRYSRVINCQVITESGQQLGRVLGFSFDIETGELTTLVIGAIGVPLLGEGVLSTWEMPVDEVVSSGADRIIVYEGAEEKLKQLNSGFLEKLGVGGPSWEEQERERYRMNLVPVENQLNSGQPTEQEQRRLQPSTTQTFEPEEELEYVELEERQQEVIPQQRYLDETPSSSPTRYRNDREERMTFEEPSAYEQRPVFEESAAYEPRRTFEDQQPQRPRPASRRPVQSLGDPLDVEPLDFSGRDQAGRDRDTEIEETPQRRNGTELDDPW

SEQ ID NO: 55903 - protein, 97 aa, Solanum lyratum
ATYKVKLITPEGPVEFNCPDDVYILDSAEENGHDLPYSCRAGACSSCAGKITAGNVDQSDNSFLDDDQVAEGFVLTCVAYPKSNVTIETHKEDDLVG

SEQ ID NO: 55904 - protein, 703 aa, Thiobacillus denitrificans ATCC 25259
MTTRPNPLLRFLPFLAWFPMTRESLRADLLAGITVSLILVPQSMAYAQLAGLPVVYGLYAGFLPVIVASLWGSLRQLHTGPTAMLSLMSAAALIPYAATGSETFIALSLMLALMVGILRLALGLFRLGVVVNFLSHPVIIGFTNAAALIIGLSQLNKLVNVPMPRSDWFLGDLWVVLQQLGSTHWPTLGFGLGAFALILVLQKRLPRLPGVLIAIVVTTLASYAIDFERTAKAGVDAIEDPGVRAQVMQLDQATAELQRHNETAARLQSELARAEDDGAPLDTLLDLKGDIARSQAAAYALGDRMMTLRIQLHRVDFTQQSGADGAPRFAVAGEMPKSEPLGTGHWRFGGIAGGEVTFTGGGEVVGAIPAGVPGFQVPHVDWALVLPLLPAALVMALLGFMEATSISKAISAKTGQRIDTNRELVGQGLANIVGSFFHAYVVSGSFSRSAVAAREGARTGLFAIVSALGVLAVMLFLTPLLYHLPQAVLAAVIMLAVFGLVRVAPLFHAWKVNRPDAVIGIATFVATVAMAPALANGILLGVGLTVALYLFRNMRPRAEILGRHPDGVLGGIDTHNLPAVSEHYVALRFDGSLNFVNVAYFEDVVLQALERFPHAKAVLVIGSGINDLDVSGEEKLRALVEQLRARNVNLYFSSLKRQVLAAFERSGLSSVIPGDHIFKTKEVALKTLDACYGSGRIGPAVPA

SEQ ID NO: 55905 - protein, 97 aa, Solanum lasiocarpum
ASYKVKLITPDGPIEFNCPDDVYILDRAEEEGHDLPYSCRAGACSSCAGKIVDGSVDQSDNSFLDDDQIGGGFVLTCVAYPKSNVTIETHKEEALVG

SEQ ID NO: 55906 - protein, 97 aa, Solanum abutiloides
ATYKVKLVTPDGPVEFECPDDEYILDRAEEEGHDLPYSCRAGSCSSCAGKIAAGSVDQSDGNFLDDDQIADGFVLTCVAYPQSDVTIETHKEEELTA

SEQ ID NO: 55907 - protein, 341 aa, Gordonia sp. TY-5
MRAVQVVGYHDKLQLNEIPDPEITGPLDVIVRIGGAGVCRTDLHILEGQWEAKSGVALPYTIGHENAGWVEAIGDAVTNVAVGDKVILHPLITCGLCRACRDGDDVHCENSKFPGIDTDGGYADYLKTTARSVVRIDDSLEPAAVAALADAGLTAYHAAAKVARMTRPGDTCVVIGAGGLGHIGIQVLSAISGVTIVVLDRNPDAVALAVEVGAHEGIVADGNHIEKVLALTDGKGAEAVLDFVGEGGATAEGVAMLRQAGNYFVVGYGENINVPTIDIISTEINFIGNLVGSYNDLTELMTLAAQGKVTLHTATYPLTDFQQALDDLDAGKVRGRAILIP

SEQ ID NO: 55908 - protein, 316 aa, Haemophilus ducreyi 35000HP
MPDIKLFAGNATPELAKRISERLYISLGNATVGRFSDGEIQVQINENVRGSDVFIIQSTCAPTNDNLMELIVMVDALRRASAGRITAVIPYFGYSRQDRRVRSARVPITAKVVADFLSSVGVDRVLTCDLHAEQIQGFFDVPVDNVFGSPVLIDDILKKKDLVNPIVVSPDIGGVVRARAVAKLLNDTDMAIIDKRRPKANVSQVMHIIGDVTDRDCILVDDMIDTGGTLVKAAEALKERGARRVFAYATHAVFSGSAANNLANPALDEVVVTDTIPLSDEIEALNKVRVLTLSSMLAEAIRRISNEESISAMFDA

SEQ ID NO: 55909 - protein, 382 aa, Pyrobaculum aerophilum str. IM2
MKLHEYEAKELFSKYGVKIPPGKVALTPEEVLKIAREIGAPVVLKAQVVVAGRGKAGGIKVANSPEEAYELSKRMFGMNIKGLIVKKLYVTKFVEVEREMYLSLIIDRASRRYLFLASPVGGMDIEEIAKTSPEKIKRVYVDPATGLRDYHVRSIVSWLGFKQGTSQWQQAASIVQAMYRIMVDYDAELVESNPLAVTKEGEVIPLDARVIVDDNALFKHPELEKALEEDPRDVTEFEAYAKKIGFHYVELDGDVGIIGNGAGLTMATMDLVYHFGGRPANFLDIGGGASREVVKEAVKVLLHHPRVKVIFVNIFGGITRADEVALGIKEALAESGGTNKKIVVRMKGTNEELGRAILAEIGVPLFDSAEEAAKKAVELARV

SEQ ID NO: 55910 - protein, 117 aa, Glycine max
  misc_feature (34)..(34): Xaa can be any naturally occurring amino acid
  misc_feature (59)..(59): Xaa can be any naturally occurring amino acid
  misc_feature (79)..(79): Xaa can be any naturally occurring amino acid
PTRTVEDDVKVVVSPTFACLHLVKSLLRPHTHVXAQNSCVHKRGAYTGQVRAEMLVNYXITLVIIGHSELSQLMNESYXLVEYKVAYALQQGLNIIACIEETMEQLEPVTTTDVDAE

SEQ ID NO: 55911 - protein, 457 aa, Schizosaccharomyces pombe
  misc_feature (1)..(1): Xaa can be any naturally occurring amino acid
  misc_feature (99)..(99): Xaa can be any naturally occurring amino acid
  misc_feature (379)..(379): Xaa can be any naturally occurring amino acid
  misc_feature (388)..(388): Xaa can be any naturally occurring amino acid
  misc_feature (435)..(435): Xaa can be any naturally occurring amino acid
XSLCLPTIRKIAIIGAGPSGLVTAKALLAEKAFDQVTLFERRGSPGGVWNYTSTLSNKLPVPSTNPILTTEPIVGPAALPVYPSPLYRDLQTNTPIELXGYCDQSFKPQTLQFPHRHTIQEYQRIYAQPLLPFIKLATDVLDIEKKDGSWVVTYKGTKAGSPISKDIFDAVSICNGHYEVPYIPNIKGLDEYAKAVPGSVLHSSLFREPELFVGESVLVVGGASSANDLVRHLTPVAKHPIYQSLLGGGDIQNESLQQVPEITKFDPTTREIYLKGGKVLSNIDRVIYCTGYLYSVPFPSLAKLKSPETKLIDDGSHVHNVYQHIFYIPDPTLAFVGLALHVVPFPTSQAQAAFLARVWSGRLKLPSKEEQLKWQDELXFSLSGANNXYHSLDYPKDATYINKLHDWCKQATPVLEEEFPSPYWGEKERSIRENXWSIRAKFFGIEPPKEGHHHHHH

SEQ ID NO: 55912 - protein, 336 aa, Shigella flexneri 2a str. 301
MKTAVVTKDHHVDVTDKTLRSLKHGEALLKMECCGVCHTDLHVKNGDFGDKTGVILGHEGIGVVAEVGPGVTSLKPGDRASVAWFYEGCGHCEYCNSGNETLCRSVKNAGYSVDGGMEEECIVVADYAVKVPDGLDSAAPSSITCAGVTTYKAVKLSKIRPGQWIAIYGLGGLGNLALQYAKNVFNAKVIAIDVNDEQLKLATEMDADLAINSRTEDAAKIVQEKTGGAHAAVVTAVAKAAFNSAVDAVRAGGRVVAVGLPPESMSLDIPRLVLDGIEVVGSLVGTRQDLTEAFQFAAEGKVVPKVALRPLADINTIFTEMEEGKIRGRMVIDFRH

SEQ ID NO: 55913 - protein, 254 aa, Chlamydophila pneumoniae J138
MTRQSYVLGNWKMHKTIQEAKEYVQTLASLLQGEPLSCTIGIASPFTSLRAIHEMINTTGAFLWLGAQNVHPELSGAFTGEISLPMLKEVGVEFVLVGHSERRHIFGESDALIASKVKSVAQAGLVPVLCVGESLEVREEGKAHQVIKKQLLLGLEQMDNGSEFLIAYEPVWAIGTGKVAEASDVQDIHMFCREVVAERFSEATAEEISILYGGSVKVDNAQRFGQCSDVDGLLVGGASLEGQSFFEVAKNFNV

SEQ ID NO: 55914 - protein, 495 aa, Pseudomonas sp. R9
MLHSLKQTWLSNIRGDILAGLVVALALIPEAIAFSIIAGVDPKVGLYASFCIAVVIAFVGGRPGMISAATGAMALLMVTLVKNHGLEYLLAATLLCGVLQIAAGYLKLGSLMRFVSRSVVTGFVNALAILIFMAQLPELTNVTWHVYAMTAAGLGIIYLFPYVPKIGKLIPSPLVCIIVLTAVAMSVGLDIRTVGDMGELPDTLPIFLWPDVPLTFETLAIIFPYSAALAVVGLLESMMTATIVDDLTDTPSDKNRECKGQGVANIASGLIGGMAGCAMIGQSIINVKSGGRSRLSSLAAGVFLLLMVVFLGDWLKQIPMAALVAVMIMVSIGTFSWDSLRNLKKHPLSTNIVMVVTVVVVVATHNLAFGVLAGVLLAAMFFANKVGHYMAISSSLDEAGEHRSYNVTGQVFFSSADKFVAAFDFKEALNKVTIDLNRAHFWDITAVAALDKVVIKFRREGTEVEVLGLNEASATIVDRFGVHDKPDAIDQLMGH

SEQ ID NO: 55915 - protein, 135 aa, Coprinopsis cinerea okayama7#130
MSGKVSGKSKSGKATTGDASKSQSRSSKAGLQFPVGRVHRLLKKGNYAQRVGAGAPVYLAAVLEYLAAEILELAGNAARDNKKHRIVPRHLQLAIRNDEELGKLLGDVVISQGGVVPHIAPELLPSKTKGKRDDE

SEQ ID NO: 55916 - protein, 227 aa, Brassica napus
MDVSNTMLLVAIAAAYWLWFKRISRWLKGPRVWPILGSLPGLIEQRDRMHDWITENLRACGGTYQTCICAVPFLAKKQGLVTVTADPKNIEHMLKTRFDNYPKGPTWQAVFHDFLGQGIFNSDGDTWLFQRKTAALEFTTRTLRQAMGRWVNRGIKLRFCPILETAQNTCEPVDLQDLVLRLTFDNICGLAFGKDTRTCAPGLPENGFASAFDRATEASLQRFILPE

SEQ ID NO: 55917 - protein, 633 aa, Aspergillus oryzae
MDPNNNRLHLNFGYNERGFNAAANNRAYPTTPSAFPQPIYQNQGPQDYMDAQNGAYNQGYFMANPYPPQAAYAQQHYGQSNLQSPQPAYQSRMGYSANDGTNGLIQQFSNQDLNSNRTGFFGRSASPAQRPRTAGSSAPGQQQPGHLAPPMPRSPRTPAENEELQRYPERYSENIHKRGKAAKELVNVFFHENIERARDRNMRSTNLDKMIQDPSISKDAKRQEGETIAKKESNFLRFLRTKETPSNFQTIKVIGKGAFGEVKLVQRKTDGKIYALKSLIKTEMFKKDQLAHVRAERDILADSKDNPWLVKLHASFQDSAYLYLLMEFLPGGDLMTMLIKYEIFSEDITRFYMAEIVMAIEAVHKLGFLHRDIKPDNILLDRGGHVKLTDFGLSTGGKKTHDNSYYQNLLKNSTSKDKNRNSGYFNDAINLTVSNRGQINTWRKSRRAMAYSTVGTPDYIAPEIFNGQGYTYLCDWWSVGAIMFECLVGWPPFCAEDTTDTYRKIVNWRECLYFPEELTLSRESEGLIRSFLCDAEHRVGNDGGQFGGATQIKNHPFFRGVVWEQLRNIRAPFEPRLSSNIDVSYFPIDEIPQEDTSAIHRAQARAMPEEQEAEMSLPFIGYTYKAFNAFQNN

SEQ ID NO: 55918 - protein, 67 aa, Glycine max
FAVAIVGVGGVRTVSAEMLTICGIGRLLSDDCDQVELANMNRLSFRPNQVGLTQTDGAAHTLTDINP

SEQ ID NO: 55919 - protein, 298 aa, Oryza sativa
  misc_feature (22)..(22): Xaa can be any naturally occurring amino acid
  misc_feature (43)..(43): Xaa can be any naturally occurring amino acid
EDSVSLSSSSVSPPRRLRSPAXSRLRRRRLLPRPLPVVASVPXDRSPSMAGAEEGQWVLMATGRSPTNIAVIKYWGKRDEALILPVKDSIRVSLDPDHLSATTTVAVSPSFPSDRMWLNGKEISLSGGRFQSCLREIRKRAQDVEDEKKGIRIKKEDWGKLHVHIASFNNFPTAAGLASSAAGLACFVFTLGKLMNVKEDHGELSSIARQGSGSACRSIYGGFVKWCMGKNNDGSDSIAVQLADEAHWNDLVIIIAVVSSKQKETSSTSGMRDSVETSPLLQYRAQVTVLTCTFVLAV

SEQ ID NO: 55920 - protein, 341 aa, Williopsis saturnus
AGVAKFAKYPLTFGPSPISNLNRLSQHLGSKVNVYAKREDCNSGLAFGGNTLRKLEYIVPDIVEGDYTHLVSIGGRQSNQTRMVAALAAKLGKKCVLIQEDWVPIPEAEKDVYNRVGNIELSRIMGADVRVIEDGFDIGMRKSFANALQELEDAGHKPYPIPAGCSEHKYGGLGFVGFADEVINQEVELGIKFDKIVVCCVTGSTTAGILAGMAQYGRQDDVIAIDASFTSEKTKEQTLRIANNTAKLIGVEHEFKDFTLDTRFAYPCYGVPNEGTIEAIRTCAEQEGVLTDPVYEGKSMQGLIALIKEDYFKPGANVLYVHLGGAPALSAYSSFFPTKTA

SEQ ID NO: 55921 - protein, 273 aa, Bradyrhizobium sp. BTAi1
MDAIDTQGIRLPKLGLGTFRMQGTVCREAVESALALGYRHIDTAEMYANEDAIGAALAAAQVPRAELHVTTKVWPENLAPDAIRRAFDTSLKKLRLDVVDLYLIHWPAKGMNLPAALETLIKLKDEGRTRAIGVANFTVALLRQAIEEIQAPIACNQVEYHVMLDQSKLMGYMASRSIPLVAYCPLAQGRAAADATLAAIGSKHGASAAQVALKWLLDQDGVAAIPKAGRKESQQANWDAMKVQLDDEDRATIAALPKDKRFVNPGFAPDWDR

SEQ ID NO: 55922 - protein, 295 aa, unidentified eubacterium SCB49
MSLRIAIQGIESSFHDLAVQQLFPDTEITLVPCTSFKKVTIALEQNKADLGVIAIENTIAGSILPNYQLIDDGDFQILGETFLTIDMYMMALAGQSIHDIDEVHSHPVALQQCSEYLLKLQPHCKIIEGKDTASEAQKIKQLGLKNVAAIAGKQVAEKYGLTILDRKIQTIKENKTRFVVLSKNAGKSDGYNKASLRFELGHEIGSLSNVLQILNTFNINLTKIQSFPIEGQPWQYSFFIDVLFEDYELFQEVITVLTKAVLKLKVLGAYKQNLSNQPYNISDNKELFQEVIIAD

SEQ ID NO: 55923 - protein, 454 aa, Bacillus cereus G9241
MNTKKFAKVNEQIPGPKAASLLERRQNIVPKGVSNGIPTFVQSANGALVTDVDGNQYIDFAGAIGTINVGHCHPAVKEALHKQVDQYIHTGFNVMMYEPYIELAEKLAALAPGSFDKQVLFLNSGAEAVENAVKIARKYTKRPGIIAFSKGFHGRTLMTMTMTSKVKPYKFGFGPFAPEVYKAPFPYEYRRPEGLTEEQYDDFMIEEFKNFFISEVAPETIAAVVMEPVQGEGGFIVPSKKFVQEVRNICSEHGILFVADEIQTGFSRTGKYFAIDHYDVVPDLITVSKSLGAGVPISGVIGRKEIMNESAPGELGGTYAGSPLGCAAALAVLDVIEKENLNDRAIELGKVVMNRFEEMKNKYNCIGDVRGLGAMCAFELVQDRKTKAPDKTLTANLCAEANKRGLLLLSAGTYGNVIRVLMPLVITDEQIEEGLTIIEESLQVCYEKANIARV

SEQ ID NO: 55924 - protein, 469 aa, Bacillus cereus G9241
MYINGEWITLQEQIEVNNPATKEIFATVPKGGVTEAKQAVDAAHEAFKSWSKLTAADRAVKLKKWFTLIDENKEEIAAIMTREQGKPFAEALGEVNYANSFVEWYAEEGKRVYGEMIPASHPNKRILVMKQPVGVMAAITPWNFPAAMITRKVAPALAAGCTAVVKPASQTPLTALKLAELAHEADIPKGVINIVTGSAKAIADKWMEDGRVRKVSFTGSTEIGKELMASAAQTMKKVSLELGGHAPFIVMNDADLDKAVEAVIGSKFRNAGQTCICTNRVFVQEEVYEAFVEKFQKAVGQLKVGDGFGDGTTVGPLIDENAVSKVQEHIEDAIQKGGTVLYGGQKVAELDGHFIQPTVIGLANDTMLCMNEETFGPVAPVAKFKTVDEVIERANHTPYGLAAYIFTKDISQAFQISEALEYGIIGLNDGLPSVAQAPFGGFKESGIGREGGHFGIEEYLEIKYISLGL

SEQ ID NO: 55925 - protein, 441 aa, Prochlorococcus marinus str. NATL1A
MKQEEKLNLMNEKENSNQTIQNPHIWPPFTQLTSSKPQLLVEKAKGALLLPKDRAPIIDGISSWWVTLHGHANEYIAKAIATQAEQLEQIIFADFTHPQAELLANRLSKLTGLEKLFFSDNGSTAVEVALKMARQWWKNKGDNRSQIIAFEGAYHGDTFGAMAVGERNIFSEPFDQMLFPVSRVPWPETWWGDEDFERREKEVLETLDHLLKTPTIAVIIEPLVQGAGGMRMVRSEFLVEVEKRIRHANSLLITDEVLTGFGRCGELFAFQRAGLRPDLISLSKGLTGGFLPMGVTMSSKKISEGFLGEDPKQTFWHGHSFTANPLGCAAANASLDLLERSPQKYLDFESRHLPHLQKIVKDPRIECPRITGTIAAFNIKVKGNKGYLSSVGKIMKASALSVGVFIRPLGDVVYLMPPLCITDQELEKCYFGIQEGLNALS

SEQ ID NO: 55926 - protein, 358 aa, Bradyrhizobium sp. BTAi1
MADSIQEVLYAFAKGEMVVVTDDDDREGEGDLIVAASLCTPDKMAFIIRHTSGIVCAPITADDARRLRLDPMVAHNDSNHTTAFTVSIDYKPDGGTGISAEERASCCRALANPNAGANDFARPGHIFPLIARDGGVLLRSGHTEAAVDLCKLSGLPPVGVISELMNDDGTVMKGEQVVRFAAAHNLKHVTIADLISYRQAREKLIERVSTFTTESPIGPLQGFAYRSPFDPITHAAFVYNGIGDGKNVLTRLHKPNIVKDLIAGPQRIQAVLQHFKKAGRGILIYLRDGAAGVPVEPVTEPHTAEADRHRQWREVGVGAQILRDLGVTSIRNLTSSAHDYKGLSGFGIEIVANERLEG

SEQ ID NO: 55927 - protein, 374 aa, Herminiimonas arsenicoxydans
MAKRDFYEILGLGKNASDEEIKKAYRKLAMKHHPDRNPDSKGAEDKFKEAKEAYEMLSDPQKRDAYDRYGHAGVDPNMGGGGGGGGFADAFGDIFGDIFGQAGGGRGGRGGPQVYRGADLRYNLEITLEQAAHGYDTTIRVPSWDSCETCDGSGAKPGTSPINCTTCGGHGQVRMQQGFFSVLQTCPKCHGSGKINPSPCTACSGAGKIKRNKTLEVKIPSGIDDGMRIRSSGNGEPGMNGGPPGDLYVEIRIKQHAMFQREGDDLHCEIPISFAKAALGGEIEVPTLNGKASFTIPEGTQSGKTFRLRSKGIKGVRSGYAGDLFCHVVVETPVTLTEKQKELLREFELLTIEGGSKHSPQTKSWKDKVKEFFE

SEQ ID NO: 55928 - protein, 176 aa, Escherichia coli
EGLWDTLSARLDFCNLDVNDTAAFSRLGAMLDQKNRITINYFAMPPSTFGAICKGLGEAKLNAKPARVVMEKPLGTSLATSQEINDQVGEYFEECQVYRIDHYLGKETVLNLLALRFANSLFVNNWDNRTIDHVEITVAEEVGIEGRWGYFDKAGQMRDMIQNHLLQILCMIAMSP

SEQ ID NO: 55929 - protein, 481 aa, Mycobacterium tuberculosis H37Rv
MVGPRTRGYAIHKLGFCSVVMLGINSIIGAGIFLTPGEVIGLAGPFAPMAYVLAGIFAGVVAIVFATAARYVRTNGASYAYTTAAFGRRIGIYVGVTHAITASIAWGVLASFFVSTLLRVAFPDKAWADAEQLFSVKTLTFLGFIGVLLAINLFGNRAIKWANGTSTVGKAFALSAFIVGGLWIITTQHVNNYATAWSAYSATPYSLLGVAEIGKGTFSSMALATIVALYAFTGFESIANAAEEMDAPDRNLPRAIPIAIFSVGAIYLLTLTVAMLLGSNKIAASDDTVKLAAAIGNATFRTIIVVGALISMFGINVAASFGAPRLWTALADSGVLPTRLSRKNQYDVPMVSFAITASLALAFPLALRFDNLHLTGLAVIARFVQFIIVPIALIALARSQAVEHAAVRRNAFTDKVLPLVAIVVSVGLAVSYDYRCIFLVRGGPNYFSIALIVITFVVVPAMAYLHYYRIIRRVGDRPSTR

SEQ ID NO: 55930 - protein, 290 aa, Arabidopsis thaliana
MRNKSQSFISSKLIFICCSILVLFILFLKRASFSSNSTATIRDEYHQKSKCPSTPQQCTKLPTSLSDALVHYVTSEITPQQTFDEVSVSKRVLDKKSPCNFLVFGLGHDSLMWASLNHGGRTLFLEEDEAWIETVTKKFPNLESYHVVYDTKVKDSNKLMELKRTEDCKAVSDPRDSKCALSLKGFPADVYETQWDVIMVDAPTGYHDEAPGRMSAIYTAGLLARNRYDGGETDVFVHDINRPVEDEFSVAFLCGGYMKEQQGRLRHFNIPSHRASFGTPFCPADISRRF

SEQ ID NO: 55931 - protein, 271 aa, Oryza sativa
RLVFAPTDYASRLAPMADLHPPEPDTNGGSAAAAAAAAAAAAPLGDPAAEASGAQAAAGPPYSKRRRRPSVRLGDIGVHSAAAADVPLPQRRHHKTSSSSHPRPPRRAHPEDALDPLNHSSAAAHRRGQKPAQRRPRTAWIPAAPGTDGYEEEAEHYYDDADQSDSAAAAAARARVSGSRDASGDESDGVADWGLPNGRLPGSMGYGGVKAWLDGLGLSRYAPVFEIHEVDDEVLPLLTLEDLKDMGIGAVGSRRKLYAAIQKLQRSDSVS

SEQ ID NO: 55932 - protein, 390 aa, Desulfitobacterium hafniense Y51
MPNKEMLLIPGPTPVVDEIYEALAQETYSHTDPRLVKRFKNSLDMTKRLFNTDGEVFVVAGSGTLSMEMAIVNTVAPGEKILVISHGYFGDRFIPLAQAHGIQVEVLQSQWGKHVEISAVEEKLAEGGFKAVTVTHADTSTGVMSNLEELVPAVKKYGPLFILDGVCASAAIEENMQKEYGHPDYRIDLVLTGSQKAIGVPPGLAIVAFGPKALKAREAMDKVAAYYMDILRWLPTMQDPGKYYATHPVNMIYAYEKGMELVMAEGLEARYKRHAALGKAVRAGLAQYGMRALAPEEIAAPTLSCILYPEGVNDAEFRSKLAEKGMVIAGSLANLAGKAFRIGHMGNATEEMFIKAMELVGETLNEMGLRADPAKAVETFKNVYHEGLGK

SEQ ID NO: 55933 - protein, 159 aa, Clostridium acetobutylicum ATCC 824
MNITLITVGKLKEKYLKDAVNEYAKRLQKYCKLNIIELQDEKTPEKASLKEEKLIKEKEGEKILSSIKDNSYVVSMDLKGKMFSSEEFSAFIDDLGVRGNSSIDFVIGGSLGLSDAVLARANYKLCFSKMTFPHQLFRVMLLEQVYRAFRISRGEPYHK

SEQ ID NO: 55934 - protein, 328 aa, Roseovarius nubinhibens ISM
MLLAAPPANRATIALSEGEDPRIVEGALAAQAAGAADIILVGQGDAVRAELTRQGAEEGPGIAVHDPETSDLTDSFAKSFHALRQHKGVDEAAAARAVRAPLTYAAMLVREGHATGTVGGAVATTSDVVRTALQVIGKAPDAAMVSSFFLMYPPEGTETGRTMLYSDCGLVIDPAADELAEIAAMSARSCRALMREEPKIAMLSFSTMGSAKHDRVTKVTDALATLRARHPDLEADGELQFDAAFVPSVGTAKAPGSAVAGQANVMIFPNLDAGNIGYKLTQRLGGYAAIGPILQGLAHPANDLSRGCVAEDVTQMIAVTVLQSMAAG

SEQ ID NO: 55935 - protein, 407 aa, Solanum lycopersicum
MASLSRFIGKQCKLQCSDTLQRPSYGFCVRRSPTHLSMGMRNKDEIGRYNLFINQNQSKTSLVQSPCNRKIVCCEAASNVSGESSSTGMTQYEKIIETLTTLFPLWVILGTIIGIYKPSAVTWLETDLFTLGLGFLMLSMGLTLTFDDFRRCLRNPWTVGVGFLAQYFIKPLLGFTIAMALKLSAPLATGLILVSCCPGGQASNVATYISKGNVALSVLMTTCSTVGAIVMTPLLTKLLAGQLVPVDAAGLAISTFQVVLVPTVIGVLSNEFFPKFTSKIVTITPLIGVILTTLLCASPIGQVADVLKTQGAQLLLPVAALHAAAFFLGYQISKFSFGESTSRTISIECGMQSSALGFLLAQKHFTNPLVAVPSAVSVVCMALGGSALAVYWRNQPIPVDDKDDFKE

SEQ ID NO: 55936 - protein, 477 aa, Desulfitobacterium hafniense Y51
MTYNREYFYVTSVTLIGTEDGKLKQRRLGGKLNMTYVQEVLEQAVKRNPGEAEFHQALREVLESLEPVLEKRPDLKEAGILERIVEPERQILFRVPWVDDQGKVQVNRGFRVEYNSAIGPYKGGLRFHPSVYLGIIKFLGFEQIFKNSLTGLPIGGGKGGSDFDPKGKSEGEIMRFCQSFITELYRYLGADTDVPAGDIGVGGREVGYMFGQYKRITNRYEGVLTGKGLTFGGSLGRTEATGYGLVYFMEEALKAVGKSFSGATVVVSGSGNVAIYATQKATQLGGTVVAMSDSNGYIYDKDGINLDTVRQLKEVERKRLKDYVSIHPTAEYYEGCAGIWTIPCAIALPCATQNELDGEAAEVLVKNGCYAVGEGANMPSTPEAVDVFLQHKIIYGPGKAANAGGVAVSALEMSQNSMRYSWTFEEVDAKLKNIMVNIYHNASKAAQEFGFEGNLVAGANIAGFLKVAEAMKAQGTV

SEQ ID NO: 55937 - protein, 524 aa, Trametes sp. I-62
MSGFRLLPSFASLAVIVSLALNTFAAVGPVTDLTISNANVSPDGFQRAAVVANGGVPGPLINGQKGDHFQINVVNQLTNHTMLKSTSIHWHGFFQKGTNWADGPAFVNQCPIATGHSFLYDFQVPDQAGTFWYHSHLSTQYCDGLRGPFVVYDPNDPHASLYDVDNEDTVITLADWYHVAAKLGPAFPPRADATLINGLGRSTDTPTADLAVIKVTSGKRYRFRLASLSCDPAFTFSIDNHDMTIIEADAVNTQPLEVDSLQIFAGQRYSFVLEANQAVDNYWVRANPFFGTTGFAGGINSAILRYDGAAEVEPTTTQSTSTKPLAETDLVPLASMPVPGSPVSGGVDKAINFAFTFNGTNFFVNGATFTPPSTPVLLQIMSGAQDASALLPSGDVYSLPSNATIELTFPATTGAPGAPHPFHLHGHTFAVVRSAGSTKYNYDNPIWRDVVSTGTPAAGDNVTIRFRTDNPGPWFLHCHIDFHLEAGFAVVMAEDIPDTKLANPVPQAWSDLCPIYDALDPSDQ

SEQ ID NO: 55938 - protein, 434 aa, Prochlorococcus marinus str. MIT 9313
MTSSVSSEQSMPLEMAAVETSANLAELTRADFPLLGQTACLGQPLIYMDHAATSQKPRQVLDALQHYYDHDNANVHRGAHQLSVRATEDFERARQKVADFIAASSAREIVFTRNASEAINLVARTWGDANLHEGDEVLLTLMEHHSNIVPWQMLAKRTGCVLRFVDLTDCGELDLNDLRHKLSERTRLISLAHLSNVLGCFNPISEVTAEAHRFGALVLLDACQSLPHMPVDVSRLGCDFLVGSSHKLCGPTGMGFLWAREELLDAMPPFLGGGEMIQDVYLDHSSWADLPYKFEAGTPAIGEAIGMGVALDYLNQVGLDRIHAWEQQLTLQLFDRLQAIDGLTILGPTPQQEPDRAVLAAFTVDGLHPNDVGALLDSAGICIRSGHHCTQPLHRHYGIPGSARASLSFTNTPEEVDRFAEELVATIGFLREHS

SEQ ID NO: 55939 - protein, 182 aa, Synechococcus sp. WH 7803
MVSPWRSWADRLTLLRAVLGAPVLLALAAEQFSTAWILLLLGALSDWADGWMARKADGGSSWGARLDPLADKLLISAPLIWLAAEQVLPLWSVWLLMARELLISGWRSASQSGAPASWLGKTKTTLQFLSLFLLIWPPTWGVDSVVAGLHQLGWSLYWPALGLALWSGLAYINPGKTGPRRR

SEQ ID NO: 55940 - protein, 341 aa, Williopsis saturnus
AGVAKFAKYPLTFGPSPISNLNRLSQHLGSKVNVYAKREDCNSGLAFGGNKLRKLEYIVPDIVEGDYTHLVSIGGRQSNQTRMVAALAAKLGKKCVLIQEDWVPIPEAEKDVYNRVGNIELSRIMGADVRVIEDGFDIGMRKSFANALQELEDAGHKPYPIPAGCSEHKYGGLGFVGFADEVINQEVELGIKFDKIVVCCVTGSTTAGILAGMAQYGRQDDVIAIDASFTSEKTKEQTLRIANNTAKLIGVEHEFKDFTLDTRFAYPCYGVPNEGTIEAIRTCAEQEGVLTDPVFEGKSMQGLIALIKEDYFKPGANVLYVHLGGAPALSAYSSFFPTKTA

SEQ ID NO: 55941 - protein, 373 aa, Streptomyces hygroscopicus subsp. yingchengensis
MDGVRAVLLAGGEGRRMGPLGRGRLKPLVPFGGTSRLIDFSIANVHRSGLRDVLLLSQYEERRLMDDLHLVWNGRHRGFRIDFGPYDAVYRHSPGKLPEQLPERTWPLERGTADALLTKAEYVFRQGDAEASEILVLHADHVYRFDYGDMIREHRASKAALTVSYQRIERRYVHLFGMVEFDGDGLLTAFEEKPDDPTSDLVFAAFCLFDAATLRRYLEQLRGTDWQHDISRDVIPAMLAGGELIRGYEVKSYWEDIGTVDRYHRAHRGLLRADPTLALSDMPLTVAPEVPRHLVPGGPGRRASVVAADVANEGEIVSSVVYPGARIGVDAHVVDCVVLPGARVPDGTHLASAIVLEDGSVQQCEAEREEVAL

SEQ ID NO: 55942 - protein, 198 aa, Klebsiella sp. PAMU-1.2
MPIYQIDGMTPVVPDESYVHPTAVLIGDVILGKGVYVGPNASLRGDFGRIVVKDGANIQDNCVMHGFPGQDTVVEEEGHIGHGAILHGCTIGRNALVGMSAVIIDGARIGENSIVGASAFVKANAEMPANHLIVGSPAKAIRALSEQELAWKKAGNSGVSDAGGALQADAASGEPLKEAEPDRKRLVFDENLRPKSSS

SEQ ID NO: 55943 - protein, 436 aa, Nostoc punctiforme PCC 73102
MTQAIKTQTQTQTSTAYFQALKCKECGAEYELKASNVCELCFGPLEVKYDYSALRLTVTRETIQAGPNSIWRYRPFLPVATDNVIDVGTGMTPLVRSHRLARRLGLNKLYIKNDAVNMPTLSFKDRVVSVALSRARELGFTTVSCASTGNLANSTAAIAAHAGLDCCVFIPADLEAGKIIGSLIYSPTLMAVKGNYDQVNRLCSEVANTHGWGFVNINLRPYYSEGSKTLGFEVAEQLGWELPDHVVAPLASGSLFTKIYKGFQEFIEVGLVEDKKVRFSGAQAEGCSPIAQAFKEGRDFIKPVKPNTIAKSLAIGNPADGIYAVELAQKTGGNIESVNDAEIIDGIKLLAETEGIFTETAGGTTVAVLKKLVEAGKIDPDETTVIYITGNGLKTQEAIQGYVGEPLTIDAKLDSFERALERSRTLDRLEWQQVLV

SEQ ID NO: 55944 - protein, 135 aa, Klebsiella sp. PAMU-1.2
MAEKLSAQCHCGAVAFTVELSDGFNTARRCNCSFCRMRGAVTVSAPLSGIDILRGREKLTEYRFNTGEAVHFFCSVCGIYTFHQRRSNPQQYGVNVACIAGVSPFDFPCLEVNDGVNHPKDGGGGVVGYLRYEKK

SEQ ID NO: 55945 - protein, 121 aa, Prunus persica
VEACKNSLKKLQLDYLDLYLVHYPLATKHSGVGTTASLLDENKVLDIDVTVSLETTWHDMEKTVSLGLVRSIGLSNYELFLTRDCLSYAKIKPQVSQFETHPYFQRESLVRFCKKHGVVPM

SEQ ID NO: 55946 - protein, 329 aa, Bacillus cereus G9241
MIDNFWRDLPRPFFVLAPMEDVTDVVFRHVVSEAGRPDVFFTEFTNSDSYCHPEGMKSVRGRLIFTEDEQPMVAHIWGDNPEYFRQMSIGMAELGFKGIDINMGCPVPNVASRGKGSGLILRPDVAAELIQAAKAGGLPVSVKTRLGFKELSEWEDWLTHIFKQDIANLSIHLRTREEMSQVDAHWELIPEIKKLRDRIAPNTLLTINGDIPDRKTGLELAEKYGIDGVMIGRGIFKNPFAFEKEPREHSSKEHLDLLRLQLDLQDQYAEVLPRSITGLHRFFKIYVKGFPGAAELRNQLMSTKSTDEVRALLNKFEASVNVVEGSETV

SEQ ID NO: 55947 - protein, 492 aa, Arabidopsis thaliana
MEMLLGGRATNGALRSKTKIVCTLGPVSRSVEMIEKLLKAETLDNLRTAMNNTGILCAVMLDTKGPEIRTGFLKEGKPIQLNQGQEITISIDYKIEGDSNIISMSYKKLAEDVKPGDVILCSDGTISLTVLSCDKSFGLVRCRCENSTILGERKNVNLPGIVVDLPTLTEKDKEDIIQWGVPNKIDIIALSFVRKGSDLTEVRKLLGEHSKNIMLMSKVENQEGVMNCEKILENSDAFMVARGDLGMEIQIEKMFLAQKTMIKMANALGKPVVTATQMLESMTVSPRPTRAEATDVANAVLDGTDCVMLSGETAAGAHPEAAVLTMSRICKEAEDFIDYDILHKKTLGMLSLPLSPIESLAASVVSTAQSVFASAIVVLTKGGYTAELVAKYRPSVPILSVIVPEIAQGNDIEMSCSDSVAHVARRGLIYRGIIPVVATGSSARDSNKDATEEMINLAIGFAKTKGICKNGDSIVALHKIDGSSVVKIVSVE

SEQ ID NO: 55948 - protein, 403 aa, Glycine max
MPELYRGYCDQSSASVSSGKLFTWGDGDKNRLGHGDKDARLEPTCVPSLIEDNFHRIACGHSLTVGLTTSGRVFTMGSTVYGQLGNPQSDGKLPCLVEDKFAGESVEEIACGAYHVAVLTSKNEVFTWGKGANGRLGHGDVEDRKSPTLVEALKDRHVKYIACGSNYSSAICLHKWVSGAEQSQCSACRQAFGFTRKRHNCYNCGLVHCHSCSSRKALRAALAPNPGKPYRVCDSCFVKLNKVAELGNNNRRNAMPRLSGENKDRLEKPELRLTKTAVPSNMDLIKQLDSKAAKQGKKADTFSLVHPSQPPSLLQLKDVVLSSALDLRRTVPRPVVAPSGVSSRSVSPFSRRPSPPRSATPIPTTSGLAFSKSISDSLKKTNELLNQEVQKLHAQVHFAILLM

SEQ ID NO: 55949 - protein, 723 aa, Coccidioides immitis RS
MSRAPGHSDANSGNVEDETSRLLELERNDIAAGGSRHGTFSPDTHQYPNRGTSASPSLRHGCTLPGSSSQSIRGDGISSAPFYVATGKSATRQLADAHGVKNRRIMYLAYYVPFFNWISQYQWRYLRGDFISAVTVASVYIPLGLSLASNVAHIPALNGLYSFVFHPLMYALLGSSPQVIVGPEAPGSLLVATVVRNAVDDGKSIDDDLLANAQIAGIVTGMAGAMILIAGLTRLGFLDNILSRPFLRGFISAIGFVIFVDQLVPEMGLSDRAKHDGLVTHGSSWDKLVFLFLNVRYSHALTCAVSFGSFAIIMMFRTLKKFLEPRFPSVVFFPDQLLVVIFSAIFTWKFGWAEQGLHILGDIKGAGNQTFGFRWPFQWSQLDHIRTAMSTSFIISLLGFFESSIAAKGLRSTVQDGIEGMTYSPNRELVALGTANILGGCFMALPSFGGYGRSKLSAATGGKTPMSSIFLCLITVICIVYLLPYFYYLPMGVLSAVISVVSWSLIEECPDDIRFFIRIRGWSELILMLLIFVSTVFYSLYLGIALGMGLSILQVIRHATKPRIQILGKVSGTDNRFENAELHPERVEFIEGCLIVKIPEPLTFANTGDLKNRLRRLEFYGTNAAHPALPRLRSPEHNRNMIFDIHGVTSIDGSGVQVLSEIVQEYIDQDVRVFFCRIPRPESEVFRLMVKSGIVDICGGMTHFVESVDEALKLTETPHIHME

SEQ ID NO: 55950 - protein, 227 aa, Haemophilus ducreyi 35000HP
MELVFIRHGFSEWNAKNLFTGWRDVNLTERGVEEAKAAGQKLLAAGYEFDIAFTSVLTRAIKTCNIVLEESNQLWIPQVKHWRLNERHYGELQGLDKKATAEKYGDEQVHIWRRSYDTLPPLLAPSDPNSAHNDRRYAHLPKEVVPNGENLKVTLERVLPFWEDQIAPALLSGKRVLVTAHGNSLRALAKHIIGISDAEIMDFEIPTGQPLVLKLDSKLNFIEKFYL

SEQ ID NO: 55951 - protein, 216 aa, Zea mays
  misc_feature (17)..(17): Xaa can be any naturally occurring amino acid
  misc_feature (26)..(26): Xaa can be any naturally occurring amino acid
  misc_feature (34)..(34): Xaa can be any naturally occurring amino acid
  misc_feature (59)..(59): Xaa can be any naturally occurring amino acid
  misc_feature (69)..(69): Xaa can be any naturally occurring amino acid
  misc_feature (158)..(158): Xaa can be any naturally occurring amino acid
QNSGNCKRREASYIVQXAIRDQETAXLESAARDXTSQLEPASMQARSLSLDPAIHEDVXRLKSLVEQEXKKVYELHDSLTAYPPSALSLKGKTLMEKRNRLQEESSEIGRQAAEGKIHDLATKLSMQKCQGAEFRKQFEGLINHMEDLANDVERSKEXVIILQDKSEEKDKELERVKKGMEVVVSDVAEKKDDGTDKDRKILVKHNKVGTGGGKGV

SEQ ID NO: 55952 - protein, 837 aa, Pseudomonas fluorescens PfO-1
MHNNNKELTLSAPLSGPVLTLAKVPDAVFASGAMGDGIAIDPLNDTLYSPCAGVVIHVARTGHALTVRADNGAELLLHLGLDTVELQGEGFSMLVKEGARVSNGQPLLRYDLDKVGRQCKSLVSLLILTNSQDFQARPITLKTVKVGEPLLHIVARHSAAANTEELGGPQVHGHVKVAHRGGLHARPAALIRQTAQGFKSQSQLHFAGKSAPCNSLIGLMGLAIGEQDEVQVSCQGPDAQAALQALLVALATALPEDHHAAAPLAATPRNRPAEAGVLHGVCAAPGLVGGPLFRLNAISLPADSGNHQPEQQLQILDTALNQVRSEIDGTLAQAKKQRNADEEAIFAAHLALLEDPALLDAARQSIETGTAATHAWSQSIDAQCQVLQNTGSPLLAERANDLRDLKQRVLRALLGEAWHYDVPAGAIVAAHELTPSDLLQLSAQGVAGLCMAEGGATSHVAILARGKGLPCMVALGSVLLDQTQGQSVVLDADGGRLELTPNAERLAEVQQAQIDRQQRRDAQQAQAHLPAETRNGVAIEVVANVASSHEAADAFANGADGVGLLRTEFLFVDRHTAPDVEEQRAAYQAVIDAMGDKSVIIRTIDVGGDKQLDYLPLPVEANPVLGLRGIRLAQARPEILDQQLRALLQVSPLQRCRILLPMVTEVDELLHIRQRVDALCLELGINQRPEIGVMIEVPAAALQAEQLAEHADFLSIGTNDLSQYTLAMDRDHAGLAARVDALHPALLRLIAMTCEGAAVHKRWVGVCGALASDPLATPVLIGLGVSELSVSPVQIGEIKDRVRQLHEAECQRLARDLLKLSSAAAVRHACHQHWPLR

SEQ ID NO: 55953 - protein, 199 aa, Zea mays
  misc_feature (189)..(189): Xaa can be any naturally occurring amino acid
MASLADSFLADLDELSDNEAYPEEDNAEAVGMDEDGDDDMPDLESLNYDDLDSVSKLQKTQRYSDIMQKVEGALEKDTYLSNQGFILEEDPEYQLIVDCNALSVDIENELIIIHNFIRDKYRLKFPELESLVHHPIDYARVVKKIANEVDITLVDLEGLLPSAVIMVVSVTASTTSGKPLSQENLVKTXEACDRALNLD

SEQ ID NO: 55954 - protein, 174 aa, Pseudomonas fluorescens PfO-1
MKYRLGDARVETHPQSWVAPNAVLVGKVRLEEGANVWFNAVLRGDNELILIGKNSNVQDGTVMHTDMGYPLTIGTGVTIGHNAMLHGCTVGDYSLIGINAVILNGAKIGKNCIIGANSLIGEGKEIPDGSLVMGSPGKVVRELTEQQKKMLEASAAHYVHNSQRYARDLVEQEE

SEQ ID NO: 55955 - protein, 516 aa, Mycobacterium sp. JLS
MAPRASHRDAHTALVEELRTKLAGAALGGPAKSRERHVSRGKLLPRDRVDGLLDAGSPFLEIAPLAADGMYDDECPGAGMIAGVGRISGRECMIVANDATVKGGTYYPVTVKKHLRAQEIAGQNRLPCVYLVDSGGAFLPRQDEVFPDRDHFGRIFYNQATLSAQGIAQIAAVLGSCTAGGAYVPAMSDEAVIVRNQGTIFLGGPPLVKAATGEVVSAEDLGGGDLHSKTSGVTDHLAHDDRDALRIVRRIVGTLGRPQPPPWDVAPAVDAVADQSELYDVVPVDSRVPYDVHEVITRIVDGGEFAEFKAEYGTTLVTGFARIHGHPVGIVANNGVLFGESAQKGAHFIELCDKRVIPLLFLQNIAGFMVGRDYEASGIAKHGAKMVTAVACARVPKLTVVIGGSYGAGNYSMCGRAYSPRFLWMWPNARISVMGGEQAASVLATVRGEMTPEQEQEFKAPIREQYERQGNPYYSTARLWDDGVIDPADTRTVVGLALSIVGQAPLEPVSYGVFRM

SEQ ID NO: 55956 - protein, 365 aa, Picea sitchensis
MEPTSAENSKMNMTIVSEDEWLLGMELGNFSCLPMAMKAAVELDVLQIIANAGNGVQLSPRQIVAHIPTTNPDAAITLDRILRVLASHSVLSCSVTTDENGKAERLYGLTPLCKYLVKNQDGVSLAPLVLINQDKVFMETWYYLKDAVLEGSQPFTKAHGMNAFEYTAMDQRFNRLFNRSMSGHSTMLMNKIMDSYQGFKEVQELVDVGGGVGSTLNLIISRYPHISGINFDMPHVLADAPHYPAVRHVGGDMFDGVPTGQAIFMKWILHNWSDDRCVKLLKNCHKALPEKGKVIAVDSILPVAAETSPYARQGFHLDLMMLAYIPGGKERTEQEFQELGHAAGFVGGVKPICCVNGLWVIEFHK

SEQ ID NO: 55957 - protein, 419 aa, Pseudomonas syringae pv. phaseolicola 1448A
MRAISNTPRLYWPPYTPMKMDDCRPSIVRGEGVYLYDDTGRRYIDGISGSYNHCLGHSHFGLIEAVKEQVDTLVHACNISSNTVLPEALAERISGKLVKARLVHTFLVMSGSEGVEAALKMAWQYQINRGCPQRTKVVAIDGAYHGCTLGAMIATRREFINEGAAPLLAAHAIAMPIPSGLEDISHWRALLAEQETTIAAIVIEPVMAMAGTRQFPDGFLRELSALAKKYDIPFICDEVYCGVGRTGAFCESINQGASPDIVILSKCLGGGFPITAVVTTADMTDSFAAQSMPLFRHGHTQSGNLLGCRAALFILDYLDSHRSYEVVAAGGSRLLQGIRENLQTTNSIVSVQGKGLMLSITFETSQACTRAQLAVRRQGVIVGAADRHLKLAPSFLISEPEADELTDRLVSSIRSVSQQ

SEQ ID NO: 55958 - protein, 746 aa, Oryza sativa Japonica Group
MSVMARPRFEEDDEDEFFDSREVMSPASVSSPASSGRYDGPMLEVWATDPCSVHERRQRFIKSLGLSDSSPSAGGGGDRPDEEPCSRSSAAEEILPCSPTVELVSAVPSFACRGEEPGASGGGGGAEVLDCVFKNLDDGTVFVVDEMGKDGSFRSLRDRRSNRTVTAAEFERTYGSSPFICELMRRVDDSDESSAVEKALVRGRRRRRRFGWLRRLGIRGCVVDVEEDDETNSTSSSSCRSCSGKVDRVKVRHYKKRSKELSAVYRGQDIKAHEGAIVTMKFSSDGQYLATGGEDGVVRVWRVVEGERPNELDFAEDDPSCVFFTVNENSELAPVNSSEGSKSKHYKNSKVSTDPACVVIPHRTFALSQEPVHEFYGHDDAILDLSWSKNRDLLSSSMDKTVRLWQVGCNSCLKVFSHTNYVTCVQFHPTSDNYFISGCIDGLVRIWDVRRCQVVDWADTKEIITAVCYRPDGKAAVVGTITGNCRHYDASENHLELESQVALNGRKKSPLKRIIGFQYCPSDPKKLMVTSGDSQVRILDGLHVISNYKGLRSSSQVAASFTPDGDHIISASDDSSIYMWNYANQIAPVTNHVKTVWSNEHFSCHDVAIAIPWNASQTRNSISLACSITSSQQEVLDEFHNEHDSSSCSHTEDSPDGDSLYQLPSGNFTLSSAFFAESAPRGSATWPEEQLPSNSTTQSTLRKSQYKFLKASCQNAATHAWGQVIVAAGWDGYIRSFQNYGLPVQV

SEQ ID NO: 55959 - protein, 121 aa, Pyrus pyrifolia
VEACKNSLEKLQLDYLDLYLVHYPMPTRHNAIGKTASLLGEDKVLDIDVTISLQQTWEGMEKTVSLGLVRSIGLSNYDLFLTRDCLAYSKIKPAVSQFETHPYFQRDSLVKFCIKHGVLPT

SEQ ID NO: 55960 - protein, 366 aa, Debaryomyces hansenii CBS767
  misc_feature (297)..(298): Xaa can be any naturally occurring amino acid
  misc_feature (304)..(337): Xaa can be any naturally occurring amino acid
MSCHSKVWMLVVATALVTTGVVEGFHRYMDSRDNVKSPPSTKQITETNKDYSEELIQEQLARNYAFLTEGGMEKVRNQNIVVVGAGGVGSWVTTMLVRSGVGKIRVIDFDQVSLSSLNRHAVANLKDVGISKVECLRNHLLQIAPWIEIDTKNQLWNIDVAEELIFGEDFKPTYVVDCIDNIDTKVDLLTFCHEKKLPVISSGGAACKSDPTRVNISDISKTEEDPLSRSVRIRLKKRGIISSIPVVFSAEKPDPRKAQLMPLTDAEIAKGEVDQLSAIKNFRVRIKPVLGTMPGMXXSTRGPXXXXXXXXXXXXXXXXXXXXXXXXXXXXXXXXXXIIFVKDNFFRRLVGFIDLENNQKYLKKLN

SEQ ID NO: 55961 - protein, 203 aa, Acidobacteria bacterium Ellin345
MRVLTRFMLSAADARQFPAAGAPEIAFLGRSNVGKSSLINAIVGSKIAKTSSTPGRTQTINFFEIRRPGKPRPDWIFADLPGYGYARVPKELTAEWPKFIDPYLHERPTLALCVSIVDVSVPPQKKDLELLNWLRHVGRPFVVVGTKIDRVSGNQLRNNLLKLKEELLVEEVVPFSAKGTTGHNELWKKIFEAAGTDAPATAG

SEQ ID NO: 55962 - protein, 474 aa, Shigella flexneri 2a str. 301
MQHKLLINGERVSGEGEKQPVYNPATGDVLLEIAEVSAEQVDAAVRAADAAFAEWGQTTPKARAECLLKLADVIEENGQVFAELESRNCGKPLHSAFNDEIPAIVDVFRFFAGAARCLNGLAAGEYLEGHTSMIRRDPLGVVASIAPWNYPLMMAAWKLAPALAAGNCVVLKPSEITPLTALKLAELAKDIFPAGVINILFGRGKTVGDPLTGHPKVRMVSLTGSIATGEHIISHTASSIKRTHMELGGKAPVIVFDDADIEAVVEGVRTFGYYNAGQDCTAACRIYAQKGIYDTLVEKLGAAVATLKSGAPDDESTELGPLSSLAHLERVSKAVEEAKATGHIKVITGGEKRKGNGYYYAPTLLAGALQDDAIVQKEVFGPVVSVTPFDNEEQVVNWANDSQYGLASSVWTKDVGRAHRVSARLQYGCTWVNTHFMLVSEMPHGGQKLSGYGKDMSLYGLEDYTVVRHVMVKH

SEQ ID NO: 55963 - protein, 431 aa, Pseudoalteromonas tunicata D2
MTSATQPSNFTELGLIPPLLARLTELEYQQPTPIQAQAIPSVLAGRDLIAGANTGSGKTATFALPMLQQLYLQQQGKTSVATNKGNYVAGLVLVPTRELATQVANSIKSYAAHFNGAIKTVAVFGGVSVNAQMQALRGGSDIVVATPGRLLDLISSNAIKLDKVSTLVLDEADRMLGLGFTEELSQLLALMPAKKQTLLFSATFPLQVQSLTQSLLTNPVEIQVQSSDASTVVQRVFTVNKGAKTELLAHLITEHKWRQALIFVNAKNHCEHLAQKLEKRGISAKVFHGDKGQSARTRVLEEFKAGEIDILIATDIAARGLDIEKLPVVINYNLPRSPADYMHRIGRSGRAGEVGLALSLIDQDDYHHFSIIEKKNKIRLERELVPGFLVVEPSAENMVEKPMAKPEGTGKKKNKNKINPEDDIWAGWRNN

SEQ ID NO: 55964 - protein, 513 aa, Glycine max
YITHHFSLSNRPWTKICYIFVLLAFPILLLFFFRKRKTSKKPGLPPGPRGLPFIGNLYQFDSSTLCLKLYDLSKTYGPIFSLQLGSRPTLVISSPKLAKEVMNTHDLEFCGRPSLISSMKFSYNGLDMAFSPYRDYWRHTRKISIIHFLSLKRVLMFSSTRKYEVTQLVKKITEHASCSKVTNLHELLTCLTSAIVCRTALGRTYEGEGIETSMFHGLLKEAQDLISSTFYTDYIPFVGGVIDKLTGLMGRLENLFKVLDGFYQNVIDEHLDPERKKLTDEEDIIDALLQLKDDPSFSMDLTPAHIKPLMMNIILAGTDTSAAAVVWAMTALMKSPRVMKKAQEEIRNVFGEKDFIGEDDIQKLPYLKAVIKETMRMYPPLPLLIHRETIKKCSIEGYEIPEKTLVYVNAWAVHRDPETWKKPEEFYPERFLDSKIDFRGYDFEFIPFGTGRRICPGINMGIITVELVLANLLYSFDWEMPQGMERKDIDPDMLPGLVQHKKNPLCLVAKKRG

SEQ ID NO: 55965 - protein, 384 aa, Oryza sativa
MSTAGKTITCKAAVAWEAGKPLSIEDIEVAPPKANEVRIQIYYTGVCHTDAYTLSGKDPEGAFPIVLGHEGAGIVESIGEGVTNVKVGDHVVALYTPECKECKFCKSGKTNLCGKIRATQGKGLMPDGTSRFKCKGKDLLHFMGTSTFSQYTVVADISVVAIEHDAPMDRTCLLGCGITTGYGAATITANVQAGDNVAIFGAGCVGLSVVQGAAARKAGKIIVVDVNPSKKEWGEKFGATDFVNPPELGDQSIQDKLIEMTDGGCDYTFDCTGNVGVMRAALEACHKGWGESIVIGVAAAGQEISTRPFQLVTGRVWRGCAFGGVKGRSQLNDLVADYKKGDLKVDEFITHRKTLGEINNAFDTMKQGDCIRAVVDMQKLEPKI

SEQ ID NO: 55966 - protein, 686 aa, Physcomitrella patens subsp. patens
MAFHTACLFTCRKICYCTLGTPAPLRAQSGQNEFLRRTAALQKLVSNPRLMLGGGPEYVEITVPPLPNQPKKNLEEPTIEQLDDSGDDGVTKRAGTRRKATFSIVGPADSSIKGSHSKKLEAAKYASRQHASREASANGWADRERAGMPVRGGSDEEFNEEGHFESLFPQVVCGLCGCGEAIGSDKAGRMLSCQACRKQYHRKCTKYWAEHRDLFNWASWMCGSCRVCEVCLRSGDSNKLMFCKRCDHAYHSSCLHPPLKHVPKGPFVCPKHVRCTSCNTTVPGGGVSSKWFLSYSLCDACGRLFTRGKYCPICLKVYRDSEPAPMVCCDVCEHWVHCECDGISDEKYQEFQVNSQLRYKCASCRGECYKVADLDDAAVEIWRRKDIRDATQIAEIRAAAGLPSPEEILKAYPSSDEEDRERDSSEVEEASKRSAKKKVKKAPLGTESLTKNNKTPKRAAIKDGSKPKSTPSKVDGVSDKPILTLSAVDSKKTTILTKKFKKGSTSGDGLEKTLPNKDLVSTLSAEDKDADEMKKMVPPPDVHIGLESLKDKKRKSDSSKEKSSSTKRRRSSKAGDLDSAKNLTIQDDSGKAKKVKISNGQEVAGREDKSEVPTTSTEIPLAQEGFHVFNGKSTRERASIKVARIEADLDSKLARIEGTRMHTKRASCRFSLSMTLVNVNLRNVRE

SEQ ID NO: 55967 - protein, 150 aa, Aspergillus fumigatus
  misc_feature (37)..(37): Xaa can be any naturally occurring amino acid
ACGLLTVVLSAANSNVYSGSRILIGLAQEGFAPRLFXRTSKKGVPYYSVAFTSAFGLLGFMNVSNAGSTVFNWFLNISGVAGFITWASLNACHIAFMRALKARNISRDLLPYKALWQPWYAYYGLFFNVLIILTQGFTAWIPTFSVTVVG

SEQ ID NO: 55968 - protein, 217 aa, Haemophilus ducreyi 35000HP
MPETIENQACIVIAIAGASASGKSLIASTIYKELKEELDSNDIDIISEDAYYKDQTHLTMDEREQTNYDHPDSMVHYLLVEHLRQLKQGKPIQIPEYDYAKHNRKTSSKHFEPKKIIILEGILLLTHETIRNEINVSIFVDAPLDICFIRRLQRDLIERGRSMDSVISQCRKTVRPMFLKFIEPSKQYADIIIPKGGKNRIAIDILKAQIKQLLSKK

SEQ ID NO: 55969 - protein, 521 aa, Aspergillus nidulans FGSC A4
MVTLSRVSQESSSHRQRREIRDISVQTTEYAGVYGTKYAAEELPLYVMNDNGMPPDVAEQMIRDELSLDGNPLLNMASFVTTYMEPQVETLMAAAMRKNFIDFEQYPQSARMQTRCVNMIADLFNAPTNQESKEGTEHGESEGAEGAMGTSTVGSSEAIMLALLAMKKTWHKKRSDAGKDTSHPNIIMNSAVQVCWEKAARYFDVEERYCYCTDDRYVIDPVQAVELVDENTIGICAIMGTTYTGHYEDVKAINDLLVQRNIDCPIHVDAASGGFVAPFICPELVWDFRLEKVVSINVSGHKYGLVYPGVGWIFWRSPEYLPRELVFNINYLGSEQATFTLNFSKGASHIIGQYYQLIRLGRNGYKAIMQNLVQVSQNLARGLSDLGLLILSDNTGNGSGGVPLVAFRLPDDESRLFDEFAVSAVLRRRGWVVPAYTMAPRSNNLKLMRIVVREDFTAHRCGILIQDIKMAIEWLEEMDETTIQRYTTYLAQHGTRLPNAHSFYKDEHSLHGKTGKTHAVC

SEQ ID NO: 55970 - protein, 236 aa, Prochlorococcus marinus str. NATL1A
MDLQNQMKKAVAQAAVDQIQNGMILGLGSGSTAALMIEALAIKIKSGEIKDVVGVTTSFQGEVLASELGIPLKSLSSVSEIDLAIDGADEVDPKFQLIKGGGACHVQEKLVAALAKKFIVVVDSTKLVEKLNLDFKLPVEVLPSAWKQVQKTLINLGGEGNLRMAQKKAGPIVTDQGNLILDLTFRNGIDQPELLETQINNIPGVLENGLFVNLTDEVLVGKVESDVVGVESLKKI

SEQ ID NO: 55971 - protein, 284 aa, Vitis vinifera
  misc_feature (282)..(282): Xaa can be any naturally occurring amino acid
MTKDVEVAEHGSFSAKDYHDPPPAPLFDSVELTKWSFYRALIAEFIATLLFLYITVLTVIGYKSQTAGGDPCGGVGILGIAWSFGGMIFILVYCTAGISGGHINPAVTFGLFLARKVSLIRAILYMVAQCLGAICGVGLVKAFQSAYYDRYGGGANELSTGYSKGTGLGAEIIGTFVLVYTVFSATDPKRSARDSHVPVLAPLPIGFAVFMVHLATIPITGTGINPARSLGAAVIYNNEKAWDDQWIFWVGPFIGAAIAAFYHQFILRAGAVKALGSFRSTXHV

SEQ ID NO: 55972 - protein, 136 aa, Euryops virgineus
LDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCA

SEQ ID NO: 55973 - protein, 440 aa, Mycobacterium tuberculosis H37Rv
MRRPLDPRDIPDELRRRLGLLDAVVIGLGSMIGAGIFAALAPAAYAAGSGLLLGLAVAAVVAYCNAISSARLAARYPASGGTYVYGRMRLGDFWGYLAGWGFVVGKTASCAAMALTVGFYVWPAQAHAVAVAVVVALTAVNYAGIQKSAWLTRSIVAVVLVVLTAVVVAAYGSGAADPARLDIGVDAHVWGMLQAAGLLFFAFAGYARIATLGEEVRDPARTIPRAIPLALGITLAVYALVAVAVIAVLGPQRLARAAAPLSEAMRVAGVNWLIPVVQIGAAVAALGSLLALILGVSRTTLAMARDRHLPRWLAAVHPRFKVPFRAELVVGAVVAALAATADIRGAIGFSSFGVLVYYAIANASALTLGLDEGRPRRLIPLVGLIGCVVLAFALPLSSVAAGAAVLGVGVAAYGVRRIITRRARQTDSGDTQRSGHPSAT

SEQ ID NO: 55974 - protein, 492 aa, Herminiimonas arsenicoxydans
MLRAANNPFQMKDPSLLRNLAYIDGTWAGAATNFDISNPADGSIIGSAPNMGAEETETAIRAAQSAFPAWAAKTGKERAIIMRQWFDLIIANVDDLAILMTAEQGKPLIESRGEVIYGASFIEWFSEEAKRVSGDVMASTWNDKRTLTIKQPIGICAAITPWNFPIAMITRKVAPAVAAGCTIVIKPAEQTPLSALAIAELAHRAGLPAGVINVITADAENSIVVGKTLCASPIVRHVSFTGSTPVGRILMEQCAPTVKKIALELGGHAPFIVFDDADLDAAVTGALQSKYRNAGQTCVCTNRFYVHESIYDVFVQKLAAGAARIKVGNGFEQGVLQGPLIDDQAIRKVEQHVSDAVKKGASVMTGGKKHALGGHFYEPTVLSNITDDMSIMHEETFGPVAAIVKFKTEDEAIAAANNTDFGLASYFYARDISRVWRVAEKLEYGMVGINTGLISNEVAPFGGVKQSGLGREGSKYGIDEYLEIKYLCMGGI

SEQ ID NO: 55975 - protein, 260 aa, Mycobacterium tuberculosis H37Rv
MSGRLIGKVALVSGGARGMGASHVRAMVAEGAKVVFGDILDEEGKAVAAELADAARYVHLDVTQPAQWTAAVDTAVTAFGGLHVLVNNAGILNIGTIEDYALTEWQRILDVNLTGVFLGIRAVVKPMKEAGRGSIINISSIEGLAGTVACHGYTATKFAVRGLTKSTALELGPSGIRVNSIHPGLVKTPMTDWVPEDIFQTALGRAAEPVEVSNLVVYLASDESSYSTGAEFVVDGGTVAGLAHNDFGAVEVSSQPEWVT

SEQ ID NO: 55976 - protein, 491 aa, Roseovarius nubinhibens ISM
MMTDTNLKSLLKDPSLLAEKSYVNGEWIDGEGGTFDVTNPARGDVIAQVTDLSRAQVSKAIDAAVTAQKDWASWTGKERAAVLRKWFDLMMENADDLATILTAEQGKPLAEAKGEIAYGASFFEFFGEEAKRIYGETIPGHQRDKRITVIKQPIGVAASITPWNFPNAMITRKAAPALAAGCAFVGRPAAETPLSATAMAVLAERAGVPAGVFNIVTSSRSSEIGKEFCENPGIRKLTFTGSTEVGRILLRQAADQVMKCSMELGGNAPFIVFDDADLDAAVEGAIMCKFRNNGQTCVCANRIYVQSGVYDAFSKKLAEAVSKLKIGDGLDDGTQLGPLINSDAITKVQEHVADAKSKGAEVILGGGEPMEGEGYFLPPTIITGATQDMAVATDETFGPLAPLFKFDDVDDVIAMANDTIFGLASYFYAKDLSRVYKVAEALEYGIVGVNTGIISTEVAPFGGVKQSGLGREGSHHGIEDYLEMKYICMSV

SEQ ID NO: 55977 - protein, 779 aa, Oryza sativa
MASRSPTNKQISSEDRVRGARGKRHHHSSDEWSMEHAEEHEHGRGGGERDDAAEPEAEQPELEQEELSDSESGAESIEISDLKKRMWKDQMLLMKLEGGRPGGGGGRGGGGLAAAGAGTSSEGQLEEETPEARCRRKAMLRAQDGVLRHMLKMMEACNARGFVYGVIDEAGQPMSGSSDSLRGWWKDNVSFDRAGPMALIGPAAAGDSPQAGGGGLHRLQDIQDSTLGSVLSALIQHCEPPQRSFPLERGLAPPWWPTGEEPWWGTQGETQAHQGAPPYRKPHDLKKAWKVSLLSAVIKHMSPRFDQMRKLVWQSKRLQQKMSAKESDTWSKVIRQEEALDRRLKTSLHITLLDADGGEEDDSDGLEDVVRGAAAQDKRKREYTRSGSGSSSGNSGGGKFPRGGSGGADHHQLAVMLPELAAAADQEGRSPINELMKLYYSCLQQEEGAADGGEAGGEGCDVAAAALAVPPEVLAGVDEVAQDVLFDLIGSYPEVDDILVVHAPPSDLDTMRCGRARLSNHFLNAYARLFPSRIPVRAQGVRRNALPESLVVTASPGAPCPDHPVLVSGDGEVFDPKTGIWSELPEMPFMKAQVLPTAFLADVLKPIATGMASYKGKLYVPQSLYSWPFFFDIGGEIYDPELNSWETMADGLGDGWPARQAGTKLGIVVNEELYTLEPSSSLDSGQIKRYDSEQDTWKTIVPQVPVHDFTDAEAPFLLAGLHGKVHVITKEANNNLQVMQAVLQNNIENSPSEENIIWNILASKNFGSAELVSCQVLDV

SEQ ID NO: 55978 - protein, 89 aa, Vitis vinifera
MKQLAFPTLLLVSLLLSSIFLQPTVAVKGFCDSKCGVRCANAGVYDRCVKYCGICCQECKCVPSGTYGNKSECPCYRDKLNSKGKPKCP

SEQ ID NO: 55979 - protein, 175 aa, Triticum aestivum
MPPAVMASSATTVAPFQGLKSTAGFPVSRRSGSAGLRSVSNGGRIRSMQVCPIEGIKKFETLSYFPPLSTEALLNQVDYLIRSKWVPSLEFTKVGFVFREHNSSPGYYAGRYWTMWKLPMFGCTDATQVLNEVEEVKKEYPDAYVRVIGFDNMRQVQCVSSIPFRPPGWEESAKP

SEQ ID NO: 55980 - protein, 86 aa, Zea mays
LVQGVNVKAKGLGFIEDLVELLGHYSPIPVIYVGGVSPRAALKGIKKPAKSGVNVPIGSALNIFGGDFPSKNVALWPRNQSMVGQV

SEQ ID NO: 55981 - protein, 268 aa, Pisum sativum
MAESSSTKTGLRLAGKVAIVTGGASGIGKETAHLFANQAARMVVIADIQDELGIQVAESIGTDRCTFIHCDIRIEDDVKNLVQSTVDTYGQIDIIHCNAGIISPSDQTLLELDVSQANGVFATNAIGTALCVKHAARAMVDGKVRGSIVCTASISASYGVTTGTDYSMSKHAVLGLMRSASVQLAKYGIRVNSVSPNGLATPLTEKLLDADAKTVEEIFSKFSMLKGVVLRTNHVADAVLFLASNESDFVTGLDLRVDGNYITSDAVI

SEQ ID NO: 55982 - protein, 411 aa, Debaryomyces hansenii CBS767
MDSRDNVKSPPSTKQITETNKDYSEELIQEQLARNYASLTEGGMEKVRNQNIVVVGAGGVGSWVTTMLVRSGVGKIRVIDFDQVSLSSLNRHAVANLKDVGISKVECLRNHLLQIAPWIEIDTKNQLWNIDVAEELIFGEDFKPTYVVDCIDNIDTKVDLLTFCHEKKLPVISSGGAACKSDPTRVNISDISKTEEDPLSRSVRIRLKKRGIISSIPVVFSAEKPDPRKAQLMPLTDAEIAKGEVDQLSAIKNFRVRILPVLGTMPGMFGLTLATHLITSISGYPVEPIEGKNRYKVYDGILQSLAGQQSRIGKLDQRVPIALNDVNYILEEVFHGKSPISNYSTRLTLSRWDPRKELSYQNVVIMTKEEQKLHEDRVLKGGELLTEVYTKEILDRVEQRFSEERFYSQFR

SEQ ID NO: 55983 - protein, 576 aa, Saccharomyces cerevisiae
MSQNIQIGTRKRSRANMNNSTTTGPANNTSSNKTFLDNFEETRTNKLLDEMFARQNSFLTDNLRNSLDLNQADNPLRPRQHQHQLFLDNENAIELDEEPRIINTTINNSNNHNSSRVDEDADDDIIFIKEQPIQFSSPLILPSSSSINNNNNIVTSNNPGCGTAATSNSTYITTPKKFKKQRTISLPQLPLSKLSYQSNYFNVPDQTNAIVPRVTQTENELLHLTGSCAKTLEGNKAVNLTIAHSTSPFSNPPAQIASLPQSNLKKQIGSSLRKFTSNGSSESASSNKSNFKTDKDGHYVYQENDIFGSGGRFVVKDLLGQGTFGKVLKCIDNKYEPNYVAVKVIRAVDRYREAAKTELRILQTILNNDPQGQFQCLLLRECFDYKNHICLVTDLYGRSIYDFMCSNGIARFPGSHIQAIARQLIRSVCFLHDLGIIHTDLKPENILICDETHIAQKLPLKTVQSLSKRRREASKGKRKILKNPEIKIIDFGSAIFHYEYHPPVISTRHYRAPEIVLGLGWSFPCDIWSIACVLVELVIGESLYPIHENLEHMAMMQRINGTPFPTDIIDKMFYKS

SEQ ID NO: 55984 - protein, 257 aa, Zea mays
MESRALLHARPAALPARAGLRLPPQLPRPRAVSFSPAAKPALRSPLLASRGPFLPRHDALLGNGFLKQRAVSVGGDVSFRAQAAAAAVPAPQPEESAKKFLGIDVKTLRKIVPLGLMFFCILFNYTILRDTKDVLVVTAKGSSAEIIPFLRTWVNLPMAIGFMLLYPSFQRSLAGGALYTVIFPFIAFFGAFAFVLYPLRNVIHPTALADKLLAALGPSFLGPVAILRIWSFCLFYVMAELWGSVVISVLFWGFANQ

SEQ ID NO: 55985 - protein, 641 aa, Bradyrhizobium sp. BTAi1
MTTFSKTPLLDTIKTPEDLRRLKVEQVRQVADELRQETIDAVSVTGGHFGAGLGVVELTTAIHYVFDTPRDRLIWDVGHQAYPHKILTGRRDRIRTLRTGGGLSGFTKRTESDYDPFGAAHSSTSISAGLGMAVARDLSGGKNNVIAVIGDGAMSAGMAYEAMNNAGAMNSRLIVILNDNDMSIAPPVGAMSAYLSRLYSGKTYRTLRDAAKQLGQHLPKVIANRASRVEEYSRGFMMDGGTLFEELGFYYVGPIDGHNLDHLLPVLKNVRDMETGPILVHVVTQKGKGYPPAEASADKYHAVVKFDVATGTQAKAKPNAPAYQNVFGQSLVKEAEKDDKVVGITAAMPSGTGIDIFAKAFPKRTFDVGIAEQHAVTFAAGLAAEGFKPFCAIYSTFLQRGYDQIVHDVCIQSLPVRFAIDRAGLVGADGATHAGSFDNAYLGCLPNMVIMAASDEAELVHMVATQVAINDRPSSVRYPRGEGRGVEMPEVGVPLPIGKGRMIRQGKQVALLSFGTRLAECEKAADELAAHGLSASIADARFMKPLDEELVLKLAREHEILITIEEGSIGGFGSHVMQYLADQGMLDGGLKMRSMVLPDEFQDHDTPAAMYARAGLDAKGIVRKVFEALGKDYTAEVVKLA

SEQ ID NO: 55986 - protein, 565 aa, Herminiimonas arsenicoxydans
MKNRLFPGMTRRDFLSASGAMALGSMAPLSMALEAKPKSVLATSTKGMVTSPHELATNAGLDVLKSGGNAIEAAIAIAACLNVTYPHFSGFGGDAFMIISDRNGKVRTLSGIGQAPAILPQYSGNAIPVRGPQSMLTTAANVDTLGKAFDISRNELAGGKSWAELLKPAIGFARDGFPVSPSERFWMDFREKEMNALPGVAQSFMINGKAPEIGQLFKQPQLADTLEMLAVRGYRDFYEGKLAERIAQGLKSAGSPLTASDLAKTQARIEPPLRVNYRDGVLLANQPPTQGITTLEIMGILDRFDLKKIPEGSADYYHVVVEAVKRAFIDRNQYVADPEFVNVPSAKLLSKAHLDQLAGKIQMQHALPWPHVFKNGDTVYIGATDAQGNSVSMLQTVYFDWGSGMMAGDTGILWHNRGASFSLKADSLNVLQPGKRPFHTLNPGMYLKNDKPHILYGTQGADGQPQTLATILTRMIDYGMDPLTALSKPRFLLGKTFSDTRDSLKLEKDAGEKVFEELARRGHEMSVIPAQSPLSGHPGAIVIDQKSGTFSGAHDPRSDGRALGV

SEQ ID NO: 55987 - protein, 911 aa, Eremothecium gossypii
MELSSASTVKKKRQLAIFNAYATPLRQDERRLRASYEHGGVVGGHVASNEKVLLFDDFVDLISNSRSFYSKFTDHCFNLNQIPNTVFGCIFFAIDENNKGYLNVNDWFYFNNVLEYDNYHFIILYEFFRKFDAARERAYGPSVKSINYGNRFLSFDELYLDLEQFQATLRLLHSCVRDDFIVNNKLFLDWKQFRWLKWYQFYPRGLLQNGPHITLNSLISIVQNDLKSEKLLLGFHCLSQLDHRTNSMTISKNQLVYLMRLFYSHKIPADIFNSLNMSTLSCAKCDNNHINYNVFRDLFYLIQNFDLLNQIVHRYAEVHKFSDRDVREQHISRKDLLRFMNTEYNKINNIIEFSPAQISLLFSIVTNSKKLNYLNNARQNNPELSYHHRDSEIDSFIHNEYINGNAASSLHNESLEKFNDDFENIIQADAGDTKQQISSTDWRSVFSWSSFLSSFEWLHFKKRKSVQTNGLSDEYVNEALTLEDIMKIVNPNYLNDLVHHMELRRIESESRSSNLYFYPIFDSIYNFTLGSVAGCIGAMVVYPIDMVKTRMQAQRDFSKYKNSIDCLLKILSKEGVRGLYSGLGPQLIGVAPEKAIKLTVNDHMRATLAGRDGKLSLPCEIISGATAGACQVVFTNPLEIVKIRLQVKSDYVADAARNSVNAISVIKNLGLIGLYRGAGACLLRDIPFSAIYFPTYAHIKSNVFNFDPKDSDKRNKLNTWQLLVSGGLAGMPAAFLTTPFDVIKTRLQIDPKKGESVYNGIWDAARTILKEEGIKSFFKGGPARVLRSSPQFGFTLAAYEIFHNLFPAPRYDDSTTHRPTREPVGALAPINKTVSAFFPDQLEPHVGNNKWASRLYGPNIDPYSSSFLNYYYKSCQVAKAFMDLDYNFAHFDFNTYQQFHDELNAMKNKKH

SEQ ID NO: 55988 - protein, 199 aa, unidentified eubacterium SCB49
MKIKAAEFIMSNSEVAKCPKDRLPEYAFIGRSNVGKSSLINMLVDQKNMAKTSGRPGKTQLINHFLINKNWFLVDLPGYGYARVSKKAKKTFQRFITDYFEKREQLILAFVLVDCRHEPQPIDQEFMQYLGENGIPFHIIFTKADKLKPGALERNLKAYETKMLETWEEMPRSFVTSASKYEGRDELLNYIGELNEADF

SEQ ID NO: 55989 - protein, 310 aa, Methanocaldococcus jannaschii DSM 2661
MFDPKKFIDEAVEEIKQQISDRKAIIALSGGVDSSVAAVLTHKAIGDKLTAVFVDTGLMRKGEREEVEKTFRDKLGLNLIVVDAKDRFLNALKGVTDPEEKRKIIGKLFIDVFEEIAEDIKAEVLVQGTIAPDWIETQGKIKSHHNVALPHGMVLEVVEPLRELYKDEVRLLAKELGLPDSIVYRQPFPGPGLAVRVLGEVTEEKLNICREANAIVEEEVKKANLDKDLWQYFAVVLDCKATGVKGDEREYNWIVALRMVKSLDAMTAHVPEIPFDLLKRISKRITSEIPNVARVVFDITDKPPATIEFE

SEQ ID NO: 55990 - protein, 384 aa, Gloeobacter violaceus PCC 7421
MAQRTVARLVLEDGTAFEGWSFGAPGTSVGEVVFNTGMTGYQEVLTDPSYCGQIVAFTYPELGNTGVNLEDAESDRPQVRGVIAHNVAGRPSSWRATQSLGDYLKDHAIVAIASIDTRALTRHLRSRGAMNGAISTELSTEALLARLQEAPAMQGLDLVPRVTTAAPYTWSESTAADWLATRAAAGERPLRVVAIDFGIKHNILRRLASYGCEVIVVPADTGVEAILAYRPDGIFLSNGPGDPAAVRYGIETVQGLLKSRKPMFGICLGHQILALALGGETYKLKFGHRGLNQPASFNNRVEITSQNHGFAVDDASLAGANIEITHLNLNDRTVEGLRHRELPVFSVQYHPEASPGPHDADYLFAQFVDLMREKPADAASLVEL

SEQ ID NO: 55991 - protein, 136 aa, Euryops virgineus
LDAAGKTTILYKLKLGEIVTTIPTIGFNVETVEYKNISFTVWDVGGLDKIRPLWRHYFQNTQGLIFVVDSNDRDRVVEARDELHRMLNEDELRDAVLLVFANKQDLPNAMNAAEITDKLGLHSLRQRHWYIQSTCA

SEQ ID NO: 55992 - protein, 154 aa, Vitis vinifera
MAASLQLPMASSIPSSSSPSTTRPIFKTHCSMKPTCSAKIPMPPINPKDPFLSKLASVAATSPERLLQRPSGSDSLPFLDLFDSPKLMATPAQAIIHISPDPDENLNVERSVSYNEHRPRRPPPDLPSLLLHGRIVYIGMPVFFLFFKHVDNIE

SEQ ID NO: 55993 - protein, 602 aa, Pseudomonas fluorescens PfO-1
MNEQQILLAFGGIGAAALGCQWLAWRLKLPAILFLLLTGILAGPVLGWLDPQEMFGPLLMPLVSLAVALILFEGSLTLHLSEWREIGSVVHRLVTLGALSTWIVIAVATHWLLGFDWLLAILFGSLTLVTGPTVIVPMLRVVRPKASIANILRWEGIVIDPIGALLAVVVYSFIIARAEGHGLEQSLLTFGGVIVCGSAFGVAGGWLLGTIIRRQWLPEYLHNLASLAAVLGIFIAANQVMHESGLLAVTLMGMWLANMKGVDVRHILHFKENLSVLLISGLFILLAARLDLNALIGLGPLVLILLLVIQLIARPLNVVLSTAGSSLSWRERALLCWIAPRGIVAAAVSAIFAIRLDEAGHEGALLLVPLTFAVIIGTVVLQSATARPLARLLKVAEPAPSGFLIVGANGPARLLGKSLQQLGSRVLLTDSSWENIRAARMEGLPTYFGNPASQHADAHLDLVGLGHLLALSPSGELNTLAAMRFRHDFGHQRLFGLASGQESRRSDKHRASLEHRGNQLGNEALTYARLASQLGQGADLYSTTLTDGFGWDDYRALHGNRATLLFMRDDSGWVHVVSPETVLKPGPGWTLVALIQPESVNA

SEQ ID NO: 55994 - protein, 163 aa, Gloeobacter violaceus PCC 7421
MAVGGFEMRIGNGYDFHRLVEGRRLILGGVEIPYRLGLLGHSDADLLTHAITDALLGAACLGDIGRHFPPGDPQWQDVSSLLLLSKVLELVRGRGLRLSNVDAVVVAERPKLAPHIPAIRQSLAGALGLPLDRLSVKATTNEGLGPVGEGLAMACHAVVLLEE

SEQ ID NO: 55995 - protein, 136 aa, Euryops virgineus
LDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITVKLGLHSLRQRHWYIQSTCA

SEQ ID NO: 55996 - protein, 233 aa, Gloeobacter violaceus PCC 7421
MAKPVVVAPSILSADFARLGEEIHAIDEAGADWIHVDVMDGRFVPNITIGPLIVKAIRPVTQKVLDVHLMIVEPEKYIADFAKAGADIITVHCEHNSTVHLHRALSQIKELGKQAGVSLNPSTPLSLIEYVLDLCDLVLVMSVNPGFGGQSFIPQVLPKIARLKSMCEERGLDPWIEVDGGLKPSNTWQVLEVGANAIVSGSGVFGVGPARYAEAIEGVRASHRPAVEVAAQV

SEQ ID NO: 55997 - protein, 464 aa, Roseovarius nubinhibens ISM
MASQSFDLIVIGAGPGGYVAAIRGAQLGLKVAVVEREHMGGICLNWGCIPTKALLRSSEVFHLMHRAKEFGLSAEKIDYDIDAVVKRSRGVAKQLSGGVAHLLKKNKVTAIMGEATIPAKGKVTVKTEKGSEELTAKHIVLATGARARELPGLEADGDLVWTYKHALMPPRMPKKLLVIGSGAIGIEFASFYNTLGADTTVVEVMDRVLPVEDAEISAFAKKQFEKQGMTIMEKSTVKKLDRAKGKVTAHIERGGKTETLEFDTVISAVGIVGNTEGLGLEALGVEVDRTHVVVDEYCRTKVEGLYAIGDIAGAPWLAHKASHEGVMVAELIAGGHPHPVRPESIAGCTYCHPQVASVGLTEAKAKEAGYDIKVGRFPFIGNGKAIALGEPEGMVKTVFDAKTGELLGAHMVGAEVTELIQGYVVGRQLETTEEDLMNTVFPHPTLSEMMHESVLDAYGRAIHF

SEQ ID NO: 55998 - protein, 231 aa, Zea mays
SDHCHSARYYLKDAVLDGGIPFNKAYGMTAFEYHGTDARFNRVFNEGMKNHSVIITKKLLDFYTGFEGVSTLVDVGGGVGATLHAITSRHPHISGVNFDLPHVISEAPPFPGVRHVGGDMFASVPAGDAILMKWILHDWSDAHCATLLKNCYDALPENGKVIVVECVLPVNTEATPKAQGVFHVDMIMLAHNPGGKERYEREFRELAKGAGFSGFKATYIYANAWAIEFIK

SEQ ID NO: 55999 - protein, 762 aa, Vitis vinifera
MKGLGFLLTVALTLLGFCHVFVAAVERNDEERRTYIVHMATSQMPESFQERAHWYDSSLKSVSESAEMLYKYSNVIHGFSTRLTAEEARSLQGRPGILSILEEVRYELHTTRTPEFLGLDKSADLFPESGSASEVIIGVLDTGIWPESKSFDDTGLGPIPSSWKGECETGTNFTSSSCNRKLIGARFFSKGYEATLGPIDESKESKSPRDDDGHGTHTATTAAGSVVEGASLFGFAEGTARGMATRARIAAYKVCWIGGCFSTDILAALDKAVEDNVNILSLSLGGGMSDYYRDSVAMGAFGAMEKGILVSCSAGNSGPSPYSLSNVAPWITTVGAGTLDRDFPAFVSLGNGKNYSGVSLYRGDPLPGTLLPFVYAGNASNAPNGNLCMTNTLIPEKVAGKMVMCDRGVNPRVQKGSVVKAAGGIGMVLANTGTNGEELVADAHLLPATAVGQKSGDAIKSYLFSDHDATVTILFEGTKVGIQPSPVVAAFSSRGPNSITPDILKPDLIAPGVNILAGWSGAVGPTGLPTDKRHVDFNIISGTSMSCPHISGLAGLLKAAHPEWSPAAIRSALMTTAYTNYKSGQKIQDVATGKPSTAFDHGAGHVDPVSALNPGLIYDLTVDDYLNFLCAINYSAPQISILAKRNFTCDTDKKYSVADLNYPSFAVPLQTPLGSSTVVKHTRTLTNVGSPSTYKVSIFSESESVKISVEPGSLSFSELNEKKSFKVTFTATSMPSNTNIFGRIEWSDGKHVVGSPIVVSWT

SEQ ID NO: 56000 - protein, 408 aa, Bacteroides fragilis YCH46
MDACFMGLGYIGLPTAIIAAKHGVKVTGVDINPKVVEMTNEGKLHIIEPGMQDILEEVVANGMLTASTIPTVSDAYFMVVPTPFKGDHEPDISYVEAATRAIIPFLKEGDLYVIESTSPVGTTGKMADLIFSLRPELRCKIYIAYCPERVLPGNVIYELVHNDRVIGGIDERSTDKAIEFYSQFVKGKLHKTDCKTAEMCKLTENSSRDVQIAFANELSLICDKAGINVWELIDLANKHPRVNILQPSCGVGGHCIAVDPYFITADFPIESQIIAKAREINNYKAFWCAEKVENEMLKFEIKYGRKPIIAMMGLAFKPDIDDLREAPAKYITTKVMQSCNNADILVVEPNVVEHKVFKLTNYKDAYAKADIIVFLVAHSVFKTLLYDDNKVILDFCGIYKKQLSRSPL

SEQ ID NO: 56001 - protein, 148 aa, Nicotiana tabacum
MEQTFIMIKPDGVQRGLVGEIIGRFEKKGFSLKGLKLITVDRAFAEKHYSDLSAKPFFNGLVDYIISGPVVAMVWEGKGVVTTGRKIIGATNPLESAPGTIRGDYAIDIGRNVIHGSDAVESARKEIALWFPEGVAEWQSSLHSWIYE

SEQ ID NO: 56002 - protein, 250 aa, Brassica napus
LEEKKKYPMEPGTVQGYGQAFIFSEDQKLDWCNMFALGVHPPSIRNPKLWPSKPATRPESLKGYSKEMRKLCKRLLTYIAISLGLKKERFEEMFGEAVQAVRMNYYPPCSSPDLVLGLSPHSDGSALTVLQQSKDSCVGLQILKDNTWVPVLPLPNALVINIGDTVEVLFNRNYKSVEHRAVTNRERERLTIVTFYAPNYEVKIEPMGELVDDETNPCKYRSYNHGDYSYHYVSNKLQGKKSLDFAKILN

SEQ ID NO: 56003 - protein, 479 aa, Shigella flexneri 2a str. 301
MSVPVQHPMYIDGQFVTWRGDAWIDVVNPATEAVISRIPDGQAEDARKAIDAAERAQPEWEALPAIERASWLCKISAGIRERASEISALIVEEGGKIQQLAEVEVAFTADYIDYMAEWARRYEGEIIQSDRPGENILLFKRALGVTTGILPWNFPFFLIARKMAPALLTGNTIVIKPSEFTPNNAIAFAKIVDEIGLPRGVFNLVLGRGETVGQELAGNPKVAMVSMTGSVSAGEKIMATAAKNITKVCLELGGKAPAIVMDDADLELAVKAIVDSRVINSGQVCNCAERVYVQKGIYDQFVNLLGEALQAVQFGNPAERNDIAMGPLINAAALERVEQKVARAVEEGARVALGGKAVEGKGYYYPPTLLLDVRQEMSIMHEETFGPVLPVVAFDTLEDAISMANDSDYGLTSSIYTQNLNVAMKAIKGLKFGETYINRENFEAMQGFHAGWRKSGIGGADGKHGLHEYLQTQVVYLQS

SEQ ID NO: 56004 - protein, 278 aa, Brodoa intestiniformis
VEHGDVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEIISNASCTTNCLAPLAKVMHDNFTIIEGLMTTIHSYTATQKTVDGPSSKDWRGGRTAAQNIIPSSTGAAKAVGKVIPSLNGKLTGMSMRVPTSNVSVVDLTCRVEKSVTYDQIKETMKKASEGELKGIMAYSEDALVSTDLNGDNHSCIFDATAG

SEQ ID NO: 56005 - protein, 428 aa, Arabidopsis thaliana
MAGAASALFLLDIKGRVLVWRDYRGDVSAAQAERFFTKLIEKEGDSQSNDPVAYDNGVTYMFVQHSNVYLMIASRQNCNAASLLFFLHRVVDVFKHYFEELEEESLRDNFVVVYELLDEMMDFGYPQYTEARILSEFIKTDAYRMEVTQRPPMAVTNAVSWRSEGIQYKKNEVFLDVIENVNILVNSNGQIVRSDVVGALKMRTYLTGMPECKLGLNDRVLLEAQGRATKGKAIDLEDIKFHQCVRLARFENDRTISFIPPDGAFDLMTYRLSTQVKPLIWVEAQIESHSRSRVEMLIKARSQFKERSTATNVEIELPVPTDASNPTVRTSLGSASYAPEKDALVWKIKSFPGNKEYMLRAEFHLPSITAEEATPERKAPIRVKFEIPYFTVSGIQVRYLKIIEKSGYQALPWVRYITMAGEYELRLV

SEQ ID NO: 56006 - protein, 278 aa, Almbornia azaniensis
VEHGEVKVVAVNDPFIEPHYAAYMLKYDSQHGQFKGTIEVKGSDLIVNGQTVKFYTEKDPANIPWKDTGAYYIVESTGVFTTTEKAKAHLKGGAKKVVISAPSADAAMFVMGVNEKEYKSDIEIISNASCTTNCLAPLAKVMNDNFTIIEGLMTTIHSYTATQKTVDGPSSKDWRGGRTAAQNIIPSSTGAAKAVGKVIPSLNGKLTGMSMRVPTSNVSVVDLTCRLEKSVSYDQIKETMKKASEGELKGIMAYSEDALVSTDLNGDNHSCIFDATAG

SEQ ID NO: 56007 - protein, 544 aa, Zea mays
  misc_feature (298)..(298): Xaa can be any naturally occurring amino acid
  misc_feature (303)..(303): Xaa can be any naturally occurring amino acid
  misc_feature (311)..(311): Xaa can be any naturally occurring amino acid
  misc_feature (334)..(334): Xaa can be any naturally occurring amino acid
  misc_feature (348)..(348): Xaa can be any naturally occurring amino acid
  misc_feature (365)..(365): Xaa can be any naturally occurring amino acid
KLGTRKLGPLEGYSRAAASVAAHEQATLACQELELEGLKAGVEAVKSREESPEEKEAWWLLSRAVVNYCGSAVGTVAANDPSTSQMLNYDQVFIRDFVPSAIAFLLKGESDIVKNFLLHTLQLQSWEKTVDCYSPGQGLMPASFKVRSVPLDGNSEAFEEVLDPDFGESAIGRVAPVDSGLWWIILLRAYGKITGDYALQERVDVQTGIRLILNLCLSDGFDMFPTLLVTDGSCMIDRRMGIHGHPLEIQALFYSALRCPREMIGGNRMESKKLDPVLFNNRAPVLLSFHIQGSYYWXVDMKXKINEIYRXYRLEEYSHDAINKFNIYPEQIPXSGLADWIPVKGGYXLIGNLQPAHMDFRFFSXLGNLWAIVSSLATQRQAEGILNLIEAKWDDIVANMPLKICYPALEYEEWRIITGSDPKNTPWSYHNGGSWPTLLWQFTLACIKMGRRDLARRAVEVAEKRLSDDKWPEYYDTRTGRFIGKQSRLYQTWSIAGYLSSKMLLDCPEMASILVCDEDFELLEGCASSLNKNARTKCSRRAAK

SEQ ID NO: 56008 - protein, 252 aa, Bradyrhizobium sp. BTAi1
MLHRLGVDAPILVGAERASDGFAQSATDIHGLDGLGNVIGEVRPDEQFDSLSESIESPLERARWLNEDVHILSIGPATNIPSIARMLGAERISGITMMTGAIFDKGNITEDAEFNAYNDPIALANILHSGIPITIVPLDICRKLIFRREDLTSLSTFGAAAPMLSEAHKFYMASYEQAEGISGCFPHDTIALLSMLYPSKFNFWRIPFDVDSSTDHRGQLRFDINGAYHARFCLGGDLRWVRQFMRSWSILA

SEQ ID NO: 56009 - protein, 276 aa, Pseudomonas aeruginosa
MGSSHHHHHHSSGLVPRGSHMHPYFSLAGRIALVTGGSRGIGQMIAQGLLEAGARVFICARDAEACADTATRLSAYGDCQAIPADLSSEAGARRLAQALGELSARLDILVNNAGTSWGAALESYPVSGWEKVMQLNVTSVFSCIQQLLPLLRRSASAENPARVINIGSVAGISAMGEQAYAYGPSKAALHQLSRMLAKELVGEHINVNVIAPGRFPSRMTRHIANDPQALEADSASIPMGRWGRPEEMAALAISLAGTAGAYMTGNVIPIDGGFHL

SEQ ID NO: 56010 - protein, 599 aa, Oryza sativa
  misc_feature (88)..(88): Xaa can be any naturally occurring amino acid
MGTYKCCLIFKRRFRWNDAPPPDDVRALFANHSAGGGPHMAADGLRAYLQATGTRTATWTWSGWWSRSGSCRGAAGASRGWGGHSHSXTVDDFHRFLFSHELNPPIRHGQGQVHHDMAAPLSHYFIYTGHNSYLTGNQLSSDCSDLPIIRALQRGVRVIELDMWPNSSKDDISILHGRTLTTPVSLLKCLLSIKQHAFEASPYPVIITLEDHLTPDLQDKAAKMVLEVFGDILYYPDKDHLKEFPSPQDLKGRVLLSTKPPREYLQAKDGNAATIKEDAKAAATDDAAWGKEVPDIHSQIHSATKHDQREDDDDTDEDEDDEEEEQKMQQHLAPQYKHLITIKAGKPKGTLLDALQSDPEKVRRLSLSEQQLAKLADHHGTEIVRFTQRNLLRIYPKGTRVTSSNYNPFLGWVHGAQMVAFNMQGYGRALWLMHGFYKANGGCGYVKKPDFLMQTDPEVFDPKKSLSPKKTLKVKVYMGDGWRMDFTQTHFDQYSPPDFYARVGIAGVPADSVMKRTRAIEDNWVPVWEEDFTFKLTVPEIALLRVEVHEYDMSEKDDFGGQTVLPVSDLIPGIRAVALHDRKGIKLNNVKLLMRFEFE

SEQ ID NO: 56011 - protein, 312 aa, Streptomyces avermitilis MA-4680
MVMRVFVAGGTGVLGRRLVPQLVARGHQVTATTTSAAKLGLVERLGGEAVVMDGLDAVSVGEAVAAARPDVIVHQMTGISMAHAGKPDLKHFDRWSVPTVRLRTEGTDHLLAAAEATGVAHFVAQGYANWNGIREGGWVKTEEDALDLHEGTAAYTAMAALRHVEDAVLKADGAVMRYGAFYGPGATDDQLVLVRKRQFPLVGDGTGYASWVHLDDAASATVLAVEQKTRGVFNIVDDEPAPESEWLPWLAACAGAKPPMRVPRWLARLLAGDVVVTMMTEGRGFSNAKAKRELGWELRYPSWRQGFKEGLS

SEQ ID NO: 56012 - protein, 61 aa, Zea mays
MAAELRLDMRTDGYVRVRDLLKLNLQTFAKVPLKSHTVDEIRETVTSESLLKPILSPDEVS

SEQ ID NO: 56013 - protein, 136 aa, Petasites fragrans
  misc_feature (9)..(9): Xaa can be any naturally occurring amino acid
LDAAGKTPXRYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCA

SEQ ID NO: 56014 - protein, 362 aa, Gloeobacter violaceus PCC 7421
MGGRYKIAVLPGDGIGTEIVQVGVAMLEAAARRFDFAFDFEEAPIGGAAIDATGEPLPAATLELCKASDAVFLGAVGGPQWDTLPSDKRPEKALLGLRAGLGLFANLRPARILPQLVAASALKPEVVEGVDILVVRELTGGLYFGIPKGIFPEKKGGRRGVNTMSYSAFEIERIGRVAFEAARERRGKLCSVDKANVLEVSQLWREVLVGLAPEYPDVELTHMYVDNCAMQLVRRPRQFDTIVTENMFGDILSDEAAMLTGSIGMLPSASLGSGGPGLYEPVHGSAPDIAGQDKANPLAQVLSGAMLLRHSLRQPEAAQAVERAVQTVLEQGYRTGDIAAPGAQIVGCRAMGEQLLAAFERA

SEQ ID NO: 56015 - protein, 548 aa, Alteromonadales bacterium TW-7
MSNRTQLASWQALEQSAAKMKQTHLKTLFAQDGTRFSKFSTQIPGVLFDYSKQLIDNDVFANLVSLAKECDIASWRDKMFSGEKINITEERSVLHTALRNRAHTPLIVDGENVTQAVDNELAKIKVFVEKVRSGQWLGYTGKAVKDVVSIGVGGSNLGPQMATEALKALADNTLNVHYVSNADGVQIASVLKNIDPETTLFVISSKTFTTSETMTNAKTAVAWFLKTTKDESTIAKHFVAVSTNLEKTAAFGIADENVFTMWDWVGGRFSLWSAIGLPIALYLGYDAFEEILTGAFEVDEHFKNAPLEQNIPLIMALLSVWNTSFLGYTSQAILPYDQSLHMLPAYLQQGEMESNGKHVNFAGKVVPYTTVPIIWGMTGINGQHAFYQCLHQGNVIVPADFIASVKPQINVDKHHDILLSNFFAQTEAMMSGVDAEQVTADLTAKGKSQAQIDELLNHKIHQGNRPTTSMLLDTVDAKTVGRLIALYEHKIFCQGIILDICSFDQWGVELGKGLASKIESELTDDSVNHDHDSSTSGLMAYYKQHRTQ

SEQ ID NO: 56016 - protein, 490 aa, Alteromonadales bacterium TW-7
MLNPFDIIIFGGGGDLALRKLLPAMYRAYQEGNLPEGSRILPTVREESKRAEYIETAHKALQEFLSKGEFNAKDWKAFSTYLVPVVSNVTEADDNWDVLKEILDEHDSTKSRVFYLSLPPAVYGKCCEILSTKNLITPTSRVVVEKPIGYCGESAEAINAKIAEFFEEDQIFRIDHYLGKETVQNLMALRFSNSLFENMWDAKSIDNIQISLSETVGLESRAGFYDKAGALRDMVQNHLLQLLCLVAMEAPNKLNANSIRNEKLKVLEALRPLFDSDVDSNIVRGQYVPGDLNGKIVPGYLEELNEGASKTETFVAIRAHIDNWRWAGVPFYLRTGKRMAKRCAEIVVEYKKVSHNIYEENVGNIEPNRLVIRLQPEETIQLTLMSKRLDNLEMQLEPVTMNIELSQAYSNGFHSDAYKRLMLDAAANNPSLFIHRDEVRQAWKWIDPIVERWQEKGKPALYRAGTWGPDDADELLAENNHVWFNTGDKA

SEQ ID NO: 56017 - protein, 136 aa, Petasites fragrans
  misc_feature (9)..(10): Xaa can be any naturally occurring amino acid
  misc_feature (135)..(135): Xaa can be any naturally occurring amino acid
LDAAGKTPXXYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTXA

SEQ ID NO: 56018 - protein, 511 aa, Coccidioides immitis RS
MSNLAPQALRQASRACSRRLSSSTGLLRPLCGPGTNAALHHSSWRSYVSESKAQTTADAAIKAEQRLFTEQTTLKPNSVQVPGATVTGDTPTSPNAGILKQATVMDQGTRPIYLDMQATTPTDPRVLDAMLPFLTGLYGNPHSRTHAYGWETEKATEQAREYVANLIGADAKEIIFTSGATESNNMSIKGVARFFGRSGKKKHIITTQTEHKCVLDSCRHLQDEGFEVTYLPVQSNGLIRLEDLEAAIRPDTALVSIMTVNNEIGVIQPMKEIGALCRSKKVFFHTDAAQAVGKIPVDVNAWNVDLMSISSHKIYGPKGIGACYVRRRPRVRIDPIISGGGQERGLRSGTLAPHLVVGFGEACRVAKEDMKYDAKHIERLSKKLVDGLLAMEHTTLNGDPERHYPGCVNVSFAYVEGESLLMALKDIALSSGSACTSASLEPSYVLRALGNSDESAHSSIRFGIGRFTTDDEIDYVLNAVQQRVKFLRDLSPLWELVQEGIDLNTIEWSQH

SEQ ID NO: 56019 - protein, 473 aa, Oryza sativa
  misc_feature (29)..(29): Xaa can be any naturally occurring amino acid
MEPRVGNKYRLGRKLGSGSFGEIYLGTNXVQTNEEVAIKLENVKTKHPQLLYESKLYRILQGGTGIPNVKWFGVEGDYNVLVMDLLGPSLEDLFSFCNRKLSLKTVLMLADQMINRVEFVHSKSFLHRDIKPDNFLMGLGKRANQVYMIDFGLAKKYRDTSTHQHIPYRENKNLTGTARYASVNTHLGIEQSRRDDLESLGYVLMYFLRGSLPWQGLKAGTKKQKYEKISERKIATSIEALCRGYPCEFQSYFHYCRSLRFEDLPDYQYLKRLFRDLFIREGFQFDYVFDWTILKYQQSQITSVPPRAIAAAAGQSSGMSPIAINNRLSATEEGRRSGWSDDPTRRQVPPTGINAGSLSKQKSPVRPDMSTSKDALFSSSTMLGRSSGSLRRPVVSSSRELQSSEAEPSRSRTPDASPGTFQRSAPPRRSSQMLDYSDPRHSSSGRHAANKNYESTIRGIQGLNFDANDRIHY

SEQ ID NO: 56020 - protein, 136 aa, Petasites fragrans
  misc_feature (2)..(2): Xaa can be any naturally occurring amino acid
LXAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFTNKQDLPNAMNAAEITDKLGLHSLRQRHWYIQSTCA

SEQ ID NO: 56021 - protein, 291 aa, Streptomyces galilaeus
MKGIILAGGSGTRLHPITVSVSKQLLPVGDKPMIYYPLSVLMLADIREILLICTERDLEQFRRLLGDGSQLGLRIDYAVQNRPAGLADAFVIGADHVGDDDVALVLGDNIFHGHHFYDLLQSNVRDVQGCVLFGYPVEDPERYGVGETDASGQLVSLEEKPLRPRSDLAITGLYLYDNEVVDIAKNLRPSARGELEITDVNRNYLARGRARLVDLGRGFAWLDAGTPESLLQATQYVRTLEERQGVRIACVEEVAVRMGFIDADMCHRLGEQMSQSGYGRYVMAVAREFSG

SEQ ID NO: 56022 - protein, 136 aa, Petasites fragrans
  misc_feature (2)..(2): Xaa can be any naturally occurring amino acid
FXAAGKTTILYKLKLGEIVTTIPTIGFNVETVEYKNISFTVWDVGGQDKIRPLWRHYFQNTQGLIFVVDSNDRDRVVEARDELHRMLNEDELRDAVLPVFANKQDLPNAMNAAEITDKLGLHSLRQRHWYIQSTCA

SEQ ID NO: 56023 - protein, 506 aa, Hordeum vulgare subsp. vulgare
MPPRRPNTGGGGGTSSSAAPAPRKVPLRSLLRAASVACGVQFGWALQLSLLTPYVQELGIPHAFASLVWLCGPLSGLLVQPLVGHLSDRITPANSPLGRRRPFIAAGAASIAFAVLTVGFSADLGRLFGDNVVPGSTRIGAIIVYLVGFWLLDVGNNATQGPCRAFLADLTENDPRRTRIANAYFSLFMALGNILGYATGAYNGWYKIFPFTITGSCGVSCANLNSAFLLDIIILAITTYISVATVQDNPTFGSDEAAPPSSHEEEAFLFELFGSFKYFTMPVWMVLIVTSLTWVGWFLFILFDTDWMGREIYRGSPEIVADTQKYHDGVRMGSFGLMLNSVVLGITSIGMEKLCRKWGAGLVWGVSNIIMALCFVAMLIITYVAQNLDYGPSGAPPTGIVAASLIVFTILGAPLSITYSIPYAMAASRVENLGLGQGLAMGILNLSIVIPQIIVSLGSGPWDQLFGGGNAPSFWVAAAASFVGGLVAILGLPRARLGPKKKTTQR

SEQ ID NO: 56024 - protein, 523 aa, Hordeum vulgare subsp. vulgare
MARGGGNGEVELSVGVGGGGGGAAPRAAEPAVQISLGRLILAGMVAGGVQYGWALQLSLLTPYVQTLGLSHALTSFMWLCGPIAGLVVQPCVGLYSDKCTSRWGRRRPFILTGCVLICLAVIIVGFSADIGAALGDSKEECSLYHGPRWHAAIVYVLGFWLLDFSNNTVQGPARALMADLSAQHGPSAANSIFCSWMALGNILGYSSGSTNNWHKWFPFLRTRACCEACANLKGAFLVAVLFLSLALVITLIFAKEVPYKAIAPLPTKANGQVEVEPTGPLAVFKGFKNLPPGMPSVLLVTGLTWLSWFPFILYDTDWMGREIYHGDPKGTPAEANAFQEGVRAGAFGLLLNSVVLGFSSFLIEPMCKRLGPRVVWVSSNMLVCLSMAAICIISWWATQDLHGYIQHAITASKEIKAVSLALFAFLGIPLAILYSVPFAVTAQLAANKGGGQGLCTGVLNIAIVIPQVIIAVGAGPWDELFGKGNIPAFGMASVFALIGGVVGIFLLPKISRRQFRAVSGGGH

SEQ ID NO: 56025 - protein, 499 aa, Roseovarius nubinhibens ISM
MQELHHFIDGALVKGKSGRFDDVFNPATGEVQYKCPMASVDETTDAIERAAKAQPAWGATNPQKRARVMMKMVALMNRDMDKLAEALSREHGKTIPDAKGDLQRGLEVIEYCVGAPQMLKGEFTDSAGPGIDMYSMRQPLGVVASIMPFNFPAMMPLWHVGPALACGNAVVLKPSERDPSVPLMLAELFVEAGLPAGCFQVVNGDKEAVDTLLDSEIIQGVSFVGSTPIAQYIYSRATANGKRAQCFGGAKNHMIVMPDADMDQAADALVGAGFGAAGERCMAISVAVPVGEETADRLIEKLVPRIEKLKVAPYTAGDDVDLGPVVTAAAKERILGLINSGVEQGAELVVDNRDFKLQGYEDGFFVGPHLFDRVTPDMDIYKQEIFGPVLSTVRAETYEEALKLAMDHEYGNGTAIFTRDGDTARDFASRVNIGMVGINVPIPVPLAYHTFGGWKKSMFGDLNQHGPDSFKFYTRTKTVTSRWPSGIKEGGEFNFKAMD

SEQ ID NO: 56026 - protein, 398 aa, Coprinopsis cinerea okayama7#130
MEYEAETIKVPQMAESISEGTLKSWLKQEGETVAADEEVATIETDKIDVQVNAPKSGKIVKLLASEEDTVTVGQDLFIIEPGEVGETAAPPPAKEPEGTAAPAQETKDASEPADQQVDKKLPAPPAPSQADKTPEVKEQVTKPKEKEDVKKSSKKESEPAPRPAAGSRTETRVKMSRMRLRIAERLKESQNAAASLTTFNEIDMSSLMEMRKKYKDQVLKEHDVKLGFMSAFAKACSLALRDIPAANASIEGDEIVYRDYVDLSVAVATPKGLVTPVLRNAESMNFIEIEREIAALGKKARDGKLTLEDMAGGTFTISNGGVFGSLFGTPIINLPQAAVLGMHAIKDKPVVVDGQIVIRPIMVVALTYDHRLLDGREGVTFLVKVKEYIEDPRKMLLA

SEQ ID NO: 56027 - protein, 253 aa, Debaryomyces hansenii CBS767
MAVHKLIILRHGESEWNHENRFCGWIDIPLSEKGRDEAKFAGHLIQKYNLKPTITYTSKLTRSIQTGDIILEELGRLWCDVVKTWRLNERHYGAFQGRDKNEVYRELGAEKYQYIRRNYNGTPPPMETQYKDDCIDERYEVDDVDIADLPRGESLKLVMERVIPYLRKEIVEGSLIGDNKTVLVVTHGSIVRSVIKYFKGVSDADISKINVPTGVPMVFELDDDCNMVKDYYYLDPELAKKGIEKVSNEGTKK

SEQ ID NO: 56028 - protein, 363 aa, Microcystis aeruginosa PCC 7806
MLKAGIVGLPNVGKSTLFNALVANAKAEAANFPFCTIEPNVGVVSVPDERLEVLAKISNSEKIVPTRIEFVDIAGLVKGASRGEGLGNQFLANIREVDAIVHVVRCFDNDDIIHVSGSVDPARDIEVINLELALADLGQVEKRVERLRKQAKNSKEAAEELVILEKILICLNDGISARKVDLSKEEEELIKNLGLLSRKPVIYAANVSEDDLATGNDWVESVRQIAQEEQAKVVIVSAQVESELVELSEEERKDFLGSLGVEEGGLKSLIQATYELLGLRTYLTTGPQETRAWTIISGMKAPQAAGVIHSDFERGFIRAETVSYQDLVNSGTMSAAKEKGLVRSEGKEYIVQEGDVLLFRFNV

SEQ ID NO: 56029 - protein, 118 aa, Enterobacter aerogenes
DIDNIVESVQQRLSSHQPQPSLLHGDLWSGNCALGPNGPYIFDPACYWGDRECDLAMLPLHPEQPPQIYDGYQSVSPLPAGFLERQPIYQLYTLLNRAILFGGQHLVTAQKALDEALQ

SEQ ID NO: 56030 - protein, 123 aa, Klebsiella pneumoniae
DIDTLVDMVQQRLANHQPQPSLLHGDLWSGNCALGPDGPYIFDPACYWGDRECDLAMLPMHPEQPPQIYDGYQSVSPLPSGFLDRQPIYQLYTLLNRAILFGGQHLVTAAQQALDDVLMEKMR

SEQ ID NO: 56031 - protein, 369 aa, Physcomitrella patens subsp. patens
MDAIRKRASAFRDSVAKQQQAVFKSFSSHGSGDQLIIDEAELQRHHQLERLYTSTKIAKHFQREIVRGVEGIISTGVKQYEVANKLADDCRKYATEGPSSSGVLAKASFHFGSARKQMENERDNMHRFIGTQVAEPLRSMVMGAPLEDARLLTQRYERLRQEAENQALDVGRKQVRSKEGNPDADQKLQLAEQKMGELLSAMAVLGKEAAAAMTSVEAQQQRQTLQRLMSMVEAERAYHLRAAEILEQLQGQMASERQRNETNAPSTGDSYAPPSYDDVKVNDASQHESGSKPSKSLYFLAEVMYPFEPEEGGELGLQVGDYVVVRQVSSTGWSEGETRGRAGWFPSSHVEKRQRIPASKVVDVGLQVA

SEQ ID NO: 56032 - protein, 422 aa, Sinorhizobium meliloti 1021
MTSLTDRKNAAISRGVGMTTQVYADRAENAEIWDKEGNRYIDFAAGIAVVNTGHRHPKVIAAVKAQLDRFTHTCHQVVPYENYVHLAERLNAIVPGDFAKKTIFVTTGAEAVENAVKIARAATGRQAVVAFGGGFHGRTFMGMALTGKVVPYKVGFGAMPADVFHAPFPIELHGVTVEQSLSALKKLFAADVDPARVAAIIIEPVQGEGGFYPVPTAFMKALREVCDQHGILLIADEVQTGFARTGKLFAMEHHGVAPDLTTMAKSLAGGFPLAAVTGRAEIMDAPGPGGLGGTYGGNPLGIAAAHAVLDVIAEENLCERANQLGNRLKQRLAAIREKAPEIVDIRGPGFMNAVEFNDVRTNLPSAEFANKVRLLALEKGLILLTCGVHGNVIRFLAPITIQDEVFAEALDTIEASILEARG

SEQ ID NO: 56033 - protein, 598 aa, Coccidioides immitis RS
MVASHSGNARKPARSFPRTVHPTPSFPEVSLDYDDDPPQKNAWQRLLDSFKRNPHAQVSKLGQIDTNGKLFDLEEAVANIALSPLKRKLKGRHLQMIAIGGSVGTGLFVSSGRSLAIGGPASLVIAFSLVGIMVYSTIHALGEMAVLFPVAGSFSSFSTRFLDPAWGFAMGWNYALQWLVVLPLEIVAASLTVSYWPSHISPAAWVAIFYTMVITINLFGVQGYGEAEFIFSIIKVVAIVGFIILGIVINIGGGDNGSYIGFRYWRDPGAFNHGFKGLCSCFVNAAFAFTGTELVGLAAAEASNPVKALPSAVRQVFWRITLFYIVALIIVGLLVPYTEARLLNPASQADTKASPFVIAIRDAGIQGLDSVMNVVIMLAVLSVGNSAIYGSSRTLAALAEQHQAPRFLAYIDRRGRPLFAIIVASAIGLLSFLAASSKQEEVFIWMMAISGLSSILNWASICLAHIRFRRGWALQGHSLDELAFTSQPGVVGSWIGFIFNILVLMAQFWVGVAPIIQEMDGDPTVAGVKNWFSVYLAAPIVILFYVPYKIRFKTKIVRAKDMDLKTGRRDLHLAHLIAEERAERAEWPLWKKVYRFFC

SEQ ID NO: 56034 - protein, 369 aa, Opitutaceae bacterium TAV2
MSMSTLKFAVLPGDYIGPEVMIEALRVLEHVAKQENLTLSYKTADVGGAGIDNHGKALPESTLATCRDADAILFGSVGGPKWEKLPPAEQPERAALLPLRKAFNLFANIRPGLLYKDLVDASPLKPERIPNGIDIVCIRELTGGIYFGQPKATTTLENGEQQAIDTMVYKTSEIERIAEVAAVTARARGKKICSVDKANVLETSVLWRKTVTAYFASKHPDLALTHMYVDNAAMQLARDPNQFDVLFTENMFGDILSDEMAVICGSLGMLSSASLGTGKNSLGKPFGLYEPAGGTAPDIAGKGLANPCAQILSGALMLRYSFGLDAIATRIEAAVRKTVAVDGHRTGDIAFGRPSIGTKAMADAIIANL

SEQ ID NO: 56035 - protein, 252 aa, Prunus emarginata
AHYKYEADVGNAIAEAIRSGLVKREELFITSKASNHGHVVEACKDSLKKLQLDYLDLYLVHYPLATKHSGVGTTASLLDKNKVLDIDVTVSLESTWHDMEKTVSLGLVRSIGLSNYELFLTRDCLSYAKIKPQVNQFETHPYFQRASLVKFCWKHGVCPMAHTPLGGATANVKSFGSISPLDDPVLQGLAKKYKKSVAQIALRWNIDRNTPVIPKSSKIQRLKENLEVLTFKLEKEDIELINSIDKKSRTTL

SEQ ID NO: 56036 - protein, 136 aa, Petasites fragrans
LDAAGKTTILYKLKLGEIATTIPTIGLNVETVEYKNISFTVWDVGGQDKIRPLWRHYFQSTQGLIFVVDSNDRDRVVEARDELHRMLNEDELRDAVLLVFANKQDLPNAMNAAEITDKLGLHSLRQRHWYILSTCA

SEQ ID NO: 56037 - protein, 261 aa, Streptomyces galilaeus
MPPAAERVAIVTGATSGIGLAVARSLAERGARVFVCARDGDRVAHTVKELREAGHDVDGASCDVRDTARVRAFVQEARDRFGPVDVLVNNAGRSGGGHTAQIPDELWLDVIETNLNSVFRMTREVLTTGGMLERGAGRIVNIASTGGKQGVALGAPYSASKHGVVGFTKALGLELAKTGITVNAVCPGYVETPMAERVRQGYAGAWDITEDEVLERFEAKIPLGRYSTPDEVAGLVGYLLSSTAASITAQAMNVCGGLGNY

SEQ ID NO: 56038 - protein, 494 aa, Pseudomonas fluorescens PfO-1
MSALPDLSAAVADSDAEQLRQLGYTSNFNRSMSLWENFALGFTYLSPVVGVYTLFGLCLAAGGPPMFWAYLLVGCGQLLVCLIFGEVVSQFPISGGVYPWARRLVGKKWAWMVGWIYSIALCVTIAAVAVGAGPYLAAMLGFEPSNNTNIVIALVLTLFATLVNLSGTKVLARIAMFGFLCELVGAVIVGVYLLIFERHQPISVLFNTFDISVDGSYLPAFLTASLAGMFLYYGFEACGDVAEETPNPSAKIPVAMRMTIYIGGIAAMFACLALILAVPDMQAVINGTDKDPVTTILNNAFGPVGSKVVMGVVMISFISCVISLQAAASRLLYSYARDEMVIGSRLLKKISPTTQVPVAALFVSGVLPGLIIALGFFLQDAVATIVSFAAIGIYLAFQMIVLAALYARSKGWKPSGKFTLGAWGWPVNIGALVYGVGAIINMAWPRTPDAAWYINYAMVLSTAIVIGLGLVYMWIGKPYDHGKAPAGDAWKVGR

SEQ ID NO: 56039 - protein, 135 aa, Petasites fragrans
  misc_feature (10)..(10): Xaa can be any naturally occurring amino acid
  misc_feature (135)..(135): Xaa can be any naturally occurring amino acid
LDAAGKTPIXYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQTPX

SEQ ID NO: 56040 - protein, 252 aa, Prunus emarginata
AHYKSEADVGNAIAEAIRSGLVKREELFITSKASNHGHVVEACKNSLEKLQLDYLDLYLVHYPLATKHSGVGTTASLLDENKVLDIDVTVSLESTWHDMEKTVSLGLVRSIGLSNYELFLTRDCLSYAKIKPQVSQFETHPYFQRESLVRFCKKHGVTPMAHTPLGGATANVKSFGSISPLEDPVLLGLAKKYKKSVAQIALRWNIERDTPVIPKSSKVERLKENLEVLNFKLEKEDIELINTIDKKSRTTL

SEQ ID NO: 56041 - protein, 474 aa, Pseudomonas fluorescens PfO-1
MQTKLLINGQLVNGEGPAQPVLNPARGEVLVEINEATEAQVDAAVRAADSAFAEWSQTTPKDRSLLLLKLADAIEAHGEELAKLESDNCGKPYNAALNDEIPAIADVFRFFAGASRCMSGSAGGEYLPGHTSMIRRDPVGVIASIAPWNYPLMMVAWKIAPALAAGNTVVLKPSEQTPLTALRLAELASDIFPAGVLNLVFGRGPSVGSPLVTHPKVRMVSLTGSIATGSNIISSTADSVKRMHMELGGKAPVIIFDDADIDAAVEGIRTFGFYNAGQDCTAACRIYAQQGIYDKFVEKLGAAVSSIKYGLQDDPSTELGPLITAQHRDRVAGFVERAVAQPHIRLITGGKAVDGNGFFFEPTVLADAQQDDEIVRREVFGPVVSVTKFTDEAQALEWANDSDYGLASSVWTADVGRAHRLSARLQYGCTWVNTHFMLVSEMPHGGQKLSGYGKDMSMYGLEDYTTVRHVMFKH

SEQ ID NO: 56042 - protein, 87 aa, Arabidopsis thaliana
MDSYSSPPMGGSGSSVSPEVMMESVKTQLAQAYAEELIETLRTKCLDKCVTKPGSSLGGSESSCISRCVERYMEATAIISRSLFTQR

SEQ ID NO: 56043 - protein, 333 aa, Roseovarius nubinhibens ISM
MTITVGINGFGRIGRCTLAHIAQSTRDDIKVVKVNATGPLETAAHLLKYDSVHGRFANEITLGDGTMDLGRGPMQMFSTYDMDELDWSGCDVVLECTGKFNDGEKAKKHLERGAKKVLLSAPGKNVDRTIVFGVNDNELQASDTMISNGSCTTNCLAPVAKVLDDSFGIESGIMTTIHAYTGDQPTLDRRHKDLYRARAAAMSMIPTSTGAAKALGEVLPALKGKLDGSAIRVPTPNVSAVDLTFVAKTDVTEDEVNAAMRAAAEGPMKGVLGYDPEPKVSIDFNHTEESSIFAPAQTKVIGGRLVRVLSWYDNEWGFSCRMADVAVAMGKLG

SEQ ID NO: 56044 - protein, 182 aa, Flavobacteria bacterium BBFL7
MKFSKDIKRYTDYSGKSAFLMLLTQQGLWALLQYRFFNWIYTSKWPKVIKWPLLGIGVLKLKGIEVLTGITIPYSATIGEGFYIGHHSGIIINANAVIGVNCNVSQGVTIGVSGRGENRGVPVIGDHVYIGANATVAGNIIVGNNAVIGANSLVIKDVEEGTTVLGVPAIKVSDNDSADYIL

SEQ ID NO: 56045 - protein, 1435 aa, Coprinopsis cinerea okayama7#130
MSKPVHPIRSYSELDTANLAANVIAMCTDGEQRDAFLSAQDPAVDQELADLLYSVLGSRHLDPVHAPILRALLKLSENTDLLPQRLAHNSLQVAGGPPIHSTRISKIHRGKVDDRVVAVKVSNHSPELELGEYLNKAFKREAIIWSQLHHPNVLPFYGLFQAEGEHFYSLLSPWMDNGNITDFLKAEPQTDRQELIFDIARGLEYLHNLDPPVIHGDLKPNNIFVTANKRACIGDFGLGKLPRDPKWGISRSSSLFAGNELYCAPELLEEIIEGEAESVSDATEDDQLGYKTLASDVYAFACICYEVYHGKPRFFDLHGLRRWKAIVGLIDDPTHKPGGMSDLLWHWVECFWDRNPAARPSISAFVQAMCPTPLNNPYKYDTAWDWTFLQDSPNDYDGSMKKVRPEELTDNDIVIALMGPTGTGKSTFINCALGDDVARVSGSVRSCTSKVELFACFHPDKPEQRVFFVDTPGFDHTEDVSSEKQTLAQVADWLIKTYKENIRLSGVLHFCSVTSARFSGTDRVNLRVFTELCGPEALDNVVIVSTGWEDLETDELVTLGEKREEQLRNTFLDDAGLDQFSVSMSSKQTLETLHRRLRECQCGEVSLELLHEKPATWIGHHRDDIAAICAAYSECYPILKDEGISEMLFPRTFILAAVVLGSSEENTSALREILDAGRGLDRVARLAAYRTPKDGLRRILLSETAPTPGFIPRNVVDANFQAPRTSLRPMVNELLLLETAHIAALVVDCIEQGPGQDTLFLKKDPEVDQNLIDLFQGLLDYPALKSIHPMILRALIHLVKEAALFPRCLVHQDVNIPGQRCTAIGSFGDVWKGDLRGQAVAVKVMRQHVTGIPVDSIIRGYGREAILWSQLHHPNVLPFYGIYLWPSEDSGPTWVCLLSPWMANGNLSQYLEARPALDRMPLVRDIARGLNYLHSLDPSFIHGDIKSNNILVTPSGTACLADFGLGRLAPDARLGWRSSTVATGGPYLFSAPELLVEDVQPAKGPGSHEVTPAKKKSTQTDVYAFACVVYEMYTGTPRFVNLALAEAYRAIISNEPCERPAAMPEPLWAWINRAWDLNPDRRPAMSEFIQEFDTGPPSIQYKWDSKPVSNLRSTTFLAVPPTPIRIQPPRLGTSASSLSASTITSSGASSTTLEVPQCDSPVEDYEVVNGFDDPPPEKSAPRPEKPLPRRPARVPRSQASSFLEDDIIIALMGPTGSGKSTFINCALNDYVAPVSHTITSCTKEVGVYGCFHPNQPGRRVFLVDTPGFESTAMHDRQTLELIAKWLKETYQTHVVLTGVLQFHSIADARVGGTKRDNLDVFRAMCGQDALKNVVYVSTGWEDLDEEEQGERRQHQLVNDYLAEPLQHGCRYQPFLQRDFDAAWAIIDLFQEKRRALKIQEEMVKYRWRLTQTSAYKALSRKFIKVFKFKRGSTMN

SEQ ID NO: 56046 - protein, 368 aa, Prunus armeniaca
MATLVEPPDGIRQRGKHYYSMWQTLFEVDTKYVPIKPIGRGAYGIVCSSINRATNEKVAIKKINNVFENRIDALRTLRELKLLRHIRHENVIALKDVMMPIHRTSFKDVYFVYELMDTDLHQIIKSSQPLSSDHCKYFLFQLLRGLKYLHSANILHRDLKPGNLLINANCDLKICDFGLARTSGGTGQFMTEYVVTRWYRAPELLLCCDNYGTSIDVWSVGCIFAEILGRKPIFPGTECLNQLKLIINVLGSQHEPDLAFIDNPKARKYIKSLPYSRGTHFSRLYPQADPLAIDLLQRMLVFDPTKRISVTEALQHPYMSGLYDPRCNPPAQVPINLDIDENLAEPMIREMMWHEMLHYHPEAAFVNA

SEQ ID NO: 56047 - protein, 260 aa, Roseovarius nubinhibens ISM
MLNWAEAALHWREDGDPGGRPLVFANSLGTDLRLWDALLPHLPVGLRLIRYDMRGHGLSACPPGPYDMDALARDAEALIEYLDLTNVTFIGLSIGGMVGQALAARRPDLLSALVLSNTAAAMGTPEAWQARIAAIRAGGIEAIADAVMERWFAARFRATPELALWRNMLTRTPPEGYIGCCAAIAGADLRATTATLTLPTLAIAGAEDGASPPDLVADTARLIPGARFATLPDTGHLPCVEAPAAYAAILSDFLKETAHV

SEQ ID NO: 56048 - protein, 509 aa, Zea mays
MAYPAAPHTSAAFLASFATPLPARCASPPTRRRAVSAAAIATTTTCVFADAPRGIKEEQADSGAQAAAAAAARRDVSPDTVASIILGGGAGTRLFPLTRTRAKPAVPVGGCYRLIDIPMSNCINSKINKIYVLTQFNSQSLNRHIARTYNFGEGVGFSGGSVEVLAATQTAGESGKKWFQGTADAVRQFLWLFEDARLKCIENILILSGDHLYRMDYMDFVQKHVDSGADISVACVPMDESRASDFGLMKADRNGHITDFLEKPKGADLESMQVDMGLFGLSPEFASTYKYMASMGIYVFKADVLRKLLRGHYPTANDFGLEVIPMAAKDYDVQAYLFDGYWEDIGTIKSFFEANLALTDQSPNFYFYDPVKPIFTSPRFLPPTKVLNSIVSHGCFLTECSVEHSVIGIRSRLEPGVQLKDTMMMGADYYQTEAERLSELSVGKVPVGVGENTKIRNCIIDKNARIGKNVVIMNSENVQEADRPAEGYYIRSGITVVLKNAVILNGTKI

SEQ ID NO: 56049 - protein, 113 aa, Oryza sativa
DDQRQMITQAAVKAGFGAGMLEDDPGTKNQKLYLVLTVGGGDLTKKGGDITGVVDGMDGVDVEDARRSIKTHAPNMSKGSKAWIVKKKEQMERKGKIVKSTSKYTGRKRRVQF

SEQ ID NO: 56050 - protein, 219 aa, Microcystis aeruginosa PCC 7806
MTIASRIESIRLTLPSCTRLIAVSKQVSSDYIRQAYRAGVRDFAESKLQEAISKQQELKDLPDISWHFIGHLQANKARKVLESFDLIHSLDSLKLAQRLDRLASELEINPQVLLQVKVVPDPDKFGWDKAELIADLPALVNCQQLKIQGLMTILPQGLSAGEKLAAFEKTSDLAQIIENSSSLCLPHLSMGMSNDYPLAVKAGATLIRVGTGIFGERIY

SEQ ID NO: 56051 - protein, 290 aa, Bordetella petrii
MTARVASLHIYPIKSCAAIDLAESSIDRAGLAGDRRWMILTAQGQFMTQRQWPAMALIRPALTADHLELRAPGMPVLRVPLDGSQLSGTVRQATVWKDTVPARDESGEAAAWLSQVLGLDCVLVKIDAPSQRPSRIEWVERWCAAHPDLAEAFAGEHRLGFADGFPLLIANQASLDELNARLAAQGEPAVPMNRFRPNIVIQGEWEAYDEDHTAMVTVGQVRMALVKPCTRCPMPNIDQLTAQRHDEPGRTLAAYRKFEIGVVFGQNAIVAAPTGARLRVGDAAEIELDF

SEQ ID NO: 56052 - protein, 270 aa, Microcystis aeruginosa PCC 7806
MSIRLGIIGGGVMAEAILSRLLKKNVYSPETVLVSEPQSQRRNFWVNTYGVQVSEDNREAARATEVLILAVKPQTLEQVVNSLLGIPEKPLIISILAGVTLNRLEMGFPDRPVIRTMPNTPATVGQGVTAIASGRYAEPEHLAVARDIFAAVGSVVEVPEALMDAVTGLSGSGPAFVALMVEALSDGGVAAGLPRSIASQLAIETVLGTATLLKESAIHPGELKDRVTSPGGTTIAGVRQLEKGSFRSTIIEAVVAAYHRSKDLGRSSEK

SEQ ID NO: 56053 - protein, 350 aa, Bordetella petrii
MSFKVTVQPSQHQFTVEAGQTVLDAALAAGIVLPYSCRNGACSTCKGKVVTGQVDAGEYPAQILSPEELAQGYTLFCQARPQSDLVVESTEVRLASDIQIRKLPARVQAMELAAPDVTVLSLQLPAADPFRYYAGQYIEVILKDGKRRSYSMACAPHTGSPLELHVRHMPGGVFTDHVFGAGATQMKVREILRLEGPFGSFFLREDSDKPIVLLASGTGFAPVKAIVEHMAHHGIRRPAVLYWGGRRPRDLYMHELAQSWAQTLPDFRYVPVVSDGLPEDGWDGRTGYVHEAVLQDLPDLSGYQVYACGAPPMVDAARREFTAQCGLPADEFYADAFTSEADLARTGTGA

SEQ ID NO: 56054 - protein, 146 aa, Picea sitchensis
MAATAVFSTTTSVSAFLLNRSLGSAAASRPSSLSVVGLPALDKRCTVCYAQKQEEIVRAKENSQNCMVSLGGAAPLMAVAAALTVSTKEAFALVDERLSTEGTGLGLGLSNPLLGWILVGVFTLIWILYFTTYSGVKEDEDSGLSL

SEQ ID NO: 56055 - protein, 368 aa, Triticum aestivum
MAIGGVGAGGGAGGAEAQGRSVLVTGGAGFIGTHTVLQLLEKGYAVTVVDNFHNSVPEALDRVRHIVGPALSARLQFIFGDLTIKDDLEKVFAAKRYDAVIHFAGLKAVAESVAHPEMYNRNNIVGTVNLYDVMKKHGCNKLVFSSSATVYGQPEKVPCFEDSPLKALNPYGRTKLYLEEMLRDYQHANPEWRTILLRYFNPIGAHESGDIGEDPKGVPNNLLPYIQQVAVGRRPELNVYGHDYRTRDGTAVRDYIHVVDLADGHIAALEKLFATPDIGCVAYNLGTGRGTTVLEMVSAFEKAYGKKIPVKMCPRRPGDSEQVYASTAKAEEELGWRAKYGIEEMCRDQWNWAKKNPYGYCGNAENKD

SEQ ID NO: 56056 - protein, 115 aa, Microcystis aeruginosa PCC 7806
MANWKCIKNCGACCQLNPDERPDLEEYLTPAQLTQYLSMVGEGGWCINFDRQTRLCTIYDQRPEFCRVQPDIFAKMYQIAPGEFDQFAIDCCHQHIEDLYGEDSLEMNSYRQQVG

SEQ ID NO: 56057 - protein, 594 aa, Synechococcus sp. WH 7803
MAVLDLNRRTKIVATIGPATESPERIRELIQAGATTFRLNFSHGDHSEHAARMATIRQVAHELGVHIGILQDLQGPKIRLGRFEEGPITVGKGDHFSLTSKQVRCNQTVATVTYDKLADEVTAGSRILLDDGRVEMRVDRVDLADQTLHCVVTVGGVLSNNKGVNFPDVQLSVRALTQKDRQDLAFGLQQGVDWVALSFVRNPSDMQEIRELIRKHGFTTPVVAKIEKFEAIDQIDAILPLCDGVMVARGDLGVEMPAEEVPLLQKDLIHKANSLGIPIITATQMLDSMASSPRPTRAEVSDVANAILDGTDAVMLSNETAVGDFPVEAVETMATIARRIERDYPQRPIDTHLPSTIPNAISGAVSSIARQLNAAAILPLTKSGATAHNVSKFRPSTPILAITSEVSVARKLQLVWGVTPLLIETQKSTTATFTLAMGVAQEMGVLKDGDLCVQTAGTLAGVSGSTDLIKVGIVSAVLGRGTGIGNGSISGKVRIALNASDCARLEPGEILVASDTNADYLDAFREAAAIITECGGDDSHAAVIARRLGLSVITGVANATRDLREGEVVTLHIKEGAVHRGTGSNTLMKLDTML

SEQ ID NO: 56058 - protein, 597 aa, Physcomitrella patens subsp. patens
MVSDASKKKAAAKKLAAAEKRGSKSAAVVAQSKLKDVSNGTTADTLAEELAAANITDRTCTGILASHAQSRDIHIESLSVTFHGHELVADSTLELNYGRRYGLLGLNGCGKSTLLTAIGLREVPIPEHMDIYHLTREIDATDMTSLQAVMNVDSERLLLEKEAEKLSQQDDGGGEPLERIYERLEAMDSATAEMRAAQILHGLGFTKKMQNKKTRDFSGGWRMRIALARALFMNPTILLLDEPTNHLDLEACVWLEETLKKFERILVVVSHSQDFLNGVCTNIIHMQNKQLKFYTGNYDQYCQTRAELEENQMKQYRWEQEQISAMKEYIARFGHGSAKLARQAQSKEKTLAKMERGGLAEKVVRDKVLTFRFTDVGKLPPPVLQFVDLKFGYTPDQLIYEKVDFGVDLDSRIALVGPNGAGKSTLLKLMTGELEPLDGMVRRHNHLRIAQYHQHLAETLSLEMSALQYMMSEYPGLEEEKMRSAIGRFGLTGKAQVMPMGNLSDGQKSRVIFAWLAWRLPHLLLLDEPTNHLDIETIDSLAEALNEWDGGLVLVSHDFRLINQVAKEIWVCEKKTITRWNGDIMDFKRHLKKTAGL

SEQ ID NO: 56059 - protein, 510 aa, Synechococcus sp. WH 7803
MDDYLQRILRARVYDVARETPLDVASNLSRRLANTVRLKREDLQPVFSFKLRGAYNRMAQLSQEELSRGVIASSAGNHAQGVALSASHLHCRAVIVMPVTTPSVKVEAVKQLGGEVVLHGETYDEAYAEACRRSENEHLCFIHPFDDPDVIAGQGTVGMEILRQSPRPPDAIYIAIGGGGLIGGIAAYVKTLWPDVQIIGVEPHDAAAMTLSLEAGERIRLPQVGLFADGVAVREVGEHTFRLVQRYVDSIVTVSTDEICAAIKDVFEDTRSILEPAGALAVAGLKADVARRGLKDQHLVAVACGANMNFDRLRFVAERAELGEEREAMLAVEIPEQPGSLRRLCELLHKRSLTEFSYRMGAGETAQIFMGIQVADLQDRSDLLAYLRSHGYECLDLSDDELAKVHLRHMVGGRLPMRVDPANQQPQELLYRFEFPERPGALMRFVSALHADWSISIFHYRNHGADVGRIVVGVLVKPDELQDWQVVLRELGYASWEETSNPAYRLFLGA

SEQ ID NO: 56060 - protein, 647 aa, Synechococcus sp. WH 7803
MHLSDLAHPNELHGLSVAELQDVAKQIRERHLEVVSNSGGHLGPGLGVVELTLALYQTLDLDKDRVVWDVGHQAYPHKLITGRYADFDSLRQQGGVAGYLKRCESEFDHFGAGHASTSISAALGMAMARDRQGLDYKCVAVIGDGALTGGMALEAINHAGHMPNTPLLVVLNDNDMSISPPVGALSSHLNRMRLSPPMQFLSGSVEESMRHLPFMGGDLPPELNRLKESMRRLAVPKVGAVFEELGFTYMGPIDGHDMGEMIRTFQAAHRIGGPALVHVITKKGKGYPYAEADQVGYHAQSAFDLGTGKARPSKTPKPPSYSKVFGQTLVKICEQNSKVVGITAAMATGTGLDLLQKALPDQYVDVGIAEQHAVTLAAGMACDGLRPVVAIYSTFLQRAFDQMIHDVGIQNLPVTFVLDRAGIVGADGPTHQGQYDISYLRAIPNFTVMAPKDEAELQRMLVSSLQHSGPCAIRIPRGPGEGVPLMEEGWEPLPIGRGEVLRDGDDLLIVAYGAMNSKALATADLLASCGVQSTVVNARFLRPLDDELLHPLARRIGKVVTIEEGTLAGGFGSALTESLLDADIKPSILRLGIPDVLVDHATPQQSFEKLGLTPAQMAESIQGFLQRSKLTTATSVVQQPSVSVLES

SEQ ID NO: 56061 - protein, 355 aa, Oryza sativa
MEQVVNAVLDLVVPPASMVMLAFAWPTLSFLRGVEWVVKTLTVENMHNKVVLITGASSAIGEQVAYEYARRNANLVLVARREHRLFAVRENARALGAGQVLVIAADVVKEDDCRRLVGDTISFFGQLNHLVNTVSLGHDFCFEEAGDTVAFPHLMDVNFWGNVYPTYAALPYLRRSHGRVVVNAAVEIWLPMPRMTLYSAAKAAVIDFYESLRYEVGDEVGISVATHGWIGGEASGGKFMLEEGAEMQWKGEEREVPLAGGQVEAYARMVVAGACRGDAHVKHPNWYDVFLVFRAFAPDVLAWTFRLLLSTPSPSPPASARRHQLAALPAPPLHPLLEYPSARSPGRAAQQHKLE

SEQ ID NO: 56062 - protein, 267 aa, Streptomyces avermitilis MA-4680
MDIRRRNNVVVTGRPDGPVVLLAHGFGCDQNMWRLVVPALADDFRVVLFDYVGSGRSDLSAWSEQRYSSLEGYALDVLEVCEELDLRDVAFVGHSVSAMVGVLAAQKAPERFSRLVMVAPSPRYIDEDGYRGGFSAEDIDELLTSLDSNYLGWSATMAPVIMDNPDRPELGEELTASFCATDPDIARAFARTTFLSDSRQDLKSVAVPTLVLECAQDVIAPREVGAYVHAAIPGSRLVTLDATGHCPQLSAPDATAQAITAFLGATR

SEQ ID NO: 56063 - protein, 418 aa, Desulfotalea psychrophila LSv54
MSEPIFIFYKESVNVMAVSSIEEAIEDIKAGKMVILVDDEDRENEGDLCMAAEFVAAADINFMATHGRGLICLTLTPKLVDQLALPMMVQENKSPYGTGFTISIEAKTGVETGISAADRARTIQVAVADGAGPQDLVSPGHVFPLRAREGGVLCRTGQTEGSVDLARLSGATPAGVICEIMKDDGTMARMPDLEIFAAEHELKIVTVADLVEYRLRQDLLVHRQVAARIPTADAGEFTAIVYTNDVDNFEHLALVKGDLEAAEEVLVRVHSECLTGDLFGSARCDCGPQLHEAMRMIDRAGCGVVLYMRQEGRGIGLINKLKAYNLQDNQGLDTVEANIELGFKADLRDYGIGAQILRDLGITKMSLLTNNPKKIIGLEGYGIEVISRVPIEIEASEENEGYLRCKRDRMGHLLNMKE

SEQ ID NO: 56064 - protein, 245 aa, unidentified eubacterium SCB49
MKKDPSITPYKDHQGSKKEQVEEMFDNISGNYDGLNRVISMGIDQKWRKKVIDLITSKQPKSYLDIATGTGDLALQFAERLPDTKIVGLDLSEGMLSMARKKVEGTSLQQQIDFIKGDSEALPFSDNSFEAITVSFGIRNFQNLEKGLSEILRVLAPGGIFVILETSVPTKFPFKQGYGVYSKAILPLIGKIFSKDKVAYRYLSESASVFPFGEKLNNILQKIGFKQVEHKPQTLGVATIYSATK

SEQ ID NO: 56065 - protein, 903 aa, Methanocaldococcus jannaschii DSM 2661
MVKELKVAEAYQGDVGRGIARIDPYTMEELGLKPGDVIEIEGPKGKAYAIVYRGFLEDAGKGIIRIDGYLRQNAGVAIGDRVKVKRVEIKEAKKVVLAPTQPIRFGPGFEDFVKRKILGQVLSKGSKVTIGVLGTALTFVVVSTTPAGPVRVTDFTHVELKEEPVSEIKETKVPDVTYEDIGGLKEEVKKVREMIELPMRHPELFEKLGIEPPKGVLLVGPPGTGKTLLAKAVANEAGANFYVINGPEIMSKYVGETEENLRKIFEEAEENAPSIIFIDEIDAIAPKRDEATGEVERRLVAQLLTLMDGLKGRGQVVVIGATNRPNALDPALRRPGRFDREIVIGVPDREGRKEILQIHTRNMPLAEDVDLDYLADVTHGFVGADLAALCKEAAMRALRRVLPSIDLEAEEIPKEVLDNLKVTMDDFKEALKDVEPSAMREVLVEVPNVKWEDIGGLEEVKQELREAVEWPLKAKEVFEKIGVRPPKGVLLFGPPGTGKTLLAKAVANESGANFISVKGPEIFSKWVGESEKAIREIFRKARQSAPCIIFFDEIDAIAPKRGRDLSSAVTDKVVNQLLTELDGMEEPKDVVVIAATNRPDIIDPALLRPGRLDRVILVPVPDEKARLDIFKIHTRSMNLAEDVNLEELAKKTEGYTGADIEALCREAAMLAVRESIGKPWDIEVKLRELINYLQSISGTFRAAAVELNSVIKATKERESAEAGEFSELKNAIGKIISVLSPAKEKIEAVEKEIDKFLEVINKEELKPSEKDEAQKLAKYLKDILGKLKEMIDNIYELENKLNTLKEQVSAEEIDEIIKTTQNIIQRFTTSLDELKNILKDIESIRLKVSTKDVKIKKEHFMKALEKIKPSVSKEDMRVYEKLAQEYGRATSVEKKKEEGKEVI

SEQ ID NO: 56066 - protein, 155 aa, Desulfotalea psychrophila LSv54
MPNFIEGNLKADGKKFAIIVARFNSFISDKLLDGALDSLVRSGATDSDIDVVRVPGAYEIPLIAKKLAASLKYDAVICLGAVIRGATPHFDVVVNEVSKGSAQVSLETGVPVLFGVLTTETIEQAIERSGTKAGNKGSDVAIAAIEMANLVDALQ

SEQ ID NO: 56067 - protein, 188 aa, Triticum aestivum
  misc_feature (101)..(101): Xaa can be any naturally occurring amino acid
  misc_feature (115)..(115): Xaa can be any naturally occurring amino acid
  misc_feature (130)..(130): Xaa can be any naturally occurring amino acid
  misc_feature (137)..(137): Xaa can be any naturally occurring amino acid
  misc_feature (150)..(150): Xaa can be any naturally occurring amino acid
MAPTVMASSATSVAPFQGLKSTAGLPISRRSSSAGLSSVSNGGRIRCMQVWPIEGIKKFETLSYLPPLSTEALLKQVDYLIRSKWVPCLEFNKVGFVFREXHNNSPGYYDGRYWXTMWKLPMFGCTDATXVLNEVEXVKERSTLTPNVRXVIGFDNLRQVQRQLQSFKARGLRNPGKGPKTNEVNNWM

SEQ ID NO: 56068 - protein, 257 aa, Oryza sativa Japonica Group
MASKEEVAVETVEGGAAAAKAPYWDPPPAPLLDTSELGKWSLYRALIAEFMATLIFLYVSIATVIGYKNQRATVDACTGVGYLGVAWSFGATIFVLVYCTGGVSGGHINPAVTLGLFFGRKLSLVRTVLYVVAQCLGAIAGAGIVGTFILVYTVFSATDPKRTARDSFIPVLVPLPIGFAVFVVHLATIPITGTGINPARSLGAAVLYNQHAAWKDHWIFWVGPVIGAFLAAAYHKLVLRGEAAKALSSFRSTSVTA

SEQ ID NO: 56069 - protein, 337 aa, Vitis vinifera
MDHEADSHRTDLMTITRYVLNEQSRHPESRGDFTILLSHIVLGCKFVCTAVNKAGLAKLIGLAGETNGEEQKKLDVLSNEVFIKALVSSGRTCILVSEEDEEATIVEPSKRGRYCVVFDPLDGSSNIDCGVSIGTIFGIYMVKDGGEPTLDNVLQPGKNMLAAGYCMYGSSCTLVLSTGTGVNGFTLDPSLGEFILTHPNIKIPKKGKIYSVNEGNTKNWDAPTAKYVEKCKFPKDGSSPKSLRYIGSMVADVHRTLLYGGIFLYPADKKSPNGKLRVLYEVFPMSFLMEQAGGQAFTGKQRALDLVPKNIHERSPIFLGSYDDVEEIKALYAAEEK

SEQ ID NO: 56070 - protein, 308 aa, Salmonella enterica subsp. houtenae
INGFGRIGRIVFRAAQKRSDIEIVAINDLLDAEYMAYMLKYDSTHGRFDGTVEVKDGHLIVNGKKIRVTAERDPANLKWDEVGVDVVAEATGIFLTDETARKHITAGAKKVVLTGPSKDNTPMFVKGANFDKYEGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKEATYEQIKAAVKAAAEGEMKGVLGYTEDDVVSTDFNGEVCTSVFDAKAGIALNDNFVKLVSWYDN

SEQ ID NO: 56071 - protein, 298 aa, Glycine max
MATSLSFSISPKTTATTSAFRFKVSAMATTIAAPSTKVAPAVIVGGGRVGRALQDMGTGQDLLVRRGESVPPNFEGPIFVCTRNDDLESVLQSTPSSRWRADLVFFQNGMMEPWLESKGLEDANQVLAYFAVSKIGESPIDGRTDTNPEGLTAAYGKWASVVAARLNAGGLSCKVLDKEAFQKQMLEKLIWICSVMLVGARHGGVSVGVVEKEFRTELSSLITELASAAASEKGLKFEEAMEERLCAYSRAVAHFPTAVKEFKWRNGWFCSLSEKANAQGKPDPCPLHSQWLKELRIV

SEQ ID NO: 56072 - protein, 136 aa, Lactuca sativa
LDAAGKTTILYKLKLGEIVTTIPTIGFNVETVEYKNISFTVWDVGGQDKIRPLWRHYFQTTQGLIFVVDSNDRDRVVEARDELHRMLNEDELRDAVLLVFANKQDLPNAMNAAEITDKLGLHSLRQRHWYIQSTCA

SEQ ID NO: 56073 - protein, 136 aa, Lactuca sativa
LDAAGKTTILYKLKLGEIVTTIPTIGFNVETVEYKDISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCA

SEQ ID NO: 56074 - protein, 1036 aa, Brassica rapa subsp. pekinensis
MNTGGRLIAGSHNRNEFVLINADENARIRSVQELKGQTCEICRDEIESTVDGEPFVACNECAFPVCRPCYEYERREGNQACPQCKTRYKRIKGSPRVENDEEEDDVDDIDNEFEYGGNGIGFDQVSEGVSVSRRHSGDLDSAPPGSQIPLLTYGDEDIEISSDRHALIVPPSLSGHGSRVHPASLSDPTIAAHPRPMVPQKDLAVYGYGSVAWKDRMEEWKRKQNEKLQVVRHEGDPDFEDGDDIPMMDEGRQPLSRKIPIKSSKINPYRMLIVLRLVILSLFFHYRILHPVKDAYALWLTSVICEIWFAVSWVLDQFPKWYPIERETYLDRLSLRYEKEGKPSELSPVDVFVSTVDPLKEPPLITANTVLSILAVDYPVDKVACYVSDDGAAMLTFEALSETAEFARKWVPFCKKYCIEPRAPEWYFCHKMDYLKNKVHPAFVRERRAMKRDYEEFKVKINALVATAQKVPEEGWTMQDGTPWPGNSTRDHPGMIQVFLGSDGVRDVENNELPRLVYVSREKRPGFDHHKKAGAMNSLIRVSGVLSNAPYLLNVDCDHYINNSKALREAMCFMMDPQSGKKICYVQFPQRFDGIDRHDRYSNRNVVFFDINMKGLDGLQGPIYVGTGCVFRRQALYGFDAPKKKKAPRKTCNCWPKWCFLCCGSRKNRKAKTLAAADKKKKNREASKQIHALENIEEGPVTKGSNVELSSEAMQLKLEKKFGQSPVFVASARMQNGGMARNASPACLLKEAIQVISCGYEDKTEWGKEISNYASILFMALFSSIAVTGILEMQWGKVGIDDWWRNEQFWVIGGVSAHLFALFQGLLKVLAGVDTNFTVTSKAADDGEFSDLYLFKWTSLLIPPTTLLIINVIGIVVGISDAISNGYDSWGPLFGRLFFALWVVIHLYPFLKGLLGKQDRMPTIIVVWSILLASILTLLWVRVNPFVAKGGPVLEICGVPHLRGSFPWARLGSGPLHPGRLYLGWGQDPTPSTAFGDRMGSSPLPGVEPVSMTIGPQDPYQVSYLIPSILVICFCD

SEQ ID NO: 56075 - protein, 515 aa, Coprinopsis cinerea okayama7#130
MPELVYTSLEDIEKIHEELRAGFRSGKLNSIEYRKYQLLQIGYLVQENFEAFENALKADLGRPVLESRFVEINTCIGDALKAYKNVEKWAKPEYPAFNINFFAMKPTINKVPKGTVLIIAPFNYPLWLTIGPLVGAIAAGNTVLLKPSESTPAVSSLLAELVPKYLDSDLVRVVNGAVAETSKILELQWDHILYTGSGRVGKIVATAAAKHLTPVSLELGGKSPVIVDPTCDLQTATRRILWGKCTNAGQTCVAPDYILVPRSFQNTFIEALTKTYNEFFPSDAKPSDPDNFARMITPQAFNRVKGLLDATKGTVVLGGETDAATKFIAPTIVKDVLPDDSLMSDEIFGPILPIVAVEDIDEAIRFVNSRDHPLALYVFTQDQAVKDRVFRNTQSGAYSVNEVVIHTGVDGLPFGGTGPSGYGEHTGKFSFDMFTHLRSSIDSPSWVDAILKFRYPPYTAKKLKATENFKVKLPAKPKGPPSVSSSGSRLNKWFVLALAVAVAAGLTKRARALIA

SEQ ID NO: 56076 - protein, 488 aa, Pseudomonas aeruginosa
MNAVAPLIPCIVSGGSGTRLWPVSRESMPKPFMRLADDQSLLQKTFLRIAGLPDVARLLTVTNRDLLFRTLDDYRAVNRSGLAQDLLLEPVGRNTAPAIAAAALHVQEHFGDQAQLLILPADHLIRDEQAFAAAVAEARGLAAQGYLVTFGITPERAETGFGYIEQGAPLGNGFRVARFVEKPDQATAQSYLDSGKYLWNAGMFCFQAATVLQELERHAPEVLIAARAALADGSSLENGQCRQRELAAGAFPQAPDISVDYALMERSDKVAVVPCSIGWSDIGSWQALRELSAADENGNQVRGESVLHDVSNCYIDSPKRLVGAVGVHDLIIVDTPDALLVADAARSQDVKFVAQELKRRGHDAFRLHRTVSRPWGTYTVLEEGRRFKIKRIVVRPKRSLSLQMHHHRSEHWIVVSGMALVENGEREFLLNTNESTFIPAGHSHRLSNPGIIDLVMIEVQSGEYLGEDDIVRFNDIYGRAPASDEKKA

SEQ ID NO: 56077 - protein, 256 aa, Oryza sativa Japonica Group
MPPKRKRAAAMETAGGDAAPPPQQQRRNKSSAANKGKKGGASGGGGGGRWPPVKPKKDLQVNRLKGTHLLTVPNFFTSAEAKAFVDIAENIGFTHQGSLGPLKGEAYRDNDRISVTDPLLAQTIWESGINKIFEDISISGKVATSLNPNIRFYRYTEGQRFGRHIDESVDLGDGSRTLYTLLIYLSGKGSAKESSGQALVGGETVFYDHRGGVVAEVAPVQGLALLHLHGAKCMLHEARVVKKNIKYVLRSDVVFA

SEQ ID NO: 56078 - protein, 330 aa, Debaryomyces hansenii CBS767
MTGSSSQFQQLEKLGEGTYATVYKGRNRTNGQLVALKEINLDSEEGTPSTAIREISLMKELDHENIVTLYDVIHTENKLTLVFEFMDKDLKKYMEAHGNQGALDLKIVKSFIFQLLKGIMFCHDNRVLHRDLKPQNLLINNKGELKLGDFGLARAFGIPFNTFSNEVVTLWYRAPDVLLGSRAYTASIDIWSAGCIFAEMCTGKPLFPGTSNDDQLIKIFRLMGTPNERTWPGVSSYANFKNNWQIFVPQDLRLLIPNLDSMGLNLLSSLLQMRPDARITARQALQHPWFHEISNPNPLMQHLADPYQQLQQQLQQQAQQLQQMDPQTYR

SEQ ID NO: 56079 - protein, 360 aa, Penicillium citrinum
MTDPNPVTLPTPFSTIPRTPLLLGPSPIHPLPRTTADLAKNNPHPLVTIYAKRDDLNSGYAYGGNKTRKLEYLLADAQAQGCTTLVSIGGVQSNHTRQVAAVAARSGLKARLVQEHWVDWTDPGYESTGNIQLSRLMGADVRLDPSGFGIEHKNTVQRVVEEARGDGEKPYYIPAGASDHPLGGLGFARWAFEVREQEGEMGVFFDTVLVCAVTGSTFAGMIAGFKLLERLYPADAKRRVVGIDASATVEATRAQVLRIAKNTAAKIGLSEDDITEDDVMLDDRYHAGIYGVPDRQTWDAIEYAAKMEAFITDPVYEGKSFAGMMDMIRRGEIKGGNILYAHLGGQLALNAYSELGRTNE

SEQ ID NO: 56080 - protein, 347 aa, Catharanthus roseus
MMAVFFMFFLLLLSSSSSSSSSSPILKKIFIESPSYAPNAFTFDSTDKGFYTSVQDGRVIKYEGPNSGFTDFAYASPFWNKAFCENSTDPEKRPLCGRTYDISYDYKNSQMYIVDGHYHLCVVGKEGGYATQLATSVQGVPFKWLYAVTVDQRTGIVYFTDVSSIHDDSPEGVEEIMNTSDRTGRLMKYDPSTKETTLLLKELHVPGGAEISADGSFVVVAEFLSNRIVKYWLEGPKKGSAEFLVTIPNPGNIKRNSDGHFWVSSSEELDGGQHGSVVSRGIKFDGFGNILQVIPLPPPYEGEHFEQIQEHDGLLYIGSLSHSSVGILVYDDHDNKGNSYVSQLVIN

SEQ ID NO: 56081 - protein, 759 aa, Oceanicola granulosus HTCC2516
MSDQVKDSARQAALDYHRLPKPGKLEVRATKPLANGRDLSRAYSPGVAEACLEIKGDPQTASDFTARGNLVAVVSNGTAVLGLGDIGALASKPVMEGKAVLFKKFANIDCFDIELDERDPEKLAEIVCALEPTFGAINLEDIKAPDCFIVEKICRERMGIPVFHDDQHGTAIVVGAATTNALRVAGKRFEDIKVVSTGGGAAGIACLNMLLKLGVKRENVWLCDIAGLVHEGREEEMTPQKAEFAQGTEPRQLGDVIDGADLFLGLSGPNVLKPEMVAKMAGTPIIFALANPTPEIMPDAAREVAPDAIIATGRSDFPNQVNNVLCFPFIFRGALDVGATEINDAMQIACIEGIAALARATTSAEAAAAYHGEQLTFGADYLIPKPFDPRLMGVVASAVARAAIEAGVAARPLADMDAYKRKLDSSVFKSALLMRPVFDAAATAARRIVFAEGEDERVLRCAQAVLEETPETPILIGRPEVIATRCERLGLTIRPERDFNIVNPENDPRYRDYWGTYHELMARKGVTPDLAKAVMRTNTTAIGAVMVHREEADSLICGTFGQYLWHLNYVTQVLGTEALRPVGALSMMILEDGPLFIADTQVHAEPTPEQIAETAIGAARHVRRFGLAPAIALCSHSQFGNLDNETGRRMRAAVALLDSEPRDFCYEGEMNVDAALDRELRDRVFPDSRMTGAANVLIFANSDAASGVRNILKMKGGGLEVGPILMGLGNRAHIVTPSITARGLLNMSAIAGTPVSHYG

SEQ ID NO: 56082 - protein, 336 aa, Streptococcus agalactiae
MVVKVGINGFGRIGRLAFRRIQNVEGVEVTRINDLTDPNMLAHLLKYDTTQGRFDGTVEVKDGGFEVNGSFVKVSAEREPANIDWATDGVDIVLEATGFFASKAAAEQHIHANGAKKVVITAPGGNDVKTVVYNTNHDILDGTETVISGASCTTNCLAPMAKALQDNFGVKQGLMTTIHGYTGDQMVLDGPHRGGDLRRARAAAANIVPNSTGAAKAIGLVIPELNGKLDGAAQRVPVPTGSVTELVAVLEKDTSVEEINAAMKAAANDSYGYTEDAIVSSDIVGISYGSLFDATQTKVQTVDGNQLVKVVSWYDNEMSYTAQLVRTLEYFAKIAK

SEQ ID NO: 56083 - protein, 1691 aa, Cryptococcus neoformans var. neoformans JEC21
MSIANSSSSPEDQNITGLLENHSRETGELPSPPLVEDRAAPNGMKLDGENIVSQSNGISAAQAAVTTSRTSSLTSNLNRPQSVSGAQPAVASSSRSAINSPPRRYLLISQQSPSSRTTPCRSAGTASPTSRPPTPPLPPTQSTPVTVSGLPAPLILSPVPAASSAISPTIPSIPLHASLPYPTLSLPPSATPALPNSFTLSASTILPADSSISALPSTSAAGLPVMPVFISPATSSPAGPEPSTLQSASEATKSSNQKESPRKTDSKQAPSPSSTHGLWTNTRPFHASSNLSATSGKSSAASSRSTSRTLLPSRVATSDNVAGPSKTTSVSSTHPPARAPSLSLPSEPERQVHPRSPSHEGVGKREKKSKALSSGTGQSTPSRSSLSTYDVASNRKTKSTGLNALPQKPSSAGKTSSIPQRTSTLATAMAIRPFVRSPTSPCRPSSFEASGPIQSSGGAVKAAQNQDKIHPLSTTSSISSHSRETTTKAATPSHVTISSPSPSQSTSASTTVHVTQDAQKSATTSPTREKIHPSRRKSQTSDCVVAPTTSQTAASLSYPAGTSDGTGEADKKAAGTTVHAGPSSADFGTFVVPPTTAIASTTVSPSVTPPEDAPFLKSGPTVHPLFRAASAIGGQDTLTETGAVGDVLSQGSKGRASSPRITTTGAVSHLVLPIDVGSKIKPTAAPSLFASGVTIGNVDDQAAAQPQNPAPLPSALSVLSKKNLGSSSKESSVKSAASSVSSSSTLGDSVSGLGRKSHHKSTQSIPQSPLPTTNTSNSSGIEVNSWLNPQPFGPSFAASHLNTHAKKKWKGKEREKEREKEKAREKEKAKEENEQLRRRRMADLEKISANLEKYKGRMGVESRTRSIPRADGENRKRPPSPGISASTDGEVRVVKRSKPAWAIAPENGHVAAAMEKETNDNKKTTDAIKINHQPAAFYTPQFATPTSAAKTTTTPLSVTAGLGPPVNSSSSSSTPSLLSRSINLDIPRETPEERMDDDDGNDSTGGLLVRKTGKNDAVEEQVEQVRLDLDDVSIHGSSPVGPISTFTSRFRNVSITPSQTQKILEQPGEDVPIRRSAIKINGKQKAQRSKDKSDGSESEDDVPLNWPSRKGKGKAAPEPQDNSETQRDDDGVNLGSSNGEEGSSDDHSNPVLPPFLFKDRPAHVRQPLQTLFKGGFVAKHSYQRPLVKSSAVSPVPNANRTSSEPSAKAELLPQKRKRRPKKLTREQWHHIAQNHLSDVDDLLDESSKKRLSPKSAEKLGADLSKLTSPRVFSIVSRSEPRSKGAPIEENDNEYFTDSDSHTSDIALFLQHPDPPPPPERIREAKRNFGTRTIDPWNRQKHTFRSNPALHRAIFEAYIMQSTSMEESGGDDIKVTNEVDADGGPPDFEFVYSDTMLYPDGIPPPELGLGCDCDGPCDPDSETCTCVKRQELYFYDLGLKGFAYDENGKIRENSASIWECNELCGCPPECMNRVIQRGRAKDTGIEIFKTKEKGWGIRARSFIPSGTYIGSYTGELIREAESERRGVTYTAIGRTYVFDLDGWQIRHPPKGLEKIDKRAAELAEAVKMRAKAAMRESQEDAYNAYSVDAFHYGNHSCDPNLAITQAYVKDFHPERPLLVIFTRRDIKKHEELCISYKGIPDDDVPSPEPVKKKKGNKGKKQMSKTSASAHPPEMIALNSDKGPVEVKDICRW

SEQ ID NO: 56084 - protein, 478 aa, Geobacillus stearothermophilus
MALPGGAAMNITIRLQFEKDIVSFSDIAAAIGKAGGDIVGIDVISSSKVHTVRDITVSALDTKQCDLIIEALKKIRGVKIVNVSDRTFLMHIGGKIETNSKIPVKTRDDLSRVYTPGVARVCTAIAEDPRKAYSLTIKRNTVAVVSDGTAVLGLGDIGPYAAMPVMEGKAMLFKEFAGVDAFPICLDTKDTEEIIQIVKAIAPAFGGINLEDISAPRCFEIEKRLKEELDIPVFHDDQHGTAVVLLAGLLNALKIVDKKLEDIKVVLTGIGAAGIACTKILLAAGVRNIIGVDRHGAIHRDETYENPYWQEYAQLTNPDNLKGSLSDVIAGADVFIGVSAPGILKVEDVKKMARDPIVFAMANPIPEIDPELAEPYVRVMATGRSDYPNQINNVLCFPGIFRGALDCRAREINEEMKLAAAKAIASVVTEDELNETYIIPSVFNSKVVERVRQAVVEAAYRTGVARKDNIPVGGYTGQ

SEQ ID NO: 56085 - protein, 648 aa, Flaveria trinervia
MISLNSSFLERSSVTGGSRTQSQSLRLSARRPVVTSMLNSNSLPERNVSVSVDSAVRDVNAPVAVEVDRSVGEKPFAAVGGGVEDMYGEDTATEDHYITPWSVSVASGYSLLRDPHHNKGLAFTEKERDAHFLRGLLPPVVVNHDLQVKKMMHNIRQYQVPLQRYQAMMDLQQRNERLFYKLLIENVEELLPIVYTPTVGEACQKYGSIFENSQGLFISLKDKGRILEILKNWPHKKIQVIVVTDGERILGLGDLGCQGMGIPVGKLALYTALGGVRPSACLPITIDVGTNNEKLLNDDEFYIGLKQKRAAGQEYAELMNEFMSAVKQNYGENLLIQFEDFANHNAFDLLEKYRTTHLVFNDDIQGTASVVLGGLISALKLVGGSLADQKFLFLGAGEAGTGIAELIALEISKQTNIPLEESRKKVWLVDSKGLIVRSRLDSLQHFKKPWAHDHEPVNEFLDAIKTIRPTVLIGSSGTGQTFTKEVVETMSSLNEKPIILALSNPTSQSECTAEQAYTWSEGRAIFASGSPFKPVEYNGKLYVSGQANNAYIFPGFGLGLIISGAIRVHDDMLLAASEAPAEQVTQEHFDKGLIFPPFTSIRKISAHIAAKVAAKAYELGLASRLPQPENLVAYAESCMYSPKYRIYR

SEQ ID NO: 56086 - protein, 437 aa, Acidobacteria bacterium Ellin345
MHESLLSPFFAAVEGASTLRWHGRVTKVVGNLIESEGPLSSLGDSCEVISSKGDVYPGEIVGFRDNAVLSMTLQPPKGIRFGDSVVGLAQPPSIAVGDEILGRVLDATGAPLDGITPARPRGSRPVDGSAPLPYARIPVREVMPCGIRAIDGFVTCGRGQRIGIFGGSGVGKSTLIGMLTRGSAADVTVLALIGERGREVREFVEESIGEEGMQRAVVIVSTSDQSPLLRLRAAMAATAVAEHFAAEGKHVLLVLDSLTRFGMAQREIGLAAGEPPTAKGYTPSVFTLLARLVERAGNFERGSITGFYTVLMEGDDLQDPLVDAVRSLLDGHIVLDRKLASDGHYPPIQILESLSRLASAVCSVQHLQASRKLRAWLASYVRSEDLIRIGAYQRGGDPVLDQAVSAMPEIRKLLIQGALERTSLEEIVSGMSAIANR

SEQ ID NO: 56087 - protein, 402 aa, Oryza sativa Japonica Group
MTTDLLLLLLLLSSSRLALAAAFGVWINGAASSSPQSQEYEALQALKAAVVEDPRGALASWQGPNVCAYRGVYCSAPPDDAAASGAVVAGIDLNRANLRGTLPAAVSLLAHLTFLHLNSNRLAGQPPDSLRDLQYLTELDLSNNLFSGPFPAAALLIPSLVYLDLRFNAFSGGIPAEAFAKSSLDALFLNNNQFDGEIPETLWSSPATVITLANNRLTGPVPSAYGYGGRVREVLFLNNKLTGCIPEELGFLPTIEVLDLSYNSLSGHLPPTLSCLAGIEVLNIAHNQFTGELPDLVCDLKRITNLSVSFNFFSGISQHCNRLAGRSVFDFVGNCVPGRGLQRPPPECDGGPGDGGLSCLRSIPVTRPVPCAQASVSVGVGVIVGGAMPSFGAGGVVTVTVP

SEQ ID NO: 56088 - protein, 541 aa, Oenococcus oeni
MTDPVSILNDPFINKGTAFTEAEREELGLNGLLPAKVQALQEQVDQTYAQFQSKVSNLEKRLFLMEIFNTNHVLFYKLFSQHVVEFMPIVYDPTIADTIENYSELFVEPQGAAFLDINHPENIQSTLKNAANGRDIKLLVVSDAEGILGIGDWGVQGVDIAVGKLMVYTVAAGIDPSTVLAVVIDAGTNNEKLLKDPMYLGNKFNRVRGDKYYDFIDKFVNHAESLFPNLYLHWEDFGRSNASNILNSYKDKIATFNDDIQGTGIVVLAGVLGALKISGQKLTDQTYMSFGAGTAGMGIVKQLHEEMVEQGLSDEEAKKHFFLVDKQGLLFDDDPDLTPEQKPFAAKRSDFKNANQLTNLQAAVEAVHPTILVGTSTHPNSFTEEIVKDMSGYTERPIIFPISNPTKLAEAKAEDVLKWSNGKALIGTGVPVDDIEYEGNAYQIGQANNALIYPGLGFGAIAAQSKLLTPEMISAAAHSLGGIVDTTKVGAAVLPPVSKLADFSRTVAVAVAKKAVEQGLNRQPIDDVEKAVDDLKWEPKY

SEQ ID NO: 56089 - protein, 519 aa, Caulobacter crescentus CB15
MVVRTTACALIPVTLMSPATKGPTRTSRASTGRYGPMGRTPVASVSNAGPSAGMSADGGKVNMTFVAAIVAVATIGGFMFGYDSGVINGTQEGLESAFNLSKLGTGLNVGAILIGCAIGAFAAGRLADVWGRRTVMIISALLFVISAIGTGAAESSIVFIIFRLIGGLGVGAASVLCPVYISEVTPANIRGRLSSVQQIMIITGLTGAFVANYALAHTAGSSTAEFWLGLPAWRWMFWMQIIPAGVFFLCLLGIPESPRYLVAKGKDAQAEAILSRLFGAGQGAKKVEEIRASLSADHKPTFSDLLDPTTKKLRVILWAGLVLAVFQQLVGINIVFYYGSVLWQSVGFTEDDSLKINILSGTLSILACLLAIGLIDKIGRKPLLLIGSAGMAVTLGVLTWCFSTATTVNGALTLGDQIGLTALIAANLYVIFFNLSWGPVMWVMLGEMFPNQMRGSALAVCGFAQWIANFAISVSFPALAAASLPMTYGFYALSAVVSFFLVQKLVHETRGKELEAMQG

SEQ ID NO: 56090 - protein, 605 aa, Arabidopsis thaliana
MAHSQVAYLIPLKADLKEDNSSPRITLSEGPNIIGRGNVSIVDKRLSRKHITIIVSTSGSASLSVDGTNPVVIRSSGDGERKKVKPSEEVSVCNDDLIELIPGHHFFKLVLLNGRAAKKARKAEDDVEAIRRFCPPNEKLPSTFRLLSVDALPDWANTSCVSINDVIEGDVVAAILSNYMVDIDWLMSACPKLANIPQVMVIHGEGDGRQEYIQRKKPANWILHKPRLPISFGTHHSKAIFLVYPRGVRVVVHTANLIHVDWNNKSQGLWMQDFPWKDDDKDPPKGCGFEGDLIDYLNVLKWPEFTANLPGRGNVKINAAFFKKFDYSDATVRLIASVPGYHTGFNLNKWGHMKLRTILQECIFDREFRRSPLIYQFSSLGSLDEKWLAEFGNSLSSGITEDKTPLGPGDSLIIWPTVEDVRCSLEGYAAGNAIPSPLKNVEKPFLKKYWARWKADHSARGRAMPHIKTFTRYNDQKIAWFLLTSSNLSKAAWGALQKNNSQLMIRSYELGVLFLPSPIKTQGCVFSCTESNPSVMKAKQETKDEVEKRSKLVTMTWQGDRDLPEIISLPVPYQLPPKPYSPEDVPWSWDRGYSKKDVYGQVWPR

SEQ ID NO: 56091 - protein, 431 aa, Penicillium citrinum
MTQSVLSRRAQDVVDAGSENPMWDVMKDTWHASTNPTGYVNVGVAENALMHDELLEFINKKLELPAKYLTYNDGGGGSSRLKAAIAAFLNHNLKPVIPLEPSHIMATNGVSSAIEHVAWSFADPGEGILLGRPYYGMFIPDMSLRTGSSVVPVSFGELDPLSVEGVDKYEEALLEFHRTTGKKVKALMLAHPHNPLGRCYSREVLVKLMRLCQKYQVHFISDEIYALSVFENTVDEHPPPVKFESALSIDLTGIIDPRLVHVLWGMSKDFGANGIRLGVIISQANRDIHMALTGPSLYSYASGITDHLTALILEDFDFTTRYIQQNQKLLSESYAYTANYLKEHGIEYATGCNAAFFVWMNLGKKYRELHPEDECENVGEQIMQRLLQKKVFLASGFLFGSEKDGWFRIVFTQGHDYLSVALERINAALEE

SEQ ID NO: 56092 - protein, 104 aa, Glycine max
MGAKEVERVDGRTPNQLRPLACSRNLLNRAHGSAQWSQGNTIVLAAVYGPKAGTRKGENPEKASIEVIWKPKSGQIGKPEKEYEMILKRTLQSICLLTIHPNTT

SEQ ID NO: 56093 - protein, 956 aa, Arabidopsis thaliana
MTSMIVKTTPELFKGNGVFRTDHLGENRMVSRSNRLGDGSNRFPRTGTIHCQRLSIAKTGLHRETKARAILSPVSDPAASIAQKRVFTFGKGRSEGNKGMKSLLGGKGANLAEMASIGLSVPPGLTISTEACQQYQIAGKKLPEGLWEEILEGLSFIERDIGASLADPSKPLLLSVRSGAAISMPGMMDTVLNLGLNDQVVVGLAAKSGERFAYDSFRRFLDMFGDVVMGIPHAKFEEKLERMKERKGVKNDTDLSAADLKELVEQYKSVYLEAKGQEFPSDPKKQLELAIEAVFDSWDSPRANKYRSINQITGLKGTAVNIQCMVFGNMGDTSGTGVLFTRNPSTGEKKLYGEFLVNAQGEDVVAGIRTPEDLDTMKRFMPEAYAELVENCNILERHYKDMMDIEFTVQEERLWMLQCRAGKRTGKGAVKIAVDMVGEGLVEKSSAIKMVEPQHLDQLLHPQFHDPSGYREKVVAKGLPASPGAAVGQVVFTAEEAEAWHSQGKTVILVRTETSPDDVGGMHAAEGILTARGGMTSHAAVVARGWGKCCIAGCSEIRVDENHKVLLIGDLTINEGEWISMNGSTGEVILGKQALAPPALSPDLETFMSWADAIRRLKVMANADTPEDAIAARKNGAQGIGLCRTEHMFFGADRIKAVRKMIMAVTTEQRKASLDILLPYQRSDFEGIFRAMDGLPVTIRLLDPPLHEFLPEGDLDNIVHELAEETGVKEDEVLSRIEKLSEVNPMLGFRGCRLGISYPELTEMQARAIFEAAASMQDQGVTVIPEIMVPLVGTPQELGHQVDVIRKVAKKVFAEKGHTVSYKVGTMIEIPRAALIADEIAKEAEFFSFGTNDLTQMTFGYSRDDVGKFLPIYLAKGILQHDPFEVLDQQGVGQLIKMATEKGRAARPSLKVGICGEHGGDPSSVGFFAEAGLDYVSCSPFRVPIARLAAAQVVVA

SEQ ID NO: 56094 - protein, 194 aa, Zea mays
TWAIILGGLQVGGGINLQNAMSYLNEGASHVIVTSYVLSDGKMNIERLTKLVELVGKQRLVLDLSCRKKDGRYTIVTDRWQKFSDVFVDEPALEYLAAFADEFLVHGVDVEGKRLGIDEELVELLGHHSPIPVTYAGGVSTMDDLERIKKAGKSRVDVTVGSALDIFGGDLPYKDVVLWHKKQSMVGQVSRNMW

SEQ ID NO: 56095 - protein, 222 aa, Vitis vinifera
MSANHLTRTILMGKVIIQCLFWSKKFISCHSFLFFHIIVQHFVPNLTIGAPVIESLRKHTNAYLDCHLMVTNPLDYVEPLGKAGASGFTFHVEVSKENWQELVERIRSKGMRPGVALKPGTPIEEVYPLVEGENPVEMVLVMTVEPGFGGQKFMPEMMDKVRALRKKYPSLDIEVDGGLGPSTIDMAASAGANCIVAGSSVFGAPKPEQVISLLRKSVEEAQ

SEQ ID NO: 56096 - protein, 210 aa, Microcystis aeruginosa PCC 7806
MSIITHRTKIVATIGPASNSPEVLKEMIGAGMNVARLNFSHGSYEDHARVVSLLRQISQELDNPITLLQDLQGPKIRVGNLPNGSITINDGDYLTLVPMDEYRGEANTVSIDYPYLAEEAELGEQILLDDGLLELKIVEINGKDLKCQVLEGGILKSRKGVNLPRLNLRLPSMTEKDKQDLEFGLSQGVDWVSLSFVRKGENISRALRHF

SEQ ID NO: 56097 - protein, 172 aa, Brassica napus
PRGPTEGVMALIEEKWDDLVANMPLKICFPALEQEEWRIITGSDPKNTPWSYHNGGSWPPLLWQFTLACIKMEKLDLAKKAVAVAEKRLKEDQWPEYYDTKSGRFVGKQSRLYQTWTIAGFLASKKLIEQPEKASLLFWEEDYQLLETCVCGLNKSSGKKKNKCSRFTPPRS

SEQ ID NO: 56098 - protein, 541 aa, Coprinopsis cinerea okayama7#130
MTIVLTPYWSNGVQKLKVQPTGKANRGLVPPAFDPAIHVQRALAQLRSKDKPLEKYIFLSGLKHDDAPLFYKLCLENMSEITPIIYTPTVGDACIQFSHIYRRPEGLYVSIKDKGQIKQVIANWPKIHEARISVVTDGSRILGLGDLGVNGMGISIGKLSLYVAGAGIRPESTVPITVDLGTNNETFLNDPFYLGLRQKRITGPEMDEFMDEFMHEMSMAFPKMMIQFEDFSTDNAFRYLERYRRKYPVFNDDIQGTGAVVLSGFLNAAQLSSDASGMPMSEHRILFFGAGSAGVGVATQLMSFFTLQGLSVEEARSRIWLIDSQGLVYDGRGRLAEHKKYFSRKDYNGPPMTNILDIIDYVKPTALLGLSTISGAFTPEVIQAMAAINPRPIIFPLSNPVRLSECSFADAVKYTNGNVLFASGSPFPEQQYGDHILYPGQGNNMYIFPGIGLGAILARASQVTDSMVEASSLGLANSLTEDERALDLLYPRVERIREISAHIARQVIRAAQKAGVDRSEALRKMNDAELLAFVKRKMWKP

SEQ ID NO: 56099 - protein, 539 aa, Silicibacter pomeroyi DSS-3
MFQDLHALHTRTSGRRILDLFAADLRRAERFSADLGEMRLDYSKTQIDDAIRAGLIALCDRAQLADKREAMFAGAPINETEGRAVLHTALRNLDGGPVHVDGAEVMADVRLTLARMRRFAEALRSGALPGAGGAITDVVNIGIGGSDLGPAMAVLALAPYHDGPRCHFVSNVDGAHIADTLRGLDPARTLVIVASKTFTTIETMTNARTARDWMQRGGGDPERQFAAVSTATDRTAAFGIPGDRVFGFADWVGGRYSLWGPIGLSLMIAIGPDDFDAFLRGAQEMDRHFQSAPWEKNLPVMLALTGIWHHQICGHPSRAVLPYDQRLARLPAYLQQLEMESNGKSVAMDGTALDQAAGPIVWGEPGTNGQHAFYQLIHQGKQVVPCEFMVAARGHEPDLAHHHRLLIANCLAQSEALMRGRPLDEARAIAAARGVAGDELERQARHRVFAGNRPSTTLIYPRLTPAMLGRIIALYEHRVFVEGVILGINSFDQWGVELGKELATSLGPVVDGTESAAAKDGSTAALVDYVLAHRDTDLT

SEQ ID NO: 56100 - protein, 485 aa, Silicibacter pomeroyi DSS-3
MVSRIIPVEPFDLVVFGGTGDLARSKILPALFRRSVAGQVPEGGRIIGVARQDMGVEAYHALIAQSLRELLPDLAQVPGALDRFLKQLDYVALDATQPEGWEQLASMLGQGVRAFYFSVGPGLFGALAERLRQHGLVSDDTRIVVEKPFGHDLASARALNATLAAQFHERQIYRIDHYLGKETVQNLMAVRFGNMLFEPLWNSQYVDHIQITVAEAVGVGGRADYYDRAGAMRDMMQNHLMQLLCLIAMEPPAKFDPDAVRDEKLKVIRALDAVKPHHIVRGQYAVPVGGVGQGYRDEVGDPRSITESYIALRAHISNWRWAGTPFYLRTGKRLVARSSVINVMFKDAPHSIFGEEAGRHANVLSIRLQPNEGITLKVTIKEPGPGGMRLVDVPLDMSFAKALGPENQSPPDAYERLIMDVIRGNQTLFMRGDEVEAAWAWTDPIIAGWQARGDVPKPYDCGSTGPGDAELLMRRDGRRWQGINP

SEQ ID NO: 56101 - protein, 363 aa, Cryptococcus neoformans var. neoformans JEC21
MSAFAPRPVVPIKDPKLQPWVEKYRPKTIDDVSSQDNTVAVLRKALASTNLPHMLFYGPPGTGKTSTILALARQLFGPDLFRARVLELNASDERGISVVREKIKSFARETPRHAPAVSSDGKEYPCPPFKLIILDEADSMTQDAQSALRRIMETYSKITRFCLVCNYVTRIIEPLASRCSKFRFKPLEQGSTRARMEMIAENEGVQTDPGVISLILELAGGDLRKAITYLQTAQRLHSSIEPPMPVSALSIHEISGVVPEDLITDLLAAMGVDRQTGIDHSLARGFDGVKIAVTRVEREGWSVGQVLEQIHDTLIPIPSIPAIQKSLAGIAIAECDKGLCEGGDEELQLLDCMLRIKDIMGRQ

SEQ ID NO: 56102 - protein, 193 aa, Trichodesmium erythraeum IMS101
MTVFEGTFTQVDSLRFAIVIARFNDLITGKLLEGCQDCLKRHGVDPDPDGTQVDYVWIPGSFEIPLVARQLAMSNSYDAVICLGAVIKGQTPHFDYVAAEVSKGIAAAAFQTGTPVIFGVLTTDTMQQALERAGIKSNKGWEYAMNALEMGSLMRQIKGSINSSPNNYSITGKTQALPITSNDFIESDISPEV

SEQ ID NO: 56103 - protein, 283 aa, Bacillus cereus ATCC 14579
MIRVGYLGPEATFTNMAVSRFFPEAEHVPYRTIPDCIDAAANENVDFAVVPLENAIEGSVNITVDYLVHEQPLSIVGEITVPIQQHLLVHPQYAEVWEEVYAVHSHPHAIAQCHKFLNEELKGVTVRDMTSTSAAAQYVKEHPEEKIAAIANEAAAEKYGLTIVRRSIHTHKNNHTRFLVLHKKKKAVLPNNGENRGEKTTLMITLPADYAGALYQVLSAFAWRKLNLSKIESRPMKTGLGNYFFLIDVDKAYDDVLLPGVTMELEALGFSVTVLGSYSSYWL

SEQ ID NO: 56104 - protein, 141 aa, Bordetella petrii
MSVERTLSIIKPDAVAKNVIGQIIARFENAGLKVIAARLQQLSRADAERFYAVHKERPFFKDLVDFMVSGPVFVQVLEGEGAIQKNRDLMGATDPKKAAPGTIRADFADSIDANAVHGSDAAETAAVEVAFFFPEINIHSR

SEQ ID NO: 56105 - protein, 391 aa, Physcomitrella patens subsp. patens
MGYPSAGTNATPKELGYTMPGEFEKHAGCWMGWPYDGNLWRENAKPAQAQYAAIAKAISEFEPLTMFAHPGEPAEVAREYFEDAPNVTVVELEIEDGWTRDWGPSCVAKDDPVTGKRIVAGVHWDYDCYGGLLKRKLGLPTMMPSWDKDYAAGRALLEMNGLEVFEAPIHLEGGSIHSDGEGTLMCTEECLLHPSRNPHLGKEGIEKVLKDYLGLEKIIWFWRGIMGDDGVVNGHVDNFCCFVRPGVVLLAWTDDKDDPQYEVSMNAYERLSNTTDAKGRKLEIIKLPRPPPLFRTFNEANGLAEGYVEKGYVPRIAGERLPSTYINHYCANGGVVVPQFGGVAAEADKKALEIIQEAYGPDYKVVGVSSREVVLNAGNIHCITQQHPAAW

SEQ ID NO: 56106 - protein, 879 aa, Penicillium marneffei
MFTSPTESEFSVNNDGLDSVRSWDEKKVADWLHSIRCAQYEPLFKANNFNGDNLLECDQKILQEIGIKKIGDRVRIFVAIKQLRNKALINLKKNNKDPLAALEATAYAPLSNDVYSSSNSRNPLTSKWSRQLDSIGGRSNSRPSSPLTMDDRSRAFRYASNPIDGPRMPGYFSHPSSAGSGSGRHPITPGDSSQFSHLRQNPSIDGYTIGSLPANSHVIRIIYTGGQTKAMNVKGCKNTEEIMVHVLRKLQLPEYQHRSYCFYVLDGLEPDPANCRRVTDSELMRICEGSQKSERGRLILRKIHAGEPDADELRRAAQLALDESQATHLNALSSSNARNQLKIQQLTGEPWHHIKQPISPLTSERSRHLANDEHEASPTSAGMERPSASKLRSFFGARPPSEMIIHELTSYFPSHQREDIEKTMRMSVRRSQRLSRAASRLSVVSNISFASSMKDAPPIPSIADTWLTGGQLARPSRPLSVARSHLPQVSYRDSIASSSLQPLQEESPIEPDRKSYVSFGSGSDPVLGDANSAQRSFLDETLSVAATDGGGSLNERLSMIVAEDGEEEDTGLADFLNGDNFAAKNWMKGSLIGEGSFGSVFLALHSITGELMAVKQVELPSATKGTEFDKRKNTMVTALKHEIELLQGLHHPNIVQYLGTSADDHNLNIFLEYVPGGSIAEMLKQYNTFQEPLIKNFVRQILAGLSYLHSRDIIHRDIKGANILVDNKGGIKISDFGISKRVEASAMLGSSAVSGRGHLHRPSLQGSVYWMAPEVVRQTAHTKKADIWSLGCLVVEMFIGAHPFPDCSQLQAIFKIGNNQARPPAPEHASEEARAFLDVTFEINHEKRPSADELLESCEMSLCMGFGLLGSEMLYNEID

SEQ ID NO: 56107 - protein, 290 aa, Medicago sativa
MEAKEQDVSLGANKFPERQPIGIAAQSHDDGKDYKEPPPAPLFEPSELTSWSFYRAGIAEFVATFLFLYITLLTVMGVNRSESKCKTVGIQGIAWSFGGMIFALVYCTAGISGGHINPAVTFGLFLARKLSLTRALFYMVMQTLGAICGAGVVKGFEGKTFYTNKNGGANFVAPGYTKGDGLGAEIVGTFVLVYTVFSATDAKRSARDSHVPILAPLPIGFAVFLVHLATIPITGTGINPARSLGAAIIFNKDLGWNDHWIFWVGPFIGAALAALYHTVVIRAIPFKSSN

SEQ ID NO: 56108 - protein, 367 aa, Ashbya gossypii ATCC 10895
MDADAILKKDQRRSSLKQRNLLLSMRLNQTTATNGAPPQARVQPGKGYRNPGKVLSPIRNQEMSPGKRPTLEISELKNVSPINQAHKTGKARAGGVPLSKLQNLKLADFEIGKVLGKGKFGRVYCVRHIESGFVCALKAMEKKDIIQYNIEKQFRREVEIQSSLRHPNLTQLYGYFHDEKRVYLLMEYLVNGELYKHLKGRSHFNDVVASYYVYQMADALDYMHERNILHRDIKPENIIIGFNNTIKLTDFGWSVITPKGSKRKTLCGTVDYLSPELIRSREYNEKVDVWALGVLTYELLVGSPPFEEESKELTYKRILKRNLIFPDHVDTEARHLISRLLEYDPGDRIPLKEVKKHPWIEKNKPFW

SEQ ID NO: 56109 - protein, 559 aa, Penicillium marneffei
MADAFKPRTMKRKNVKGLALNSTPKPASAPSEGDAQVPGAVGNTESTRSDTLEIGLEFKLDLRSEDLVTLKEVGAGNGGTVAKVMHATTKVVMARKIIRVDVKENIRKQILRELQVGHDCNSPYIVTFYGAFQNESRDIVLCMEYMDCGSLDRISKEFGPVRIDVLGKITESILAGLVYLYENHRIMHRDIKPSNVLVNSRGNIKLCDFGVATETVNSVADTFVGTSTYMAPERIQGGAYTVRSDVWSVGLTVMELAVGRFPFDATDSAAGDRASAGPMGILDLLQQIVHEPAPKLPKSDAFPPILHEFVAKCLLKKSEERPTPRELYDKDAFLQAAKRTPVDLQKWARKMMHAQDRHSYLEPPAPASLKTATTTTSSSPSPDMTPRDTPATTVSAAPSHPTPTFGDIPLRNEVTSAHKQHFSPSSHHIPTSHHGDYSNHNQYAQQQPQHASHNSRSSQSSSRQQSPYLSLEHLSLESEEARNGRGRSPRTYSGEPRSAIDPPSRPHFPRALSSNHQGGLHTATLPMGAAPPPSGPLPPPPQSAGEAWRNQYRARENMT

SEQ ID NO: 56110 - protein, 715 aa, Penicillium marneffei
MAQGQNSTHGGSRKISFNVSDQYDIQDVIGEGAYGVVCSALHKPSGQKVAIKKITPFDHSMFCLRTLREMKLLRYFNHENIISILDIQRPRSYDSFTEVYLIQELMETDMHRVIRTQDLSDDHCQYFIYQTLRALKAMHSANVLHRDLKPSNLLLNANCDLKVCDFGLARSAASTDDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKIPFKHLFPKTTDLALDLLEKLLAFNPAKRITVEEALRHPYLEPYHDPDDEPTADPIPEEFFDFDKNKDTLSKEQLKLCRDNPGSSFTLTQSDLELNPSRYGIKHSKISRSPPTLSELAEKLQGSLSANYERSSVTVVPCLDLREPPFLLAHEGLSGDEKVADVGGQTHLYPRPMRDKTYALISISREMEIEVGESHEQVMIIGAGAGSSDIVGQNCEMAINFGWRYGGGGGGGGGGGGGVPQGSWRHNGGRYVKIEPGTDSVLLEKTDSARWWFGLMGNLFASDGGPGDVLKITARKRVGEEGSFTECIRKALHAAYGDSQIVSLGGVFVIKSGKARYHIMPDFPPEELPFRDRQRFNDWLTYHDFKGPMTCLTVLHSVDPDKKLGLRMEHTHALSTVGENAGGHYHYDVEEEKEEIEYEGYFNTAKALYRIDKPEFSLEQVLQK

SEQ ID NO: 56111 - protein, 478 aa, Caulobacter crescentus CB15
MTDTLRHYIGGERVAADAPAESLNPSNTNDVVAKVPMGGQAEVDAAVDAARKAFPAWADASPEVRSDLLDKVGSTIIARSADIGRLLAREEGKTLAEGIGETVRAGRIFKYFAGEALRRHGQNLESTRPGVEIQTYRQAVGVYGLITPWNFPIAIPAWKAAPALAFGNTVVIKPAGPTPATANVLADIMAECGAPAGVFNMLFGRGSMGDALIKHKDVDGVSFTGSQGVGAQVAAAAVARQARVQLEMGGKNPLIVLDDADLERAVAIALDGSFFATGQRCTASSRLIVQDGIHDKFVALLAEKVAALRVGDALDPNTQIGPAVSEDQMETSYRYIDIAASEGGRVVTGGDRIKLDNPGWYVRPTLIADTQAGMRINNEEVFGPVASTIRVKSYEEALEIANGVEFGLSAGIATTSLKHARHFQRYARAGMTMVNLATAGVDYHVPFGGTKSSSYGAREQGFAAVEFFTQTKTSYSWS

SEQ ID NO: 56112 - protein, 518 aa, Brassica rapa subsp. pekinensis
MAAAACGQLNLEEPTPIRGSRSVDCFEKLEQIGEGTYGQVYMAKDIKTGEIVALKKIRMDNEREGFPITAIREIKILKKLHHENVIHLKEIVTSPGRDRDDQGKPDNNKYKGGIYMVFEYMDHDLTGLADRPGLRFTVPQIKCYMKQLLTGLHYCHVNQVLHRDIKGSNLLIDNEGNLKLADFGLARSYSHDHSGNLTNRVITLWYRPPELLLGATKYGPAIDMWSVGCIFAELLNGKPILPGKTESEQLNKIYELCGSPDENNWPGVTKMPWYNQMKSSRPLKRRVREVYRHFDRHALELLEKMLVLDPSQRISAKDALDAEYFWTDPLPCDPKSLPTYESSHEFQTKKKRQQMRHNEEAAKKQKLQHPQQQQHSRLPPQQHGVGQSHAAPHWPVGPNHPINNGPPPQLPAGGPSGHNYYQKARVGGAPGPNRYPPGGNQTGGYNNNQSRGGYSSGSYPPQGRGAAPYGGAGPRGPSGGYGAGPPNYSQGGGGQYGGSGRGQNPMGGARNQQYGWQP

SEQ ID NO: 56113 - protein, 946 aa, Opitutaceae bacterium TAV2
MSVIKKTNKAAASKTAAKSTPKAASKGTKNVKYVYTWGAGKADGNGGMKPLLGGKGANLAEMTRIGLPVPPGFTVTTEVCTYYYANKRTYPASLQAQMEAGVKNMERIMGTKFGDSQGFPLLVAVRSGARDSMPGMMDTILNLGLNDQTVVSLEKATKNPRFAWDCYRRFIQMYGDVVLGVQKRENEDHEPFETVIHAYKHEVYNADIEDSKLTAADQQELVKRFKALVKERTGKVFPNDPWDQLRGAAGAVFGSWMNDRAIVYRRKYNIPTEWGTAVNVQAMVFGNTGDTSGSGVAFTRNPANGTNEFYGEFLINAQGEDVVAGVRTPEPVANLKKEMPKSYAELLKVRAILEKHFKDVQDIEFTIQEGKLFMLQTRNGKRTAAAALKFSIDMVKEKLINWETAILRNPADQLEQLLAPIFDLSEVKKAKVIATGLPAGPGAATGKIYFNAERAVAAHEKGEKVLLVRVETSPEDLRGMIAAEGILTARGGVSSHAALVARQMGKVCVCGAAAVQIDYDKKVAIVAGQHFSEGDYLSIDGTAGTVYAGQIKTAPSEIIAGLLHGDKAAQKTQKYKDYAQLMSWCAKATKLQVRTNADTPEQAANAIAFGATGIGLTRTEHMFFEGDRIDAMREMILADTVEAREAALAKLLPYQRDDFFGIFKALKGYPATIRFLDPPLHEFLPQTKEQQMDLARKLEIPVEKIMTRVHELHEFNPMLGFRGCRLGVKYPEIPRMQARAVFEAAADALKKGIKAKPEIMIPLVGFKRELDQQVAIVHEAAAAVQKEKKVKLTYSVGTMIEVPRGALTADEIARTAEFFSFGTNDLTQTTLGMSRDDSGSFLGAYQEHEIIKKNPFASIDQTGVGQLMEIAIAKGRATRPDIKLGICGEHGGDPDSVKFCHRIGLAYVSCSPYRVPVARLAAAQAAVEESLAAAKKASTTKTKKKK

SEQ ID NO: 56114 - protein, 405 aa, Herminiimonas arsenicoxydans
MLKLDFHPAGRHFLNIPGPSPVPDRLLRAMSYPTIDHRGPEFGAMGLKILSGIQKIFKTTQPVVIYPASGTGAWEAALANTLSPGDHVLMFETGHFATLWKKMAESLGIKPEFIGLPGYEGWRNGVRADMIEARLRADTKHDIKAVCVVHNETSTGVTSNIAAVRKAINAAAHPALLLVDTISGLASADYRHDEWGVDVTVSGSQKGLMLPPGISFNAVSKKALEASKTAKLPRAFWGWNEIIEMNKTGYWPYTPNTNLLYALHEALDMILSEGLDNVFERHQRLGAACRTAVQAWGLEIQCADPEVYSPVLTGVVMPDGVDADVVRRLIYERFNMSLGAGLGKAKGKMFRIGHLGETSDLSLMASLAGAEMGLKLAGVKLAGSGVVAAMEYLESHAVPALKIPV

SEQ ID NO: 56115 - protein, 220 aa, Streptococcus agalactiae A909
MSTNKIAPSILAADYANFANELKRIEETTAEYVHIDIMDGQFVPNISFGADVVSSMRKHSKLVFDCHLMVVDPERYIEAFAQAGTDIMTIHVEATKHIHGALQKIKEAGMKAGVVINPGTPVESLIPILDLVDQILIMTVNPGFGGQAFIPEMMSKVKTVAAWRKEYGHHYDIEVDGGIDNTTIKAAAEAGANVFVAGSYLFKASDLPAQVETLRVALDD

SEQ ID NO: 56116 - protein, 434 aa, Brassica rapa subsp. pekinensis
MCGLDRCLADTIRSESSDHGGLFLDESVPSSSVSFVPCKNCTVSSMRFVGKSSFLKLRRRDRTRGPLFLSVSLSIKKKESEGYNGQNGYKSLQLKDSVLIQEAGEKKIKCYGERIRSCSQHHQASMGWSFCCHCFRVSLFLFFTLILMRGFVGLSRTCIAPLERMKLEYIVRGEQRNLLGLIQMIATTEGVRGFWKGNLVNILRTAPFKSINFYAYDTYRGQLLKLSGNEETTNFERFIAGVTASLLCLPLDTVRTVMVAPGGEALGGVVGAFRHMVQTEGFFSLYKGLVPSLVSMAPAGAVFYGVYDFLKSAYLHTPEGKKRLEHVRQEGDELNAFDQLELGPMRTLLYGAVAGACSEAATYPFEVVRRHLQMQSHERKLSAVATCVKIVEHGGVPALYAGLIPSLLQVLPSAAISYFVYEFMKVVMKVESAQ

SEQ ID NO: 56117 - protein, 478 aa, Ashbya gossypii ATCC 10895
MDLRVGRKFRIGRKIGSGSFGDIYHGTNLISGEEVAIKLEPIRTKHPQLDYESRVYKYLSGGIGIPFIRWFGREGDYNAMVIDLLGPSLEDLFNYCHRKFSLKTVMMLALQMICRIQYIHGRSFIHRDIKPDNFLMGVGRRGSTVHVIDFGLSKKFRDFRTHNHIPYRENKNLTGTARYASVNTHLGIEQSRRDDLESLGYVLIYFCKGSLPWQGLRATTKRQKYDRIMEKKLCISVEQLCVGLPIEFVEYMRYCRNLRFDERPDYMYVARLFKDLSIKLEYHNDHLFDWTMLRYTKAMIDKQSQAAETQHQSQQQAQEPANGDSDTDSKNASFMKVKKLAMMKFPSHFHYWKPTDTHHPSPEEIKHQTVQNTQIVSTIPDEVLSEIDKNMEALKQEAEQGRARPGNALPQQSNGAVVTLLEQQQAQEQGQQEQQLQQQQQQQHHHPQTQVTPAQAQSPQAQPPAKPDGNAGGAGIWL

SEQ ID NO: 56118 - protein, 626 aa, Flavobacteria bacterium BBFL7
MNYISVENVSRSFGERVLFDNISLGINEGQKIGFVAKNGFGKTSLLDIIIGKEMPNTGSVNRRNDLRMAFLLQEPDLDPNATIEEIILDSDIPIIKIIANYEKALQNMEDADKYQAAFDAMDSSNAWDFETKYKQILSKLKLDDLSQKVENLSGGQKKRIAMAIALLSDPQLLIMDEPTNHLDLEMIEWLEEYFKQENYTILMVTHDRYFLDRVCNEIIELDNGKLYTYKGNYSYYVEKKEERLEIEQTTQEKAQQLYKKELQWMRRQPKARTTKSKSRIDDFYQIKEAAHNRRKDHKVELEINMERLGTKVVELHKISKSFPGKKLIDNFSYNFIKGERVGIIGKNGTGKSTFLNMITGNLLPDSGKVVKGETVKIGYYTQGGIDIKPGQKVIDVIKEYGEYIPLNKGKIISASQLLERFMFDSKKKHDFVEKLSGGERKRLYLCTVLIQNPNFLILDEPTNDLDIPTLNILENFLMDFPGCLMVVSHDRYFMDKIVDHLFVFNQSGTITDFPGNYSDFRAYVGNTDLALDKEDTASGEKVVTKKTVEKKAVENNGPTREQQKELSRLENSIKKLEEQRVKLQESFLDTSLTPEELAANSIKLDQVKADLEEREMEWLELTESIG

SEQ ID NO: 56119 - protein, 309 aa, Arabidopsis thaliana
MASSGDYDEIIKSISDAPPTHYMVKIESFSLLTKHAIERYETESFEAGGYKWKLVLYPNGNKSKNTKDHVSVYLALADSSSLSPGWEVYAVFRLYLLDQNKDNYLILQGNERRFHSVKREWGFDKFIPTGTFSDSSNGYLMEDTCMFGADVFVSKERRSGRGECLSMIKDATSSKHVWKIENFSKLDKESYDSNAFFAGDRKWKIEFYPTGTKQGTGTHLSIYLTLVDPETISDGTKIFVEFTIRIFDQLQGRHIAGKVTKWFSRSSSEHGWVKYVSMVYFTQPNSGLLLKDVCLVEADVCVHGITSAI

SEQ ID NO: 56120 - protein, 714 aa, Vitis vinifera
MQSSQTQALLQLRKHLEYPLALEIWENYSGDFCNLASTPHMAITCQDNSVSELKIMGDKHVKVSDFSGFAVPNETLSDGFSIDSFVTTLSRLSGLRVLSLVSLGIWGPLPDKIHRLALLEVLDLSSNFMFGSIPPKVSTLVKLQTLTLDANFFNDSVPDWMDSLSNLSSLSLRNNRFKGQFPPSISRIATLTDVALSHNELSGKLPDLSSLTNLHVLDLRDNHLDSELPIMPKGLVTALLSENSFSGEIPAQLGELAQLQHLDLSFNSLTGTPPSALFSMANISYLNLASNMLSGSLPDGLSCGDELGIASDRRVVKFGGNCFSIDAQHQHQESYCKAAHIKGKQSKGKEIGVLLGAIAGAVIIHLYYSFYVEGSFEQPAMPKLAQENSSTGISPELLANARFISQAAKLGTQGSPTYRLFSLEELKDATNNFDPMTFLGEGSIGKLYKGKLENGAYVGIRTITLYRKYSIRNLKLRLDLLSKLRHPHLVSLLGHCIDGGGQDDSNVDRFFLIYEYMPNGNYHTHLSENCPAKVLKWSDRLAVLIGVAKAVHFLHTGVIPGSFNNRLKTNNILLDEHRIAKLSDYGMSIIMEENEKVDINLQRKQLEDDVYNFGFILLESLVGPIVTGKGETFLLNEMASFGSQDGRKRIVDPIVLTTSSQESLSIVVSITSKCVSPEPSTRPSFEDVLWNLQYAAQVQATADADQKSDGASQT

SEQ ID NO: 56121 - protein, 710 aa, Methylococcus capsulatus str. Bath
MACSVLSCAREGLCCLMRNPRTKAITLAGLAEFLALGLLVDWGTAFAFTAALSALLYGILSIGWVNAQPAGNERMVDIATAIQQGAQAYLNRQYRTIGIVGWLLFFVIGAFLGWSIAFGFVIGAALSGAAGYIGMNISVRANSRTAQAAITGMDEAFSTAFRGGAITGMLVVGLGLLGVAGYYALLKSVGATDPLHALVGLAFGGSLISIFARLGGGIFTKGADVGADLVGKVEAGIPEDDPRNPAVIADNVGDNVGDCAGMAADLFETYAVTIVATMLLGGLLTGGSEAATVYPLVLGGISIVASIIGTFFVRITPGKKIMSGLYKGVIVSGGLAAAAFLPITGFMFGGGVSLGGIDVSWIGIFFSALIGLGLTGLMVVITEYYTATEFAPVRHIAEASTTGHGTNIIAGLGVSMKATAAPVLAVCASIWGAYELAGLYGIAVAATAMLSLTGMIVALDAYGPITDNAGGIAEMAELPDSVRAVTDPLDAVGNTTKAVTKGYAIGSAGLAALVLFADYTHNLGGNVNFDLSNHMVIIGLFIGGMVPYMFGALAMEAVGRAAGGIVNEVRRQFREIPGIMEYTAKPDYSKAVDMLTQAAIKEMVVPSLLPVAIPVLVGLLLGKEALGGLLIGTIITGLFVAISMTTGGGAWDNAKKHIEDGNFGGKGSEAHKAAITGDTVGDPYKDTAGPAVNPMIKIINIVALLIVPLL

SEQ ID NO: 56122 - protein, 167 aa, Citrus unshiu
MASADVEFRCFVGGLAWATTDSSLHEAFSAYGDILESKIINDRETGRSRGFGFVTFRDEKSMRDAIEGMNGQNLDGRNITVNEAQSRGSGGGGGGGYGSRGGGGYGGGGRRESGGGGGYGGSRGYGGGGGGYGGRREGGYSRDGGYGGDGGSRYSRSGASDGGSWRN

SEQ ID NO: 56123 - protein, 347 aa, Glycine max
  misc_feature (100)..(100): Xaa can be any naturally occurring amino acid
MEAQIHLLEQEAYSAVLRAFKAQSDALTWEKEGLITELRKELRVSDDEHRELLTRVNSDEIIHRIREWRQTGCYQPARRSTSQTFHDILPSPTVSASRKXQKTSHSGQSLPALSSVKSVQYTSAGPTGGRHFANHNSSALASNASATEAAAFDPLIGKKVWTRWPEDNHFYEAVVTDYNPADGRHALVYDIIKVNETWEWVDLKEISPEDIKWEGEDPGILHRGGHGGQGGGGRKFFGHGGDSLGAGRGRGHPRFQARQEFLPPQNGIGRRVLDDIELLNTDSLVKEVERIFATSPQDSMELEKAKQMLKEHEQALVDAIARIADASDGESDGEQPFLQHSQLMERG

SEQ ID NO: 56124 - protein, 947 aa, Zea mays
MAASVSRAICVQKPGSKCTRDREATSFARRSVAAPRPPHAKARRRHPLRLRRGTGPHCSPLRAVVDAAPIQTTKKRVFHFGKGKSEGNKTMKELLGGKGANLAEMASIGLSVPPGFTVSTEACQQYQDAGCALPAGLWAEIVDGLQWVEEYMGATLGDPQRPLLLSVRSGAAVSMPGMMDTVLNLGLNDEVAAGLAAKSGERFAYDSFRRFLDMFGNVVMDIPRSLFEEKLEHMKESKGLKNDTDLTASDLKELVGQYKEVYLSAKGEPFPSDPKKQLELAVLAVFNSWESPRAKKYRSINQITGLRGTAVNVQCMVFGNMGNTSGTGVLFTRNPNTGEKKLYGEFLVNAQGEDVVAGIRTPEDLDAMKNLMPQAYDELVENCNILESHYKEMQDIEFTVQENRLWMLQCRTGKRTGKSAVKIAVDMVNEGLVEPRSAIKMVEPGHLDQLLHPQFENPSAYKDQVIATGLPASPGAAVGQVVFTAEDAEAWHSQGKAAILVRAETSPEDVGGMHAAVGILTERGGMTSHAAVVARWWGKCCVSGCSGIRVNDAEKLVTIGSHVLREGEWLSLNGSTGEVILGKQPLSPPALSGDLGTFMAWVDDVRKLKVLANADTPDDALTARNNGAQGIGLCRTEHMFFASDERIKAVRQMIMAPTLELRQQALDRLLTYQRSDFEGIFRAMDGLPVTIRLLDHPSYEFLPEGNIEDIVSELCAETGANQEDALARIEKLSEVNPMLGFRGCRLGISYPELTEMQARAIFEAAIAMTNQGVQVFPEIMVPLVGTPQELGHQVTLIRQVAEKVFANVGKTIGYKVGTMIEIPRAALVADEIAEQAEFFSFGTNDLTQMTFGYSRDDVGKFIPVHLAQGILQHDPFEVLDQRGVGELVKFATERGRKARPNLKVGICGEHGGEPSSVAFFAKAGLDFVSCSPFRVPIARLAAAQVLV

SEQ ID NO: 56125 - protein, 446 aa, Zea mays
MAATIQSVKARQIFDSRGNPTVEVDVFCSDGTFARAAVPSGASTGVYEALELRDGGSYYLGKGVSKAVNNVNSVIGPALIGKDPTAQTEIDNFMVQQLDGTKNEWGWCKQKLGANAILAVSLAVCKAGASIKRIPLYQHIANLAGNKQLVLPVPAFNVINGGSHAGNKLAMQEFMILPTGAASFKEAMKMGVEVYHHLKSVIKKKYGQDATNVGDEGGFAPNIQENKEGLELLKTAIEKAGYTGKVVIGMDVAASEFYSDKDQTYDLNFKEENNDGSQKISGDSLKNVYKSFVSEYPIVSIEDPFDQDDWVHYAKMTEEIGEQVQIVGDDLLVTNPTRVAKAIKEKSCNALLLKVNQIGSVTESIEAVKMSKRAGWGVMTSHRSGETEDTFIADLAVGLSTGQIKTGAPCRSERLAKYNQLLRIEEELGAIAVYAGAKFRAPVEPY

SEQ ID NO: 56126 - protein, 346 aa, Synechococcus sp. WH 7805
MFGLIGHSTSFEAARRKASDLGFDHIAEGDLDVWCSAPPQLVEHVEVTSPTGKSIQGAYIDSCFVPEMLSRFKTARRKVLNAMELAQKKGIDITALGGFTSIIFENFNLLQHQHVRSTTLAWERFTTGNTHTAWVICRQVENNAPSLGIDLKKASVAVVGATGDIGSAVCRWLSSRTGVAELLLVARQQKPLEDLRDELGGGRILSLEDALPEADVVVWVASMPRTLEIDASRLKTPCLMIDGGYPKNLDARVAAKGIHVLKGGIVEFFTDIGWSMMEIAEMEKPQRQMFACFAEAMLLEFESHHTNFSWGRNNITLEKMDFIGGASVRHGFSTLNLQGLPQAAAA

SEQ ID NO: 56127 - protein, 421 aa, Treponema pallidum subsp. pallidum str. Nichols
MRCSGFTDLAIVACPGGEHFADETIKHLTRVCERKFHQRMDRLTDRYGLDSGSVIRDANFYRDLFSTELCAHDDVRRFNPPHFKVDAQFICFLNGELKTQINECIRGKDVFIFQDVENHQPVLVNNGKSKKIFSVNDHVMMLIVTIDAVRHAGAGRVTLVLPTYPYSRQHKKCGREGLTAGLLGSVYEYLGVSHIVTLDLHSREIENAFHRTRLENLHASYQIIRELAKIENLSDPDIPFVVVAPDSGAVERNKFYSSGLKKPLAMIYKVRDYSVVAQNAKQSNIVEINLLGDVEGKTAFIADDMLGSGGTMLKAMEFLKSRGAKQVIAAVSLPFFTGNALELFDEAYEKRYFSRIIGTNAVFHTQLSHKQWYTETDVSGLFARVIARIHHNQSLSSLLDDRSIIERLLHARLSVAGTPRA

SEQ ID NO: 56128 - protein, 466 aa, Bacillus anthracis
MKVLKNGGSAVDAAIVVSYVLGVVELHASGIGGGGGMLIISKDKETFIDYRETTPYFTGNQKPHIGVPGFVAGMEYIHDNYGSLPMGELLQPAINYAEKGFKVDDSLTMRLDLAKPRIYSDKLSIFYPNGEPIETGETLIQTDLARTLKKIQKEGAKGFYEGGVARAISKTAKISLEDIKGYKVEVRKPVKGNYMGYDVYTAPPPFSGVTLLQMLKLAEKKEVYKDVDHTATYMSKMEEISRIAYQDRKKNLGDPNYVNMDPNKMVSDKYISTMKNENGDALSEAEHESTTHFVIIDRDGTVVSSTNTLSNFFGTGKYTAGFFLNNQLQNFGSEGFNSYEPGKRSRTFMAPTVLKKDGETIGIGSPGGNRIPQILTPILDKYTHGKGSLQDIINEYRFTFEKNTAYTEIQLSSEVKNELSRKGLNVKKKVSPAFFGGVQALIKDERDNVITGAGDGRRNGTWKSNK

SEQ ID NO: 56129 - protein, 492 aa, Candida albicans
MVALKREAEPRENGKSKKAKTSLATSSFVLHSYSKLPNINEYAKAKSTPLDVFVWGTGSMCELGLGPSAKNKEVKRPRLNPYLTEEKLGGTKIVDFAVGGMHTLALDGKNRIWSWGGNDSGVLGRDTSQAKEVLKDIDGKNGNDDDDDDDEDGDLNEAESTPALVENLPEGEIVQLAATDNLSAALLSNGDVYAWGCFRCNEGLLGFLRDEIKLQKTPLKIKELKNIVQLAAGKDHLLALDSKGIVYAWGNGQQYQLGRRILERHRYRSLEPQQFGLYNIKYIASGDFHCFAIDHSDNVYAWGLNQYGQCALTGDNGELEDGSVLMKPTLIPELSHKGIKEIAAGEHHTLALTEDGQVYAWGRYDMKEIGIPKDKLPKSTFKDQHGNPRSVPVPTKLEFAVKIKTIGVGSHHSFAVTEDGVVYAWGFAETYGPGLGPSIDDVEKPTRIVNTATKNEDILLIGAGGQFSVSGGVKIEDEEKAEVRLDKYEDLE

SEQ ID NO: 56130 - protein, 498 aa, Gluconobacter oxydans
MNVVSKTVSLPLKPREFGFFIDGEWRAGKDFFDRSSPAHDVPVTRIPRCTREDLDEAVAAARRAFENGSWAGLAAADRAAVLLKAAGLLRERRDDIAYWEVLENGKPISQAKGEIDHCIACFEMAAGAARMLHGDTFNNLGEGLFGMVLREPIGVVGLITPWNFPFMILCERAPFILASGCTLVVKPAEVTSATTLLLAEILADAGLPKGVFNVVTGTGRTVGQAMTEHQDIDMLSFTGSTGVGKSCIHAAADSNLKKLGLELGGKNPIVVFADSNLEDAADAVAFGISFNTGQCCVSSSRLIVERSVAEKFERLVVPKMEKIRVGDPFDPETQIGAITTEAQNKTILDYIAKGKAEGAKLLCGGGIVDFGKGQYIQPTLFTDVKPSMGIARDEIFGPVLASFHFDTVDEAIAIANDTVYGLAASVWSKDIDKALAVTRRVRAGRFWVNTIMSGGPETPLGGFKQSGWGREAGLYGVEEYTQIKSVHIETGKRSHWIS

SEQ ID NO: 56131 - protein, 181 aa, Synechococcus sp. WH 5701
MDISSLAASPSQGLVNLVVEIPAGSRNKYEYNSVAGLMALDRVLHSSVRYPFDYGFVPNTLAQDGAPLDAMVIMEEPTFAGCLITARPIGYLDMIDCGAHDGKLLCVPEADGRQSGLCSIRQIAANQLEDVAEFFRTYKNLEGRAVEIIGWEDADAVPALLERCIQAARADQDERCSRKPS

SEQ ID NO: 56132 - protein, 560 aa, Synechococcus sp. WH 7803
MVSELRTSRALPDSVDQSTQSQTLFDTIPDALKAIRNGECVVVVDDERRENEGDLICAAQFATPEQINFMATEARGLICLAMQGDRLDALDLPLMVDRNTDANQTAFTVSIDAGPEHGVSTGISADDRSRTIQIAIQPDAKPADLRRPGHIFPLRARPGGVLKRAGHTEAAVDLAQMSGLYPSGVICEIQNPDGSMARLPELQVYAREKGLKLISIEDLIRYRLENERFVVRSAQCSLPTEFGSFLAIGYRNELDGSEHVALVKGDPSHLQEPVLVRMHSECLTGDAFGSLRCDCRDQLHSALKRIEAEGEGVVVYLRQEGRGIGLINKFKAYSLQEGGLDTVEANEKLGFAPDLRNYGVGAQILSDLGIHRLNLLTNNPRKIAGLGGYGLEVVKRVPMKPALGDFNAEYLATKREKLGHLMDDHQQRSHWVICLDSSSTDEGELSELLHRVETLSQEHGLQLQAEQAPRLLALWERPRFVWSLQGTEPEAATLKTLLTTMASWAATSRMGLLHAVNPEQISHPPQTLERKELSLASLGSSQQGWGWFPAGDQPALIHWS

SEQ ID NO: 56133 - protein, 581 aa, Oryza sativa Japonica Group
MAHHVAPLLLLLTLAAVAAAASEEAAAADTEAAAAVEAGLLVRREAQLARLEELTESLAKSVQALESALARSVEPDPPPPAAAAAAPGDRRAPQGVAVTKRRPYWSERFHFAAAARLGDGAYAAAATALPYEDADGLTKYFAVGDSRGRVFVFSAAGDALLELEPGVSGEPPVTALLAYLSPRRTDCFLFAGHADGSIAAHRLIESSPHGDDWLTLAAASSRLLVRGLDAAPVLHLEAHHAGRARYVLSCDSGGRIRVFTENGTLYGTAIASSTPLAFVKQRLLFLTEAGAASLDLRSMSVRETPCEGLAEALNGSLPKAYSFDPSERFKAYGFTDAGDLVHVLLLGDIASLKCRVRAIKKAEIDNPVAIQTIKGYLLVASQDKILVYNTSTQYYGRVGAPRLLFATSIKDIKSVFAGSGGVMPASPAGKPLVAADREKLVILGLGDGYIAIYRSNFPVYKPESNAVVWSGPALLFLLFLIGIWQVYVKKKDSLGWTPEETFNTSVTAPTGSILNHSTSDRAFADSSTRTGERGYVDGTTRASDRSYVDATTRATDRAYAEATRGVDLRGGALRGAPRRIH

SEQ ID NO: 56134 - protein, 182 aa, Zea mays
RNCRRPATLASSSSRDSRHPSPAPCRSRCQRHALSDAIPRELTSCAYLNVIDLHGNQLSGPIPDELGLLVRLSTFDVSYNRLSGPIPVLLANRSGAGTAAVGTAGFNASSFVGNKGLYGYPLPPMRTRGLSVLAIVGIGLGSGLLSLVLSFSAVCLWLRATDRRTPTTPGEEGKISQPMPNY

SEQ ID NO: 56135 - protein, 168 aa, Synechococcus sp. WH 5701
MEMLMTVVWRSFSRAAGAALSTAFESFLAGMFSRSWWSRRLTPLLAIALGLSLTLSSCGSVSNSLSGSYVEDTMTVAESLLGTIALSQDDPARPDAESEARVLINDYMALYRPKGRVNGLPSFTTMQTALNSLAGHYTNYANRPLPEALKTRLEKELKKAETSVVRGT

SEQ ID NO: 56136 - protein, 166 aa, Ashbya gossypii ATCC 10895
MLRQVSRSARVVLRYGTAGRQAVRLNSTSAGAVDPKIAQIVEQISTLTLLETSALIGELKTRLNIPDIAMAVGGAAAPAAPAAPEAAAEEEVKEEKTIFAVKLEAFDAKSKPKVIKEVKNLLGLSLVEAKKFVEAAPKVLRENVAKEEAEKVKASLEALGAKVVLE

SEQ ID NO: 56137 - protein, 511 aa, Geobacillus stearothermophilus
MSKKPVALIILDGFALRDETYGNAVAQANKPNFDRYWNEYPHTTLKACGEAVGLPEGQMGNAEVGHLNIGAGRIVYQSLTRINIAIREGEFDRNETFLAAMNHVKQHGTSLHLFGLLSDGGVHSHIHHLYALLRLAAKEGVKRVYIHGFLDGRDVGPQTAPQYIKELQEKIKEYGVGEIATLSGRYYSMDRDKRWDRVEKAYRAMVYGEGPTYRDPLECIEDSYKHGIYDEFVLPSVIVREDGRPVATIQDNDAIIFYNFRPDRAIQISNTFTNEDFREFDRGPKHPKHLFFVCLTHFSETVAGYVAFKPTNLDNTIGEVLSQHGLRQLRIAETEKYPHVTFFMSGGREEEFPGEDRILINSPKVPTYDLKPEMSAYEVTDALLKEIEADKYDAIILNYANPDMVGHSGKLEPTIKAVEAVDECLGKVVDAILAKGGIAIITADHGNADEVLTPDGKPQTAHTTNPVPVIVTKKGIKLRDGGILGDLAPTMLDLLGLPQPKEMTGKSLIVK

SEQ ID NO: 56138 - protein, 476 aa, Caulobacter crescentus CB15
MTQFSDLGLAKPLLKALAEKGYKEPTPIQAQAIPVVLQGKDLLGIAQTGTGKTAAFALPILQRLAEDRKPAPRRGCRCLVLSPTRELATQIAENFKAYAVHMGLSVHTIYGGVKYGPQMKALAGGIDVLVATPGRLMDHMAEKSAIVSGTEIFVLDEADQMLDLGFVVPIRKIAAQLTKNRQNLFFSATMPSEIGKLAGELLNNPVQVSVAPQATTVERIDQRVLFIEAQRKRPLLAELFADTSFSRTIVFTRTKRGADRVAKYLNAAGIEAASIHGDKTQGQRERALAAFKAGEMRALVATDIAARGIDVNDVSHVINYELPNVPEAYVHRIGRTARKGKDGIAISFCADDERNLLKDIQKATRQTIPSFDRRNDKQLAAAAAVADKLVPAEKYVDPRKADPRNNVPSELRRKRNRNGGGGGGGRAEGAQKAQGRGPGQGKAGAKPGQKAGPGQNEFRGPKRQSATAEKRWSPID

SEQ ID NO: 56139 - protein, 478 aa, Physcomitrella patens subsp. patens
MSVQEYLEKHKLSSRIEDAVNAAVRAKSPDPVIFIADHLRKAVPGVITKVHARQIIDSRGNPTVEVDVWTGKGMFRAAVPSGASTGVHEAVELRDGDKNVYMGKGVLKAVANVNDKIQPAILGMDPREQAKIDRTMMELDKTENKGSLGANAILAVSMAVCKAGACEKGVPLYQHIADLAENTRLVLPVPAFNIINGGSHAGNKLAMQEFMILPVGAPSFSEAMRYGTEVYHHLKAVIKAKYGIDACNVGDEGGFAPSIARQDNKEGLDLVKMAIEKAGYSGVVKIGMDVAASEFYTSDKKYDLDFKTPNNSGADVKSGDEMIAMYQSFCKDYPIISIEDPFEQDDWENTKKLTDLKICQVVGDDTLVTNPKRVAKAIEEHTCNALLLKVNQIGTITEAIEAVNMSKKAGWGIMASHRSGETEDSFIADLAVGLSTGQIKTGAPCRSERLAKYNQLLRIEEELGDKAAYAGENWRPKL

SEQ ID NO: 56140 - protein, 535 aa, Ashbya gossypii ATCC 10895
MSKHELKDKKRKSVDGEDVSKSKKVKKDKKDKKDKKAKDGNDKVKDKKDKNKKDKSKTDKNLKEVQETEAHTGSETAPVGDSTAAAGYVESKELASVPQADVDTFFSENEVAVEDPESLGFRPLLSFSHLNLHSAIQKEISKFPKPTPIQAVSWPYLLAGKDVIGVAETGSGKTFAFGVPAINSLMSEKSTPRGVKCLVISPTRELASQIYDNLVQLTDKVGLNCCCVYGGVQKDSQREQLKKAQVVVATPGRLLDLIEEGSAKLAGVQYLVLDEADRMLEKGFEEDIKRIIKETKSDVRQTLMFTATWPKEVRELASTFMRAPVKVSIGNRDELSANKRITQVVEVIDPFKKEKRLLELLKQYQSGAKKNDKVLIFALYKKEASRVERNLKYNGYNVAAIHGDLSQQQRTQALSEFKAGTANLLLATDVAARGLDIPNVKTVINLTFPLTVEDYVHRIGRTGRAGATGVAHTLFTEQEKHLAGALVNVLNGAGQPVPEELMKFGTHTKRKEHNAYGAFYKNVDLTKKAKKITFD

SEQ ID NO: 56141 - protein, 331 aa, Gibberella zeae PH-1
MTSQRKPLVSFLGPVASYTHQAVRQAFSEDTWEFRPAVTIDDVFDQVQNGQVQAGVVPFENSTNGSVVFTLDNLADRANRYPDITVDGETYVDVHHCLVGHKCTAPIVEEATEGSGTCTPTATDPSPSRPRSKPLSSVKHIQRLYSHPQAFGQCTAFISTYLKGVEIFEVSSTSKAAEIVSKDTTGTWAAISSELAGELHGLDFLGKSIEDREDNVTRFLVIGTNAAGPKDLEKTKQAVAQKGSKSLVSFTVPHTSPGALADALSCFRAFDLNLTSINSRPSLVQPFQYIFFVEFEGHKYDDPEGRVNGALEKISRVAESWRWLGSWEKYV

SEQ ID NO: 56142 - protein, 137 aa, Gloeobacter violaceus PCC 7421
MRHNSQNLTIYEGGCHCGAVRFRVAVEKHEADDCNCSICRKKGFLHLIVPNERFTLISGTDALSTYTFNTGVAKHTFCRVCGIHPFYRPRSHPDAVDVNVRCLDGEVLEKFSIVPFDGAHWEQSMEQAQLQGRWQSN

SEQ ID NO: 56143 - protein, 264 aa, Clostridium tetani E88
MATLFYEPSTRTRFSFEAAMLRLGGQIIGFSEPNSSSVAKGESISDTIRTVGCYADIAVMRHSKEGAPKVASTYSNIPVVNAGDGGHHHPTQTLTDLMTIRAKKGKLSGLTVGFCGDLKFGRTVHSLIKALSRYENNKFILISPTELKIPEYIRREILEKNNIEFKEVENIEETIKELDILYMTRVQKERFFNEEDYVRLKDSYILTKDKLENALEDMIILHPLPRVNEIAYEVDEDSRACYFQQAKYGMYVRMALILKLLGVK

SEQ ID NO: 56144 - protein, 491 aa, Treponema denticola ATCC 35405
MNSITELFPSDFTDDEKALAKTHFLKKLSVLTHSFYGGKLQTVPKCGLYGFNWFNVWYTPGVSAISTTIRDDNETSFALSNKGNLVAVVSDSTRVLGDGDCTPPGGLGVMEGKCMLMKYLGGVDSYPLCIDSIVRVDEEGKRGVKAGKHDPDKIIDFVRMLEPSVGAVNLEDIQQPDCFKVLDTLREVCEIPVWHDDAQGTACITLAGLLNAIKLAGKKMEDCKIVLLGAGASNTTIARLILADGGKPENMIICDSRGALHSGRKDIEEDKRYYRKWELCLQTNPKKIETFDEAMKGADVLIALSTPGPNTVTKEQVASMNKKAIVFTCANPIPEIWPHEAKAAGAFIVGTGRGDFPNQINNSVCFPGILKGALLVRAKKISDGMAIRCSHSIADYSEKKGINPDNIVVTMQDEDVFAVEAADVAMQAIKEGLARVTMTWDEAYKKAKKDIEESRSLTKMLMEKNFIKEPPQEFYEKALEYAIEQIKKNRK

SEQ ID NO: 56145 - protein, 376 aa, Glycine max
MANSKGSSSFRNFMYPGKHPLLPPKSPFPSVSQAYADYVPNPAVGLKAGNRPRDGNTHHQRTSSESLVIEEQPSWLDDLLNEPETPVRRGGHRRSSSDSFAYIDTVNASNINYASQDEYKYKNMMSIPPWSPQDFDCSKDARHVPVYAEMNSTKQKNRSWDSFSNAMTNPVGVPSGKDSAAFQSSGLQCTPHEADALPPAASEKHDSVELGLQDAKSFPEKKDISHAKSSASETDTKRAKQQFAQRSRVRKLQYIAELERNVQALQAEGSEVSAELEFLNQQNLILSMENKALKQRLENIAQEQLIKYLEQEVLEREIGRLRALYQQQQQPPQTQPQQQPSGSHRRSNSRELESQFANLSLKHKDTNSGQDPALRI

SEQ ID NO: 56146 - protein, 369 aa, Arabidopsis thaliana
LRNSVAAVAWRAGEPLVMEEVEVSPPQPLEIRIKVVCTSLCRSDLSAWESQSLLPRIFGHEAAGIVESIGEGVTEFEKGDHVLAVFTGECGSCRHCISGKSNMCQVLGMERKGLMHSDQKTRFSIKGKPVYHYCAVSSFSEYTVVHSGCAVKVDPLAPLHKICLLSCGVAAGLGAAWNVADVQKGSSVVIFGLGTVGLSVAQGAKLRGAAQILGVDINPAKAEQAKTFGVTDFINSNDLSEPIPQVIKRMTGGGADFSFECVGDTGIATTALQSCSDGWGMTVTLGVPKAKPEVSAHYGLFLSGKSLKGTLFGGWKPKSDLPSLIDKYMNKEIMIDEFITHNLSFDEINKAFVLMREGKCLRCVLHMPK

SEQ ID NO: 56147 - protein, 579 aa, Cucurbita cv. Ebisu Nankin
MLQMGKAREPNFLILFFFGLILAFGISSEGSQIRHYKWEVEYMFWAPDCNENIVMGINGQFPGPTIRANAGDTVVVELINKLHTEGVVIHWHGILQRGTPWADGTASISQCAINPGETFFYNFTVDNPGTFFYHGHLGMQRSAGLYGSLIVDPPQGKKEPFHYDGEINLLLSDWCHQSIHKQEVGLSSKPIRWIGEPQTILLNGRGQFDCSIAAKYDSNLEPCKLKGSEPCAPYIFHVMPKKTYRIRIASTTALAALNFAIGNHPLLVVEADGNYVQPFYTSDIDIYSGESYSVLITTDQNPSENYWVSVGTRGRHPNTPPGLTLLNYLPNSVSKLPTSPPPETPAWDDFDRSKNFTYRITAAMGSPKPPVKSNRRIFLLNTQNVINGYVKWAINDVSLALPPTPYLGAMKFNLLHAFDQNPPPEVFPEDYDIDTPPTNEKTKIGNGVYQFKIGEIVDVILQNANMMKENLSEIHPWHLHGHDFWVLGYGDGKFTAEEESSLNLKNPPLRNTVVIFPYGWTAIRFVADNPGVWAFHCHIEPHLHMGMGVVFAEGVEKVGRIPTKALACGGTAKSLINNP

SEQ ID NO: 56148 - protein, 550 aa, Arxula adeninivorans
MSNISTPRISGLTEYTSQPDKSHYDSIESHFLLPDGTPDYLKLILTSKVYDVCNETPVTPAVNLSSKLGANIFLKREDLQPVFSFKLRGAYNMMAHLPQETRWKGVIACSAGNHAQGVAYSAKHLNIPATIVMPVVTPAIKYKNVDRLGAKVVLHGNDFDAAKAECNRLSEKHGLTNIPLFDNPYVIAGQGTIGVELLRQIDVESLKAIFVCIGGGGLIAGVGAYIKRIAPQVKIIGVETYDANAMRQSLQKGERITLSEVGLFADGAAVKILGEETFRLCQQVVDEIVLVSTDEICAAIKDVFTETRSIVEPAGALSVAGLVKYVESHPEIDHSASGYTAILSGANMDFDRLRFVSERAKLGEGSEVFIVATIPEKPGSFGKLIDLVHPRAVTEFSYRYSNGELEKSDGKAHVYISFSVDNAKAEVPRILDDFKGAGFDAIDISHNEFPKSHPRYLVGANQPVTNERVFRFEFPERPGALVKFLHGVKSKWNITLFHYRNQGSDIAKVLAGISVPSHESDQFQQFLDNLEYPYAEETDNVVYKLFSQGD

SEQ ID NO: 56149 - protein, 472 aa, Physcomitrella patens subsp. patens
MGQVRAWEQGTERGHGGSVGFVLVGRADCVDWQRLEERRSGGNAGGASQNNKSVLAFQCQLEHHQDSARLHSNGNCGENKQYRGDFFSSKDPGRRKRGNRFAKLKQCKLDARREQWLSQGSQGKQWNPEKQLQNNQLPYQNCEHHHKVGDGECMPQERASPSGHTRSQSLGSIGSMSERIPIFSLASQSRSSGNGSNNEVKNLKKEAPARRQDVSCRAPKYFGDEELDGGSEQKQGPKHLRSSSDISKLRFNISGASSSYTGSGSEDHDEPHDADDDWESAFDALHIQSSQHRPEALHKCPGSDRALHSEEKEQHDRKQNGAHHYNPHHSDMQGAQLKSDYKHRNSGFGGRRGNGGRAWRPDDVSRPPTLPTLVKQHTYPNHSGNNNHQGWGHAHGSTWENQQPSPSYCPICTEELDMTDSSYMPCPCGFQLCLFCYHRIASDDGRCPGCRKPYSTDVAVKLSQSSAVWLRV

SEQ ID NO: 56150 - protein, 488 aa, Oceanicola granulosus HTCC2516
MAAAANVAVALPSGQLYIDGAWVAGEGEFEVTNPADGSRVGAVAHATSAHALRALDAAEAAQAAWGRLAPRARADLMHRAYRLMLDQEDAFARIMTLESGKPLSESRAEFKLSADFLLWFAEQTAHVHGSYAESSHGGFRVMVHHQPIGPCLLITPWNFPLLMIVRKAGAALAAGCTAVVKTAQETPFTGALFTQVLHDAGFPSGVVNLLHTRTSSEISAPLLKDRRIRKVSFTGSTGVGALLMEQGARNIVNCSMELGGDGPFVVLDDADIDLAVAQAVICKFRNAGQACVAANRIIIDKKVEAEFTEKFIAKVKALTVGNGLDAVDVGPMISAKQRDGLAATLTKLTEAGGRTLAGGNPIAGPGYFFEPTVVRFEGPSEVMCSNELFAPIATIFPVDGAAEAIALANDTQFGLASYVFTRDISRAIGFAERLAFGMVGINRGIMADAAAPFGGTKASGIGREAGQDGIYEFMEPKYMALTVADELS

SEQ ID NO: 56151 - protein, 536 aa, Synechococcus sp. WH 7803
MHLVMSFPDFSATDTQIQWQRFCDLLWYHDDLGVWLDVSRMHLNAAALAELTPPLEQAFEAMGKLEAGAIANADENRQVGHYWLRDPQLAPDQSVGQHIAAEINDIEQFGQAVVNGEIKSPTGEPFTDVLWIGIGGSGLGPLLMVRALQDTGKGLPFHFFDNVDPNGMSRVLGELGDALRTTLVVTVSKSGGTPEPHLGMEQARHRVESLGGNWPGQAVAITMANSHLDQQAKEETWLKRFDMFDWVGGRTSITSAVGLLPGALIGSDIRDFLAGAAQMDQATRVADVRRNPAALMAAAWYTAGEGKGKRDMVVLPYRDRLEVFSRYLQQLVMESLGKRLDRSGAVAHQGIAVYGNKGSTDQHAYVQQLRDGVDNFFVTFIEVLQDVDDIPEINGERPGDFLDGFVQGTRSALTEGGRQSLSISMRTFDSRRLGALIALFERAVGFYGELVNINAYHQPGVEAGKKAAAAILKLQKQVEEVLSDGTSRSVLEIQQAIGEGSDEAIFWILRHLTGNNRGYQAQGSWDSPASLRFAKG

SEQ ID NO: 56152 - protein, 133 aa, Triticum aestivum
MQAVIRSFVSGGNVVRSSLLQHLRVVNPAIQPSVLSTRSESTQPARMEEHGFESTTISDVMNAKGKSADGSWLWCTTDDSVYDAVKSMTQHNVGALVVVKPGEQQSLAGIITERDYLRKIIVQGRSSKSTKVG

SEQ ID NO: 56153 - protein, 225 aa, Catharanthus roseus
MALSLASETTANNYHYSSPPPPHYSPPYHYKSPPPPPPVHKYPPPPPPFYKSPPPPPPVYKSPPPPPYKYKSPPPPPHKPYKYKSPPPPPPVYKSPPPPPHKPYKYKSPPPPPPPPHKPYKYKSPPPPPVYKPPYVYKSPPPPPSVHKYPPPSPPPVYKSPPSPPPKKPYKYKSPPPPPIHKSPLPSPPKKPYKYKYPPPTPVYKSPPPPHHYLYTSPPPPPYNH

SEQ ID NO: 56154 - protein, 305 aa, Synechococcus sp. WH 5701
MSQDPVISAEDTLRVSVLSEALPYIQRFAGRRVVVKYGGAAMVREDLREAVFRDLALLACVGVQPVVVHGGGPEINQWLKKLEIPAEFRDGLRVTDLDTMDVVEMVLVGRVNKQIVNGLNRVGGRAVGLSGSDGALVEARTWGEGSHGLVGEVAAVNPDVLAPLLQSGYIPVISSVAADPSGQAHNINADTVAGELAAALQAEKLILLTDTPGILQNREDPSSLLRQITLPEARELISTGVVNAGMTPKTECCIRALAQGVGAAHILDGRVPHALLLEVFTDAGVGTMVVGSSRAASRAGVPRRG

SEQ ID NO: 56155 - protein, 515 aa, Trametes hirsuta
MSRFQSLLTFITISLVAVAHAAVGPVADLTITDAAVSPDGFSRQAVVVNGVTPGPLVAGNIGDRFQLNVIDNLTNHTMLKSTSIHWHGFFQHGTNWADGPAFINQCPISPGHSFLYDFQVPDQAGTFWYHSHLSTQYCDGLRGPFVVYDPNDPHASRYDVDNDDTVITLADWYHTAAKLGPRFPGAADAVNINGKGRAPVTLPASCSVIKVTKGKRYRFRLVSLSCNPNHTFSIDGHNLTIIEVDSVNSQPLEVDSIQIFAAQRYSFVLDANQAVDNYWIRANPNFGNVGFDGGINSAILRYDGAPAVEPTTNQTTSVKPLNEVDLHPLVSTPVPGASDKAINMAFNFNGSNFFINGASFVPPTVPVLLQILSGAQTAQDLLPSGSVYVLPSNASIEISFPATAAAPGAPHPFHLHGHTFAVVRSAGSTVYNYDNPIFRGVVSPGTPAARDNVTIRFDTNQPGPWFLHCHIDFHLEGGFAVVMAEDTPDVQAVNPVPQAWSDLCPTYDALDPNDQ

SEQ ID NO: 56156 - protein, 221 aa, Zea mays
  misc_feature (51)..(51): Xaa can be any naturally occurring amino acid
  misc_feature (67)..(67): Xaa can be any naturally occurring amino acid
  misc_feature (105)..(105): Xaa can be any naturally occurring amino acid
  misc_feature (155)..(155): Xaa can be any naturally occurring amino acid
MAMEKAASSLLGGGGGEPAATGKSIFIYPIKSCRGLAVSQALIISTGAGLXPPSIFRPWRFRWDRQXVAVNGKGRAYTQRVEPKLALVQVELPPEAFAEDWQPTXLRPPGILVDGCNPYSEDLWKTIKINNLTFLGVKLCNRCQVPSINQEDGIXGTEPNETLQTFRSDQVLRPSHKNKRQVYFGQNLVCKESLSGEGKVIKVGDPVYVVQAFASSNEAPA

SEQ ID NO: 56157 - protein, 849 aa, Gibberella zeae PH-1
MAMLASKAAFPAGMGSSSHTPVASQPAMPLPRRTPMMPSSGAYGSPTESEFTEHDPAESVKNWDEDQVCEYLRTVKCGEYEKIFRKNHINGENLLEMDKDVLKEMGVEKVGDRVRLFLSIKKLRTRAYANEKKRNRDSFGGLDIQITAPNDSPRLHSSRGVPASSSKRYSRQLDLYGALDNGKTSSRPNSPLPGTDVRNLRARGKTYASIPVNAQGQRIVTTNPDLPANRLVTTHTRNNSSMDGSLMAALPQGQEVIRVISTGGVTKVVKISGCNTCEEVMRVTLRKFALREDHERNYCFWVLAGIDPDPGQCRRLGDTELWRIIKDQRRPERNRLILRRVPAGEPGEAELHRAAAIAMEEEQQKHARALETVDKRRSLRPFGGLRPPSELIASDLTSYFPDHTREDIDRTARLSMRRSTRMSKVNSRLSVASNLSFASSIQDAPPIPTIADSWLNANTQLAKVRTRDSHIRVPQAAYNRDSVTSSVLDTLQEESSLEPDRKSYVSFTESGSDSAPVSVTDPEGNTTATSYYDGDTSTGSGSFQEIRQALTNDGDDVDEELHSFLAGESWGDDKWMKGALIGQGSFGCVYLALHAVTGELLAVKQVETPAPGANSQGDNRKKGMIDALKREISLLRDLRHPNIVQYLGCSSTADYLNIFLEYVPGGSVQTMLNSYGALPEPLVRSFVRQILTGLSYLHNQDIIHRDIKGANILVDNKGTIKISDFGISKKLEATNILNGANNSKHRPSLQGSVFWMAPEVVKQTSYTRKADIWSLGCLVVEMMTGSHPFPDCSQLQAIFKIGGGKAAPTIPEHASEAAKEFLAQTFEIDHNLRPSADQLILSPFLIPIT

SEQ ID NO: 56158 - protein, 436 aa, Zea mays
TTRGSPCERKQRRPGPPTTSTAASTMAAPAAAKRPYWQAPAAAAEPNKRHRTAAAPAHMDAEPEQEDQPLLPGLPDHLAQLCLAPLPPLLLHAVCRPWRRLLYSPSFPPFLALYAVLDDEAAAFAGSGVSFAAYDAVAGRWDELPAPPMPSPPPRLWHPAFLSRRLPLQSVAAGGRLVLVAGSTRALAPALPRPVVFDPAARAWRLGPRLPFAPRRWCAAGAARGRVFMAGGVGAGYDASDARSGATWDPAAAAAAPWEPIPPMRDARFSRDAAEAVCAAGKVCMVSLRGRGAKEGAVFDLRAARWEDMPPGMLAGWKGPAAAAAAGGDEDETTIFVVDEERGALSAYDWAGDRWRTVVESERLKGAAEMAAGGGRVCVAAQGGDKVLVVDVAPSRPRRWGAPAAAELRPRVWEVAAPPGKRVVALHVLPRMARAD

SEQ ID NO: 56159 - protein, 415 aa, Caulobacter crescentus CB15
MSRLVMKFGGTSVADLERIRRVARLVAAEVATGKQVAVVVSAMSGKTNELVAWTDGAGRAAAGLPESDDEYDAVVASGEQVTAGLLAMTLRNMGHKARSFLGWQVPILTDEAHGRARIEEIPPENLEECFANGEIAVIAGFQGVTPNRRITTLGRGGSDTSAVAIAAAVKGDCDIYTDVDGVYTTDPRIESKARRLAKISYEEMLEMASLGAKVLQTRSVEMAMAHRVPVRVLSSFVEPGEAPGQGTIVCDEEEIMEKRIVSGVAYSRDEAKITLLGLPDHPGVSSQIFGRLAEANVNVDMIVQSRARSADTANMEFTVGKRDATRAVEIVQAAQKEIGFEAVAVNEDVAKVSVIGVGMRSHAGVAQSMFQALAEKNINIQVISTSEIKISVLIDAAYTELAVRALHAVYGLDQL

SEQ ID NO: 56160 - protein, 281 aa, Magnetospirillum magnetotacticum MS-1
MTLIINQDRESADFADGLWAELRHEAEEALARTPVLRRLFIDSILEQPSFESAVFHRISQRLKNEVVTLPLLTETFARSVTADRSIAQALRADIAAVLDRDPATQRFIEPFLYFKGFHAVQTHRLAHWLWNRGERDFALYLQSRSSDVFQTDIHPAARFGQGVFLDHATGLVVGETAVVEDDVSLLQNVTLGGTGKESGDRHPKVRQGAIIGAGAKILGNIEIGAHSRIAAGSVAVMAVEPHSTVAGIPARIIRTTNDPETLRTKEEILKALSYESFDYSI

SEQ ID NO: 56161 - protein, 171 aa, Desulfotalea psychrophila LSv54
MSDFKRSKANNNTEELIEKIVFINRVAKVVKGGRRFSFSAIVVVGDGNGKVGYGLGKANQVPEAIRKGVERARKDMALVSLTDVSIPHQVIGHYGAGRVFLRPASAGTGLIAGGPVRAVLEAAGVSNILTKCLGSHNPHNMVKATIDGLKQLRSAQKIAELRGKNVEEITA

SEQ ID NO: 56162 - protein, 293 aa, Zea mays
RSQEQSSVKSKKRPPLRRGKVSPQLPVPGHIPRPSYVGAKGLPELCKGQLHDAQGITGMRAACKLAARVLDFAGTLVKPSITTNEIDAAVHNMIIEAGAYPSPLGYHGFPKSICTSVNECVCHGVPDSTQLQNGDIINIDVNVFLNGYHGGTSRTFACGQVDDSIKHFLNAAEECLEKGISICRDGVNYRKIGKKISKLAYFYGYYVVERFVGHGIGTMYHSEPLILHHANENSGRMVEGQTFTIEPILTMEKTECVTWEDGWTTVTADGSWAAQFEHTILVTRDGAEILTKV

SEQ ID NO: 56163 - protein, 321 aa, Rubrobacter xylanophilus DSM 9941
MDVLQGSRHRGLSESVLEAIGDTPLIEVEEGIYAKLEYLNPSGSIKARIAKYIVEKAEREGLLLPGHTIVEATSGNTGNAFSMVAAIKGYRMVVLMPEGLSTERVAISRAFGAHIEHVGEFYVTEALKRARELGKKEGYFCPAQFDSEWNVEENREWLGKEILGQLEEGGVGAPDALVMGVGTGGTLIGVGQAFREKNAEAKLIAVEPEESCTLLCGESGVHKIEGISDGFVPGIYERHAERLGVDEVYAVGSEEALGAMRWLARRRGLFVGPSSGANLVAARRLKEAHPELKSIVTLFCDEGEKYISEHFPAGRRGDATK

SEQ ID NO: 56164 - protein, 117 aa, Methanocaldococcus jannaschii DSM 2661 [sequence omitted]

SEQ ID NO: 56165 - protein, 260 aa, Desulfotalea psychrophila LSv54
MSPSVPVRSIVVKNADEIALMYEANQHVAAVLKTLMSVVDVGQTTWELDKIAEDYCKKNKMRPAFKGYNGFPGCLCVSVNEEVVHGIPSRKKKLKKGDIVSVDFGVEYRGYYGDSAVTIPVGQISAEAKKLLQVTDESLHRGIAQAVAGNRISDISKAVQQHAEAHGFGVVRQFVGHGIGSDLHEAPEIPNFYSGERSPRLLPGMVLAIEPMLNVGTANVKVLRDGWTVVTADHRFSAHFEHTVAVTEEAPRVLSSREIA

SEQ ID NO: 56166 - protein, 334 aa, Photobacterium damselae subsp. piscicida
MKYLVTGAAGFIGSAVTERLCALGHQVVGVDNLNDYYDVSLKQARLQRAANPLFTFIELDLADREGVAQLFADQQFDKVIHLAAQAGVRYSIDNPLAYADSNLVGHLTILEGCRHHKVKHLVYASSSSVYGLNHKTPFNTSDSVDHPISLYAATKKSNELMAHTYSHLYGVPTTGLRFFTVYGPWGRPDMALFKFTNAIMEGKEIDVYNHGDMRRDFTYIDDIVEGVMRIQDVIPEPNPDWTVETGSPATSSAPYRVYNIGHGSPVKLMDYIEALEEALGIEAKKNFMDMQPGDVYMTYADTEDLFNATGYKPEVKVKEGVKAFVDWYRAYYQK

SEQ ID NO: 56167 - protein, 307 aa, Fulvimarina pelagi HTCC2506
MAKYLELPVGEALVRRFADQEIFVEIQENVRGEDVFVVQSTSYPANDHLMELLIIIDAMRRASARRITAVLPYFGYARQDRKAGGRTPISAKLVANLITHAGADRVMTLDLHAGQIQGFFDIPTDNLFAIPLFARDIKEHQDLSNLTVVSPDVGGVVRARALAKRLDAQLAIVDKRRERPGESEVMNIIGDVEGRNCILIDDIIDSAARSAMRPQPSSMPVRERFGYITHGVLSAARLHASLHQASSNSSSLIRSSRPRRSARPTISASSQPPISLAKRSLAQLRKNRSPACSTERFRPSIEARLEC

SEQ ID NO: 56168 - protein, 374 aa, Debaryomyces hansenii CBS767
MSDEKILNDVSESEDTGYLESYIRFNDDLEKDYCFQIKVDKRYRDLLEIFKSLPIALRPNVFHYSKPIGFQVSTCPGYLTEDGSLLFSYETGMEKFLKKVSFDDKIADTIWPGQLILPVWEFNSFAFYSFITLLVCWLYTDLPDFISPTPGICLTNHMTRGASYLATYFGQHKLAHALIVDIEDPVGIIGQCLFFVFHLIKVLVIFLLFHLGTFNPIRMNRFSGTKVPTDISREQLIELGWTGSRRATPDEYKEYYRDYKIKEHGGMVQAHQAGVFDTLKNLGIYLGEGEGFNTPMDSKSTMADLCDEENDKFTLSYDYLAQLGAFFASYIEKEGVDLADTIKQFRRFGLLHCTDSVKKAVQQRKIFGDSKINK

SEQ ID NO: 56169 - protein, 225 aa, Salmonella enterica subsp. enterica serovar Typhi str. CT18
MKQYLIAPSILSADFARLGEDTAKALAAGADVVHFDVMDNHYVPNLTIGPMVLKSLRQYGITAPIDVHLMVKPVDRIVPDFAAAGASIITFHPEASEHVDRTLQLIKEHGCKAGLVFNPATSLSYLDYVMDKLDVILLMSVNPGFGGQSFIPQTLDKLREVRRRIDASGYDIRLEVDGGVKVNNIGEIAAAGADMFVAGSAIFDKPDYKKVIDEMRSELAKVSHE

SEQ ID NO: 56170 - protein, 138 aa, Zea mays
  misc_feature (93)..(93): Xaa can be any naturally occurring amino acid
  misc_feature (108)..(108): Xaa can be any naturally occurring amino acid
  misc_feature (121)..(121): Xaa can be any naturally occurring amino acid
MPKHYRPAGKKKEGNAAKYITRTKAVNYLQVSLAIFRKLCILKGVFPRQPKKKVEGNHKTYYHTKDIAFLAHDPLIEKFREIKAHRRKVKKAXAKKNRDLADRLLNRXPPYKLDRLVLEKXIPTFVDALRDLDGLALM

SEQ ID NO: 56171 - protein, 189 aa, Chlamydomonas reinhardtii
MGKMKKTRKFAEVKRMLNPKDAEPPAKRQKTEKKEDEVRHVSSALFFRYNTQLGPPYQVLVDTNFINFSIKNKIDLVRGMVDCLYAECKPCITDCVLAELEKLGQKYRVALKVAKDPRVERLPCTHKGTYADDCICQRVQQHRCYIVATCDRDLRRRIRKIPGVPIMFLQSHRYSIERLPEATMGGAPK

SEQ ID NO: 56172 - protein, 289 aa, Oryza sativa Japonica Group
MLRLLASCNVVKCSTEAGPAGEPLRRRYSPAPVCRWFTAGGNSHHGSLAPSVLFGIDEDYLSTWHQLAAAVGGGGAVAFERAHGAPMFEYMGTNRRLNTLFNQAMAQQSMIVINKLLDRFHGFDGVGVLVDVGGGTGGTLEMIMSRHKHITGVNFDLPHVISQAPSLPGVKHVAGNMFESIPNGDAIFLKSILHLQNDEDCIKILKNCHQALSDNGKLIAVEIVLPAIPEPVPTAQYPFQMDMIMLNNFRGGKERTELEFTKLAMDSSFSGTLRTTYIFANYWALEFNK

SEQ ID NO: 56173 - protein, 245 aa, Oryza sativa Indica Group
MARELNGTTDQVDKIVKILNEGQIASTDVVEVVVSPPYVFLPVVKSQLRPEIQVAAQNCWVKKGGAFTGEVSAEMLVNLSIPWVILGHSERRSLLGESNEFVGDKVAYALSQGLKVIACVGETLEQRESGSTMDVVAAQTKAISERIKDWTNVVVAYEPVWAIGTGKVATPDQAQEVHDGLRKWLAANVSAEVAESTRIIYGGSVTGANCKELAAKPDVDGFLVGGASLKPEFIDIINSATVKSA

SEQ ID NO: 56174 - protein, 482 aa, Listeria monocytogenes str. 4b H7858
MKKETHGEIRRDLKTRHLSMIAIGGSIGTGLFLASGNAIHTAGPGGALVAYIAIGIMVYFLMTSLGEMATYMPVSGSFSTYASRFVDPAFGFALGWNYWFNWAITLAVDISTAAIIVQFWLPNTPAWLWSAIFLILIFGLNALSVKAYGESEYWFSIIKVATVIIFLIVGVLTIVGILGGEVIGFSNFTAGDAPFKGGFFAILGTFLIAGFSFQGTEMVGIAAGESATPETSVPKAIKQVFWRILLFYIFAIFIIGMIIPYTNPNLLSAEATDVAISPFTLVFEKAGLAFAASVMNAVILTSVLSAGNSGLYASTRMLWAMARDKKAPKFLGKVNRRGIPMAALIVTTIVGAMTFITTLTENGTVIYTWLLSASGLTGFIAWVGIAISHYRFRKAFIKQGHDLSELKYKAKFFPFGPILALILCILVIVGQDYAAFLKPEFTNPAWWQKIGISYIGLPIFLVFWLSFKFTNKTKVIPLEDCK

SEQ ID NO: 56175 - protein, 649 aa, Pseudomonas fluorescens Pf-5
MSELIRVPDIGSGEGEVIELFVKVGDRIEADQSILTLESDKASMEVPAPKAGVIKSLKVKLGDRLKEGDELLELEVEGAAAAAPAAAPAAKAEAKPAAAPAAASAPAAAPAAASVQQVHVPDIGSSGKAQIIEIQVKVGDKVEADQSLITLESDKASMEIPSPAAGVVKAISVKLNDEVGTGDLILDLEVAGAAAPAAAPAQAAAPAAAAAPAPAAAPAAPVADSVQDIHVPDIGSAGKAKIIEVLVKAGDSVEADQSLITLESDKASMEIPSPAAGVVESVSIKLDDEVGTGDLILKLKVKGAAPAAAPAPAAAPSAPAPAAAAAPAAAAPAAAPAAAPAKPGAKVHAGPAVRQLAREFGVELSAVGASGPHGRILKEDVQVYVKAMMQKAKEAPAAGGATGGAGIPPIPVVDFSRFGEIEEVPMTRLMQAGAANLHRSWLNVPHVTQFDSADITELEAFRVAQKAVAEKAGVKLTILPLLLKSCAHLLKELPDFNSSLAPSGKAIIRKKYVNIGFAVDTPDGLLVPVIKNVDQKSLLQLAAEAASLAEKARTKKLSADEMQGACFTISSLGHIGGTGFTPIVNAPEVAILGVSKATIQPVWDGKAFQPKLMLPLSLSYDHRVINGAAAARFTKRLSDLLADIRTILL

SEQ ID NO: 56176 - protein, 394 aa, Silicibacter pomeroyi DSS-3
MQSYAADLIALGLLFLTGLAADQLGARSRLPRVTLLLICGLLAGSAGFDLIPESLAALYPIISVIALSMVAFLLGGELSLRTLSGHGRAIVVISVMVVLVTQLTVSAGLAMIGMPLAAALMVGALATATDPAATLDVIRQGRASGDFPRRLKGIVAIDDAWGVLLFGLVAVLAGAVEGNGSAHGLLGGALVEIAGSVALGLAVGLPGASLTGRLSGGEPLRIEALGLVFLTAGLSLWLDLSYLIAGMTAGAVIVNLAHHHKRAFREIEHIEWPFMIVFFILAGASLDLSALWAVGPLLMGYVALRVLGRVLGGWAGAALAATARGERPWYGPALLPQAGVAIGMALIAGDLFPQYADMITALAIGATVVFELAGPLAAAYALRRVRDSRDQSAA

SEQ ID NO: 56177 - protein, 237 aa, Glycine max
SSMQAVSHRGLIALSQGCSELEYMAVYVSDITNASLEHIGTHLKNLCDFRLVLLDHEEKITDLPLDNGVRALLRGCDKLRRFALYLRRGGLTDVGLGYIGQYSPNVRWMLLGYVGESDAGLLEFAKGCPSLQKLEMRGCLFFSERALAVAATQLTSLRYLWVQGYGVSPSGRDLLVMARPFWNIELIPSRKVATNTNPDETVVVEHPAHILAYYSLAGQRSDFPDTVVPLDTATMLD

SEQ ID NO: 56178 - protein, 195 aa, Synechococcus sp. WH 5701
MANIDHAPSRTMLNLLHVLPAFADEAELRLNAIVELNSMTINKYELITETGHLKLDRVGYSSLSYPFAYGCIPRTWDEDGDPLDIEIVGVTEPLVPGSLVEARIIGIMTFDDGGEVDDKVIAVLADDKRMDHITSYEQLGDHWLKETQYYWEHYKDLKKPGTCKVNGFLNTQEAVRIIKECETRYLEQIDAKLVN

SEQ ID NO: 56179 - protein, 422 aa, Staphylococcus aureus subsp. aureus Mu50
MPEVKVPELAESITEGTIAEWLKNVGDSVEKGEAILELETDKVNVEVVSEEAGVLSEQLASEGDTVEVGQAIAIIGEGSGNASKENSNDNTPQQNEETNNKKEETTNNSVDKAEVNQANDDNQQRINATPSARRYARENGVNLAEVSPKTNDVVRKEDIDKKQQAPASTQTTQQAPAKEEKKYNQYPTKPVIREKMSRRKKTAAKKLLEVSNNTAMLTTFNEVDMTNVMELRKRKKEQFMKDHDGTKLGFMSFFTKASVAALKKYPEVNAEIDGDDMITKQYYDIGVAVSTDDGLLVPFVRDCDKKNFAEIEAEIANLAVKAREKKLGLDDMVNGSFTITNGGIFGSMMSTPIINGNQAAILGMHSIITRPIAIDQDTIENRPMMYIALSYDHRIIDGKEAVGFLKTIKELIENPEDLLLES

SEQ ID NO: 56180 - protein, 474 aa, Trichodesmium erythraeum IMS101
MSNPLLSLNYEPAIQALGGDYYDEVLSAEFPQHILRFRNDQLLPKIGLNSQDVKDEHFIEAFGKFHCVRPFLALRYHGYQFGEYNPYLGDGRGFLYGQVRGVDDELYDFGTKGSGRTPYSRSADGRLTLKGGVREVLAAEILHRHGVRTSRCLSLIETGEGLWRGDEPSPTRSSVMVRFSRSHIRFGTFERLHFYKRPDLTKKLLNHVINCYYSNLKKENISQKDPFQDCYFLFYLELVKRIAKLVAQWMAAGFCHGVLNTDNMSITGESFDYGPYSFIPTYNPKFTAAYFDYSGLYRYSHQPLVCKSNLQLLQEALAAVIDRKNMRSALEKFDDFYLHEYRQLMMRRLGFKKLAEADADKLLQLTIKMLTDSQVGYHDFFLELRQKFSPEWRDDISQIFADFEQPELIDPWRQYYYHLLQTYSDNELEEMTERLQQYNPQQSLIRPVIESVWEAITLEDNWQPFYDLLQQIYD

SEQ ID NO: 56181 - protein, 367 aa, Brassica napus
MSRRSLTLLKNLARNSNASCIQTRSVTYMPRPGDGSPRAVTLIPGDGIGPLVTNAVEQVMEAMHAPIYFEKYDVQGEMSRVPAEVMESIRKNKVCLKGGLKTPVGGGVSSLNVQLRKELDLFASLVNCFNLPGLPTRHENVDIVVIRENTEGEYAGLEHEVVPGVVESLKVITKFCSERIAKYAFEYAYLNNRKKVTAVHKANIMKLADGLFLESCREVAKKYPGITYNEIIVDNCCMQLVAKPEQFDVMVTPNLYGNLVANTAAGIAGGTGVMPGGNVGADHAVFEQGASAGNVGKDSIVRKNKANPVALLLSSAMMLRHLQFPSFADRLETAVKKVISEGKCRTKDLGGQSTTQEVVDAVIAKLE

SEQ ID NO: 56182 - protein, 222 aa, Physcomitrella patens subsp. patens
MLGSNIVITAGAEVGRLALIKSADFIKSSSKESECPHEGHPEFALVGRSNVGKSSLINALVHRKELAQTSKKPGKTQLINHYLINKTWYLVDLPGYGYAKAPTAIRTDWNEFTKGYFLKRQTLVSVLLLVDSSIEPQQIDLDCVGWLGRNKIPVTIVFTKCDRKKKKKNGGRKPEENIKDFLDRIKPLYAETPPWIMTSSETNQGKEELLRHIAQLRILWAS

SEQ ID NO: 56183 - protein, 399 aa, Oryza sativa Japonica Group
MAAKAAALSSSPFVSSRRLSSPAASLRARTPRCVMGSEQVRVVVEEEGKTKKRMGVAEPRSAPPAVWTPRAPAQEARLAALRTDGRDSRLKIFSGTANRPLAQEIASYLGVDLGKVLIKRFADGEIYVQLQESVRGCDVFLVQPTCSPVNENLMELFVMIDACRRASARSITVVIPYFGYARADRKAQGREAITAKLSANLLTEAGSDRVIVCDIHSTQALGYFDIPVDHIHGQPVILDYLASKTISKDLVVVSPDVGGVVRARAFAKKLSDAPLAIVDKRRQGHNMSEVMHLIGDVKGKVAIMVDDMIDTAGTITSAAALLKQEGAEAVYACSTHAVFSPPAIERLSGGIFEEVIVTNSILLPEHKCFPQLTVLSMANLVAETIWHVHRDGSVSSIFQ

SEQ ID NO: 56184 - protein, 97 aa, Gloeobacter violaceus PCC 7421
MATYKVTLVTPSGKKEIDCPSDEYILDAAERQGLDLPFSCRAGACSTCAGKMVSGTIDQGDQSFLDDDQIAAGYVLTCVAYPTSNCSIETHKEDELY

SEQ ID NO: 56185 - protein, 529 aa, Ashbya gossypii ATCC 10895
MSPNGAGLELADPGGAGGQQAGGGAAGGSELAREGVCVGVCGVEARAQLCGATAQRPGRRCVRGGREAWRDGLEQRQRRTRGPGGEAGLFEQPGAVAAEYGPVAVEHGVGGVVCGGEEVEGGGVAQPARGRGRCERDAWRCDAERGELVAELCVGREGLAIGPEGDRKPGGHGLRGGRCRRRALLRKPRRFAVAHHMQTSAEMGGIIEAMPALAQDGYALEQAPPEQCPGPAAENAGKGDACQGCANKDICESLPKGPDPDVALITQNLAPVRHKVLVLSGKGGVGKSTFSAMLGWALSADEALQVGVMDLDICGPSLPHMLGCVNETVHESSVGWTPVYVADNLAAMSIQFMLPEDDSAVIWRGAKKNALIKRFLKDVYWDELDYLVVDTPPGTSDEHITINTLLKESGIDGALVVTTPQEVALLDVRKELDFCRKAGIRVLGLVENMSGFVCPSCENESTIFKPTTGGGRALCEELGIKFLGAVPIDPRIGRCCDSGESFLDAYPDSPASTAIMHVVEALRDAVGDV

SEQ ID NO: 56186 - protein, 145 aa, Thermoplasma acidophilum DSM 1728
MRYCHMVLYASDIMRKYDKIMPGDTSAYEAAKIMAQDHVGFAIIAENGEIKGMVTEWDYINKIIAQDRDPKKVRIDEIMNSPIISIDPDTPTFKVTEIMAKNGIRRLPVMKNGKLLGVITSRDILRIFKDYMDSISDIISRFGNL

SEQ ID NO: 56187 - protein, 271 aa, Fulvimarina pelagi HTCC2506
MQGKRILVLGGGNMGCALMGGWLNGDVDPNGLLVVDPNRGEALAKLIEKHRFRHETSVPSDFQADVVLVAVKPQMMGKALPALMPALGKRTLAVSIAAGTTVETLCVHLGDRPIVRAMPNTPALIGRGVTGAFANDNVSEEQKEIADQLLSASGQVEWVETEELIDAVTGVSGSGPAYVFHLAECMARAGEAVGLPADLAMRLAMHTVAGAGELMIRSDEAPAKLRKNVTSPNGTTEAGLCVLMDEENGLPPLIEKTVKAARDRAIELSKD

SEQ ID NO: 56188 - protein, 321 aa, Flavobacteria bacterium BBFL7
MNLFDVTNAVNQSFKDYNDGKTRVDIKREDLLHELVSGNKLRKLKYNILEAQRQGHNTLLTYGGAFSNHIAATAAAGNICGFKTIGVIRGEELGHNLEKTLGGNKTLSTAHALGMQFKFVSRSNYREKYDDKFQKVLNAEYGHVYHIPEGGTNHLAVKGTEEILTVKDKDYYDYICVAAGTGGTAAGIINSTAPHQKVLVFSALKGDFMFDEIARYTHRENFMVFDENRFGGYARSSDGLIKFMNGRFRESVTSENPKGIPLEPIYTGKMMYRLEHLVKTGVISGETRILAIHTGGLQSVTGYNAMLEKKGKITLDYINEI

SEQ ID NO: 56189 - protein, 342 aa, Oryza sativa Japonica Group
MALSSFSMSLPFAKLPSTSKSTRFLPIRASSAAAAASPSFDLRLYWTSLIADVEAELDAAMPIRTPERIHSAMRYAVLPGAGNEGTAKRAPPVLCVAACELLGAPREAALPAAVALEMLHAASLVHDDLPCFDAAPTRRGRPSTHAAYGTDMAVLAGDALFPLAYTHVIAHTPSPDPVPHAVLLRVLGELARAVGSTGMAAGQFLDLAGATALGEAEVMKVLTKKFGEMAECSAACGAMLGGAGPDEEAALRRYGRTIGVLYQLVDDIRSASGNGKMRSNASVLRALGMDRALGIVEELKAQAKMEADRFGDKYGERVLPLYSFVDYAVERGFELQDAATTP

SEQ ID NO: 56190 - protein, 354 aa, Methanococcoides burtonii DSM 6242
MSLLKRTIPVQWYGRIDLKIITWYGILTIGDDGVSECEPFNKDVDELAELLLRKDVVAYSPGSGFDIRTVAIECGFVENDEEYNSLLRDVSIRAAKLQISRTNTPDMQIIQAVEALDDIDDVVNVLSERLSEWYGLHFPELGLSSEPLARFVSEFGSRNNVPAEHPMFEKATSSMGSELPSADEELIKGFASNACELYDSRHSIEASIVRNMEKMAPNVTLITGSLIGARFISMTGGLARLSQLPSSTVQVMGANRALFKHLRGRAPSPKHGIIFNNPLVKNSPWWQRGKIARALAAKISLAARMDVYSGELHPEIKVDLEKKVNSIKAANPKPPVKQKPAGKGYKGKNKGGER

SEQ ID NO: 56191 - protein, 405 aa, Salmonella enterica subsp. enterica serovar Typhi str. CT18
MATEQTAITRATFDEVILPVYAPADFIPVKGKGSRVWDQQGKEYIDFAGGIAVTALGHCHPALVEALKSQGETLWHTSNVFTNEPALCLGRKLIDATFAERVLFMNSGTEANETAFKLARHYACVRHSPFKTKIIAFQNAFHGRSLFTVSVGGQPKYSDGFGPKPADIIHVPFNDLHAVKAVMDDHTCAVVVEPIQGEGGVQAATPEFLKGLRDLCDKHQALLVFDEVQCGMGRTGDLFAYMHYGVTPDILTSAKALGGGFPVSAMLTTQEIASAFHVGSHGSTYGGNPLACAVAGAAFDIINTPEVLQGIHTKRQQFVQHLQAIDEQFDIFSDIRGMGLLIGAELKPKYKGRARDFLYAGAEAGVMVLNAGADVMRFAPSLVVEEADINEGMQRFAQAVGKVVA

SEQ ID NO: 56192 - protein, 275 aa, Vibrio vulnificus YJ016
MPTSQDLSALLPQVIDIARTAGQLILDIYQSKQYQEYTKSDETPVTSADLAAHKLITQRLSELTPDIPVLSEEAADISLEQRAQWNRYWLVDPLDGTQEFIARSGDFATIIALVENNKPVMGVVYGPVSGVTYYAYQGKGAWKIPEMNESLKIQTHKHELPGQNIAIAISRRQDINRITSRMSSSWNYDLVPLGSAALKACLVAEGAVDCYLRLGPTGEWDTAATQCIVEEAGGRILSTYLEPLSYNERDTLENPNFIVLGDADLPWNDILQVKG

SEQ ID NO: 56193 - protein, 430 aa, Silicibacter pomeroyi DSS-3
MKQRPSHNESPRIKGQELRICLIFNRFTTGHCQRRRHPIKIGHHPPAPRPRTAMTTAAIIVAAGRGTRAGGGVPKQWRPLAGRRVADWTLDRFALRQITHVVLVLHPEDHDAWDEFATTPLILAPGGSDRAGSVRNGLAALDGLGITKVLIHDVARPCVSAATIGAVLDALDAHPGAAPGLAVTDALWTGAEGLVTGTRERDGLFAAQTPQGFRYDAIVAAHAAHPGGAADDVEVARAAELTVAIVPGDPDNLKITRAEDFARAERILRQDMDVRLGNGYDVHRFGPGDHVILCGIKVPHDRGLQGHSDADVGMHAVTDALYGALVEGDIGRHFPPSDPQWKGAASEIFLRHAVDLVRARGFAVSNIDCTLVCEYPKIGPHALEMQAEMARIMGLEASRVSVKATTSERLGFTGRSEGIAALATACLVKP

SEQ ID NO: 56194 - protein, 142 aa, Staphylococcus aureus subsp. aureus Mu50
MLKKDKSELTDIEYIVTQENGTEPPFMNEYWNHFAKGIYVDKISGKPLFTSEEKFHSECGWPSFSKALDDDEIIELVDKSFGMVRTEVRSEESNSHLGHVFNDGPKESGGLRYCINSAAIQFIPYEKLEELGYGDLISHFDK

SEQ ID NO: 56195 - protein, 316 aa, Thermoplasma acidophilum DSM 1728
MKSESLRDVYGKELVKLGSFDRDIVVLDADLSSSTKTGYFANAFPDRFFNMGISEQSMVTTAAGLALSGKKPFVSTFAIFLTRTYEQIRQSVCYNNAPVRFVVTHGGITVGEDGATHQIVEDVGIMAGLPNMNVIVPADSVETRSVVDYLAGVDKPHYVRLSREKFPVINDEDYEFKIGKSKTIRDGADLTIIADGVMVSKSLEAAESLKKNGVDARVINMSSIKPTDRDAIIKAAKETGHIVTAEEHSIYNGLGSRVAEITSESYPVPVRRIGMRDTFGKSGKAWELFSYFHMDVKDIINEAMTCLEEKNYENIP

SEQ ID NO: 56196 - protein, 74 aa, Glycine max
MADYDRSVQHQSKETAFQALNSIIHRHFEKTLENERAIDRQKKELYKLVEIFFIFLGLVVLILAHSPRRQCRHC

SEQ ID NO: 56197 - protein, 334 aa, Porphyromonas gingivalis W83
MGGIGRIGILGSGSWATALAKIILTSQPSINWFMRREEQAQGIKRTGRNPNYLRDAVFDPRKISFFTDSDLNSFFRASDVVVLVTPSPFIKSYLKRVRSSSMRDKLIINAIKGIVPDENVLVSEYLHDFCDVPNELIGVVSGPCHAEEVARERRSYLTVGCFDINKAKAMANVLRNDYVSCTTSQDVVGIEYASVLKNVYAIAAGICNGLQYGDNFQSVLMSNAIAEMNSFVNTVHLLEREITDSVYLGDLLVTAYSNYSRNRTFGNMIGKGYSVKSAQMEMEMIAEGYYGAKCVREVNKRYQVNMPIMNTVYEVLYEKRDAAEAITALTAHFK

SEQ ID NO: 56198 - protein, 373 aa, Rubrobacter xylanophilus DSM 9941
MQTKDLYKVLGVDRGASQEEIRRAYRKLARRYHPDANPGDKEAEERFKEIQHAYEILSDPQKRREYDEGPRTFFEGARQGTGGFRPGGFSDLSDLFEGFGGLGDIFGRAGRRGDAGPRRGEDVTVSVNLRFKDALEGVTTRVSVPVEAVCEACRGTGAAPGTVPRRCPRCDGRGMRSRDQGLFAFSEPCSACGGRGTVIDSPCSACGGGGRVRMNRRVTVRVPPGARDGMKIRVPGRGSAGRDGGPPGDLYVVTRVEEHPVFKRRGDDFVVEVPVSFVEAALGAEIEVPRPEGGRLRLRLPAGTQEGRQFRVRGAGAPKARSRSGERGDLIVRAHVVVPQKLRRREREILEAFAEERGEDVREELFKRAGSWT

SEQ ID NO: 56199 - protein, 437 aa, Flavobacteria bacterium BBFL7
MAKTMDFILPKMGESITEGTILNWLVQEGEAFEEGDILVEVGTDKVDNEVPAPVAGVMSKHFFTDGDVVEIGSVIAQFEESDGSVKTVAAPKSANSIEIPKKDSIVNKQPKPVKTTSKTTSVSNSYVNQDLFVSPLIDSMARKHHMSYEELARIPATGHEGRLRKSDVVNYLNEGRPFQFAQAVSNEPDPTAYRIPQLKLDKGTGTIIEMDRMRSMIADHMVYSKHTSPHVTAYVEADLTDLVNWRNNNKAPFQEKYGERLTFTPLFVDAVARAIKEYPNINASVDGKNIIVKENINVGMATALPSGNLIVPVVKYADQKSLQDIAADVNRMANLARENKLGGDDIKGGTFTISNVGTFGSLMGTPIINQPEVAILATGIIKKRAEVMTKDGVDSIEIRSMMMLSLSFDHRVVDGFLGGSFLKQVADNLSQAPTKNY

SEQ ID NO: 56200 - protein, 202 aa, Flavobacteria bacterium BBFL7
MYIMAIYIFKSHIPVIHESSFVHPQATVIGNVIIGKNCYVGPSAVIRGDWGEIILEDGVNVQENCTIHMFPGKSITLKESAHVGHGAIIHGANLGRNCMIGMNSVIMDDATIGDECIVGAMAFVKAEAVFEPRSLIVGNPAKKIKEVSDQMIEWKTAGTKLYQQLPADCHETLEEVAPLREIPENRPVQEDFYKTLQEIKGE

SEQ ID NO: 56201 - protein, 289 aa, Salmonella enterica subsp. enterica serovar Typhi str. CT18
MSAKHPVIAVTGSSGAGTTTTSLAFRKIFAQLNLHAAEVEGDSFHRYTRPEMDMAIRKARDAGRHISYFGPEANDFSLLEHTFIEYGQTGKGQSRKYLHTYDEAVPWNQVPGTFTPWQPLPEPTDVLFYEGLHGGVVTPQHDVARHVDLLVGVVPIVNLEWIQKLIRDTSERGHSREAVMDSVVRSMDDYINYITPQFSRTHINFQRVPTVDTSNPFAAKGIPSLDESFVVIHFRNLEGIDFPWLLAMLQGSFISHINTLVVPGGKMGLAMELIMLPLVQRLMEGKKIE

SEQ ID NO: 56202 - protein, 126 aa, Zea mays
FFFRQGNLSQRKCFYVVIGRVIFTLLGIFRAGVVTYTVIPEGLPFRKELLTPGRGAPLIDFYINVFGISVGVAPKESSGISTPLWIVLLICFGSIPPGGSIVFQLFKVSYQDPISPGFLNSPPKKI

SEQ ID NO: 56203 - protein, 635 aa, Salmonella enterica subsp. enterica serovar Typhi str. CT18
MIVFSSLQIRRGVRVLLDNASATINPGQKVGLVGKNGCGKSTLLALLKNEISADAGSFTLPGTWQLAWVNQETPALPQPAIEYVIDGDREYRHLEAQLNDANERNDGHAIASIHGKLDAIDAWTVRSRAASLLHGLGFSNDQLERPVSDFSGGWRMRLNLAQALICRSDLLLLDEPTNHLDLDAVIWLEKWLKSYPGTLILISHDRDFLDPIVDKIIHIEQQTLFEYTGNYSAFEVQRATRLAQQQAMYESQQERVAHLQSYIDRFRAKATKAKQAQSRIKMLERMELIAPAHVDNPFHFSFRAPESLPNPLLKMEKVSAGYGDRIILESIKLNLVPGSRIGLLGRNGAGKSTLIKLLAGELEPLHGEIGLAKGIKLGYFAQHQLEFLRADESPLQHMARLAPQELEQKLRDYLGGFGFQGDKVTEETQRFSGGEKARLVLALIVWQRPNLLLLDEPTNHLDLDMRQALTEALIDFEGALVVVSHDRHLIRSTTDDLYLVHDKKVEPFDGDLEDYQQWLSDVQKQENQADDAPKENNANSAQSRKDQKRREAELRTLTQPLRKEITRLEKEMEKLNAQLAQAEEKLGDSSLYDPSRKAEMTECLQLQASAKSGLEECEMAWLEAQEQLEQMMQND

SEQ ID NO: 56204 - protein, 601 aa, Salmonella enterica subsp. enterica serovar Typhi str. CT18
MEGADLLTAGVLFLFAAVAAVPLAARLGIGAVLGYLLAGIAIGPWGLGFISDVDEILHFSELGVVFLMFIIGLELNPSRLWQLRRSIFGVGAAQVLLSAAVLAGLLMLADFLWQAAVVGGIGLAMSSTAMALQLMREKGMNRSESGQLGFSVLLFQDLAVIPALALVPLLAGSADEHFDWFKVAMKVLAFAVMLIGGRYLLRPVFRFIAASGVREVFTAATLLLVLSAALFMDALGLSMALGTFIAGVLLAESEYRHELENAIDPFKGLLLGLFFISVGMSLNLGVLYTHLLWVAASVVILVVIKMLTLYLLARLYGIRSSERMQFASVLSQGGEFAFVLFSTASSQRLFQGDQMALLLVTVTLSMMTTPLLMKGIDKWLSRRLNGPEENDEKPWVEDDKPQVVVVGFGRFGQVIARLLMANKMRITVLERDIGAVNLMRKYGYKVYYGDATQVELLRSAGAEAAESIVITCNEPEDTMKLVALCQQHFPHLHILARARGRVEAHELLQAGVTQFSRETFSSALELGRKTLVSLGMHPHQAQRAQLHFRRLDMRMLRELIPEHSDMVQISRAREARRELEEIFQREMQQERRQLDGWDEFE

SEQ ID NO: 56205 - protein, 386 aa, Bordetella petrii
MKIHEYQGKELLKQFGVPVPRGIPAFSVDEAVAAAEKLGGPVWVVKAQIHAGGRGKGGGVKLARSLDDVRKLASEILGMQLVTHQTGPEGQKVNRLYIEDGADIQKEYYVSLVTDRATQKVAIIASSEGGMDIEEVAHSTPEKIITEYIDPLTGLQAEQAKKVAESIGLSGGSADQAADVFQKLYTCYMDTDASLVEINPLNCDSKGNIIALDAKFNFDSNALFRHPEIVAYRDLDEEDPAEIEASKFDLAYIQLDGNIGCLVNGAGLAMATMDTIKLFGGEPANFLDVGGGATAEKVTEAFKIMLKNKGVKAILVNIFGGIMRCDVIAEGVITACKAVNLNVPLVVRMKGTNEELGKKMLADSGLPIISADTMAEAATRVVAAVK

SEQ ID NO: 56206 - protein, 444 aa, Bacillus cereus ATCC 14579
MHILVVSVNYRTAPVEFREKLTFQAAEIERAMTTLQNQKSVLENVIVSTCNRTEIYAVVDQLHTGRYYIKKFLADWFQLEIEEVAPYLTIFEQDGAIDHLFRVTCGLDSMVVGETQILGQIKDSFLEAQQVKATGTIFNELFKQVITLAKRAHSETTIGESAMSVSYAAVELGKKIFGELTDCHVLILGAGKMGELALQNLYGSGARKVTVMNRTLSKAEVMAEKYMGHAKSLSELQCALLEADILISSTGASEYVITKEMMTKVEKMRSGRPLFMVDIAVPRDIDPAIDELEGSFLYDIDDLQGVVEANRAERLKEAEKIQFMIEEEIVLFKTWLSTLGVVPLISALRDKALAIQSETMVSLERKIPNLSDREKKVISKHTKSIINQLLKDPILVAKEIAAEEGASEKLALFAKIFDLETEEVESRAEEVEHKRVWTPSVPSL

SEQ ID NO: 56207 - protein, 267 aa, Brassica napus
  misc_feature (225)..(225): Xaa can be any naturally occurring amino acid
MNNQDKIMIEKETTDKIEIKSKNGLNEQELEVKMDNMSDLNKTTNGLGEKWPEPIIRVQSLAESNLATVPDRFIKPPSQRPNETITINNQPEAAAINIPVVDLRSILSGNQEETERISEACREFGFFQVINHGVRPELMAAAREAWRSFFHLPVEAKEAYSNSPSTYEGYGSRLGVEKGALLDWNDYYFLNFLPLALKDLNKWPSLPSNIREVVRVRGRTSKLGXGLMRILSSNWGVNEEKLQEAFGGEDFSACMRVNYYPKCPRPE

SEQ ID NO: 56208 - protein, 345 aa, Arabidopsis thaliana
MMFAYLPPDLESEILSRVPATFLKELQTTCKRWYALFRDPIFVKKNLGKAATHVIFNNLGDYSVTEMNTLVHSINLRGIQNSFDPSIGVERKLYELNDPEHDKILGIISHCDGLLLCATKDKTRLVVWNPCTGQTRWIQIKNVFKNNPQLILLVIKFKIYEFNSDSWRILDDISPVCFIRSNGVNLKGNAYFVASDKESKFILKFDFTTERFLRLSFPSQNDDQIAVLSVVRQEKLALLQQRFDTSSIKMNIWVTKTKIDADKDLSWSNFLVVDFGKVTLTSEPLSFLVDEENKMVVCSSKIRHIERKTIIYFAKEGIQVHQEIAQKPKGCCSFLVSYVPSLVQF

SEQ ID NO: 56209 - protein, 420 aa, Pseudomonas aeruginosa PAO1
MWGLTMKFASLILMLLFATVARAEDYYWKIQSLPERFSSPSAACAAWAKATGRPGEFTFTGSMKARDQTSFWCEFTNNETGKTAAGYGPAGRYGDSCPEGTEYDKATGVCKSPPQECKEGELFPAKGPDSPVVTSGGRNYVGDGGAPTACYQSCEYGGNPSPASCYLVKGSTTTGFCNYILKGTGQNCGADSYTFSQTGDSLNPPDTPNTDPSDPNDPGCPPGWSWSGTTCVKAPTDPTDPTDPTTPGSDGGGDGNGGGNNNGGGNDGGTGNGGDGSGGGDGNGGGDGSGDGDGSGTGGDGNGTCDPAKENCSTGPEGPGGELKEPTPGTWDDAIATWEKKVEDAKQELKTKVKANVDQMKGAFDLNLAEGGGQLPCESMTIWGKSYSLCISDYAGQLSSLRVALLLMAALIAALILLKD

SEQ ID NO: 56210 - protein, 198 aa, Bacillus cereus ATCC 14579
MKVTKADIVISAVKPEQYPDSDLPEIALAGRSNVGKSSFINKILNRKKLVRISSKPGKTQTLNFFLINEMMHFVDVPGYGYAKVSKSERAAWGKMIETYFTTREQLDAAVLVVDLRHQPTSDDVMMYDFLKHYEIPTIIIATKADKIPKGKWQKHLKVVKETLAVEIGDEIVLFSSETGLGKEEAWKAIHKFTKTKNA
